United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 19

SEQ ID NO: 92295 - protein, 599 aa, Glycine max
  Coding DNA Sequence Number=SeqID_610
  Gene Ontology: Mol. function=oxidoreductase activity; Cellular component=cytosol; Biological process=electron transport
  Homolog annotation: Hit_ID=A8GJW3; Match level="QueryCoverage=99%, HitCoverage=88%, E-value=0.0, Identity=85%"; Hit description =NADH:flavin oxidoreductase/NADH oxidase
  Pfam annotation: Domain name=DAO; Domain location=381-568; Score= -55.5; E_value=0.047; Accession=PF01266.15; Description=FAD dependent oxidoreductase
  Pfam annotation: Domain name=Oxidored_FMN; Domain location=10-336; Score=420.4; E_value=2.5e-123; Accession=PF00724.11; Description =NADH:flavin oxidoreductase  NADH oxi
  Pfam annotation: Domain name=Pyr_redox; Domain location=381-470; Score=15.4; E_value=0.00019; Accession=PF00070.18; Description =Pyridine nucleotide-disulphide oxidor
  Pfam annotation: Domain name=Pyr_redox_2; Domain location=381-555; Score=9.7; E_value=5.3e-06; Accession=PF07992.5; Description =Pyridine nucleotide-disulphide oxidore
  Pfam module annotation: Pfam domain module=DAO::Oxidored_FMN::Pyr _redox::Pyr_redox_2; Domain location=381-568::10-336::381-470::381-555
MESAMSNYPHLLAPLDLGFTTLKNRVLMGSMHTGLEELPDGPQRLAAFYAERAAAGVALIVTGGIAPNEQGVVFRGGSILNSEEQLPHHRPVTEAVHRAGGKIALQILHAGRYSYQPHPVGPSALQAPINPFAPSALSEAEIEQTIADFARCAALAQQACYDGVEVMGSEGYLINQFLAARTNQRDDRWGGSFTNRMRFAVETVRAVRQAVGAEFILIYRLSMLDLVEDGSSWQEIEQLALAVEQAGATIINTGIGWHEARIPTIATMVPRAGFSWVTRKLMGKVGIPLITTNRINDPAVAEQVLADGCADMVSMARPFLADAAFVQKAAEGRADEINTCIGCNQACLDQIFEGKLTSCLVNPRACRETEMPLTMAEKPKKLAVIGAGPAGLAFATTAASRGHQVTLFDAAEQIGGQFNIAKQIPGKEEFHETLRYFRRQLALREVTVRLGVKVEAADLSEFDEVILACGIVPRTPDIPGIGHAKVLSYLDVLRDKKPVGQRVAIVGAGGIGFDTAEYLSQHGVSSSLDQAEFNREWGIDGRLEQRGGLVAQGPQAPRAARQIYLLQRKTSKVGEGLGKPPVGSIAPAWRCAGVKMLNS

SEQ ID NO: 92296 - protein, 61 aa, Glycine max
  Coding DNA Sequence Number=SeqID_611
MAGAGSLNIRTCKNYWELVTTNFELKFLLNFLDIWKRIRKREPSDLDIRKKELKRRIGAID

SEQ ID NO: 92297 - protein, 138 aa, Glycine max
  Coding DNA Sequence Number=SeqID_612
MQRMKSHAYQDNYTGRSQIFLGNCNILLPRQCTEWERTGRKEILHSKLLMQNIRGEVVVSSVWKVTMMFSEIKHSNLHNRSLSTLVQNTDLPGQKEEEARAWSDDGRVLWIRGEGKDEKLNRIRLIHDMLRSIVQALS

SEQ ID NO: 92298 - protein, 99 aa, Glycine max
  Coding DNA Sequence Number=SeqID_613
MQQVHLSIHKKLNLANNLYYRKLIIFKNQLVPRQPNAVDCNCYSQTIPPNQSQKNDDLEPVHRWIVVKFEYHVRNKIPSILTVGNFDIMSELRETPFAL

SEQ ID NO: 92299 - protein, 149 aa, Glycine max
  Coding DNA Sequence Number=SeqID_614
  Gene Ontology: Mol. function=RNA-directed DNA polymerase activity; Biological process=RNA-dependent DNA replication
  Homolog annotation: Hit_ID=Q9C6L3; Match level="QueryCoverage=56%, HitCoverage=6%, E-value=1e-09, Identity=39%"; Hit description =Putative uncharacterized protein F2J7.11
MFVKLQHFCRVSGLSISSDKFSIYSADIRPHELSHIQQLTGFSLGDFPFRYLGVPLLSSRLNVCHYAPLLSNITGLIQGWNMKSLSYADFIISKELSTEEAKKRIQSWSTNEQLLVGKVYEYIRGAKPTLSWCSIIWIPIIPPKMSFIL

SEQ ID NO: 92300 - protein, 102 aa, Glycine max
  Coding DNA Sequence Number=SeqID_615
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=50%, HitCoverage=50%, E-value=4e-24, Identity=100%"; Hit description=LacZ protein
MNDKVIDETTYGHTMQIFLERPPPRWSSNSPYSESYYNSLAVVLQRRDWENPGVTQLNRLAAHPPFASWRNSEEARTDRPSQQLRSLNGEWDAPCSGALSAA

SEQ ID NO: 92301 - protein, 54 aa, Glycine max
  Coding DNA Sequence Number=SeqID_616
MSLANGIYIFSDIEMFDLDNGRWISALFMLDKVFGIAAAEFYSLFYITCGNGIN

SEQ ID NO: 92302 - protein, 32 aa, Glycine max
  Coding DNA Sequence Number=SeqID_617
MAKEFVNGFVHFRLFFSSVPVVIGFVVVHVGQ

SEQ ID NO: 92303 - protein, 480 aa, Glycine max
  Coding DNA Sequence Number=SeqID_618
  Pfam annotation: Domain name=GRP; Domain location=60-144; Score= -29.6; E_value=0.085; Accession=PF07172.2; Description=Glycine rich protein family
MVATKRRVSGAMCPAREFKLNWAGYRSWVAGESGTESGTESGSRPKGVIRDGSGGSSSSASKRKTLDAHLCPRWYFSSQLKQRSRSRREAISSEVSRLKDGGGGLGEGMAVEIGRGAMEGEGGGRLRRGGPDGEREGGGRDGRGKGTGGHNLSEGEGLVSTDFPTNLRGKARDKAAEEEGCRNTDDSVGHIFKLCEGPDGILILRRCKPCLQCLQKHWPRGELTVTGHPLKPGQELINLENPTHGIRAVKTRHLKLEAVVCCEVGGKTRNGGEKGVGLWWYRGDMVDEAIDFMSEGEMLFGELNEEILNSFSIGGTHRIEHGDNESTMLTSAKQEDNEGLHAEFPISPSDEVPEDNENEKDLMYEELKELTLGHESPYLSMSCDVNDTPDENICTMENDFLNVTANSEKKEESSSPPVEHHNTIDQSKGNLAVISLANGIDIFSDIEMFDLDNGRWISALSMLGKGMIERHNYGYNMFCL

SEQ ID NO: 92304 - protein, 80 aa, Glycine max
  Coding DNA Sequence Number=SeqID_619
MRLPLKENERSPHQRLSKENVGKIKMEKVEGLRILKMRVRESFMHGEAKWRRRRVERRRHFKKKMSLEEAHHHRKPRIRA

SEQ ID NO: 92305 - protein, 227 aa, Glycine max
  Coding DNA Sequence Number=SeqID_620
  Homolog annotation: Hit_ID=Q6WAY6; Match level="QueryCoverage=39%, HitCoverage=19%, E-value=5e-12, Identity=37%"; Hit description =Putative uncharacterized protein
MVSLAPFRQEVRHACPLESHRSCTEKGRENWDQLLAIKEGASVNCFPRWMEGRTKVLISCRGFPNVPLMGTRGSISYNPVLAIRQLGYPMRGAPLEEEIVPKVRKAWEVLQKKDKELRGSNNGPIGGYREWLKAHVQGSDWLPSLRATKREEDEAPEEDEGVQALRTELKQAQTVKERFKSAALKIRKENAELRDVNIATTKALEQETKRARREEHGPEQVPRGSVE

SEQ ID NO: 92306 - protein, 177 aa, Glycine max
  Coding DNA Sequence Number=SeqID_621
MASFSQMQSQFQSQMQSQGLALPSELLVGPSGNDPKTGDSDRCSLYIEANPARLVILGRVYEGSTVVHNTPLLPGQVKVGVEEVKDPDAPVPVPIDEAVVSPTKPPQMPNPEVDDPLYLMTLTILEIFLRLYQITWDATVFGVFNPYFPLYIKHEDLSEIAHGGQCLSISVLQLWIL

SEQ ID NO: 92307 - protein, 68 aa, Glycine max
  Coding DNA Sequence Number=SeqID_622
MEEIHREDDEEQGIKLHVELVGHGSSSSMESFTSSRSMAMEWRRRKGDCRCHFKENMSQEQAHHYWKP

SEQ ID NO: 92308 - protein, 124 aa, Glycine max
  Coding DNA Sequence Number=SeqID_623
  Homolog annotation: Hit_ID=UPI0000ECBAF8; Match level="QueryCoverage =47%, HitCoverage=69%, E-value=5e-20, Identity=81%"; Hit description =UPI0000ECBAF8 related cluster
MKHFTDTSSVPTYGRHRGGAPIRPIVSRITIHWPSFYNVVTGKTLALPNLIALQHIPLSPAGVIAKRPAPIALPNKLRSLNGEWDAPCSGALSAAGVVVTRTVTATLASADVRRCFCRYAPPRQ

SEQ ID NO: 92309 - protein, 142 aa, Glycine max
  Coding DNA Sequence Number=SeqID_624
SASRLGVPVTPSKVIRPPITRAFIEKYCTQRQVQGDAPQAADAPPPHQAGPAGSFDTEQYLRHLVRQQAANHRAHSQGFTSFSCPTPDQFRAEVAWPGDWLEAQAGEAPAGAPAEAPDEADEAREDEEMTDLLDFLGGSGAT

SEQ ID NO: 92310 - protein, 86 aa, Glycine max
  Coding DNA Sequence Number=SeqID_625
MASANSLFPEGNSINRPPIFNGEGYHYWKTRRSIDFDTGLCCQPCRRSIDFDTLLSCTREEASKYQQLILGLYAREVLSNGKSSNE

SEQ ID NO: 92311 - protein, 112 aa, Glycine max
  Coding DNA Sequence Number=SeqID_626
  Homolog annotation: Hit_ID=A5BEV8; Match level="QueryCoverage=89%, HitCoverage=12%, E-value=1e-17, Identity=43%"; Hit description =Putative uncharacterized protein
MDITDMGDVIASRYNVIVVYLSKQQSTAFFPLRSQPLANSSLHRIICIGHVYDNHFVEVYLKECCPLSPVALSWSNNCHPQAKPWPNSYISRMQHYKSFVMFKRDYVDINDD

SEQ ID NO: 92312 - protein, 214 aa, Glycine max
  Coding DNA Sequence Number=SeqID_627
  Homolog annotation: Hit_ID=Q2HW90; Match level="QueryCoverage=71%, HitCoverage=30%, E-value=4e-12, Identity=28%"; Hit description =Putative uncharacterized protein
MVEEFEEILGCPLRGRKPYLFSGFYPSLARISKKVQISAQELDRQRQVENGVVGIPRKYLEVKARILADKGEWTPFIDILTLLIFEGVLFPNVDGLVDLAAIDVFLAYHNHKESPVVAMLADLYDTFDRRCEESNARIVCCTPALYVGLVSHLFLQEGRPVYPLQGYRSCIEKGKANWDQLLASMGGRLLIGSLARRKEESRFYLHAKDVQMFP

SEQ ID NO: 92313 - protein, 111 aa, Glycine max
  Coding DNA Sequence Number=SeqID_628
MTKLGLCVPSDTTVSEWQRGADNRKVSPRIIMTKLGLCVPSDTTVSEWQRGADNRKVSPRIIMTKLGLCVPSDTTVSEWAKGVRITVRYLRVSWVQNDQTWSLLVIGHDCV

SEQ ID NO: 92314 - protein, 108 aa, Glycine max
  Coding DNA Sequence Number=SeqID_629
MATQLIHDRVEMECLEGVWETLEGNARCRFWGTIRFTVTSLVHPEEPACTLQHTVEWILPTPTPYRLVEPVQVIEVTSSEEDPEEDPDELPPEPTVDALDFPEGDEGP

SEQ ID NO: 92315 - protein, 141 aa, Glycine max
  Coding DNA Sequence Number=SeqID_630
  Homolog annotation: Hit_ID=Q8TGM5; Match level="QueryCoverage=27%, HitCoverage=58%, E-value=8e-08, Identity=74%"; Hit description =Uncharacterized protein ART3
RRALGLMASGATCVQRLDGSRDSAIHTKYRISLRSSSMQEPRYPLPRVIVCKCCVVTTPAGHRSGPPGVALNRFEFLGARSAGVCVCREDEEAGRTGRRGHPLPPDGRELFPDRLALTKEFLVKQQLSFPLTIDMLKLKDT

SEQ ID NO: 92316 - protein, 225 aa, Glycine max
  Coding DNA Sequence Number=SeqID_631
  Homolog annotation: Hit_ID=Q6L477; Match level="QueryCoverage=48%, HitCoverage=21%, E-value=1e-07, Identity=28%"; Hit description =Putative uncharacterized protein OSJNBa0009L15.8
  Subcellular localization annotation: CTP_CleavageSite=63; ConfidenceScore=5.59e-01
MDEVPKDAHVHIVGSPPASTPTPPPPPTSDALASTSAVKRTRKASRLRSLSTRPPGVERPVVHADPVTGKAEGPHRKKLRTYLGIVARDKVDITYENWKEVPTAQKDLIWEDIRTVGERWRQFKSDLTKKWALAADQDGVEDTVCDKYDISKEKWAQFCQTRRDPSWEAEAIQKQNTAPHVLSRGGYDCLKQKLLAEKTKKKLQEAAQSGSVDGVIDPPSPVRCH

SEQ ID NO: 92317 - protein, 153 aa, Glycine max
  Coding DNA Sequence Number=SeqID_632
  Homolog annotation: Hit_ID=Q2HW90; Match level="QueryCoverage=59%, HitCoverage=18%, E-value=1e-11, Identity=38%"; Hit description =Putative uncharacterized protein
MGTNQNGKMFYQVKVKSLDVTSLKELGRLMGPLQRQAFRKVYGKILDLAATEVFTEVVVSLAQYYDQPLRCFTFGDFQMVPTIEEFEEILGCPLGGRKPYLFSGFLPSLSKIAVVIGDSAKELGSHETNSQWNSGPATEILGKARQGILRAKR

SEQ ID NO: 92318 - protein, 104 aa, Glycine max
  Coding DNA Sequence Number=SeqID_633
  Gene Ontology: Mol. function=structural constituent of ribosome; Cellular component=ribonucleoprotein complex; Biological process =translation
  Homolog annotation: Hit_ID=A9P8K6; Match level="QueryCoverage=36%, HitCoverage=23%, E-value=3e-09, Identity=73%"; Hit description =Putative uncharacterized protein
  Subcellular localization annotation: CTP_CleavageSite=54; ConfidenceScore=5.13e-01
MVGIDFGSPLWIALRLPGHSSFFSFCLSSSLSQTGLCFHDFNHIVEFIFVEFVSATYRLSLKKTRKGKSPGKGGNQFWESIVVGFKTPREAIEGDFFIFFSRCQ

SEQ ID NO: 92319 - protein, 72 aa, Glycine max
  Coding DNA Sequence Number=SeqID_634
MCLPHGLRDMCMMRLSALNEYGSGVIDILFGNVCHIGWCTVGRQAIWQEGVLVLNLHIMGAVPTSQIFAYHI

SEQ ID NO: 92320 - protein, 117 aa, Glycine max
  Coding DNA Sequence Number=SeqID_635
MTHYNPYPRKQKRKEGKFPIKEKAKRKERKFPIKEWEKAKRKERKFPIKEWEKAKRKERKFPTKEWEKKRNANIQDLIYGLWGDPISRLSFPWVGALFVTQKSICCSKQFGNICLFG

SEQ ID NO: 92321 - protein, 168 aa, Glycine max
  Coding DNA Sequence Number=SeqID_636
MCPVVGFGPWLGLGKPLVEILPPGQLRGFCPLLAWLGSAVLGYGPVLSFGLVGPLLPPVISFVARILPTLACAPLAKSVPRWGGTNQSDKGLNLSGSWAARPLCHLQYPVAYLSRLQRILPAARWELRFKASRRANPPHEGHQRHVPFGGPRPPTAGRQTDGGRTRRF

SEQ ID NO: 92322 - protein, 64 aa, Glycine max
  Coding DNA Sequence Number=SeqID_637
MVFHLRLVMSFKTKKGEHRLKGAIKGINSRKHQQESSQGYCASNQWLKTHQKIMMIDGSNCGIL

SEQ ID NO: 92323 - protein, 73 aa, Glycine max
  Coding DNA Sequence Number=SeqID_638
  Subcellular localization annotation: CTP_CleavageSite=24; ConfidenceScore=5.28e-01
MSPPPQEPHNHSQTHLKFSGRLPLQAQFSTGLHTAKSVKLFGTWTFLSLENPEHAEASRKGPNSTPKSDFRLK

SEQ ID NO: 92324 - protein, 85 aa, Glycine max
  Coding DNA Sequence Number=SeqID_639
MGAKHLTRTKQKLHATKQRSPDEIRAFRLTDSKKNVYTDNHSGISVRQRDSNVSMTDHVSAEDDVNLRVSTGLSAAIDEGYRRRR

SEQ ID NO: 92325 - protein, 113 aa, Glycine max
  Coding DNA Sequence Number=SeqID_640
MSSDHNQLAQSSPQVRHNQLAQSSPQVRLNSLEVPYDPISDNTNVDETDHEIVSLDPTLDNTNLGETDHEIDPCLCETTSTPNTESTIVQYNLPPRSNRGQPPAKYELDLQAK

SEQ ID NO: 92326 - protein, 81 aa, Glycine max
  Coding DNA Sequence Number=SeqID_641
  Subcellular localization annotation: CTP_CleavageSite=75; ConfidenceScore=5.46e-01
SLLNQSQTYQGNPCGVYPDLSSFTGSGVYPDLSSFTRSGVYPDLSSFFGSGVIQKSLLPVSSDPLLLRFTSSGIRASSLDT

SEQ ID NO: 92327 - protein, 192 aa, Glycine max
  Coding DNA Sequence Number=SeqID_642
  Homolog annotation: Hit_ID=Q6UUU1; Match level="QueryCoverage=31%, HitCoverage=40%, E-value=2e-18, Identity=78%"; Hit description =Putative uncharacterized protein
MVKVGTSYVPINVSFSPKVGPGLPGINRDTRIYLFCEVIFRHSCPSCSATDDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 92328 - protein, 39 aa, Glycine max
  Coding DNA Sequence Number=SeqID_643
MVSEISKEDGTPLSLGSSLACCCSMVVLRVLDWKLRSVD

SEQ ID NO: 92329 - protein, 71 aa, Glycine max
  Coding DNA Sequence Number=SeqID_644
MEAKSFEKILKYSNHLEHLVVFGAIPGAGTALDELDVLDSGIVGVGSDDDVGAGKDRGVVDLVGFNARRDE

SEQ ID NO: 92330 - protein, 72 aa, Glycine max
  Coding DNA Sequence Number=SeqID_645
MPLGGRIASPGEPEASLDCVATGVKQLNSAGKNSNRAEDIDSPRKTTDFDSLEKVKKTVVVLKQKTRIVLEM

SEQ ID NO: 92331 - protein, 105 aa, Glycine max
  Coding DNA Sequence Number=SeqID_646
MDPSLPGPSEDFSQKEPARLGEPITLAVSLSSPGRAAMVPDATFSINRREGELRKGFQHRALREIERKKGEEDKRRENEAEALPNRDCDQPLHHSLFGVLYATII

SEQ ID NO: 92332 - protein, 228 aa, Glycine max
  Coding DNA Sequence Number=SeqID_647
MVEENEFITDYFESGFKDSIETIYQIVSTIPADITKEYQARHLRRDYTRNECFEDPSLSPKAVWVTQVSCFTLLHNVAIFYPLKDEMKSHMKPLNLTTKLEDWIISKTMVDGVASINILPKSMLRRFDGKLEVSKADQTSYAIYASFVDETDQILAVTAPFDIEDSYYMNKKTGEDANKFFCCNPKKGFILINKIVEKNVHHRRSMSTSTTNLSFVRFRQVHQIAQVV

SEQ ID NO: 92333 - protein, 67 aa, Glycine max
  Coding DNA Sequence Number=SeqID_648
MELAGVAVVHSDMRGDGERLHYVKEKQVSLGNAECEDEGERVQKKPRTMQMQVGRGWWGRHKRFLMK

SEQ ID NO: 92334 - protein, 113 aa, Glycine max
  Coding DNA Sequence Number=SeqID_649
MMRIMKQAKYSLKAQVEKDEGPSGEGQSPRTYQGNPCGVYPDLSSFTGSGVYPDLSSFTGSGVYPDLSSFTGSGVYPDLSSFTGSGVIQISVTCIKRSVPSQVHIIWYQSFGS

SEQ ID NO: 92335 - protein, 95 aa, Glycine max
  Coding DNA Sequence Number=SeqID_650
MGVEVLISRVFHSSKRGIESSTLFKKRFYHVKIKSLEVANFQKLGQQMDQFQRQAFHKTYGKIWDLAMIEVSVEAIASLAQYYDQPLRCFTFGDF

SEQ ID NO: 92336 - protein, 243 aa, Glycine max
  Coding DNA Sequence Number=SeqID_651
  Homolog annotation: Hit_ID=Q2HW90; Match level="QueryCoverage=44%, HitCoverage=26%, E-value=9e-09, Identity=34%"; Hit description =Putative uncharacterized protein
MDLAAIDAFVAYHHNKESPVITVSADAYDTFDWRCEKNIARIVYCTPALYVWLRHQLIGSPNGRRRAEVLCSCEGFPNIPLMGMRGCINYNPILAIRQLDYPMRGAPSEESITFFIARGFSDPNDKELRGSNNGVIGIYHKWLRAWTQRITWLLKLKISSEGEAEVPEENEEVKALKVELERTNNELKLQRAVSDESRVESMMLQDKLKACQRSKRSLTEQLSRTEENMWAIIDQYKEKLNLA

SEQ ID NO: 92337 - protein, 157 aa, Glycine max
  Coding DNA Sequence Number=SeqID_652
MTFLLSNILPNDCNADLPMWKYQLVCAVSTQGSCPQDIQWTRRSPTGPWGFQLWLRASISPTGCPYPPARSCHRDIGIAPAGHPVDSKKSNRVLGFPALITGLCQFYGVPVTPNKVIRPPINRAFLKRYCAPRQAQGETPQQPGDGWQRQQTHRHHL

SEQ ID NO: 92338 - protein, 286 aa, Glycine max
  Coding DNA Sequence Number=SeqID_653
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSYHQRQPVASTFSLMISDGMSNSVRKGTVGDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 92339 - protein, 170 aa, Glycine max
  Coding DNA Sequence Number=SeqID_654
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=76%, HitCoverage=96%, E-value=9e-25, Identity=52%"; Hit description =Putative uncharacterized protein
MTMITPSSKLTLTKGNKSCAFPNRVAHAITDHETERARYWLPLVVRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 92340 - protein, 212 aa, Glycine max
  Coding DNA Sequence Number=SeqID_655
MASRKRKSIDAWTRYTDNVLGKNILPERKVELYHTELDGFKAELERHNFHKRLTNLADGSIDLALVKEFYANLYSSEDRPPKQSRVRGHLVKIDANSLNAFLETPVVLAEGETLPAYSRYYRLPTDFREIEAALCIPGRGFILNSKGHPGKILRKDLTRLAQVWSVLSYSNLALTSQTSNLTMDRARLIFGLVSHLEMNIGALISGQMTSIA

SEQ ID NO: 92341 - protein, 83 aa, Glycine max
  Coding DNA Sequence Number=SeqID_656
MLGFTSDSHQILASPHQLDFAPYALGPYNAQWNAPGLLHDKHTLHSSRILGEMEVDEPWLGLWLPLNYQVDMGASQHRTPELG

SEQ ID NO: 92342 - protein, 143 aa, Glycine max
  Coding DNA Sequence Number=SeqID_657
MEAQLIHDCVVMECLEGVWETLEGNERCRFRGTIRLTATSLVHPEEPARTLQQPVEWILPTPTLYRLVEPVQVIEVSSSKKDLEEDPEELPPEPAMDALDLPEDDEDPLPDVDSPEDIMSAFEADSIEESGPGGTSNSDDSSS

SEQ ID NO: 92343 - protein, 121 aa, Glycine max
  Coding DNA Sequence Number=SeqID_658
MYSHRRKHSRNSLYGKSIATRVYSRFLGFQQGPYNQQGQWRRHPRNQFNKDQSGPSNMPIQQGPNIFQRTTKLEETLTQFMQNPKEECKTVMTRSKRFVEVENEDSVVHEKKNADKKKRNK

SEQ ID NO: 92344 - protein, 73 aa, Glycine max
  Coding DNA Sequence Number=SeqID_659
MGGRRKAHRCVFQERKNARSRHQRLFEENVRKTKTCGLRTLIVKGSGVVFMHGKGCFPHSYVFLNYNEEIRPT

SEQ ID NO: 92345 - protein, 176 aa, Glycine max
  Coding DNA Sequence Number=SeqID_660
MAPTRHSLDPDKSNRALGFPSLITRLCQSFGVPVAPTKVIRPPITRAFIEKYCTQRQAQGDAPQAAGAPPPPHQAGSFDMEQYLRHLVRQQAANHRAHVQTDDCLYQMSLSMQSQGFASFSCPTPDQFRTKVAWPGDWPEAQAGEAPPEAPGDGEEAHEDEEMADLLDFLGGSGAT

SEQ ID NO: 92346 - protein, 172 aa, Glycine max
  Coding DNA Sequence Number=SeqID_661
  Homolog annotation: Hit_ID=A5BSR3; Match level="QueryCoverage=68%, HitCoverage=36%, E-value=1e-10, Identity=36%"; Hit description =Putative uncharacterized protein
MEEKSKRGHEEHSCTESPTLNVDPPSLVARHLKWKIARTKRHGQMTSEVAQEIADKIDSLQEQATQGSFVLHGRQDILNTALDRPEHPGRVRVAGTGVTISQYFGQASRASSTSSPSINQQQLADIIGVIKDDIRKQLQDEIRKEVQDEIRKEVQQEQKQQQEAWMRAVEEK

SEQ ID NO: 92347 - protein, 49 aa, Glycine max
  Coding DNA Sequence Number=SeqID_662
MVNNPSEFNIHRKVERNWKGGLVPSLEEFESRSKGPTTLRAIGLRSNPN

SEQ ID NO: 92348 - protein, 77 aa, Glycine max
  Coding DNA Sequence Number=SeqID_663
VIIVDWAFSGWIGVGVGGEIRYWLSNCIGAEDIGTWVVRGLLGTGHVGAMVTTWVSTFFFFAPPVPVLLLLALVKAT

SEQ ID NO: 92349 - protein, 55 aa, Glycine max
  Coding DNA Sequence Number=SeqID_664
MGVQIAPRPIWALQKIPPEGAEALPKRFRNVFREESRKAFNRSSTFFIRSSIFNG

SEQ ID NO: 92350 - protein, 212 aa, Glycine max
  Coding DNA Sequence Number=SeqID_665
MAVVNPEKIYQSPFPRWYNPNATCAYHGGDSSNVRTNPLASHGGSTVNAVEECGPWGPKRMEDMLTSRRFILEALREAGMICLYGNKGDSCLIHPGASHDVEICPSAEEQLQGMMDKGLIEVCGARKGEEDPVPVEKLVLFSYKSDKVVPWRYATQGPNGKKHVFVVHVKDDLSSAKVTNISGTSDMTHSGWIFTAPEPPMRSKDPKGKAKA

SEQ ID NO: 92351 - protein, 27 aa, Glycine max
  Coding DNA Sequence Number=SeqID_666
MGPVKRGGHAQRGATHTPPIAKLILMP

SEQ ID NO: 92352 - protein, 67 aa, Glycine max
  Coding DNA Sequence Number=SeqID_667
MPTSPERAQMTILASTYQITLEVRITVRCLRGLPVLGSWKHWVRQIEENHSKCINLAQCGAKKSLAH

SEQ ID NO: 92353 - protein, 232 aa, Glycine max
  Coding DNA Sequence Number=SeqID_668
MKLCFYTFLVRDFGAQNFKVIQRVHTVWESPLRKDKELRGICNGIIGGYHEWLKVRTRGLDWLAKLKIINEENFEAPEEDEEVRALKTELGKARLAKEKFKLVATDVRKECAGLREENAATAKALEQETKRARKEEHGCDKFRGALWGSNSELKLGREERDRSRAHSMVLKEELVVCSRSKRNLSQRLCETETNMLAIITKYQEELSIATTHEHRVADEYAQVYAKKEARGR

SEQ ID NO: 92354 - protein, 81 aa, Glycine max
  Coding DNA Sequence Number=SeqID_669
MVFLSCGGGTTIAVVLFDFGGGGGSKETTITAVLFCLDGSGGRICLLLGLLRHLNINPNTVAACALGKGSSDKMGGIEGFR

SEQ ID NO: 92355 - protein, 262 aa, Glycine max
  Coding DNA Sequence Number=SeqID_670
  Homolog annotation: Hit_ID=A7PVZ2; Match level="QueryCoverage=56%, HitCoverage=58%, E-value=2e-37, Identity=53%"; Hit description =Chromosome chr8 scaffold_34, whole genome shotgun sequence
  Subcellular localization annotation: CTP_CleavageSite=58; ConfidenceScore=5.30e-01
MNSISLGSFILTPCKFRPFLQTKHQPIFRTLSPIPLTQKPTFLRATDSNIDAPISLPEGASFVSIPEIIEKDWSVLDCAEHRTTDRIIASGNIEQSSRVLVSTGSEDFVDSLAGLTPSVFVVHDSLLTLACIKEKYDRVKCWQGEIIYVPEKWAPFDAVFLYFLPALPFKLHQILESLAGKCAPASDDVDLPMTGKYASEESCECYIKARDEMENLKLMRSLGVGLLRNRKGEFGKDESRKIKVMEERGRDFILPFPQNIVP

SEQ ID NO: 92356 - protein, 917 aa, Glycine max
  Coding DNA Sequence Number=SeqID_671
  Gene Ontology: Mol. function=structural constituent of cytoskeleton; Cellular component=microtubule organizing center; Biological process= microtubule cytoskeleton organization and biogenesis
  Homolog annotation: Hit_ID=A7PVY6; Match level="QueryCoverage=89%, HitCoverage=97%, E-value=0.0, Identity=76%"; Hit description =Chromosome chr8 scaffold_34, whole genome shotgun sequence
  Pfam annotation: Domain name=Spc97_Spc98; Domain location=181-677; Score=671.5; E_value=6.6e-199; Accession=PF04130.4; Description =Spc97  Spc98 family
MEEEEDQQKLPDLVKELVHRLLSQNLPPNSPPLNPNSPEFRNSLRYALRILSSRLTPSVAPDAAAIADSIKRRLATHGHSSEALSFADLFSKFSSKAQSVNNKFAVIYLLKIVSEDRHTTTATTTPLLPNLSFSEPTSNKKPWNDNGALLISKDPENRRDVAFREFVDLVKEENEVSEEVLVQDVLYACQGVDGKFVKFDGESKRYVIPDSIRVPRATRSMVYNLCELGVLFRNVSGYISLSMDRFPNEDVGTVGQAFCSALQDELSEYYKLLAVLEAQASNPIPLVSESASSGNYLSLRRLAVWVAEPLVKMRLMADLVEKCRVLRGGAMAGAIHLHAQHGDPLVHEFMRRLLQRVCSSLFEMVRRWVLEGELEDIFAEFFIVGQPVKAESLWREGYRLHDSMLPLFISPSLAQRILRTGKSINFLRVCCEDHGWADAATEVVADHGATARRGGFGYGETDTLEFLVDEASKRIDKHLLDVIFKRYKFKEHCLAIKQYLLLGQGDFVQYLMDIVGPELSEPANTISSFKLSGLLETAIRASNAQYDDPEILDRLRVKMMPHESGDRGWDVFSLEYDARVPLDTVFTESVMARYLRIFNFLWKLRRVEHALTGAWKTMKPNCITSNSFTRLQHAVKMQLVSTLRRCQVLWVEINHFISNLQYYIMFEVLEVSWSNFLAEMEVAKDLDDLLAAHEKYLHSIVEKSLLGELSQSLYKSLFVIFDLILRFRSRADRLYEGIHELQARFTESSLSSRDKNQSRSRKQLSDKSAEQGSWIADGRKALTQRAGEFLRNMEQDLDAIAKEYSSLQEGFISQLPVQQHVDLKKFVNKAEGQAEALFLQKDKALKALHPANFHYMKLLIFNWMPDMSSTDEIAGLAENVGAVQATLGFWKCCEKEVVIQVEFLTKIDGDEAIPFPL

SEQ ID NO: 92357 - protein, 379 aa, Glycine max
  Coding DNA Sequence Number=SeqID_672
  Gene Ontology: Mol. function=zinc ion binding; Cellular component =intracellular; Biological process=intracellular signaling cascade
  Homolog annotation: Hit_ID=A7P007; Match level="QueryCoverage=43%, HitCoverage=74%, E-value=7e-38, Identity=46%"; Hit description =Chromosome chr6 scaffold_3, whole genome shotgun sequence
  Pfam annotation: Domain name=C1_2; Domain location=144-174; Score =23.9; E_value=0.00058; Accession=PF03107.7; Description=C1 domain
  Pfam annotation: Domain name=C1_2; Domain location=33-62; Score=1.7; E_value=2; Accession=PF03107.7; Description=C1 domain
  Pfam annotation: Domain name=C1_2; Domain location=91-118; Score =21.3; E_value=0.0035; Accession=PF03107.7; Description=C1 domain
  Pfam annotation: Domain name=C1_3; Domain location=143-174; Score =31.7; E_value=2.7e-06; Accession=PF07649.3; Description=C1-like domain
  Pfam annotation: Domain name=C1_3; Domain location=32-62; Score=15.5; E_value=0.0079; Accession=PF07649.3; Description=C1-like domain
  Pfam annotation: Domain name=C1_3; Domain location=90-118; Score =12.9; E_value=0.016; Accession=PF07649.3; Description=C1-like domain
  Pfam annotation: Domain name=PHD; Domain location=91-151; Score=3.7; E_value=0.0049; Accession=PF00628.20; Description=PHD-finger
  Pfam module annotation: Pfam domain module=C1_2::C1_2::C1_2::C1_3::C1_ 3::C1_3::PHD; Domain location=144-174::33-62::91-118::143-174::32 -62::90-118::91-151
MGSAHKDPNVFHFSHPHPLECTTPPSTGNNVIICFGCKLKVKHGEDYYECKTCAFSLHNVCYKMPLITNHPSHASHNLVLLAIPSTKATLNCVACGNHVTGFCYHCAECSIFFHSLCLALPVSLAITYHPHKIKLEFSAPYHFFCDLCNKPSYNNNGWLYRCNMCEFDTHIACAVENLEPHSFKNESFHQSSPLLRQLTSDHRVEHKRVSASVGDSCKGYDEYEIMRLVAQQIIGGGIRENSDSAVAGWDKRLYSIPWKKLNKTGSGKMKIISELELQEKELSPAQLLLKLEERTPLRDKSTPFSDHLGTPYSNQYSDSYFSIDLAKSYSNQHGHRSQVPREGGSDQITRDVTMPERVVSNSGQREEPFGLVNWPFNDS

SEQ ID NO: 92358 - protein, 99 aa, Glycine max
  Coding DNA Sequence Number=SeqID_673
MSRRVNNEAEFVYGSGQLNPRRSLSPGLAYYVDDFGQDAINYPHDAIWLGKQQRHKSMIFQKKSDQLKPTSLIFSKTLQKMSFKKFKVVVIVKDTFIAK

SEQ ID NO: 92359 - protein, 426 aa, Glycine max
  Coding DNA Sequence Number=SeqID_674
  Gene Ontology: Mol. function=DNA-directed DNA polymerase activity; Cellular component=nucleus; Biological process=DNA replication
  Homolog annotation: Hit_ID=A7PVW5; Match level="QueryCoverage=99%, HitCoverage=98%, E-value=0.0, Identity=74%"; Hit description =Chromosome chr8 scaffold_34, whole genome shotgun sequence
  Pfam annotation: Domain name=DNA_pol_E_B; Domain location=173-380; Score=197.5; E_value=3.3e-56; Accession=PF04042.7; Description=DNA polymerase epsilon subunit B
MGMERVQCAYASLDEAFEIGKEAYQGQQYSQIYFARLHLMRTLLYSLVPHWKPNFPVLGLEEGKECVIVGTLYKHMKLKPCILDEYSKERSVVPLVKPHNFIHPDDHLVLEDESGRVKLSGSIILPSEYVTGIVVALLGKETGAGDFLVQDVLDAGLPPQIEFPLKPREDKYVVLVSGLSVGSSSSNPLQFQLLIDHITGHLGDEKEQSIASQIVRVVFAGNLVEIPRRLLNGQNLASKDLSRMAEPIKELDILLSQIAAGLPLDIMPGPSDPANFSLPQQVNRLLSILLPLMLNLLYLEHDPHTASRFLGTSGQNVDDLEKYSEAKDKLEFMERTLRWRHLAPTAPNTLGCYPYTDKDPFFIESCPHVYFVGNQDKFETRVIKGSEGQLVRLICVPKFSETGVAVMLNLRDLDCHALSFGTQFSS

SEQ ID NO: 92360 - protein, 78 aa, Glycine max
  Coding DNA Sequence Number=SeqID_675
  Homolog annotation: Hit_ID=UPI0000ECAFAB; Match level="QueryCoverage =75%, HitCoverage=91%, E-value=3e-23, Identity=74%"; Hit description =UPI0000ECAFAB related cluster
MRGSSKARPAGMQAWHWPSFYNVVTGKTLALPNLIALQHIPLSPAGPEWRMAPDAVFSPYASVRYFTPHMVHSQYNLL

SEQ ID NO: 92361 - protein, 423 aa, Glycine max
  Coding DNA Sequence Number=SeqID_676
  Gene Ontology: Mol. function=DNA binding; Cellular component=nucleus; Biological process=regulation of transcription
  Homolog annotation: Hit_ID=A7PVU7; Match level="QueryCoverage=99%, HitCoverage=100%, E-value=6e-78, Identity=44%"; Hit description =Chromosome chr8 scaffold_34, whole genome shotgun sequence
  Pfam annotation: Domain name=Myb_DNA-binding; Domain location=241 -292; Score=40.0; E_value=8.4e-09; Accession=PF00249.22; Description =Myb-like DNA-binding domain
MNENKIDWGGLIQQSHVLSGDFNSEFGNRYCQYFDIRQAWNMGPLAMVGGEAIDNELQNIGHAKSSGTIMSRFESPASAFYAAENCMEFAEYDCQVGIHSLSSQLCKINDLEFPLYQSPRENLFLDSANQSETNFDLSNTLQSIVKSQLNSANQCSRSPEKSNKISCGNFHSTKFLPVEQQKLFIDGLISGSSFPNKGNQDHMLRFSSQIERLSPTLSAGSVSTIGNSASNVAAVVSSKTRIRWTKDLHEKFVECVNRLGGAEQATPKAILKMMNTDGLTIFHVKSHLQKYRIAKFIPEPSHGKSDKRTHTKDVHHLDVKTGIQIREALKLQLDAQRCLHEQLEIFNYHTFLVQIQRKLQLRIEEQGRQLKKMFDQQQKTSNDVSNTQNSTIEETSISHKDGENASEGANNNSFFPSKTSPSQ

SEQ ID NO: 92362 - protein, 308 aa, Glycine max
  Coding DNA Sequence Number=SeqID_677
  Gene Ontology: Mol. function=DNA binding; Cellular component=nucleus; Biological process=regulation of transcription, DNA-dependent
  Homolog annotation: Hit_ID=A2Q4T4; Match level="QueryCoverage=100%, HitCoverage=81%, E-value=4e-89, Identity=52%"; Hit description=SBP
  Pfam annotation: Domain name=SBP; Domain location=69-145; Score=89.2; E_value=1.3e-23; Accession=PF03110.5; Description=SBP domain
  Subcellular localization annotation: CTP_CleavageSite=69; ConfidenceScore=5.56e-01
MASDAKLSSSESLNGLKFGQKIYFEDVGFATPATSLTSSATTATTVTSSSSSSSRKGRGGSVQPAQPPRCQVEGCEVDLSNAKTYYSRHKVCGMHSKSPTVIVAGLQQRFCQQCSRGGNFLMELASYPKLSLRNSLPTPRSSELAPGNQTSTLSWHGNSETSSDLFLQGSVGGTSFAGPGHPPGESYTGVTTSSCALSLLSNQTWGSRNPAPSLGLNNMVNFHGTPMTQPAASSHGASIHQLPNTPWCFKGIDSGNCSPEGVPDLGLGQISQPLSSQLHGELDLSQQGRRHYMDLEQSRAYESAHWSL

SEQ ID NO: 92363 - protein, 1025 aa, Glycine max
  Coding DNA Sequence Number=SeqID_678
  Gene Ontology: Mol. function=binding
  Homolog annotation: Hit_ID=A2Q4U5; Match level="QueryCoverage=98%, HitCoverage=97%, E-value=0.0, Identity=77%"; Hit description=Tubulin binding cofactor C
  Pfam annotation: Domain name=TBCC; Domain location=359-476; Score =193.9; E_value=3.9e-55; Accession=PF07986.3; Description=Tubulin binding cofactor C
MTEPTEPCTSSSLARDPTTVIHPRREPFEHGLLPIPRLIFSDPAQTLIPLKQKLLESSSNQRVDSAAISESLQISIEQARLVLDTLASVLHSDAEPLVAAKLGEIDSVGVDVHDLVLFLYIQSYKRLLPRTHKDSAAVADVWPSTSAFDGYLSALSPLQLVRSNSRRGMPSQVDEEAHQLSYLQKHLANIVSLVAQPVEGEGEESLNRSGLPMKIMETLDCAFQVSGDVHGFAGWVLTMDRFEHLGFLIQFGDKGSEGNSFSQSSPFFANSDPDMPAVPVPAAQVHDWLLQNIAAALEYISERTSSKENGPASASDQDVAMTDACTTSVNKVSTSTRSASFIEGISKSSYVKHASDIKGSSVKVLNCHESAIYILAPLRYATVYGCSDATVVIGAVGKAVRVEHCERVHVIVAAKRICIANCRECVFFLGVNQQPLILGDNHKLQVAPYNTFYSQLEEHMNEVGIVPTVNRWDEPLALGMVDPHDSLSHPAGVSDVQAESATRVDPDQFTNFVIPNWFGAESTGATKGNPFMLPDAYMASQHKNQKNLGEIRQLLREAPLEESRKRELSSALHVYFKDWLYVNQLPIVQTQQIKARHVTIKPYGKLHQNAPACLSSPSTLFPNQRSATLSHDFSLGVAMTEPTEPSTSSSLARDPTTVVHPRREPFEHGLLPIPRLIFSDPTQTLISLKQKLLELSSNQRVDSAAISESLQIPIEHARLVLDTLASILHSDSEPLVAAKLEEIDSVGVDVHDLVLFLYIQSYKRLLPRTHKDSAAVADVWPSTSAFDGYLSALSPLQADEEAHQLSYLQKHLANIVSLLAEPVEGEGEESLVLTMDRFEHLGFLIQFGDKGSEGNSFSQCSPFFANSDPDMPAVPVPAAQVHDWLLQNIVSALEYISERTSSKENGPASASDQDVAMTDASTVSVKVSTGTRGASFIEGISKSSYAKHASDIKGSSVKVLNCHESAIYILAPLRYATVYGCSDATIVLGAVGKEDDTDMMIAVKWACLQVTEISLGFIVLLGQFG

SEQ ID NO: 92364 - protein, 161 aa, Glycine max
  Coding DNA Sequence Number=SeqID_679
  Gene Ontology: Mol. function=binding
  Homolog annotation: Hit_ID=A2Q4U5; Match level="QueryCoverage=92%, HitCoverage=24%, E-value=7e-47, Identity=61%"; Hit description =Tubulin binding cofactor C
MVAPYNTFYAQLEEHMNEVRIVPSVNRWNEPLALGMVDPHDSLSHPAGVSDVQTESATQVDPEQFTNFVSHALFLVHAVGTQIPSWLGGESTGFKKDNPFTLPDAYMASQHKNHKNLEEIRKLLREASLEESRKRELSSALHVYFKDWLYVETWTNSLPGI

SEQ ID NO: 92365 - protein, 76 aa, Glycine max
  Coding DNA Sequence Number=SeqID_680
  Gene Ontology: Mol. function=structural constituent of ribosome; Cellular component=ribonucleoprotein complex; Biological process =translation
  Homolog annotation: Hit_ID=A6H5N0; Match level="QueryCoverage=50%, HitCoverage=31%, E-value=2e-10, Identity=86%"; Hit description =Ribosomal protein S12
MEKILQESQVPKVHDKYRQSPILQRKLSETLLYVKLSDLSKRGRVKDLPGVRYHIVRGTLDVVEVKDRQQGRSSAL

SEQ ID NO: 92366 - protein, 400 aa, Glycine max
  Coding DNA Sequence Number=SeqID_681
MYKGINDIEARHTMFIYTAEDAARAYDIISIKLNGWDALTNFHLNCYDVRCIMESDLTQTTEGIATLRKVDSSGSTEGYPQQLNNSSFSEFSHGFKNPNLIPSNPYTLGGFTAGAGSSSDGNLFGGEFPNMSAILQQSLQPQSQVNFNNVFNNQNLFINTTNNNINQFLPQSSNFTAGAGSSSTANFNPIGGEFPNQSATLQQPLQTPSQENVNTVFNQSILNDGDEDNNNNRQFLALISNFPLLARGTKNLDLESCLRFTNWPAEFGKKLLGGNLELDLEPSSSNLNVPSPTHDMVNETAEAANAVGSLGQQIQPVEPSNQEFGATQPQLPALNQSLEPDHNYNANILNQIPPQNLNPSFSDTFQINPSSEPNNIIGSQSQTDQGMRIGKAPNTARHQV

SEQ ID NO: 92367 - protein, 90 aa, Glycine max
  Coding DNA Sequence Number=SeqID_682
  Gene Ontology: Mol. function=nucleic acid binding; Cellular component= mitochondrion
  Homolog annotation: Hit_ID=A5B074; Match level="QueryCoverage=100%, HitCoverage=37%, E-value=8e-18, Identity=52%"; Hit description =Putative uncharacterized protein
  Subcellular localization annotation: CTP_CleavageSite=21; ConfidenceScore=5.06e-01
MAFFGRIGNLLRQTASRQAIRCMLSAPSTKLFIGGGVNEIMLTYFMFPLNVTLFVARIIMDRETGRSRGFGFVTYTSDEEASSTIQALDG

SEQ ID NO: 92368 - protein, 309 aa, Glycine max
  Coding DNA Sequence Number=SeqID_683
  Gene Ontology: Mol. function=metal ion binding; Cellular component =cellular_component; Biological process=response to stress
  Homolog annotation: Hit_ID=A2Q3D5; Match level="QueryCoverage=55%, HitCoverage=100%, E-value=2e-71, Identity=74%"; Hit description=Zinc finger, AN1-type; Zinc finger, A20-type
  Pfam annotation: Domain name=zf-A20; Domain location=154-178; Score =28.8; E_value=1.9e-05; Accession=PF01754.7; Description=A20-like zinc finger
  Pfam annotation: Domain name=zf-AN1; Domain location=250-290; Score =83.6; E_value=6.2e-22; Accession=PF01428.7; Description=AN1-like Zinc finger
  Pfam module annotation: Pfam domain module=zf-A20::zf-AN1; Domain location=154-178::250-290
MKGHIGKRQHNRLCEKRMLAGINVQREGTVQECEDRLTQLHRIDFDLLNMIEILCHTGIEFQEFCLHSFNCGRDFIALLGVVGDAVAIMIVVMETPKNLDVAAEIAVPDHYFGRIDFEMLNMIEMCRYWCKQARVVTKIMESHDETGCQAPERPILCINNCGFFGRAATMNMCSKCYKDMLLKQEQDNFAASSVENIVNGSSNGNGAVTTGAVDVQVEAVEVKTVSAQSSVDSSSGESLEMKAKNSPSRCATCRKRVGLTGFSCKCGNLFCAMHRYSDKHECPFDYRTVGQDAIAKANPIVKADKLDKI

SEQ ID NO: 92369 - protein, 106 aa, Glycine max
  Coding DNA Sequence Number=SeqID_684
MSKCNLAITPIEIGIRLQLVGDENIFVRKPRIPHFQVAKRILRYLKGTLDFGIFYSILIVRRMQKEKSMAIATQIGVEIKEIGKLLLVMSSNLSQQQFLGVQGSKE

SEQ ID NO: 92370 - protein, 283 aa, Glycine max
  Coding DNA Sequence Number=SeqID_685
  Gene Ontology: Mol. function=RNA-directed DNA polymerase activity; Cellular component=chromatin; Biological process=chromatin assembly or disassembly
  Homolog annotation: Hit_ID=A5B2I6; Match level="QueryCoverage=46%, HitCoverage=6%, E-value=5e-13, Identity=31%"; Hit description =Putative uncharacterized protein
  Pfam annotation: Domain name=Retrotrans_gag; Domain location=95-185; Score=33.6; E_value=7e-07; Accession=PF03732.8; Description =Retrotransposon gag protein
MGERCMLVGVLSTRIRAPILERRIINGDEGKHENGDMHGSHGERMIQRLAAAWEKKSPTTNVHTADMSGGNEGIAAHDDNRWRNLEMPIFDGKLEAVMVAMDGEALGWFQWWESWNPNHSWDGFKIAVTQRFQAPSLGNPFQVLMALEQEETVQGFIGQFEKCVGMVKRLEEPFLVEVFLKGLKEEISTEVRLHEPKNLMEAMVKDQRVEDKNRVLGKLLLSNSQGYNLQKPNYSGQKFVRDWQRANSKVADPTNVAKTGSSGWQGYFPQLDLEDKVHLEGEY

SEQ ID NO: 92371 - protein, 284 aa, Glycine max
  Coding DNA Sequence Number=SeqID_686
  Gene Ontology: Mol. function=transcription factor activity; Cellular component=nucleus; Biological process=regulation of transcription, DNA-dependent
  Homolog annotation: Hit_ID=A5B053; Match level="QueryCoverage=100%, HitCoverage=100%, E-value=4e-76, Identity=53%"; Hit description =Putative uncharacterized protein
  Pfam annotation: Domain name=AP2; Domain location=28-79; Score=80.8; E_value=4.5e-21; Accession=PF00847.11; Description=AP2 domain
MDTCKKFPLKPWKKGPTRGKGGPQNASCEYRGVRQRTWGKWVAEIREPKKRTRLWLGSFATAEEAAMAYDEAARRLYGPDAYLNLPHLQPRSTSTTITSSGKFKWFPSKNFISMFPSCGLLNVNAQPSVHLIHQRLQELKRNSVVSQSPPNSSNEPKEETQTVGSKKDGENPPKDDQMLSEEVLGDLQEKPQIDLHEFLQQMGILKEERESERTDSSGSSSTMPEALLRDDNDHHLGVFSDNSVNWEALIDMHGIAGIQESEVTQLEAYDPNDDLTFSTSIWNF

SEQ ID NO: 92372 - protein, 680 aa, Glycine max
  Coding DNA Sequence Number=SeqID_687
  Gene Ontology: Mol. function=nucleic acid binding; Cellular component= nucleus; Biological process=regulation of transcription
  Homolog annotation: Hit_ID=A2Q3L5; Match level="QueryCoverage=97%, HitCoverage=93%, E-value=0.0, Identity=68%"; Hit description=Zinc finger, CCCH-type
  Pfam annotation: Domain name=Ank; Domain location=58-91; Score=22.4; E_value=0.0017; Accession=PF00023.21; Description=Ankyrin repeat
  Pfam annotation: Domain name=Ank; Domain location=93-128; Score=35.8; E_value=1.6e-07; Accession=PF00023.21; Description=Ankyrin repeat
  Pfam annotation: Domain name=zf-CCCH; Domain location=273-298; Score =26.4; E_value=0.0001; Accession=PF00642.15; Description=Zinc finger C-x8-C-x5-C-x3-H type (and similar)
  Pfam module annotation: Pfam domain module=Ank::Ank::zf-CCCH; Domain location=58-91::93-128::273-298
MNHLSLDTEDYSLSSLLELAANNDVSGFKRLIECDPSSIDEVGLWYIRHKESKKMVNEQRTPLMVAATYGSIDVMKLILSLSEADVNLSCGLDKSTALHCAASGGSENAVDAVKLLLEAGADVNSVDVNAHRPGDVIVFPTKLEHVKKTSLEELLQKTDDWSLLRVITTTTSCNACSPPLSTSPEIEIEIEIESPCSARDSKMKSDEVTEKKEYPVAPSLPDIKNSIYSTDEFRMYSFKVRPCSRAYSHDWTECPFVHPGENARRRDPRKFHYSCVPCPEFRKGSCRRGDLCEYAHGVFECWLHPAQYRTRLCKDGTNCARRVCFFAHTNEELRPLYVSTGSAVPSPRSGAPSSAMDFVTAMTMSPSSPSIAWSQPNIPALHLPGSNFHSSRLRSSLNARDISMDDFDLLLPDYDQHQQQQQFLNELSCLSPHAMNSNPMNRSGRMKLLTPSNLDDLFSAESSSPRYADPALASAVFSPTHKSAVFNQFQQHQQSLLAPVNTNFASKNVEHPLLQASLVMSPRNMEPISPMGSRISMLAQREKQQFRSLSFRELGSNSAASAASTTSANSWSKWGSPNGNFDWPVGASDEIGKLRRSSSFELGNNGEEPDLSWVQSLVKESPADVKGKFATTVSNVSAAAAGSSSEGSNMSTQMESVVDHAVLGAWLEQMQLDHLVAQQN

SEQ ID NO: 92373 - protein, 79 aa, Glycine max
  Coding DNA Sequence Number=SeqID_688
MFLLSCPLLASWNLWDYTHTKSNWYWRREKSSFIQHFELSAYLCCPFCQPKVFERLAITGNGGFVGAFGNALCRSWGLQ

SEQ ID NO: 92374 - protein, 53 aa, Glycine max
  Coding DNA Sequence Number=SeqID_689
MSDPSKRRQTSSRPTTTRIHNEMDEPIPNRPKKYSLCRIEGHNRSNCPYKQII

SEQ ID NO: 92375 - protein, 143 aa, Glycine max
  Coding DNA Sequence Number=SeqID_690
  Gene Ontology: Mol. function=hydrolase activity, acting on glycosyl bonds; Cellular component=extracellular region; Biological process =cell wall organization and biogenesis
  Homolog annotation: Hit_ID=Q944B5; Match level="QueryCoverage=94%, HitCoverage=35%, E-value=7e-30, Identity=47%"; Hit description =Dehiscence-related endopolygalaturonase
MLIIHLLYIDDGGTFKNMIKQSANVLSLNKFDYKLGNTPFLEKAFNKAWQVVCSTGEAILVVPQGNYLLKPIRFSGPCKPNFAVQISGTLEASDDPSDYSGDNRHWLVFDNIQKLFVYGGGTINGNGNISWQNSCKRNKKLKC

SEQ ID NO: 92376 - protein, 782 aa, Glycine max
  Coding DNA Sequence Number=SeqID_691
  Gene Ontology: Mol. function=binding; Cellular component=nucleus
  Homolog annotation: Hit_ID=A7PWD9; Match level="QueryCoverage=100%, HitCoverage=78%, E-value=1e-172, Identity=45%"; Hit description =Chromosome chr8 scaffold_34, whole genome shotgun sequence
IVSAVLENYEVPKKNSANLDHEEQDVMANEGQISPLLDVKRRNPSWRKVVNDKGEINVAMEDDMNPSFWSGVCLHNMANLAKEGTTIRRVMESLFRYFDNGNLWSINHGLAFSVLKDMLFLMDDSEKNTHVLLSTLIKHLDHKIVLKEPQMQLDIVEVATSLAPYAKVQPSVSIVGAVSDMMRHLRKCIHCSLDDSNLAPDVINWNKNFKKVVDRCLVQLSNKPPYQMCPIRIRQGVDIPGFVLSSMVHYFDFLWINLRLKPYISPQAFPETLFHQLLLAMVHPDHETRVVSHHIFSSILVPTSVFPHPSLSASDPKASNVPRTLSRAVSVFSSSAVLFEKLRLEKRSSSEKLIQHNKGNISGEIEPVSSNVGIVNRLKSTYGRLPSVNNPPLQLELDEIAANKDNRNSVDVIMVNITDQLFTCIQEAAALRLTKLQINRLLSSIWAQSLSPGNMPANYEAIAYSYTLVLLVSREKVGYSMLCELVIDGVKVLVRSFQLAFSLWNISLKEGPLPPSRRRSLFTLATSMIVFSSKEYNIDHLVQSAKAVLTEKVDPYLQLIEDHKLQAVSFAPDNLSINYGSKEDDDRALDMLSDLLTYIHKTRDLFASEIIKSLEMFAKAELSSIKEQLLEEFAPDAMCELGSQLTMNMAAKALDTSHPAGRISVSNAFNMPYKDMADKCEVLLLEKQKMSRLMSTQQKQECSVDSLSPNHGNELKNMDSSSHVDFQKVGNPPFDENAAFDFHGPTFSPLPMVSGTEYQNQPHPFKLPAASPYDNFMKAAGC

SEQ ID NO: 92377 - protein, 137 aa, Glycine max
  Coding DNA Sequence Number=SeqID_692
MIANALDKDGKFTTAQVSRKLKQLGLSLPLKSSGGKMHPKGVDLMDRSNERMDESDDETLVSLVKRKKMESGKLSRGQLHGQTSEDKLSKGDFDDEMLNSVLKDKLDDVIKGFAPTSGSNSDKDDHKYVYNLTSNFT

SEQ ID NO: 92378 - protein, 186 aa, Glycine max
  Coding DNA Sequence Number=SeqID_693
MAESAWVTKSAWAVESTRSAWAMEVAVVTAQRKKGSGGWFSEAVLGEGHPVWIRGGIELQQVWSRQPRGSPRKRQKVWCPSFEVVWVVVVEVGMTAMEGNHESFVWQVVWVAVVKADTTKKKTFYIGSNDFSTSVMTRGGNPRSLNHNIGFMTIFEGRLFYIGCLATIDVEWVAFYSGSKAETDVE

SEQ ID NO: 92379 - protein, 98 aa, Glycine max
  Coding DNA Sequence Number=SeqID_694
  Homolog annotation: Hit_ID=A2Q4E5; Match level="QueryCoverage=88%, HitCoverage=12%, E-value=3e-15, Identity=45%"; Hit description =Disease resistance protein
MQEQNQELRKCLRRLKRVFSYAEDMLDEFECKRQRKQVVKAHGTTKDKMAQQIKDISKRLDKVAADRHKFGLQPIDVDRRVVHKRDMTPNWFLYCHFF

SEQ ID NO: 92380 - protein, 932 aa, Glycine max
  Coding DNA Sequence Number=SeqID_695
  Gene Ontology: Mol. function=calcium ion binding; Cellular component =cytoskeleton; Biological process=cytoskeleton organization and biogenesis
  Homolog annotation: Hit_ID=A7PWH1; Match level="QueryCoverage=100%, HitCoverage=100%, E-value=0.0, Identity=61%"; Hit description =Chromosome chr8 scaffold_34, whole genome shotgun sequence
  Pfam annotation: Domain name=Gelsolin; Domain location=131-211; Score= 41.5; E_value=3.1e-09; Accession=PF00626.13; Description=Gelsolin repeat
  Pfam annotation: Domain name=Gelsolin; Domain location=16-99; Score =67.7; E_value=3.8e-17; Accession=PF00626.13; Description=Gelsolin repeat
  Pfam annotation: Domain name=Gelsolin; Domain location=246-321; Score= 58.8; E_value=1.9e-14; Accession=PF00626.13; Description=Gelsolin repeat
  Pfam annotation: Domain name=Gelsolin; Domain location=384-467; Score= 40.4; E_value=6.5e-09; Accession=PF00626.13; Description=Gelsolin repeat
  Pfam annotation: Domain name=Gelsolin; Domain location=564-644; Score= 35.3; E_value=2.2e-07; Accession=PF00626.13; Description=Gelsolin repeat
  Pfam annotation: Domain name=VHP; Domain location=897-932; Score =65.0; E_value=2.5e-16; Accession=PF02209.10; Description=Villin headpiece domain
  Pfam module annotation: Pfam domain module=Gelsolin::Gelsolin::Gelsoli n::Gelsolin::Gelsolin::VHP; Domain location=131-211::16-99::246 -321::384-467::564-644::897-932
MSSATKVLDPAFQGVGQKPVPLPRPDYGKFYMGDSYIILQTTQGKGSAYLYDIHFWIGKDTSQDEAGTAAIKTVELDASLGGRAVQHREIQGHESDKFLSYFKPCIIPLEGGVASGFKKPEEEEFETRLYVCRGKRVVPFARSSLNHDDVFILDTQNKIYQFNGANSNIQERAKALEVIQLLKEKYHEGKCDVAIVDDGKLDTESDSGEFWVLFGGFAPIGKKIISEDDIVPETIPAQLYSIADGEAKPVEGELSKSLLENYKCYLLDCGAEVFVWVGRVTQVEERKAACQAAEEFLTSQKRPKSTRITRIIQGYETHSFKSNFDSWPSGSATTGADEGRGKVAALLKQQGMGVKGVTKTTSVVEEIPPLLEGGGKMEVWQINGSAKTPLPKEDIGKFYSGDCYIVLYTYHSSERKEDYYLCCWFGKDSTEEDQRMAIRLANTMFNSLKGRPVQGRIFDGKEPPQFIVLFHPMVVLKGGLSSGYKKLIADKGLPDETYTAESVAFIRISGTSTHNNKVVQVDAVAALLNSTECFVLQSGSAVFTWHGNQCSLEQQQLAAKVAEFLRVEEVYNFSQDDLLTEDILILDTHAEVFVWIGQCVDPKEKQNAFEIAQKYIDKAASLEGLSPHVPLYKVTEGNEPCFFTTYFSWDHTKAMVPGNSFQKKVTLLFGIGHPVEEKSNGSSQGGGPRQRAEALAALNNAFNSSPEATSSASLNFKSLVDSPDKKGGHRDKSNGLSRGGPRQRAEALAALNSAFNSSSGTKVYTPRPSGRGQGSQRAAAVAALSSVLTAEKKKTSPETSPVASTSPVVENSNFDTKSESAPSEKEIVEEVTEVKETEVVALETGTNGDSEQPKQENVEDGGNDSENNNQNFFSYEQLKTKSGSVVSGIDLKRREAYLSDKEFQAVFGMAKDAFSKLPRWKQDMLKRKVDLF

SEQ ID NO: 92381 - protein, 114 aa, Glycine max
  Coding DNA Sequence Number=SeqID_696
  Gene Ontology: Mol. function=RNA polymerase II transcription factor activity; Cellular component=transcription factor TFIIF complex; Biological process=transcription initiation from RNA polymerase II promoter
  Homolog annotation: Hit_ID=A7PI78; Match level="QueryCoverage=92%, HitCoverage=43%, E-value=2e-34, Identity=62%"; Hit description =Chromosome chr13 scaffold_17, whole genome shotgun sequence
MEGKILNKFDMRSHNQTLELYGKLYRERTNKYMVIENDSGAHMRPMPMMISFSTSGPSEKKAPTKPTDMKRTRRDHGKIEEIVFELFERQPNWSLRKLIQETNQPEVGLYKHTI

SEQ ID NO: 92382 - protein, 215 aa, Glycine max
  Coding DNA Sequence Number=SeqID_697
  Gene Ontology: Mol. function=nucleoside-triphosphatase activity
  Homolog annotation: Hit_ID=A5CBI6; Match level="QueryCoverage=52%, HitCoverage=8%, E-value=7e-36, Identity=68%"; Hit description =Putative uncharacterized protein
MDASMQARLQEQWRRLEIPTFGGDEDVKVWVHEVECYFRIWAAMEDEKLEMLQQMVDSFIILIAQQSDFNFNAENLELPLPGFYDNNFSLKNPWTQFNPARIRIAPFPTREYTDDQFQSIIKRVMGILYLLGFLYPISRLISYSVYEKEQKIKEGLYMMGLNDVLHSVRINELDGWGAKMDGKDENIGWKKKSGDADLLPKSLRTKTINVKKFGN

SEQ ID NO: 92383 - protein, 122 aa, Glycine max
  Coding DNA Sequence Number=SeqID_698
  Gene Ontology: Mol. function=nucleoside-triphosphatase activity
  Homolog annotation: Hit_ID=Q84M24; Match level="QueryCoverage=73%, HitCoverage=4%, E-value=1e-28, Identity=70%"; Hit description=AtABCA1
MTDISSVPPLVEYGIGCSLDQFVGGVSLLPTILMLLEYGLAIASSTYCLTFFFFDHTMAQNVVLLIHFFSGLILMVISFIMGLMPSTMSANSFLKHEYFALTWANSFSCKTKNRKKGFRALI

SEQ ID NO: 92384 - protein, 108 aa, Glycine max
  Coding DNA Sequence Number=SeqID_699
MTRGLRWESMCWIQAIGPFSADPANHFIQFCDGFGAGRNLSRRGGWWIALSITIWQHRNSFLFHGIPFEPQKVLDDALILAWSWLKCGEKGFNTSFNHWSTNLMMAFG

SEQ ID NO: 92385 - protein, 141 aa, Glycine max
  Coding DNA Sequence Number=SeqID_700
  Gene Ontology: Cellular component=nucleus
  Homolog annotation: Hit_ID=A5B6N4; Match level="QueryCoverage=43%, HitCoverage=9%, E-value=1e-20, Identity=75%"; Hit description =Putative uncharacterized protein
MGTFHHISWLRFSLGPHLGFSSTRFDLRFTTTATKIKATPDGEYIIASGIYPPQVKVYKVKELGLKFEHHLDFEIVDFQLHVLVACGGEDGVVECFDMRVRSSIGRIDVVGPSGDVNQEITALEFDEDGGFLMVVGSSAGK

SEQ ID NO: 92386 - protein, 332 aa, Glycine max
  Coding DNA Sequence Number=SeqID_701
  Gene Ontology: Mol. function=nucleoside-triphosphatase activity; Cellular component=integral to membrane; Biological process=transport
  Homolog annotation: Hit_ID=A7PQV3; Match level="QueryCoverage=96%, HitCoverage=63%, E-value=1e-87, Identity=42%"; Hit description =Chromosome chr6 scaffold_25, whole genome shotgun sequence
  Pfam annotation: Domain name=ABC2_membrane; Domain location=189-326; Score=-30.7; E_value=0.06; Accession=PF01061.15; Description=ABC-2 type transporter
  Pfam annotation: Domain name=ABC_tran; Domain location=1-117; Score= -23.8; E_value=6.7e-05; Accession=PF00005.18; Description=ABC transporter
  Pfam module annotation: Pfam domain module=ABC2_membrane::ABC_tran; Domain location=189-326::1-117
MRLPSKMTKEEIDKVVEETIVEMGLEDCADTRIGNWHCRGISNGEKKRLSIGLEILTQPYVLLLDEPTTGLDSASAFYVIQSLCHNAHNGKIVICSIHQPSSETFNIFDDLLLLSSGETVYFGEANMALKLSSSNSALGAKKAEIRETLIRSYEGSRLMINARRRIQQLKANEEQEIKAKIGSSATWWKQMCTLTKRSFLNMTRDIGYYWLRIVFYILVFYGERSKGHYGEAAFVVSNIISSFPFIVLTSLSSGLIIYFMVQLHPASVVPNVLMGLGTGTGVILFMMMSSQLVRPLHDIPKIFWRYPMSYLSFTTWAVQVPSNSYVTTDSIK

SEQ ID NO: 92387 - protein, 70 aa, Glycine max
  Coding DNA Sequence Number=SeqID_702
  Gene Ontology: Mol. function=4 iron, 4 sulfur cluster binding; Cellular component=cytoplasm; Biological process=metabolic process
  Homolog annotation: Hit_ID=Q42669; Match level="QueryCoverage=47%, HitCoverage=4%, E-value=3e-09, Identity=87%"; Hit description =Aconitate hydratase
MAGTDSHTTMIDGLGVARWGVGGIKAEAAMLGQSGGGARKVDLQKRLSATEQEEDLSWDIEDDDDETLNA

SEQ ID NO: 92388 - protein, 567 aa, Glycine max
  Coding DNA Sequence Number=SeqID_703
  Gene Ontology: Mol. function=microtubule motor activity; Cellular component=microtubule associated complex; Biological process =microtubule-based movement
  Homolog annotation: Hit_ID=A7PWI0; Match level="QueryCoverage=96%, HitCoverage=68%, E-value=1e-144, Identity=52%"; Hit description =Chromosome chr8 scaffold_34, whole genome shotgun sequence
  Pfam annotation: Domain name=CH; Domain location=23-148; Score=39.3; E_value=1.4e-08; Accession=PF00307.22; Description=Calponin homology (CH) domain
  Pfam annotation: Domain name=Kinesin; Domain location=400-567; Score=- 14.0; E_value=2.6e-14; Accession=PF00225.14; Description=Kinesin motor domain
  Pfam module annotation: Pfam domain module=CH::Kinesin; Domain location=23-148::400-567
MEDGSRNRTHFNMASRKAEESAWRRYEATQWLESQVGPLGIPNQPTETELISCLRNGLILCNAINKIHPGAVPKVVVVDNQVPSQSLAWDSQPLPAYQYFENVRNFLFVMEELKLPAFEVSDLERDNLEMGSAAKLVDCILALKSFQELKQMNKQNGYNKHIKSPLPMRMHSRAAAFSFDASRHLDLSATLTLINCPCILMCTCIIAFFLLLPLLDPAEIVELLAKQLVDLMFDAKENIDGNIIASLHKEHLVADPIKVFNQIMACCNGEQPPTNFNELPLLLKDSVKEKGNLPPHSISTPTQSDALSAPDSSKHGEACLRKCKCNQVHLLDMQEKELLDLKALKLKIKKEFQEIQSQFQGSQIQEMSTKALGYHKVVEENRKLYNMVQDLKGNIRVYCRIRPSFRAESKNVVDFIGEDGSLFILDPTKTLKDGRKLFQFNQVFGPIAGQDDVYKDTQPLIRSVMDGYNVCIFAYGQTGSGKTYTMSGPSGGGTSKDMGINYLALNDLFQMSNERKDIISYDIYVQMVEIYNEQVRDLLAEDKTDNKYPFHIHYSIGSNIFTLLRRD

SEQ ID NO: 92389 - protein, 537 aa, Glycine max
  Coding DNA Sequence Number=SeqID_704
  Gene Ontology: Mol. function=transferase activity
  Homolog annotation: Hit_ID=Q5QPZ6; Match level="QueryCoverage=100%, HitCoverage=100%, E-value=0.0, Identity=70%"; Hit description =Glycosyltransferase
  Pfam annotation: Domain name=DUF563; Domain location=105-393; Score =434.5; E_value=1.5e-127; Accession=PF04577.5; Description=Protein of unknown function (DUF563)
MVHYHRSHQPRKANNTDSIIKDEESQNNITLDCSSSAYYKRTRPKLLSFLFLITFLSCCYVFAPLFLGPSFPLSLLYSPATENDLKQDGVGANDSPCSSVSTGTICCDRSGYRSDVCVMKGDIRTHSASSSVFLYNSRSNNNVSRNFEEELQHEKIKPYTRKWETSVMDTIDELNLISKKVNSGSVGGCDVQHDVPAVFFSNGGYTGNVYHEFNDGIVPLYITSQHFKKKVVFVILEYHNWWIMKYGDILSRLSDFPPIDFQGDNRTHCFTEAIVGLRIHDELTVDSSLMRGNKSIADFRNLLDKAYWPRIKGLIRDEERKAQEKLREQVSSSESSEASQQQYITIRQQVQENPMKKPKLVILSRSGSRAITNENLLVKMAKEIGFLVQVLKPDRTTEMAKIYRTLNASDVMIGVHGAAMTHFLFLRPGSVFIQVVPLGTTWAAETYYGEPARKLGLKYIGYQILPRESTLYEKYDKNDPILRDPTSINKKGWEYTKKIYLDSQNVMLDLRRFRKRLHRAYEYTLSKSKLSLQHQPM

SEQ ID NO: 92390 - protein, 68 aa, Glycine max
  Coding DNA Sequence Number=SeqID_705
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q8W0V0; Match level="QueryCoverage=85%, HitCoverage=5%, E-value=4e-19, Identity=84%"; Hit description=Type IIB calcium ATPase
MEKTLLKDFELQHKNPSVEALRRWRSAVTLVKNHRRRFRMVADLDKRVQAEQIKQGIKCIVISVTAIA

SEQ ID NO: 92391 - protein, 122 aa, Glycine max
  Coding DNA Sequence Number=SeqID_706
  Subcellular localization annotation: CTP_CleavageSite=71; ConfidenceScore=5.33e-01
MGPCGTRGVIPYPAPTMPVGNHPCPCGKIFPSAGFHTGQSPRGSRLRFKLTPLVSLFLVIAVGDWMMRPCRVLQLVSLHWWAYKEILLPKRNRRKKLNERLFVLGSVVPNISKALIIKDAIE

SEQ ID NO: 92392 - protein, 1535 aa, Glycine max
  Coding DNA Sequence Number=SeqID_707
  Gene Ontology: Mol. function=nucleic acid binding; Cellular component= nucleus; Biological process=regulation of transcription, DNA-dependent
  Homolog annotation: Hit_ID=Q9M2L7; Match level="QueryCoverage=99%, HitCoverage=99%, E-value=0.0, Identity=60%"; Hit description =Helicase-like protein
  Pfam annotation: Domain name=DEAD; Domain location=597-747; Score= -32.1; E_value=0.011; Accession=PF00270.20; Description=DEADDEAH box helicase
  Pfam annotation: Domain name=Helicase_C; Domain location=1243-1321; Score=94.6; E_value=3e-25; Accession=PF00271.22; Description =Helicase conserved C-terminal domain
  Pfam annotation: Domain name=ResIII; Domain location=563-741; Score= -17.2; E_value=0.0013; Accession=PF04851.6; Description=Type III restriction enzyme, res subunit
  Pfam annotation: Domain name=SNF2_N; Domain location=569-876; Score =345.4; E_value=9.9e-101; Accession=PF00176.14; Description=SNF2 family N-terminal domain
  Pfam module annotation: Pfam domain module=DEAD::Helicase _C::ResIII::SNF2_N; Domain location=597-747::1243-1321::563-741::569 -876
MDHRPKSKESLSYSTLFNLESLMNFQLPEQDNDFDYYGNSSQDESRDSQGVGIANHSNGNVHEKEVNLFKKRRWSLNSDNEEKSSFYGTHMTEERYRSMLGEHIQKYKRRFKGTLNSPAQNQAAVPLVKSNTGLKAHKSGNERRGGGLHVAESTSEWMNDSGSQKPGNYRNADFSPQYGTDRIMYEPASLDIGDGIIYKIPPVYDKLAGALNLPSCSDIHVEDLYLKGTLDLGSLAEMMAADKRFGNRNRAGMGEAIPQFESLQARLKVMSASNSARKFSLKMSDVDLNSSIPEGAAGSIRRSILSEGGVLQVYYVKVLEKGDTYELCHIGLLQIIERSLPKKQKVKKDPALIEKEEMERCGKVWANIVRMKVSRSLKWTRTASMRTRKLARDMLLFWKRIDKEMTEVRKREEKEAAEALRREQELREAKRQQQRLNFLIQQTELYSHFMQNKSNLLSSETLPKEDEDADDQDALIDSSDAVPDEEEDPEEAELKKEALKAAQEAVSKQKMLTSAFDTECLRLRQAGETDSLPPDVAGASNIDLQTPSTMPVASTVRTPELFKGVLKEYQLKGLQWLVNCYEQGLNGILADEMGLGKTIQAMAFLAHLAEVAIHPHVLEKNIWGPFLVVAPASVLNNWNEELERFCPELKRLPYWGGLSERTVLRKSINPKDLYRREAKFHILITSYQLLVSDEKYFRRVKWQYMVLDEAQAIKSATSIRWKTLLSFNCRNRLLLTGTPIQNNMAELWALLHFIMPTLFDSHEQFNEWFSKGIENHAEHGGTLNEHQLNRLHSILKPFMLRRVKKDVISELTTKTEVTVHCKLSSRQQAFYQAIKNKISLAELFDSNRGQLNEKRILNLMNIVIQLRKVCNHPELFERSEGSTYLYFGEIPNSLPPPPFGEMEDVYYSGGHNPISYEFLWSENGSIVNGRYKEDFSMIPKLVYQEIIQSSETLSSAVGRGVSRESFHKHFNIFRPENVYRSVFSEDMCSKSGNFGFTHMMNLSPHEVTFLATGSFMERLLFSMMRWEQKFIDEAVDFLMETIDDDPECSYLEKEKVRAVTRMLLVPSRSETQFLQKKWQTGPSHAPFEALVVPHQDRVLSNARLLHSAYTYIPQSRAPPIGAHCSDRNFYYKMIEELHDPWVKRLLVGFARTSDNNVPRKPDSPHHLIQEIDSELPVSQPALQLTYSIFGSSPPMRNFDPAKLLTDSGKLQTLDILLKRLRAENHRVLLFAQMTKMLNILEDYMNYRKYRYFRLDGSSTIQDRRDMVKDFQHRSDIFVFLLSTRAGGLGINLTAADTVIFYESDWNPTLDLQAMDRAHRLGQTKDVTVYRLICKETVEEKILLRASQKSTVQNLVMTGGSVGGDLLAPEDVVSLLLDDVQLEQKLKEIPLQVKDKQKKKQPMRGIRVNEDGDASMEDLTSSVAQGTSDNDLSMDPEGSKSSNKKRKAFSDKPTSRPMNSQKMSEFSTTPMDDELDVVDPVGQKPKRPKRIKKNVNEKFEDAFTGIAALIPEQTQFPPPPSDFSAGGSKAESGQDN

SEQ ID NO: 92393 - protein, 338 aa, Glycine max
  Coding DNA Sequence Number=SeqID_708
  Gene Ontology: Mol. function=heat shock protein binding
  Homolog annotation: Hit_ID=A7PWL0; Match level="QueryCoverage=26%, HitCoverage=9%, E-value=1e-34, Identity=80%"; Hit description =Chromosome chr8 scaffold_34, whole genome shotgun sequence
  Pfam annotation: Domain name=DnaJ; Domain location=115-192; Score =59.4; E_value=1.2e-14; Accession=PF00226.22; Description=DnaJ domain
MDRIPVTRLRWLDDRWFLSGYSATVDSGQVGGKNLWILRLLFGQRHKDGTLGSADQMQKPLKNKQGGSRYHIEETKDTRINVQSGIELPSFLLLIVANSEHPNLNSVLYNVNIRGIKSADTATDIKKAYHKAALRHHPDKAGQLLARSEVGDEGQLWKEISQEVYKDADKLFKMIGEAYAVLSDPAKRSEYDLEEEIRKASKLYLQMRMGVEDRLMITDLPLTELLTDEMDGIIGRPMDIRILDGIDAILILPLIPYLLLDEFFEGKGIVHTENQAGKTLTREPMQLLLGLHTFSNGMYLWLYKDSVMCIQGYQTQEFTQIRESSIDWIRRLVRVYFI

SEQ ID NO: 92394 - protein, 545 aa, Glycine max
  Coding DNA Sequence Number=SeqID_709
  Gene Ontology: Mol. function=cytokinin dehydrogenase activity; Cellular component=vacuole; Biological process=cytokinin catabolic process
  Homolog annotation: Hit_ID=A7PWL1; Match level="QueryCoverage=94%, HitCoverage=93%, E-value=0.0, Identity=73%"; Hit description =Chromosome chr8 scaffold_34, whole genome shotgun sequence
  Pfam annotation: Domain name=Cytokin-bind; Domain location=261-537; Score=570.6; E_value=1.6e-168; Accession=PF09265.1; Description =Cytokinin dehydrogenase 1, FAD and cyto
  Pfam annotation: Domain name=FAD_binding_4; Domain location=86-229; Score=88.9; E_value=1.6e-23; Accession=PF01565.14; Description=FAD binding domain
  Pfam module annotation: Pfam domain module=Cytokin-bind::FAD_binding _4; Domain location=261-537::86-229
MVSSKPSGFYEQRSFPSIKILILILLNSILHKANSGCSNSVSNSLVPFLSHEILSSLQTLPLDGHFSLRDNEDAAKDFGNIHHFPPLAVLYPKTVSDISLTIKHVFEMGFAAQLKIAARGHGHSLQGQAQVHGGLVINMESLQGPEMKVHNGELPYVDVSGGELWINILHETLKLGLAPKSWTDYLHLTVGGTLSNAGISGQAFKHGPQINNIFQLEVITGKGEVVTCSGNRNADLFYGVLGGLGQFGIITRARISLEPAPKMVKWIRVLYSEFSTFTRDQEYLVSLNNTFDYIEGFVIINRTGILNNWRSSFDPKNQLQASQFSSDGKTFYCLEMAKYFNPGEAEAMNQSVAYLLSKLSYIPSTLFLSEVSYVEFLDRVHVSEKKLRAQGLWEVPHPWLNLLIPRSEIHNFAEEVFGNILKDTNNGPILIYPVNQTRWNSKTSLITPEEDIFYLVAFLSLALPNSTGADSLEHILAQNKRVIDFYTGAKMRVKQYLPHYSTQEEWQVHFGSRWETFVERKRAYDPLALLAPGHKIFQKAVSSSC

SEQ ID NO: 92395 - protein, 164 aa, Glycine max
  Coding DNA Sequence Number=SeqID_710
  Homolog annotation: Hit_ID=A7Q6E7; Match level="QueryCoverage=37%, HitCoverage=10%, E-value=1e-16, Identity=70%"; Hit description =Chromosome chr11 scaffold_56, whole genome shotgun sequence
  Subcellular localization annotation: CTP_CleavageSite=41; ConfidenceScore=5.05e-01
MSCLALFLQPANGPNILLQTREWFPPSCALSALSAFRQTRRAFAVNKHSTPDDAYAGESIGDQRPGHHRCRESLPRHVLPRERHLRARHHRRRPRQLGELVRVHPHRQSGREHRGNSVLRHRRHAVETQSQVCAVCNDESFAFMLVFSAQRKWDLTYWECCLKF

SEQ ID NO: 92396 - protein, 32 aa, Glycine max
  Coding DNA Sequence Number=SeqID_711
MVEALCLEDNHYWTCKHMHLVLLVVIAAAHAA

SEQ ID NO: 92397 - protein, 63 aa, Glycine max
  Coding DNA Sequence Number=SeqID_712
MAGWEGIGEREVSRPWRWRDRREGVVPPLKLAGQGAGGTATGGCGTGGERIRQLERRDRLAFI

SEQ ID NO: 92398 - protein, 649 aa, Glycine max
  Coding DNA Sequence Number=SeqID_713
  Gene Ontology: Mol. function=N-acetyltransferase activity; Cellular component=intracellular; Biological process=metabolic process
  Homolog annotation: Hit_ID=Q2HRG1; Match level="QueryCoverage=100%, HitCoverage=99%, E-value=0.0, Identity=75%"; Hit description=GCN5 -related N-acetyltransferase; BRCT
  Pfam annotation: Domain name=Acetyltransf_1; Domain location=129-207; Score=24.8; E_value=0.00033; Accession=PF00583.15; Description =Acetyltransferase (GNAT) family
  Pfam annotation: Domain name=BRCT; Domain location=446-519; Score =16.6; E_value=0.058; Accession=PF00533.17; Description=BRCA1 C Terminus (BRCT) domain
  Pfam annotation: Domain name=BRCT; Domain location=555-633; Score =29.4; E_value=1.3e-05; Accession=PF00533.17; Description=BRCA1 C Terminus (BRCT) domain
  Pfam module annotation: Pfam domain module=Acetyltransf _1::BRCT::BRCT; Domain location=129-207::446-519::555-633
MAPKRKPSSPISIGNCEITVEANRFTCNSDSNGVVISLPRSGKIKVSAVAPNRGSASEDLRSGDKEHEFVLVNPKDVDAISKSYLQEVLQMYTTELPGMNYAANTGKQSKFLERCVTNGKYRTLLIKSTSVGNSGKVIAAITYQIIPADTEYAEIPLAAVNAIYQRKGFGHLMFLELRKRLQSVGVRSILCWGDKESEGFWLKQGFVEIAQVGTKGRARRLPIKADIQKSLCFLGGSTLMVCHLGKELLADDANTVKYLPSQFHQNSFTSAIAEDEQLEFSGKLHVDLKFPDKSSHRTESSKNQHEALVKEGSSTEYDKLSGFDSHNAKECCTGISPFAKVNDDRQASPESSQDGIDANVKYSSQSTKGAKRAWEASLSSLKSKRVKGSQMVDYQPDSSCGFIFETDKANPCFDEVPHDPSITKSSEKCIGDYLHLEAPINIDFPSTKQCFRIMLMNIADDAKKTQLTKVIEDLGGSISHDGSMTTHVVTGKVRKTLNFCTALCSGAWVISSSWLKESYRQGRFVDELPHILNDTDYLLKYKSDLKNAVLRAKASPDALFKGYNICIAAHVQTPKTLSAIVRSAGGNVISGLETVNETSTTIFVACEEDTEEAMIAAQKGIWTFSSEWFMNCVMRQELDLEASQFAESL

SEQ ID NO: 92399 - protein, 281 aa, Glycine max
  Coding DNA Sequence Number=SeqID_714
  Gene Ontology: Mol. function=oxidoreductase activity, acting on single donors with incorporation of molecular oxygen, incorporation of two atoms of oxygen
  Homolog annotation: Hit_ID=A7P7I9; Match level="QueryCoverage=79%, HitCoverage=98%, E-value=2e-46, Identity=38%"; Hit description =Chromosome chr9 scaffold_7, whole genome shotgun sequence
  Pfam annotation: Domain name=2OG-FeII_Oxy; Domain location=99-179; Score=4.9; E_value=0.048; Accession=PF03171.11; Description=2OG -Fe(II) oxygenase superfamily
MGSEPELKLPTIDFSIEDLEFNVAKWELVKSQVHKALVEYGCFEALFDKVPLDLRKAIFLQVEEMFDLPLQTKQRVVSSRPYHGYVGPLQLYENMEKYMDEHMNSTNYLARLIKCQGPQTNEAKVGIGEHTDKNILTTLCQNQIDGLEAWTNGRVHTPNHRVMMSGNETRFTIGLFTVPKPGFIIKAPEELVTEEHPLLFKPFVQSEFMKFLHSSESTKNALKGNHHQCATTIDHAAPPPWLTASSNPFCEEEKKGSVVDGVRAVQGMLWEGRKGEGEGVG

SEQ ID NO: 92400 - protein, 252 aa, Glycine max
  Coding DNA Sequence Number=SeqID_715
MANENVNDIPDNESTGSNDDDAVTSPTTECQICSNPIPRNPNKQTSSKHPLQGPKPPTLVSPPPQSLSINPNNSFARVIPSRSQPINANRTHADVVRSTPPPKTSRTTPQDPTLAALWMNSNAARGCATSQAAALWTFDDAAENGEILHHRFHPYLRPVGQQPPRTVDFLSRMENGGSPSLYPSQIDEQMPLRTVDFLSGVNNHPWRMVDFLSQMEAASSARPEQVPRANPPIEMVVEWASSLRVGDGKRRK

SEQ ID NO: 92401 - protein, 113 aa, Glycine max
  Coding DNA Sequence Number=SeqID_716
MGSLSVEKDKVVIGDTSGGATLDHVVVTKKHLGQKMENMDNYNKRRLNAMEKTNTTMLKAMCNLVKQDYNQSTIDVVEDVAMSGTQNTSLYDQTLHCRNPNKPDAIPPCKGIG

SEQ ID NO: 92402 - protein, 335 aa, Glycine max
  Coding DNA Sequence Number=SeqID_717
  Gene Ontology: Mol. function=binding; Cellular component=nucleus; Biological process=regulation of transcription
  Homolog annotation: Hit_ID=A7PZU2; Match level="QueryCoverage=51%, HitCoverage=24%, E-value=5e-18, Identity=31%"; Hit description =Chromosome chr15 scaffold_40, whole genome shotgun sequence
  Pfam annotation: Domain name=PPR; Domain location=154-188; Score =33.4; E_value=8.4e-07; Accession=PF01535.11; Description=PPR repeat
  Pfam annotation: Domain name=PPR; Domain location=216-250; Score =33.4; E_value=8.4e-07; Accession=PF01535.11; Description=PPR repeat
  Pfam annotation: Domain name=PPR; Domain location=251-285; Score =12.9; E_value=0.23; Accession=PF01535.11; Description=PPR repeat
  Pfam module annotation: Pfam domain module=PPR::PPR::PPR; Domain location=154-188::216-250::251-285
MASFHDLEQKWCAKVGALMELQCLRVVSLVPVPRVSLHPSGPVFEITCIYVEALEAKDHWKHWTSNTIGSTGHHGIVHGEYVVMGMDDQRGSLFGSPIHAGALDIFKEDVYGFGVILLELLTVPHITTTYKKVVGTFKVQSKKSQVQSKKPDLVTWNSLVLGYSMTYRSEEALVVFNRIESLGLTPNVVSWTPHITTTYKKVVGTFKVQSKKPDLVTWNSLVLGYSMTYRSEEALVVFNRIESLGLTPNVVSWTAMISGCCENENYMDALQFFSQKADTSIWGVVLAACRLHKFIKIAEIAARNLLRLEPYNSANYVLMINLGGENPKCLELDTS

SEQ ID NO: 92403 - protein, 85 aa, Glycine max
  Coding DNA Sequence Number=SeqID_718
  Homolog annotation: Hit_ID=A6FJQ2; Match level="QueryCoverage=44%, HitCoverage=84%, E-value=2e-11, Identity=92%"; Hit description=50S ribosomal protein L5
MTLKPLTHAAPGDGHSLSVSGLPGADKPMRKEKIPHQAPFAIQAAQLLGRAIGAGLFAITPAGERGMCCKAIKLGNARVFPVTTL

SEQ ID NO: 92404 - protein, 93 aa, Glycine max
  Coding DNA Sequence Number=SeqID_719
MSPPPLDPHNHSQTHLMLLGWLPLVAQFSASLFTAKALKTLLNLDLSLLTATDCSLKGHMEVIRPPEDQHVALFYRDVESKESMMHVAALKSR

SEQ ID NO: 92405 - protein, 160 aa, Glycine max
  Coding DNA Sequence Number=SeqID_720
MWTIIDQYKEKLSLAATHEQRLEDEYAKMDRFAFTLNGSQELLRLLAKAKAMMDVYSAPEEVHGLLDYRENTITKRALRHPYRTRSKTRVMGDIEEVQEQIKAGMVALKDQMASMMEAMLSMKRLIECNAATVVAASAAAKVDPTHSFATNQAHQLASDM

SEQ ID NO: 92406 - protein, 200 aa, Glycine max
  Coding DNA Sequence Number=SeqID_721
MKKIQGLQALHGATSDQAEASGHMLTREGSGSRCTRDMALTRSDSCNRGIMRGIRANLCPSTVWFRMNQGKACGHVTFRILKRATKRTCEWMIFREQPHGWAGNTKEWKSKESKGEFRGYQHITWSSLKWKKIVHGGACGRSLATNLIRRGVLSKNSSLESKNTQVLFNTKQLPAFTNKSLNEYNNSTTLNEWIDNKAQI

SEQ ID NO: 92407 - protein, 251 aa, Glycine max
  Coding DNA Sequence Number=SeqID_722
WHLLSLPFSIPLSFIFQEAKESIDEEDHRPTSSNRAYIKAGVQPDYEVHQKGSVWEIKANMKNKETIFIPGDDNDDFPMPIHTGMKAKFLGGENNTRYSSPKTMNMSGPNDVKTTDDSSRQQPFMSNYVRGVKTKDMPCSFKPTIDMNLTFEETQVYAYVFNPNVDPRLLTVNSTAQGVFGVCPQLLRVLQTVFETQDLVFGFDGMDSWDIVEARGIPNCGSSEKSALWVLEWMQMEESFVSLLYGVVRIL

SEQ ID NO: 92408 - protein, 379 aa, Glycine max
  Coding DNA Sequence Number=SeqID_723
  Gene Ontology: Mol. function=nucleic acid binding; Cellular component= intracellular; Biological process=regulation of transcription
  Homolog annotation: Hit_ID=Q9M202; Match level="QueryCoverage=98%, HitCoverage=99%, E-value=2e-51, Identity=37%"; Hit description=Zinc finger protein-like
  Pfam annotation: Domain name=zf-C2H2; Domain location=256-278; Score =21.4; E_value=0.0035; Accession=PF00096.17; Description=Zinc finger, C2H2 type
  Pfam annotation: Domain name=zf-C2H2; Domain location=310-332; Score =19.6; E_value=0.011; Accession=PF00096.17; Description=Zinc finger, C2H2 type
  Pfam annotation: Domain name=zf-C2H2; Domain location=4-26; Score =19.5; E_value=0.013; Accession=PF00096.17; Description=Zinc finger, C2H2 type
  Pfam module annotation: Pfam domain module=zf-C2H2::zf-C2H2::zf-C2H2; Domain location=256-278::310-332::4-26
MDRHKCKLCFRSFANGRALGGHMRSHMMNLPISKPEELASSRTIQLSFEAESASSSSSSSSDEEDEDDEKTLCYDLRENPKRSIRLVDPEFSFATAADTGSVILHDRESESESSKNNPTRRISKRPWNNNDNYYNNDTTNSSVRKKGLGFEHESTKKCKTESWVDHDPASSVSDATTEEDVAFCLMMLSRDKWKRQRDQDQPCRFAERENQYEVEDQEEEDDEEDEEDEDDEEAFEESEESQETSKQCKNRVRGRYKCDTCNKVFRSYQALGGHRASHKKIKVNGGGREQELEHNKKKSGTCVVVEKKTHECPVCFRVFASGQALGGHKRTHVTGSAATAAAIATTLPSSSAKFGNSFIDLNLPAPIDEDDASQIENSA

SEQ ID NO: 92409 - protein, 117 aa, Glycine max
  Coding DNA Sequence Number=SeqID_724
MMHAPDLNSQMQCGTYRIQYQGNILKRVYTTPHLGNHAIFVEATQSCTVTPPLGDQPGATRSCLLGDTPPSTKYILPQFILFPVSYEGHPTRSMHPPMDIHNIRRMNVGTIKYNDHG

SEQ ID NO: 92410 - protein, 358 aa, Glycine max
  Coding DNA Sequence Number=SeqID_725
  Gene Ontology: Mol. function=transcription factor activity; Cellular component=intracellular; Biological process=regulation of transcription, DNA-dependent
  Homolog annotation: Hit_ID=A0JWE5; Match level="QueryCoverage=99%, HitCoverage=98%, E-value=4e-77, Identity=44%"; Hit description =Transcriptional regulator, LacI family
  Pfam annotation: Domain name=Peripla_BP_1; Domain location=68-342; Score=39.3; E_value=1.4e-08; Accession=PF00532.12; Description =Periplasmic binding proteins and sugar
  Subcellular localization annotation: CTP_CleavageSite=44; ConfidenceScore=5.24e-01
MTNENARSRGPTVATSPAPPMFPKLRRHARWAGMVPVSEDVQTRVNQAAEALGYRPNELARSMNTGRSNTIGVIVGDIENPHFGLALRGMADVARQAGFHLLLSNSDETLDEEREAVRVMLDKRVDGIIVAPCSSLFEDNEHLRQVLAEGRSLMMFDRAVQGMEVETIQANFVAVAKQATELLLAAGHQRIAYLSSMRSAAPYSPAITLGPTPVAQRVSGMIDAYRAAGKELDPALIRLNALSEAIIEQILTELLALAEPPSALIASDNLIAMGILRGLAKRGLRVPEDISFVMYDDFPWTELMSPPLTVVAQPVYEMGREAARRLICHIRQQSPGVLPAFDSWMVVRGSVGENPSAR

SEQ ID NO: 92411 - protein, 145 aa, Glycine max
  Coding DNA Sequence Number=SeqID_726
MLYVQGKVFIKQAKQGSIPHNLQWLQKKLWDGQCHKIEGIIDFMIRPICWFCRDIQQGHCTTHVHTQHTMYETWAPSMHLPWIISAIPSWVGIALSAPLALRDTSKVVIFKIPMVRLWKNVLGSSRQNLKMIQRLKNPGITILLK

SEQ ID NO: 92412 - protein, 362 aa, Glycine max
  Coding DNA Sequence Number=SeqID_727
  Homolog annotation: Hit_ID=Q6WAY6; Match level="QueryCoverage=80%, HitCoverage=61%, E-value=8e-23, Identity=27%"; Hit description =Putative uncharacterized protein
MGTNQTGKRFYQVKVKSLDTTSIKELGRLMEPLQMQAFRKTYGKILELTIAEVSIEAIASLTQYYDQPLRCFTFGDFQLNCNCGQGFSKRFGPHKTDSERYSGPTTEVPRRQGEGYGQSREIGVPFMDVLALLIFGVVLFPNVGWVWWDLAAIDAFLAYHHSKGKSGGAKRVAHGSSVACPPSVFDWDQLLAGIGGRTISWFPRWKEGKEGVLFSCGGYPNIPLVGTRGCINYNPALAIRQLGYPMRGAPTEESMSPFLVRDFGAQNSKTIQRIHKAWETPLRKDQELRGIRNGIIGGYHEWLKVHIRGLDWLAKLKVVSEESFEAPEEVEEVQALKSELGKAKLAKEKFKLAATHIRKECA

SEQ ID NO: 92413 - protein, 97 aa, Glycine max
  Coding DNA Sequence Number=SeqID_728
MERYLQHLVRQQAANHRGQVQIHDCLYQLNLSQQGQGFAPFACPAPDQFRAEVAWPGDWPEDQTEEAPAGAPDNAEDARMDEEMTDLLGFLGGSGAT

SEQ ID NO: 92414 - protein, 150 aa, Glycine max
  Coding DNA Sequence Number=SeqID_729
  Gene Ontology: Biological process=transposition, DNA-mediated
  Homolog annotation: Hit_ID=Q1J7G7; Match level="QueryCoverage=22%, HitCoverage=47%, E-value=7e-12, Identity=100%"; Hit description =Transposase
MVKVGTSYVPINVSFSPKVGPELPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDINLCIPPSPFRASGEIFTAFTLQV

SEQ ID NO: 92415 - protein, 222 aa, Glycine max
  Coding DNA Sequence Number=SeqID_730
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=78%, HitCoverage=16%, E-value=4e-94, Identity=98%"; Hit description=DNA -directed RNA polymerase subunit beta
  Pfam annotation: Domain name=RNA_pol_Rpb2_1; Domain location=34-218; Score=135.9; E_value=1.2e-37; Accession=PF04563.6; Description=RNA polymerase beta subunit
MKNGSKSVEYFSIKFTGKLKMLGDGNEGMSTLPGLNQIQFEGFCRFIDRGLPEGLFKFPKIEDTDQEIEFQLFVETYQLLEPLINEKDAVYESLTYSAELYVSAGLIWKSSRDIQEQTIFVGNIPLMNSLGTSIVNGIYRIVINQILQSPGIYYRSELDPSGISVYTGTIISDWGGRLELEIDRKARIWARGQKKMPFWSFIDNLLVLVEIQYFLNLYVGIL

SEQ ID NO: 92416 - protein, 161 aa, Glycine max
  Coding DNA Sequence Number=SeqID_731
MASKKLSAKRSRRDAAVEGTSAAPKFDSHHFRSAEHQQRFEVIKGWSFHRERRVQLRDDEYTDFQEEIARRHWTSLVTPMAKFDPDIVIEFYANAWPIEEGVRDMRSWVRGQWIPFDADALSQFLGDPLVLEEGQECEFSQRRNRADGFEEEAIVQLLCIP

SEQ ID NO: 92417 - protein, 201 aa, Glycine max
  Coding DNA Sequence Number=SeqID_732
MVAFVRQFFADERIKVGLKRGKFNHPAWTNEKIGANEEGENEGETHAVTAVPIWKLPHQLNKHHYSANISPSHYPPPSHPQRPSLNQPQNLSTAFPMTNTTFSTNQNTNQEMNFAAKKPIEFTLILVSYADLLPYLLDNAMVAITAARVPQPPFFQGYDSNATCAYHGGVLGHSIEHCITSKRKVQSLINAGWLKVEENHL

SEQ ID NO: 92418 - protein, 124 aa, Glycine max
  Coding DNA Sequence Number=SeqID_733
TGGTTRPVKDRSASPAEGTSRPVHTGGGPIDPTQAGITAAAGTRLALQWILVKGFRLYSFQLPDSMSPVLLFIVTTSPCQDWVICAPAAFLGCGSRFSAPSPESNPNSPSPVTTMVGHYPTIES

SEQ ID NO: 92419 - protein, 110 aa, Glycine max
  Coding DNA Sequence Number=SeqID_734
MHMTEFMRKEMHMTQMQFMNTGAREIVSIFKKVAQTLRWFAKERGSNQNPCVMHMRKPQHGSVKYDNIHKIVSPSCPYSRDLYGRELKGFSVIIPKVVISDAILPRKGIG

SEQ ID NO: 92420 - protein, 147 aa, Glycine max
  Coding DNA Sequence Number=SeqID_735
  Homolog annotation: Hit_ID=Q6UUU1; Match level="QueryCoverage=40%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYPGNYRLESNPGNMQKHHWQQPL

SEQ ID NO: 92421 - protein, 169 aa, Glycine max
  Coding DNA Sequence Number=SeqID_736
MASGFHVQKLCNSSLGTANRLHTVIVMAAQLIHDRVEMECLEGVWETLEGNARCRFRGTIRLTATSLVHPEEPACTLQRIVEWILPTPTPYRLVEPVQVIEVSSSEEDPEEDPEELPPEPAVDALDFPEGDEDPLPDVDSLEDVMSASEADSTEESGPGGTTTSGDSSS

SEQ ID NO: 92422 - protein, 72 aa, Glycine max
  Coding DNA Sequence Number=SeqID_737
MSLEEVHHHKRPWIRAWRKKMMNEGRGREEHEILCSKRALKSEPIKSKILHQVCLGVMRHVKHEGHAQSVTK

SEQ ID NO: 92423 - protein, 52 aa, Glycine max
  Coding DNA Sequence Number=SeqID_738
MAQPPPRERTLREMAAPDFTYESLCIQYPDEDVPYVLKTGLIHLLPKFHPSQ

SEQ ID NO: 92424 - protein, 48 aa, Glycine max
  Coding DNA Sequence Number=SeqID_739
MKKQQWKRRFSRRQRRRGERRRTPLGNKPWKKELGSRPYPNQINMKMQ

SEQ ID NO: 92425 - protein, 108 aa, Glycine max
  Coding DNA Sequence Number=SeqID_740
MEAIKEQMATMMKTMMSMKRIMEANAVIIAAISAVTKVNPMLPSGLKQMNHPTSNMGKQLVVYPLKTLWRALKFAHNHNHCILRVGRAPPAMAEKGKGGSSKGKGSGH

SEQ ID NO: 92426 - protein, 164 aa, Glycine max
  Coding DNA Sequence Number=SeqID_741
  Gene Ontology: Mol. function=endonuclease activity
  Homolog annotation: Hit_ID=Q9AY32; Match level="QueryCoverage=38%, HitCoverage=95%, E-value=9e-27, Identity=96%"; Hit description=RRNA intron-encoded homing endonuclease
  Subcellular localization annotation: CTP_CleavageSite=15; ConfidenceScore=5.03e-01
LKARSLDLGLGRSVRSGVHRSARPFCRRCAPVLNWPGRASGAVTLKKLECSKQAYALYTLAWDNTTGSDPIVLAFGIGVMINRDSRGHSYFIVRERKLGARRRSDTVLVSTINDADQGSADVAFRTPLAPYEKSKSLGSGGSMVARLKLKGIDGRAPPGVEPAA

SEQ ID NO: 92427 - protein, 103 aa, Glycine max
  Coding DNA Sequence Number=SeqID_742
MHRSLTGTLVPLGLEIEATLRRNRAERRRKLLQDRVVASILEEETHFSDSLSPDSPSSRESANQHFEAVTMEEEHDQRTTLEDYSSGSVPQFFTSIARPEVQA

SEQ ID NO: 92428 - protein, 92 aa, Glycine max
  Coding DNA Sequence Number=SeqID_743
GIVPARHPVDPKKSNRFLELPALITGLYQFYGVLVAPSKVIRPPTNRAFIKKYCAPRRAQGETPQQPGDGRQRATDAPPPPLEFTSAHPQKG

SEQ ID NO: 92429 - protein, 151 aa, Glycine max
  Coding DNA Sequence Number=SeqID_744
MVYGINLKILMSHNNSFQNCPMYGVACQCYDSTSDSPQISASPYQLDFTLYASGSYNAQWNAPGLLHDKHTLRSSRILRKMEVEEPWLGLFAAKFLFVGVFLVCAKGGLRHWNNDIVGFGGKLGRIGMAVTAWVSPSFSPSSFAPVFSVVL

SEQ ID NO: 92430 - protein, 212 aa, Glycine max
  Coding DNA Sequence Number=SeqID_745
VEIYHTEFDDFKTELERRNLHKRLTNLADGTIDVAFVKEFYANLYSSEDPSPKQARVRGHLVKIDVDSLNTFLETPAALCIPGRGFIVNVEGHPRRILRKDLTTLVQVWSVLSYSNLAPTSHTSDLTADRASLTFERLSPTINLAYIRKNCWNIDDLTIAFRGARRARARPADIPSSSAAPTPTLTSTSAAPSVPAHVDSQRFEAMLQSIHQ

SEQ ID NO: 92431 - protein, 89 aa, Glycine max
  Coding DNA Sequence Number=SeqID_746
MQEENEEEDSDDEEDFSFFVKKFQKFIKKRRIDRRQNFNNGRTSQEDSQVLRTKKAYIAWDDNDSSDGSEKEINLVTKDYESDENISQE

SEQ ID NO: 92432 - protein, 412 aa, Glycine max
  Coding DNA Sequence Number=SeqID_747
  Homolog annotation: Hit_ID=Q84VI1; Match level="QueryCoverage=100%, HitCoverage=63%, E-value=1e-172, Identity=73%"; Hit description =Envelope-like protein
MATSPKETSASGSPAVPSSPHQEQPEFNIQPIQVIPGQASVPEKLVPRRQQGVKIAENPSLATSPREVDTEMDKKIRSMVSSILKEASVPEADEDVPTSSTPNVSMPDVEKDVPTSSGPNDEVLSSPSKERSTEEDDQAAEETPAPRAPEPAPGWHLALQKGYKSRKGKTPIKRSGRIKTMAQKKSTPVTPATSRRSKVAIPSKKRKEISSSESDDDVELDVSTSKRAKKSGRKVPGNVPDAPLDNISFHSIGNVEKWKYVYQRRLALERELGRAAMDCKEIVDLIKAAGLLKTVSKLGECYEGLVREFIVNIPSDISNRKSDDYQRVFVRGKCIRFSPAVINKYLGRPTDGVIDIDVSEHQIAKEITAKRVQHWPKKGKLSAGKLSVKYAILHRIGAANWVPTNHTSTVAT

SEQ ID NO: 92433 - protein, 49 aa, Glycine max
  Coding DNA Sequence Number=SeqID_748
MLFEIQFRTLSPLGFLRIEQSEEELEESQGTARDAAVVGRHVSPLRGKG

SEQ ID NO: 92434 - protein, 313 aa, Glycine max
  Coding DNA Sequence Number=SeqID_749
  Gene Ontology: Mol. function=motor activity; Cellular component=cell projection
  Homolog annotation: Hit_ID=UPI00006A2D9E; Match level="QueryCoverage =100%, HitCoverage=95%, E-value=3e-15, Identity=16%"; Hit description= UPI00006A2D9E related cluster
HVLAFRGLHVLGFRGLHVLAFRGLPDLTFRGLNDFAFRGLHVLSFRGLHVPAFRGLQALAFRGLHVLTFRGLHALTLSGLKTLTFRGLHVLVFRGLHAIAFKGEHFHAFRGLHALAFRGLHTLAFRGLHRTACPHLQRTTCPHLKRATRARLQRTARPRLLRGIHVLTFRSLHALAFGGIHTLALKGLHVLAFIGLHVLAFRGLHVLTFRGLHVLIFIGLHVLTLRGLHALAFKGLHALACIGLHTLTFRGLHVLAFRGLHALTFRGLHVLNFRGLHVLTFRGLHVLTFRGLHVLTLRGLHALTLRGLHVLAF

SEQ ID NO: 92435 - protein, 58 aa, Glycine max
  Coding DNA Sequence Number=SeqID_750
  Subcellular localization annotation: CTP_CleavageSite=52; ConfidenceScore=5.15e-01
MAIIMAICSFMASMSAFIFSCISSTSPITLALAQVRNGFMIPTWLAHGENARVTHEQT

SEQ ID NO: 92436 - protein, 64 aa, Glycine max
  Coding DNA Sequence Number=SeqID_751
MGEGMKTPVAKRNYCTKPLLCVEEVEAKRALCAKLECHSDEAELSAACCAKLKLSSVLKIVDSG

SEQ ID NO: 92437 - protein, 71 aa, Glycine max
  Coding DNA Sequence Number=SeqID_752
MFYFLVCKEDLLQDIEAVATPEEEPRSSEASSSFPIAGHSHIEPIEDSNSWLRARRVTLEIFKFYCAIIFH

SEQ ID NO: 92438 - protein, 52 aa, Glycine max
  Coding DNA Sequence Number=SeqID_753
MELDLMGRVLVNSKVFLFVESSWRGSEASFMMMNQVDSSSFDDDKKPKRMIS

SEQ ID NO: 92439 - protein, 517 aa, Glycine max
  Coding DNA Sequence Number=SeqID_754
MTINWRTIQALENDFYTKDDIEEEVGFIAYVEVFSREEHKKKLDEDARLGALVGKVSKEIPKVVILESLKTLSIEEVHKKAANKAIMVDGELVFEEHGAKLIFADVVARQVEVEMDIILEDLDPEKKKALEEAMVWSIIEASLNEIEDSIIETNLGVAPVRPIPLSKTDERKKYKLDQQHAIKWLLPSRSLPPPSPLRVVPIEPDVNVRYYPCFKGYKVLEWHTCNRVWKENVDIGTHSSSRDATIGVRKTQSHQALEDSHNEEGEKIERVARTSNAAFEDSPTTTLLLLVLHAHNNNFHIHGLLPVSEKNNKSTMAEWDEMKDDEKRNVQDDQKAKNILTSGLSSDEFFCTARCKSAKEIWKMLEVTHESTTDASSSKEDHKEGSIDDEDAENLNLIVKKIGKFLKRSKDKKISKPSKKVETNNNTFKCFECRKQGDASSIGACRPRIFFINGFLCFLEDEWQRNGERKRERRCHFKEKMSLEEAHHHRRPWIRAWRKKEMNEGRGREEHEILCSK

SEQ ID NO: 92440 - protein, 30 aa, Glycine max
  Coding DNA Sequence Number=SeqID_755
MTARSCRSARRASLRRRFERALEKKYSRGV

SEQ ID NO: 92441 - protein, 74 aa, Glycine max
  Coding DNA Sequence Number=SeqID_756
MHHQKRKTLDVTSLLSSESETQHDHRSTSIPYGSHRPGEKMSGVATNVYLRENIRKTKKRSGNYENKGLRVVYA

SEQ ID NO: 92442 - protein, 36 aa, Glycine max
  Coding DNA Sequence Number=SeqID_757
MPEVKRKHCCTIREGGANSNQAHLGLPGSSPEGGAF

SEQ ID NO: 92443 - protein, 42 aa, Glycine max
  Coding DNA Sequence Number=SeqID_758
MATPMSTARYLNKDETDQSIDIKKYRDAKQIPKNLTLTQLKE

SEQ ID NO: 92444 - protein, 138 aa, Glycine max
  Coding DNA Sequence Number=SeqID_759
CQSFGVSVAPTKVIRPPITRAFIEKYCTQRQAQGDAPQAAGAPPPPHQAGQAGAFDMEQYLRHLVRQQAANHRAHSQGFVSFSCPTPDQFRAEVAWPGDWPEAQVGEAPPKAPGDGEEAHEDEEMADLLEFLGGSGDT

SEQ ID NO: 92445 - protein, 25 aa, Glycine max
  Coding DNA Sequence Number=SeqID_760
MGVKYLEVVKHRLQAIKYWSPDEIR

SEQ ID NO: 92446 - protein, 154 aa, Glycine max
  Coding DNA Sequence Number=SeqID_761
MGTRGCISYNPVLAIRQLGYPMRGAPLEEEFAPDKELRGSNNGPIGGYRKWFIAHVQGLDWLSSLRTAKREEVEAPEEDEEVQALRTELKQAQTVKERFKSAALKIRKENAELRDINIATTKALEQETKRARREEHDWNKFRRALWGSNSELKL

SEQ ID NO: 92447 - protein, 83 aa, Glycine max
  Coding DNA Sequence Number=SeqID_762
MASNNRLPIVCNRLHKIAMAAQLIHDRMVMECLEGVWETLEGNERCRFRGIIRLTATSLVHPKESTRTLQQPVEWILPTPTPY

SEQ ID NO: 92448 - protein, 171 aa, Glycine max
  Coding DNA Sequence Number=SeqID_763
MDISEDIDIPVILGRPFMLTASCIVDMGKRKLELGFEDQKIDFDLFVENKPAPEHNVCLQVMEEGQEVLKVRTKTYDHPVSPFTKRISVHALSRESQALSAQPLHLRLIHSAKLAKAKLSLIEFDLNSAKRQPNRQATPYPWLSATQCRQAQFLTARSEVHEAKRQSWQLS

SEQ ID NO: 92449 - protein, 77 aa, Glycine max
  Coding DNA Sequence Number=SeqID_764
MTWKVGSGERIKFWTDRWLGANYTLEQKYNQLFQISRQQSSFISSMGKDCMVWLAEPHGHYTTKSAYNFYTIPSTAN

SEQ ID NO: 92450 - protein, 71 aa, Glycine max
  Coding DNA Sequence Number=SeqID_765
MVSESDSDPPSPSSAKIMASLAKQMDKLQRNVERRMGERFYEIQIGTQELSGRMEDIERRRHHQSPYSSQG

SEQ ID NO: 92451 - protein, 112 aa, Glycine max
  Coding DNA Sequence Number=SeqID_766
MQRRSTAGGLIPIDLEINATCRRRNTDRIRKILQDLEAATTPEEEPRSFEVSSSFPIPGKSHTDLIEEVIIAEESRRVTLEDYSSSSVPQFFTSIPQPEVQAQIITYPPSSI

SEQ ID NO: 92452 - protein, 143 aa, Glycine max
  Coding DNA Sequence Number=SeqID_767
SHKSAKPFRFKVLQNWDDIVDLCAKDRSTDLEEPSSNTKGKRQGSTSSGTHPHKRKMGEKEGIAASSDKMANSFNRMVEKMDGKVDNEDIQEVLREAALIPDLSRQQWAKAIKWLADDPKQLAIVKALPIHQKTDYVLTHLGE

SEQ ID NO: 92453 - protein, 110 aa, Glycine max
  Coding DNA Sequence Number=SeqID_768
MTLLLSNILPSDHNANLPLQKYQLVCVVSTWGSYPQRHPVDLKKSNRPWGFQLWLRVSVGRPFPPASSCRRGIGDCARKTPSGPEEGQQGLGVAGSKYGSLSVLGSACRP

SEQ ID NO: 92454 - protein, 145 aa, Glycine max
  Coding DNA Sequence Number=SeqID_769
METILQNPQLNSAEFYVITDLIPQPQPSSPQPSCPQLQLSPPKQLPYNNIDLNNPVSSYNNLESQDPFDIYTSYTQILSENDSFFHGQLSQRALRGRARARLTGALSKGGKMRGVATNVYLWKTSGGGGGTGQNENSKFGSCIYA

SEQ ID NO: 92455 - protein, 172 aa, Glycine max
  Coding DNA Sequence Number=SeqID_770
  Homolog annotation: Hit_ID=UPI00006A2939; Match level="QueryCoverage =89%, HitCoverage=91%, E-value=2e-11, Identity=31%"; Hit description =UPI00006A2939 related cluster
MRGTVHEPQVNIGADQKGLHVHANRGLHALTLRGLCVLTFRGLHVLTFRGLHALAIRGLRVLTFRGLHALAIRGLHVLTFRGLHALAIRGLHVLTFVGLHALTFRGLHFLANRGLHALTLRGLHVLANVGLHALTFRGLHVLAFRGLHVLTIRGLHALTSRGLHVLALRGLH

SEQ ID NO: 92456 - protein, 81 aa, Glycine max
  Coding DNA Sequence Number=SeqID_771
MTPTHDALLYYNGRWNMSRQNEFVGYSFTGKNPKKLDIPSGCTMDELKDLIKQVVPPGIPPYGIHETQNGKAIVFSKTKSP

SEQ ID NO: 92457 - protein, 124 aa, Glycine max
  Coding DNA Sequence Number=SeqID_772
PFAPSDLFDSEWKLLSFAEIAYSGWSFASLTLLRKVEEEPQLLVVFVVTVAAIAALEEEHMACLDQQHSRKEGQAVVVVEVLSISDLDDSSNLDYICCLKGHNYSAIVGFAAEEVYYKCLQHKL

SEQ ID NO: 92458 - protein, 77 aa, Glycine max
  Coding DNA Sequence Number=SeqID_773
MDISEDTDIPVILGRPFMLTTSLLQNTMFAYSPFAKRKPRAKRISVHALNCESQALSAQPLHLKLIWSAKLAKVELS

SEQ ID NO: 92459 - protein, 1521 aa, Glycine max
  Coding DNA Sequence Number=SeqID_774
  Gene Ontology: Mol. function=nucleotide binding; Cellular component =cytoplasm; Biological process=defense response
  Homolog annotation: Hit_ID=A5BH36; Match level="QueryCoverage=97%, HitCoverage=93%, E-value=1e-172, Identity=30%"; Hit description =Putative uncharacterized protein
  Pfam annotation: Domain name=AAA; Domain location=176-402; Score= -38.8; E_value=0.051; Accession=PF00004.20; Description=ATPase family associated with various cellular activities (AAA)
  Pfam annotation: Domain name=LRR_1; Domain location=1026-1046; Score =3.0; E_value=85; Accession=PF00560.24; Description=Leucine Rich Repeat
  Pfam annotation: Domain name=LRR_1; Domain location=1113-1140; Score =6.2; E_value=22; Accession=PF00560.24; Description=Leucine Rich Repeat
  Pfam annotation: Domain name=LRR_1; Domain location=1285-1309; Score =1.0; E_value=2e+02; Accession=PF00560.24; Description=Leucine Rich Repeat
  Pfam annotation: Domain name=LRR_1; Domain location=1311-1333; Score =3.1; E_value=81; Accession=PF00560.24; Description=Leucine Rich Repeat
  Pfam annotation: Domain name=LRR_1; Domain location=1335-1358; Score =5.8; E_value=26; Accession=PF00560.24; Description=Leucine Rich Repeat
  Pfam annotation: Domain name=LRR_1; Domain location=1359-1383; Score =3.3; E_value=74; Accession=PF00560.24; Description=Leucine Rich Repeat
  Pfam annotation: Domain name=LRR_1; Domain location=584-605; Score =6.5; E_value=19; Accession=PF00560.24; Description=Leucine Rich Repeat
  Pfam annotation: Domain name=LRR_1; Domain location=607-628; Score =0.7; E_value=2.3e+02; Accession=PF00560.24; Description=Leucine Rich Repeat
  Pfam annotation: Domain name=LRR_1; Domain location=630-651; Score =12.1; E_value=1.8; Accession=PF00560.24; Description=Leucine Rich Repeat
  Pfam annotation: Domain name=LRR_1; Domain location=653-676; Score =13.7; E_value=0.71; Accession=PF00560.24; Description=Leucine Rich Repeat
  Pfam annotation: Domain name=LRR_1; Domain location=831-853; Score =0.8; E_value=2.1e+02; Accession=PF00560.24; Description=Leucine Rich Repeat
  Pfam annotation: Domain name=LRR_1; Domain location=855-875; Score =3.4; E_value=72; Accession=PF00560.24; Description=Leucine Rich Repeat
  Pfam annotation: Domain name=LRR_1; Domain location=942-963; Score =1.4; E_value=1.7e+02; Accession=PF00560.24; Description=Leucine Rich Repeat
  Pfam annotation: Domain name=NB-ARC; Domain location=136-470; Score =50.8; E_value=1.7e-13; Accession=PF00931.13; Description=NB-ARC domain
  Pfam module annotation: Pfam domain module=AAA::LRR_1::LRR_1::LRR _1::LRR_1::LRR_1::LRR_1::LRR_1::LRR_1::LRR_1::LRR_1::LRR_1::LRR _1::LRR_1::NB-ARC; Domain location=176-402::1026-1046::1113 -1140::1285-1309::1311-1333::...
  Pfam module annotation: Domain location=1335-1358::1359-1383::584 -605::607-628::630-651::653-676::831-853::855-875::942-963::136-470
MNYLNKVGEKAFGCVLDLGIRHVAYIFSYGKKVDELNNSIKDLGHAKERVDHLRDEAKKNLHNIEGQVTEWFRKVEECKTEVEEFGNDEGHRKTRLLHDLFPYLWNRYRLGKQAVEMTEDVKNLIDECSKFKEVAYRENITSNDVTLSNAGYVEFGSRKSILEGVMAQLEDSTVRMIGLHGPGGVGKSTLIKDIAKKSLDKKLFDVVVKLEITANPNLQKIQEEIAYVLGLRLEGEGENVRADCLRRRLKQEKESILVILDDLWDRLDLNKLGVPLDGDVDHNDLSKKTLDGDVDHNDLSKKTSKAKMGPKEANKEKSLGDCKGCKILLTSRDKNVLTDKMEVKSTFCVEELDDDDALRLFQKEARIQGEMSKWKQEIVKKYCAGLPMAIVTVGRALRDKSDSEWEKLKNQDLVGVQNSMEISVKMSYDRLENEELKSIFFLCAQMGHQPLIMDLVKYCFGLGILEGVYSLGEARSRISTLIQKLKNSGLVLDGSSSIHFNMHDLVRDAALSIAQKEQNVFTLRNAKLDDWPQLERCTSISICNSDIIDELPEEINCPQLKFFQIDSDDPSLKIPDSFFKGMKKLKVLMLTGIQLSRLPSSIESLSDLRLLCLERCTLDHNLSIIGKLKKLRILSFSGSRIENLPAKLKDLDKLQLLDISNCSMVKMIPPNLISKLTLLEELYVRKSFIEVLEEGERNHSQISFLSELKHLHQLQVVDLSIPCAEAFPDELFFDNLTDYKIEIGNFKTLSVGDFRMPNKYEKFKSLALKLKDDTDNIHSQKGIKLLFKRVENLLLGELNDCSFTNLKTIKVEMCDQLKNLFSSCMVKLLVSLETIGVSHCFSLEEMVKIPDNSDKIEFLKLKSLSLQSLSSFTSFYTTVEGSSTNRNHIQITVIETEHSEMAPPLFGELVEIPNLENLNLISMNKIQKIWSDQPPSNFCFQDLIKLVVKDCHNLRYLCSLSVASSLRKLKGLFVSNCKMMEKIFSTEGNSADKVCIFPKLEEIHLDQMIELTDIWQAEVSVDSFSSLTSVYIFRCDKLNKIFPSHMEGWFASLNSLKVHYCESVEVIFEIKDSLQVDASGGIDTNLQVVDVCNLPKLEHVWSRDPGGILNFKNLQSIEVSGCNRLRNVFLASVAKDVPKLEYMSVQSYGIVEIVACEDGSEKNTEQLVFPELTYMTLYNLSSIQHFYRGRHPIECPKLKKLEVNKCNKELKTFQTRECSNEEDEVVLSAENIFPNLEYLDIDFDEAQEWLLSNTVKHRMHNLKELRLCYVNDGERLCQILYRMPNLEKLYLFNSEHLLKESSESRLGTVIQLKELVLWSSKIKDIGFEREPVLQRLELLSLHWCHKLRNLAPPSVSLAYLTNLEVRNCGRLRNLMASSTAKSLVQLKSMKISECDELEEIVSNEGNEEEEQIVFGKLITIELEYLLNLKSFCSYNNCEFKFPSLEILIVRECRMMQTFTEGGARAPKLQNIGGGVEKGKEEAMWQWEGDLNATIQKGFYQELGRRISRKKDERGFELEYYH

SEQ ID NO: 92460 - protein, 2382 aa, Glycine max
  Coding DNA Sequence Number=SeqID_775
  Gene Ontology: Mol. function=nucleotide binding; Cellular component =cytoplasm; Biological process=defense response
  Homolog annotation: Hit_ID=A5AWL3; Match level="QueryCoverage=98%, HitCoverage=94%, E-value=1e-180, Identity=28%"; Hit description =Putative uncharacterized protein
  Pfam annotation: Domain name=AAA; Domain location=179-391; Score= -29.0; E_value=0.007; Accession=PF00004.20; Description=ATPase family associated with various cellular activities (AAA)
  Pfam annotation: Domain name=LRR_1; Domain location=1055-1078; Score =2.8; E_value=92; Accession=PF00560.24; Description=Leucine Rich Repeat
  Pfam annotation: Domain name=LRR_1; Domain location=1142-1169; Score =3.0; E_value=84; Accession=PF00560.24; Description=Leucine Rich Repeat
  Pfam annotation: Domain name=LRR_1; Domain location=1341-1363; Score =0.6; E_value=2.3e+02; Accession=PF00560.24; Description=Leucine Rich Repeat
  Pfam annotation: Domain name=LRR_1; Domain location=1365-1388; Score =5.2; E_value=34; Accession=PF00560.24; Description=Leucine Rich Repeat
  Pfam annotation: Domain name=LRR_1; Domain location=1389-1413; Score =0.9; E_value=2.1e+02; Accession=PF00560.24; Description=Leucine Rich Repeat
  Pfam annotation: Domain name=LRR_1; Domain location=1562-1587; Score =6.7; E_value=18; Accession=PF00560.24; Description=Leucine Rich Repeat
  Pfam annotation: Domain name=LRR_1; Domain location=1589-1610; Score =2.1; E_value=1.3e+02; Accession=PF00560.24; Description=Leucine Rich Repeat
  Pfam annotation: Domain name=LRR_1; Domain location=1716-1738; Score =0.9; E_value=2.1e+02; Accession=PF00560.24; Description=Leucine Rich Repeat
  Pfam annotation: Domain name=LRR_1; Domain location=1767-1787; Score =0.9; E_value=2.1e+02; Accession=PF00560.24; Description=Leucine Rich Repeat
  Pfam annotation: Domain name=LRR_1; Domain location=1797-1822; Score =0.2; E_value=2.7e+02; Accession=PF00560.24; Description=Leucine Rich Repeat
  Pfam annotation: Domain name=LRR_1; Domain location=1825-1848; Score =5.3; E_value=31; Accession=PF00560.24; Description=Leucine Rich Repeat
  Pfam annotation: Domain name=LRR_1; Domain location=1849-1873; Score =0.4; E_value=2.6e+02; Accession=PF00560.24; Description=Leucine Rich Repeat
  Pfam annotation: Domain name=LRR_1; Domain location=2030-2055; Score =6.2; E_value=22; Accession=PF00560.24; Description=Leucine Rich Repeat
  Pfam annotation: Domain name=LRR_1; Domain location=2057-2078; Score =5.0; E_value=36; Accession=PF00560.24; Description=Leucine Rich Repeat
  Pfam annotation: Domain name=LRR_1; Domain location=2191-2211; Score =1.5; E_value=1.6e+02; Accession=PF00560.24; Description=Leucine Rich Repeat
  Pfam annotation: Domain name=LRR_1; Domain location=573-594; Score =7.5; E_value=12; Accession=PF00560.24; Description=Leucine Rich Repeat
  Pfam annotation: Domain name=LRR_1; Domain location=596-617; Score =0.7; E_value=2.3e+02; Accession=PF00560.24; Description=Leucine Rich Repeat
  Pfam annotation: Domain name=LRR_1; Domain location=619-640; Score =12.7; E_value=1.3; Accession=PF00560.24; Description=Leucine Rich Repeat
  Pfam annotation: Domain name=LRR_1; Domain location=642-665; Score =12.4; E_value=1.5; Accession=PF00560.24; Description=Leucine Rich Repeat
  Pfam annotation: Domain name=LRR_1; Domain location=667-697; Score =0.6; E_value=2.4e+02; Accession=PF00560.24; Description=Leucine Rich Repeat
  Pfam annotation: Domain name=LRR_1; Domain location=804-825; Score =3.1; E_value=80; Accession=PF00560.24; Description=Leucine Rich Repeat
  Pfam annotation: Domain name=LRR_1; Domain location=870-891; Score =0.1; E_value=2.9e+02; Accession=PF00560.24; Description=Leucine Rich Repeat
  Pfam annotation: Domain name=LRR_1; Domain location=896-917; Score =4.6; E_value=43; Accession=PF00560.24; Description=Leucine Rich Repeat
  Pfam annotation: Domain name=LRR_1; Domain location=920-940; Score =2.6; E_value=1e+02; Accession=PF00560.24; Description=Leucine Rich Repeat
  Pfam annotation: Domain name=LRR_1; Domain location=972-995; Score =2.4; E_value=1.1e+02; Accession=PF00560.24; Description=Leucine Rich Repeat
  Pfam annotation: Domain name=NACHT; Domain location=178-357; Score= -29.1; E_value=0.011; Accession=PF05729.3; Description=NACHT domain
  Pfam annotation: Domain name=NB-ARC; Domain location=139-459; Score =72.9; E_value=1.1e-18; Accession=PF00931.13; Description=NB-ARC domain
  Pfam module annotation: Pfam domain module=AAA::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::...
  Pfam module annotation: Pfam domain module=LRR_1::NACHT::NB-ARC; Domain location=179-391::1055-1078::1142-1169::1341-1363::1365 -1388::1389-1413::1562-1587::1589-1610::1716-1738::1767-1787::1797 -1822::1825-1848::...
  Pfam module annotation: Domain location=1849-1873::2030-2055::2057 -2078::2191-2211::573-594::596-617::619-640::642-665::667-697::804 -825::870-891::896-917::920-940::972-995::178-357::139-459
MESVLSPIVERTFNFAVDPIIRQLAYILRCRQNVDELLTSFESLELEKESIDRRCDQAQNNLQNIEAKVKEWSRKVDEFKTELEKFRNDEGHRKTGLSNVLFLFPYFWNRHRLGRQAKKMAEIVKNLIDESAKFNDVSYTDNLTSNDFTLSNPGYMGFASRHSTVEKIIAKLEDSSVRMIGLHGSGGMGKTTLIKAIAKKAMEKKLFNVVAISEITANPNPQKIQEDIASALRLRLEGEGENSRAHRLMTRLKQEKENTLIILDDLWDRLDLNKLGIPLDGDVDDNDLNTKTSNAKQGPKEATKEKSLGDYMGCKILLTSRDKNVLTDKMEVKSTFYVEELDDDDALRLFRKEARIQGEMSEWKQEIVKKYCAGLPMAIVTVGRALREKSDSEWEKLKNQDLVGVQNSMEISVKMSYDRLENEELKSIFFLCAQMGHQPLIMDLVKYCFGLGILKGVYSLGEARGRISTSIQQLKNSGLVLDGSSSIHFNMHDLVRDAALSIAQKEQNVFTLRDGKLDDWPELERCTSISICNSDIIDELPEEINCPQLKFFQIDSDASSLKIPDSFFKGMKKLKVLMLTGIQLSSLPSSIESLSDLRLLCLERCTLDHNLSIIGKLKKLRILSFSGSRIENLPAELKDLDKLQLLDISNCSVVKRIPPKFMSRLTSLEELYVRKSFIEVSVEGERNHCQISFLSQLKHLHQLHVVDLSIPCAQFFPKELFFDKLNDYKIEIGNFKTLSVGDFRMPNKYEKFKSLALELKDDTDNIHSQKGIKLLFKRVENLLLGELNGVQDVINELNLDGFPHLKHLSIINNPSIKYIINSKDLFYPQDVFPKLESLCLYELRKIEMIYFSSGTEMICFSPFTDCSFTKLKTIKVEKCDQLKNLFSFCMVKLLASLETIGVSNCGSLEEIIKIPDNSDKIEFLKLMSLSLESLSSFTSFYTTVEGSSTNRDQIQITVMTPPLFGELVEIPNLENLNLISMNKIQKIWSDQPPNLRKLKGLFVSKCKMMEKIFSTEGNSADKVYVFPKLEEIHLNEMDELTDIWQAEVSADSFSSVTSVNIDSCNKLDKIFPSHMEGWFASLNSLKVYSCESVEVIFEIKDSQQVDASGGIDTNLQVVDVRRLPKLEQVWSRDPGGILNFKKLQSIEMDDCKRLRNVFPASVAKDVPKLEYMSVESCDGIVEIVASEDGSETNTEQLVFPELTYMYLGYLSSIQHFYRGRHPIECPKLKKLAVEKCNKKLKTFGTGERSNEEDEAVMSAEKIFPNLEYLHIDFDEAQKWLLSNTVKHPMHRLKVLSLCKVNDGERLCQILYRMPNLEKLRLTEAEHLLQESSESRLGTVLQLKELYLWLSKIKGIGFERESVLQRLELLSLSECHILRNLAPPSVSLAYLTNLKVEDCKGLRNLMASSTAKSLVQLKSMKISECHELEEIVSNEGNEEAEQIVFGKLITIELEGLKKLKSFCSYKNYEFKFPSLEVLIVRECPLMQRFTEGGARAAKLQNIVTADEEGKEEAKWQCEGDLNATIQEGFNKSASTESSLSLRDSPLQVIWLDSRWIPKSCFSNLNSLTVDGCQFLTDVVIPFYLLPLLTNLEELKVRKCGSVKSIFDVKTTTGLGAAAFPRPLPFSLKKLTLERLPKLENVWNEDPHGILTMQLLQHVIVAEDNADPREANLELTFPCPCVSSLKLQGLPKFKYFYYCSLQCHMFQTPTEDEMPTSNLQCLSLGEIGLEMIKRGEFQTNFLHKLQVLTLCFHIGSNVFPYEILQLAPNIEKLVVYDGSFKEIFCFDSLNVDEAGLLLQLKVLCLESLPELVSIGLENSWIQPLLGNLETLEVIGCSSLKDLVPSTVSFSNLTHLQVQDCDSLLYLFTSSTARSLGQLKTMKISCCYSIEEVVVSKDGDESHEEEIIFPQLNCLKLEYLSKLRSFYKGSLLSFPSLEELSVIYCEWMETLCPGTLKADKLVQVQLEPTWRHSDPIKLENDLNSTMREAFWKKLWHSASWPWESDLDLKDSPVQEIWLRLHSLHIPPHFRFTYLDTLIVDGCHFLSDAVLPLSLLPLLPNLETLKVRNCDFVKIIFDVTTMEPLPFALKTLILERLPNLENVWNSNVELTFPQVKSLALCDLPKLKYDILKPFTHLEPHALNQLTPNIEHLTLGQHELNMILSGEFQGNHLNELKVLALFFHFESDVFLQRVPNIEKLEVCDGSFKEIFCFDSLNVDEDGLVSQLKVICPDSLPELVSIGPENSGIVPFLRNLETLQSLLYLFTSSTARSLGQLKTMEIGWCDSIEEIVSSTEEGDESDENEIIFQQLNCLKLEVLRKLRRFYKGSLSFPSLEEFTVLYCERMESLCAGTIKTDKLLLVNLVAPLLNFGYDIPLETDLNSAMQNR

SEQ ID NO: 92461 - protein, 47 aa, Glycine max
  Coding DNA Sequence Number=SeqID_776
MVAQVMLGNGYEPGMGLGKNNGGRTRGNRGKFGLGYKPTQADIRKSV

SEQ ID NO: 92462 - protein, 150 aa, Glycine max
  Coding DNA Sequence Number=SeqID_777
MQIPSSISSSSLFSSEEQRIWYTNLFSSCSIIDPKFIDMDFFSNESFECIQAFENSNLIPFMSLKLPVYSELVKAFYSNLEIQESTLISNVYGIKMVIDQSLFYDLTQLSSEGVPFEGALNNDWKFDFSVHDARRLVCTNQADMTGRLLA

SEQ ID NO: 92463 - protein, 108 aa, Glycine max
  Coding DNA Sequence Number=SeqID_778
MKSCVASFQNFALRTRHHLRRSPTGNLLPLDLEIEATLRRNRVERRRKLLQDRTVASILEEETHFYDLLSPNSPSSRESATQLPEAITMAEEYDQRITLEDYSSSSVP

SEQ ID NO: 92464 - protein, 241 aa, Glycine max
  Coding DNA Sequence Number=SeqID_779
VVVSPPKPPPKPDPEVDDPLYLMTLTIPELFLRPYQVRWDATVCEVVNPDFPLYIKHEDLSEIAHGGQCLNISVLQLWILHLTETCMRAGNCDIYGFLEPQSIQRSGQSQFESKSYIKSWMQSSQRDVYLGAYLNGFHYSGHWQMVVILPKEVLSALKGVDDAPQPKSKASARWIVVKCNRQKGSTECGYYVMHWMSTIILGTLRNNWEAYLYDPRPLEPERLKALRIQWAQFYLQVRDQA

SEQ ID NO: 92465 - protein, 134 aa, Glycine max
  Coding DNA Sequence Number=SeqID_780
  Pfam annotation: Domain name=G-patch; Domain location=11-55; Score =27.9; E_value=3.6e-05; Accession=PF01585.14; Description=G-patch domain
MSPLLPCLSNATIMVERVMLKHGYEPGMGLGKDSLGNADVVDIRRNPYKYGLGYELGKPGRRNAPSRLWADRAWPDHVSQCFTSAGIMFEEEVAAIGEESPPDPPIFVRPCHPDSQVGNWRVISQLEVYTPDSM

SEQ ID NO: 92466 - protein, 57 aa, Glycine max
  Coding DNA Sequence Number=SeqID_781
MTCMVAQEIFDKIDSLQEETTQGNFVPHGREDILNIAIGRPEHPGRIRATGNDVTID

SEQ ID NO: 92467 - protein, 93 aa, Glycine max
  Coding DNA Sequence Number=SeqID_782
  Homolog annotation: Hit_ID=A5BXI2; Match level="QueryCoverage=67%, HitCoverage=4%, E-value=2e-14, Identity=50%"; Hit description =Putative uncharacterized protein
MNTVSSIEYFGLSINVKRLFKYCKPIIQVDDKNGICLVSDHHASIKSIVANETLGWQPPYAYHVYCVRHIAKNFNHKFKNEKQKEMLKKLGKI

SEQ ID NO: 92468 - protein, 47 aa, Glycine max
  Coding DNA Sequence Number=SeqID_783
  Subcellular localization annotation: CTP_CleavageSite=18; ConfidenceScore=5.00e-01
MTWAKRTSTAKRNFSALSATEEFGRASLSRPRAKREISALSAVVVFS

SEQ ID NO: 92469 - protein, 50 aa, Glycine max
  Coding DNA Sequence Number=SeqID_784
MKLDIPSLFNDFEHTSIMVRTRELGRALGQVTGRGVGRGDRDDSDDAPQH

SEQ ID NO: 92470 - protein, 164 aa, Glycine max
  Coding DNA Sequence Number=SeqID_785
FPQASIVRYPSSQAALAAVASGEADYALGSLLAAAFLIERSYVNQLALAAILPQDALYGSRLVVKADNQPLLQALNAAIAAIPGEQQRLISRQWTQRPDVWRLQETAQPDAARAAVAAAACAAAGAASGSDAGGGGAGWRPSGGSALYPTLPEGVAGAAGAGPA

SEQ ID NO: 92471 - protein, 127 aa, Glycine max
  Coding DNA Sequence Number=SeqID_786
  Subcellular localization annotation: CTP_CleavageSite=50; ConfidenceScore=5.01e-01
MTKARQKGGTERKGRRCLPTSSPRCAQLAQASSAIPGELGCFLQKQPPSRGTSSFGMLRKLTDCVTILPFDFRHVTELHELCYNAFFLASDMSRNFTNCLTMGAKYLEVAERGSHPNNGWSPNEIRV

SEQ ID NO: 92472 - protein, 143 aa, Glycine max
  Coding DNA Sequence Number=SeqID_787
  Gene Ontology: Mol. function=aspartic-type endopeptidase activity; Cellular component=small subunit processome; Biological process=DNA integration
  Homolog annotation: Hit_ID=A5BUD6; Match level="QueryCoverage=90%, HitCoverage=11%, E-value=2e-14, Identity=34%"; Hit description =Putative uncharacterized protein
  Pfam annotation: Domain name=zf-CCHC; Domain location=126-143; Score =12.0; E_value=0.023; Accession=PF00098.14; Description=Zinc knuckle
MKVTALKQISHDMIAHVGKARVVVEELRKFLVADSLEKVNRKLDKFYMVLILRSLHSDFDHVRDQVLAGDQVPSMDSLITRLLRVPHVSKDENPTDGVETSAMVASRGRGGGRNIRRGRSGRDGRPHCTYCKRMGHTQENCYS

SEQ ID NO: 92473 - protein, 93 aa, Glycine max
  Coding DNA Sequence Number=SeqID_788
MKLAKYRLKAKWRRTKAQTYQGNPCGVYPDLSSFIGSGVYPDLSSLTGSGVYPDLSSFTGSGVYPDLSSFTGSGVYPDLSSFTGSGVIQTFVA

SEQ ID NO: 92474 - protein, 65 aa, Glycine max
  Coding DNA Sequence Number=SeqID_789
MGVQIAPRPTWALRNIPPEGGEEVKKKGPRRFRNISVTFSVKNFAKVQPFFDVLHSFFIVLRSST

SEQ ID NO: 92475 - protein, 25 aa, Glycine max
  Coding DNA Sequence Number=SeqID_790
MFPHGKMPRKWVWKEDAQSFKNLNI

SEQ ID NO: 92476 - protein, 89 aa, Glycine max
  Coding DNA Sequence Number=SeqID_791
MSFPAFSYLGTSTSGGWVHDQRIVIPYPAPDKREALLGGNLVSFKFLVIITVVSLRRWFSSPGQAPPARNGLKKRGGVQFSPKKLLPLT

SEQ ID NO: 92477 - protein, 306 aa, Glycine max
  Coding DNA Sequence Number=SeqID_792
MKTLSACCAKRHYFCIQAKCTYALSLRFIFVKAELSAPCCAKPKPFTMASKKRKSTASSSSQVRFDRSRFHSQEAWDRYNDFVITRKILPERNEVVYHTKFDEFKEELMRKKWDEKLTTFIEGSIDVAIVREFYANLYDPEDKSPKQGTKAKRSEASTSSIPPTSTAPDIPAPSSASLPDSSAPSTSAPQIPQLPTSVLDPSATDFSFTPQMLHSMMQSLHRGQEPEAAEEEPIVEEDELIPSEPTADIAQEEAHASETIPESSPPLIFEDALPSTIVMEPEQPQDAPATPVLDLNEEQPYDDQDF

SEQ ID NO: 92478 - protein, 36 aa, Glycine max
  Coding DNA Sequence Number=SeqID_793
MALSEPSRSFSIEKCIASLELDRAGLDFRMSRHRVR

SEQ ID NO: 92479 - protein, 83 aa, Glycine max
  Coding DNA Sequence Number=SeqID_794
MVQKAIDEGRLELEEKPIKIDIDLFHIEANYIEPIQIMIVGTLIGSSKKQKVEKEVMLCPRYSVVFDKSTAKAFKASQIQKNY

SEQ ID NO: 92480 - protein, 506 aa, Glycine max
  Coding DNA Sequence Number=SeqID_795
  Gene Ontology: Mol. function=hydrolase activity, hydrolyzing O -glycosyl compounds; Cellular component=integral to membrane; Biological process=carbohydrate metabolic process
  Homolog annotation: Hit_ID=A7NYK5; Match level="QueryCoverage=92%, HitCoverage=73%, E-value=0.0, Identity=72%"; Hit description =Chromosome chr6 scaffold_3, whole genome shotgun sequence
  Pfam annotation: Domain name=Glyco_hydro_3; Domain location=105-342; Score=264.0; E_value=3e-76; Accession=PF00933.12; Description =Glycosyl hydrolase family 3 N terminal domain
MACVYKNPEEQIEARVKDLLSRMTLREKIGQMTQIERTVATSSAIRDLSIGFELVGGWNEFDERPPLRVCLENCYRSILSSGGSAPFENALSSDWADMVDGFQKSALQSRLGIPLIYGIDAVHGNNSVYGTTIFPHNIGLGATRDSDLVQRIGAATALEVKACGIHYNFAPCVAVLNDPRWGRCYECYSEDTEIVRKMTSIVSGLQGQPPQGHEHGYPFVAGRNNVIACAKHFVGDGGTYKGVNEGNTILSYEDLEIIHMAPYLDCISQGVSTIMASYSSWNGRQLHADHFLITEILKDKLGFKGFVISDWEGLDRLCLPHGSDYRYCISSAVNAGIDMVMVAFRFKVFIEELTSLVESGEVPISRIDDAVERILRVKFAAGLFEFPLSDRSLLDIVGCKPHRDLAREAVQKSLVLLKNGKDPSKPFLPLTKNAKKILVAGTHANDLGYQCGGWTKTWYGMSGQITVAYSPSLFSPILVGPPVLASIFVLAYYKEEILAIEIILVL

SEQ ID NO: 92481 - protein, 130 aa, Glycine max
  Coding DNA Sequence Number=SeqID_796
MLMCNHEFSFVGPIELLCSIARTPYGILNLLEATMITTHDALLYYNGRWNMSRQNEFVGYSFIGKNPKNFDIPTGCTMDELKDLIKQVAPRGIPPYGIDETQMKWKTPRVKIWRNFSQNTHMKDIYNIPY

SEQ ID NO: 92482 - protein, 124 aa, Glycine max
  Coding DNA Sequence Number=SeqID_797
MVRTRGLGRALGHVTGRGVDRGDRDDFDDAPQHRWPTASARRQRVPVTAAHYEPVVPMPDVEADVFPDDLMAPADVEDIVADILADTGTQAAEDEHEGFLGGPSDPSVLTQYVDHVACSVWTRE

SEQ ID NO: 92483 - protein, 104 aa, Glycine max
  Coding DNA Sequence Number=SeqID_798
MPNLYDRTTKLEETLTQFMQVSMSSQKSTKSAIKNLEVQVGQLAKQLAEKSSSSFTTNTEKNLKEECKAVMTRSKMAIQAEERRADQKVEAFKQQLATQPALDP

SEQ ID NO: 92484 - protein, 88 aa, Glycine max
  Coding DNA Sequence Number=SeqID_799
MSSKPHRALLVKVLNEAHVAQDIFVQGFGGLVNNITANNYLAFAEEEIHVSQPTLRWEGEARLTGASSKKGKCAKSPPMFIRGKHRKN

SEQ ID NO: 92485 - protein, 46 aa, Glycine max
  Coding DNA Sequence Number=SeqID_800
MENWRTSLGNDFRGAPDSKAIMKHSSKLEGGGHMNSARQGHSWGSE

SEQ ID NO: 92486 - protein, 92 aa, Glycine max
  Coding DNA Sequence Number=SeqID_801
MYIKYGPKYIMKHGQQNKLSNETKTPHTYSQNNSKAPKFLKDMDASTKNQAKGYCASNQWGKTYPNDYNDGWAQILTKVKSSLFKLSFSKLS

SEQ ID NO: 92487 - protein, 126 aa, Glycine max
  Coding DNA Sequence Number=SeqID_802
MKRKEPPILTLCLQNLWHILLALKLIIMQYKSRRFNVPKFFFFEDYQGELESQFYYQNEAERSFNLDILLMQFKDTIGSIQRAFKSVEIQVGKLVEEVTQAMSRRKEEIVEVDTQEESPVIEHDLE

SEQ ID NO: 92488 - protein, 202 aa, Glycine max
  Coding DNA Sequence Number=SeqID_803
  Homolog annotation: Hit_ID=A8P6U5; Match level="QueryCoverage=12%, HitCoverage=40%, E-value=5e-07, Identity=96%"; Hit description =Putative uncharacterized protein
  Subcellular localization annotation: CTP_CleavageSite=68; ConfidenceScore=5.26e-01
MSGPALRPYSPRNPKTLISHKGASGVLKATSADPWSASFMVETRTLFVFHKSKNFTSDYEIRMPPTVPVNHYSDPEGQHNRIRILWCYPMLMYTERRLALSTLISSKSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 92489 - protein, 198 aa, Glycine max
  Coding DNA Sequence Number=SeqID_804
MERNMIDAASSGALGDMTPAEARNLIEKMASNSQQFSARNDAIVIRGVHEVATNSLHHMKLRSLRNNYDLSSNRYNPGWRNHPNLRWSSPSQQQQQQQPYFQNAASPSRPCVPPPFQQQQQQQQQQPQKQQTVETPPQPSFEELVRQMTMQNMKFQQETRASIQSLTNKMGQLTTQLNQQQSQNSDKLPSQSVQNPKN

SEQ ID NO: 92490 - protein, 134 aa, Glycine max
  Coding DNA Sequence Number=SeqID_805
MRSFNGDFPPWRCSGRQRRRGERRRDPLGNKPWKKELHHQDEPWIRSLERAQKKEKPILIFTKKSGSNLDPWAQKSTLRFMRTLGPSLVALAQASWSLLSNNLGGKPGANGENKKEGATHPVIAIPIWPNFPPA

SEQ ID NO: 92491 - protein, 76 aa, Glycine max
  Coding DNA Sequence Number=SeqID_806
MELRKKWSMENWRTALRNNFVGLQTRRLDGGGHMNSTRQYIHGAPKKKWRMENWRTALRNNFAGLQTRRWRTHEQR

SEQ ID NO: 92492 - protein, 89 aa, Glycine max
  Coding DNA Sequence Number=SeqID_807
  Pfam annotation: Domain name=G-patch; Domain location=31-69; Score =9.9; E_value=0.012; Accession=PF01585.14; Description=G-patch domain
MDSLGGSRPLNAPPKTEIRGGGALSHCFRGEGCFGHGYEPGMGLGKNNDNMTSLVDIKENYGKFGLGYKPTRTDVRKSIVERRNRGVGP

SEQ ID NO: 92493 - protein, 45 aa, Glycine max
  Coding DNA Sequence Number=SeqID_808
MGDQEETQEQMKADMSALKEQMASMMEAMLGMRQLMERCGRRCAV

SEQ ID NO: 92494 - protein, 242 aa, Glycine max
  Coding DNA Sequence Number=SeqID_809
MVIDQSLFNDLTKLPSDGVPFEGTLNDDWKFDFSAHDARQLVCTNNADMTGRLLAGSLAFESRILHYLIVRILLPRSSNLAQAFHTGRQLDWAHLVRYRMHKALRLNAPLPYPQLVTLFFRYFQIPLDSEPYVPIKRSFLIGAAVIASFGYRKEHDGSWVKKGAPPADDEGNQPVEDNSSLLRKLLEKFDGLQTFVGDKFDTMELQVDMRFDAMESRITKVEEDVSFIRTCFDPPPPPPSSS

SEQ ID NO: 92495 - protein, 152 aa, Glycine max
  Coding DNA Sequence Number=SeqID_810
MEHTNLGIPRSCSSACHRTLGSRISLLNDHLEETLGPTKIGENHSKCINLTQILSGSKTFLDVSSVFSRSLIGNFLSFFCFLPLFDWEFSFSFCVFFRGQGLTFSPWVKVYDKLGFWLKACRTAGHDICQGLASGSGIKGMSYIISMIHMQQ

SEQ ID NO: 92496 - protein, 269 aa, Glycine max
  Coding DNA Sequence Number=SeqID_811
MCRQRRGRHRAVSVAQGGYRRQSELDLCCTRITRPADTGRHRPRPVRDARRTCSSAAGAAGAASGARPAASRAMEICACSACAAPASRGSRPLHTSAASAGSFALASGDAQQPAGALGIGCLCTRLLQPGDTSRCHRTACRHRPAHVPAPLPPARRGLPGRERRHVRRLRRGCGVAQFGLRPAQQRPAIGPLWVTLQCILQGLHAIACRVASGSVGPVLHADRPAASEAATPAASAWAQGAVCSVLPALPWAFSIFSSAGISFLVDYAL

SEQ ID NO: 92497 - protein, 161 aa, Glycine max
  Coding DNA Sequence Number=SeqID_812
METHMPLRTKNLTEGSIDVAIVKEFYGNPYVPEDKELKQVRVRGHLIKFDVDSLNTFLETLVVVEQGESLPSYSRFTRLRPDPQELVSLGGDLYLMPKGQVSLRACNEDEHELRITYFWLDLTHCSVQLLAAWISSPGYCLVQGPRSHLRFSYLRVTQPSH

SEQ ID NO: 92498 - protein, 91 aa, Glycine max
  Coding DNA Sequence Number=SeqID_813
NLLCLNNNRHMSEPSMRVGNSYVYGFLEPQSIQRSGQSQFESESYMKNWMQNSKQDVYLGTYLNGALKGLDDTPQPKSKAGARWIVVKTNL

SEQ ID NO: 92499 - protein, 82 aa, Glycine max
  Coding DNA Sequence Number=SeqID_814
MTVATCSFAGERGEAHGCTFQRRKDARSRHQRLFVENFGKTDGNRSKMKILSSGVVFTLEEGRQKRGFCSYVPYIKEEIRPT

SEQ ID NO: 92500 - protein, 69 aa, Glycine max
  Coding DNA Sequence Number=SeqID_815
MRCRGARPGELNSPRHKHGPLRVGVHLLELTQGILGCLTAALSVCPGLGKGWRLIGHDPSLTLRPSLST

SEQ ID NO: 92501 - protein, 171 aa, Glycine max
  Coding DNA Sequence Number=SeqID_816
MKPRYDGSSNEAPSFNKELKRSFTSERTTLVGKKSHEENKSKQGTLFRNNKFMGHASMPLVSQPAEKESLLVESNDDDDDDDTETEDQDVEGGRTVAQNNDRGKGPPVIGGESSKTDGDEGPDVDKKADEFIAKRIESIKRSRRSARNSLSTPCISKIPLGEDYSQILIRC

SEQ ID NO: 92502 - protein, 50 aa, Glycine max
  Coding DNA Sequence Number=SeqID_817
MTDQMFIIYLRSNSNDWGGKTARKPHYKRNLKESWASSSKGNNTKIFSLP

SEQ ID NO: 92503 - protein, 207 aa, Glycine max
  Coding DNA Sequence Number=SeqID_818
MASPQPTTCAQLLIQNVQLQILDGENEEVEFVIIGVSVRLPASAPDRTSSIKRISQSVTNLSQALKPAPVSSSGFDSCLLDPKTTKEGQNSLSMKPWRGREETYTSSLKLVEKCRRRRKGKVELRRYRVVTVDHFLCHFSLTQVPVETNSFINVKPTTTICMLAKSLNKEGGNRGSGGGGENGVRVGSEEEAGRKEMWSEMETRYEM

SEQ ID NO: 92504 - protein, 105 aa, Glycine max
  Coding DNA Sequence Number=SeqID_819
MEKCLVKFQTKCREDPTVNEVWAAFLPRQLHVVFSRSFIKRRLAHSRYLLKDPNGQIMDKCLVKLQTKFREDSTVNEDLAAFLPRQLHVTFSRSFIKRLPPEASS

SEQ ID NO: 92505 - protein, 254 aa, Glycine max
  Coding DNA Sequence Number=SeqID_820
  Gene Ontology: Mol. function=protein serine/threonine kinase activity; Biological process=protein amino acid phosphorylation
  Homolog annotation: Hit_ID=A7PGX0; Match level="QueryCoverage=89%, HitCoverage=50%, E-value=9e-31, Identity=34%"; Hit description =Chromosome chr17 scaffold_16, whole genome shotgun sequence
MAEDVCPVQLEDRTRGQSTKVGQPTITFSLDERFEACVPKTCGNGQNISYPFYIQGKQKPFCGQPGFELTCGHNGFPILTLMYTPYTIHQIFYHNNSLRLSNPIFSQPNASSCIGPTQNLTVGRYIFRLAPNQRDLFVLYGCDPAVLPERVRERMIGCSAAGNETTLVVGLDKDDLDLVTARESCNGGAVNATVEDLKGGVREALWRGFMLIWNATSCRECENSEGRCGFDLDPLVYAFRCYCPDRPHVVKCNP

SEQ ID NO: 92506 - protein, 362 aa, Glycine max
  Coding DNA Sequence Number=SeqID_821
  Gene Ontology: Mol. function=phosphoprotein phosphatase activity
  Homolog annotation: Hit_ID=A7UQU7; Match level="QueryCoverage=50%, HitCoverage=33%, E-value=2e-24, Identity=35%"; Hit description=IMP dehydrogenase/GMP reductase, putative
  Pfam annotation: Domain name=DUF1723; Domain location=77-124; Score =25.9; E_value=0.00015; Accession=PF08330.1; Description=Protein of unknown function (DUF1723)
MVKTRGLGRALGRAVGRGLRRGDGDDSDVLVIVVDDVPAVPMDSPADTGAEDAADEAEGFPGDGCWDRIKFFDRVFSRHRRSSFIERWHWETSTFHLLVGEVSITLDDVASLLHLPIIGDFHDFHQRYPSRWTTIIGDFHLLVGEVSITLDDEAMLKLVELLMVSPEHWTVAARAYLLHLLGCTLFANKSETHVHVVHLDALRDLTQTRRYAWGAVGLVYMYDHLNDASISTNRQVGGYITLLQCWIYEHFPSVAECNADPDYDEAAPGSSQDSRCLLDAICGALTGPGVSSDYMFLRTAPVSFDDIDDRWVHYSDHLAPAGDICIVPGQCAPDCIDWFFVISHPFMTAPQTSDPPRDASAT

SEQ ID NO: 92507 - protein, 162 aa, Glycine max
  Coding DNA Sequence Number=SeqID_822
MWTFHTGRQIDWAHLVRYRIHKALRLNAPLPYPHLVTLFLQHFNIPLDYKPYVPIKRSFLIGATVIASFGHRKEHDGSWVKKGAQPIDEEGHLPVGEDSSLLQRILDRFDGLQTFVGERFNALELQVDMRFDEMDSRITKVEGDVSHIHTCFDLPPPQRPSS

SEQ ID NO: 92508 - protein, 139 aa, Glycine max
  Coding DNA Sequence Number=SeqID_823
  Homolog annotation: Hit_ID=A5APQ3; Match level="QueryCoverage=76%, HitCoverage=8%, E-value=2e-17, Identity=40%"; Hit description =Putative uncharacterized protein
  Pfam annotation: Domain name=DUF1723; Domain location=34-83; Score =47.5; E_value=4.8e-11; Accession=PF08330.1; Description=Protein of unknown function (DUF1723)
MEGKFQKFGRPTPKIEGPIAATGLSLLIACLVDTGDRGLISAFVERWHKETSSFHLPIDEVTITLDDVASLLHLLIIGCTLFANKCATFVHVVFLDAFRDLSHSGSYAWGVAALVHMYDNLNDACKSDSRQLAGYITLL

SEQ ID NO: 92509 - protein, 247 aa, Glycine max
  Coding DNA Sequence Number=SeqID_824
  Homolog annotation: Hit_ID=Q2HS67; Match level="QueryCoverage=95%, HitCoverage=72%, E-value=8e-11, Identity=27%"; Hit description =Cyclin-like F-box; F-box protein interaction domain
MPGYHLVGSCNELHCGVSEIPKGYCVCFWNKATRVISRESPTLSFFPGIGRRTMFGFGYDPSSEKYKVVAIALTMLSLDVSEKTEMKGKETIHSEIVIISIDLEKETCRSLFLPDDFCFFDTNIGVFRDSLCVWQDSNTNLGLWQMRKFGDDKSWIQLINFSYLHLNIRPYEEKSMILPLCMSNNRDFFMLKFTRNADDEYQTILYNQRDGKSQVSVVPLGSFRTLLWCNFKIFTKTLVISNALSDV

SEQ ID NO: 92510 - protein, 107 aa, Glycine max
  Coding DNA Sequence Number=SeqID_825
MIRGDTLRLSAPFCHPEAAGPMTSRDQVWSFCTLVSSRGGGPDDTRRYLTVICTLLSSRGGGPDDKQRPSLVILHPSSIAADKPVDTRRFTSSSALTRSVILTFESC

SEQ ID NO: 92511 - protein, 86 aa, Glycine max
  Coding DNA Sequence Number=SeqID_826
MGAKYLEVVKRGSHPNNGWSPDEIKTQNDHNLSLRFVGHDGAWVARHRMTIICLCVPPNTAASGRRKGVRNDHNLSPLTSQLVVFE

SEQ ID NO: 92512 - protein, 95 aa, Glycine max
  Coding DNA Sequence Number=SeqID_827
MAKFDPDIVLEFYANAWPTEEGVRDMRCYQPVPGIPFSAGKGQECEYGQRRNRSDGFDEEAIAHLLCIPGQDFARTVAGGRVRIMRTNMTTLTQI

SEQ ID NO: 92513 - protein, 82 aa, Glycine max
  Coding DNA Sequence Number=SeqID_828
MDKSLKVGEDEWREKERRSTKFCASNEGFTMLQKEMSKILRLGAIFVNMGIFSSRVELINSDHYAIHRVSRCFRKKWEKNSM

SEQ ID NO: 92514 - protein, 96 aa, Glycine max
  Coding DNA Sequence Number=SeqID_829
MAYTHIPVKVENPGFTHDSPQISASPHQLDLAPYTSEPYHAQWNPRGVSVTSTRCVRVVSSEKWRLMNPWLGVMATIELLSGIWGSSLAYDNGIWG

SEQ ID NO: 92515 - protein, 95 aa, Glycine max
  Coding DNA Sequence Number=SeqID_830
LSLLAFNEYGSGVIDILIESVRHIGWCIIGQAIWREGMLVLNLHKTGGNDVTQSIFCTDAILPRKGPVTRTMSKRLQEDWARAAEEGPRVLMNLM

SEQ ID NO: 92516 - protein, 106 aa, Glycine max
  Coding DNA Sequence Number=SeqID_831
MSGFTRDSPQISASLHQLDLAPYASGPYNAQWNAPGLLHDKHMLRSSRILGEMKVDEPWLGLWLPLNYQVDMGASFLTAKFISWLVFSFMLKVVFVIGSAVGRLCG

SEQ ID NO: 92517 - protein, 145 aa, Glycine max
  Coding DNA Sequence Number=SeqID_832
  Homolog annotation: Hit_ID=A5AK77; Match level="QueryCoverage=59%, HitCoverage=10%, E-value=6e-10, Identity=39%"; Hit description =Putative uncharacterized protein
MAACRGQAEYPEHPEHSVISESEHSVVGNLEHPDFEHFDFEHSDFEHSENMAQPLPRERILREMVAPDFTYESLCIQYPDEDVPYVLKTGLIHLLPKFHGLVGEDPHKHLKEFHIVCSTMKPPDVQEDHIFLKAFPHSLEGVAKD

SEQ ID NO: 92518 - protein, 51 aa, Glycine max
  Coding DNA Sequence Number=SeqID_833
MEGKGNLKSQLALHLVYTVYTKLLHTNRGLGGLLETPNTPLKNVQIQGIVT

SEQ ID NO: 92519 - protein, 128 aa, Glycine max
  Coding DNA Sequence Number=SeqID_834
  Gene Ontology: Mol. function=aspartic-type endopeptidase activity; Biological process=RNA-dependent DNA replication
  Homolog annotation: Hit_ID=Q6WAY3; Match level="QueryCoverage=47%, HitCoverage=2%, E-value=7e-09, Identity=42%"; Hit description =Gag/pol polyprotein
MFISLLRLKRYRSDDESQISTNTGDPTVDFEQEASRTENEEDEDVGLPPELERIIAQEDQEMRPHQEETELVDLGTSSGKKEVKVGTGMTTPALAFGGSKFAPSEKDCTHKTPSGPREFQQGPGGFQI

SEQ ID NO: 92520 - protein, 59 aa, Glycine max
  Coding DNA Sequence Number=SeqID_835
MPFRGLKSAGKQAVFFVFSKKRDALAKRACCAKRVHQYSLYPRAKPSVPEPSAIGCGIR

SEQ ID NO: 92521 - protein, 102 aa, Glycine max
  Coding DNA Sequence Number=SeqID_836
GSSYWKLKVKNGSWKLEVEVTGSWKLEVGNESYWKLKVENGGWKLEGEVVVIIKKGENVNHEDFDDIKKNLLEKEGDVNHASFDGVEKKSHVCHHQKGGECE

SEQ ID NO: 92522 - protein, 143 aa, Glycine max
  Coding DNA Sequence Number=SeqID_837
  Gene Ontology: Mol. function=structural constituent of ribosome; Cellular component=intracellular; Biological process=translation
  Homolog annotation: Hit_ID=A7Q5A7; Match level="QueryCoverage=30%, HitCoverage=59%, E-value=1e-11, Identity=79%"; Hit description =Chromosome undetermined scaffold_52, whole genome shotgun sequence
MPFFVHGSIFWCPRRRGTTPIHPELGGYSGEQISSGDDGVGPVAQRIRARGYEPRCRGFESLSPQPAKKGKIFPSGVEIMIGLADQSYGTSPDCGTKEYPEPTPSQLTADRSTTELLRNNGKFELIEFNSRSQPMTNMSSKFP

SEQ ID NO: 92523 - protein, 235 aa, Glycine max
  Coding DNA Sequence Number=SeqID_838
MSAGYHSKRRVPTLKPIHWPSHGGASVNAIEKDGPSGAKRLEDVATSRRFIYQSLQAACMVSCGGDERDECLFHLGESHDMETCPVVEELLQWLMDWGQFEVSKGGREEPQICMQSEEKKVPPTPKALVICFTRKGTGSRPMYPLTAPKPTPFAYQSNKVVPWKYTPPAFGERVATEVDSLSAKVTNITGFSGVSRSGRVFTPPHSAELPSKGKAPMIQEPTNVATPSKEVDPLV

SEQ ID NO: 92524 - protein, 169 aa, Glycine max
  Coding DNA Sequence Number=SeqID_839
  Gene Ontology: Mol. function=structural molecule activity; Cellular component=cytoplasm; Biological process=keratinization
  Homolog annotation: Hit_ID=A6VH24; Match level="QueryCoverage=56%, HitCoverage=23%, E-value=2e-10, Identity=47%"; Hit description=SCP -like extracellular precursor
GYVPSPSKDYTSSTLEGYTSSPSEDCRSSFLEGYTSSPSEDYTSSTLEGYTSSPSKGYMPSPSEGCTLSPSEGCTPSPSEDYTSFPSEDYTFSPSKDYKSSPSEDYTSSPSEGYTPSPSRGYRPSPSEDCTSSPSEDYTSLASVDYTSSPSEDYTSSPSEGYTHLPSKG

SEQ ID NO: 92525 - protein, 101 aa, Glycine max
  Coding DNA Sequence Number=SeqID_840
MVVMRGIMENGLYSVDGEVVIGSAATATRRVLSKTELWHMRSFYVGIEWKDKSSVNIVSMAKPVEPNSMLDSREQKVPLIMFMLIFGVQPRLPLILEQGFS

SEQ ID NO: 92526 - protein, 46 aa, Glycine max
  Coding DNA Sequence Number=SeqID_841
MECRERKGNEEGGGGGEGELREIFNTLARMCSPLLIEERVRNATLS

SEQ ID NO: 92527 - protein, 162 aa, Glycine max
  Coding DNA Sequence Number=SeqID_842
MAGQEMPLLAAAGQGDESTATTSTKFERNLNHEHNKLSHSRRKKEKENSVRTENPKHCKPEPSYVLNTASLQRADLEAFNVSLQRVPQKPVAGLPTLACPASTSGSMAPSLLVSHVPPGRMAVWVRLSPSHHVPSGGMAVCTEAVVVNGGTSSPAGSNGDTP

SEQ ID NO: 92528 - protein, 162 aa, Glycine max
  Coding DNA Sequence Number=SeqID_843
  Gene Ontology: Biological process=transposition, DNA-mediated
  Homolog annotation: Hit_ID=Q1J7G7; Match level="QueryCoverage=20%, HitCoverage=47%, E-value=1e-10, Identity=93%"; Hit description =Transposase
MCRNCRNRRGIHSQSDENVSVRSWKTGVTRVNTIPYHQLTVFHCPYEIPDEHSSGGQESERSGYRYIEQLTEMPQNVLYDAIGIYQRCWNLLRADQRLIFAKSWPRASRYQQGHQDLFILRSDLPSQVLQWLPFLSAVPPVQLLTGWCVTAKAPPDISAGKC

SEQ ID NO: 92529 - protein, 28 aa, Glycine max
  Coding DNA Sequence Number=SeqID_844
MDSIEEEDPWPTSFLYGATSCGSIIFQS

SEQ ID NO: 92530 - protein, 187 aa, Glycine max
  Coding DNA Sequence Number=SeqID_845
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=45%, HitCoverage=73%, E-value=3e-24, Identity=68%"; Hit description=LacZ protein
  Pfam annotation: Domain name=Abi; Domain location=4-125; Score=3.1; E_ value=0.011; Accession=PF02517.7; Description=CAAX amino terminal protease family
MPAFGFFMVVVFAPLTEELIFRGMLARYLFPKQDKSKQVLFLLVSSVLFALIHFPGDVQQFLVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 92531 - protein, 127 aa, Glycine max
  Coding DNA Sequence Number=SeqID_846
MSGFTRNSPQISASPHQLDLAPYASEPYHAQWNAPGLLRDKHTLRSSRILGEMEVDEPWLGLWLPLNYQVDMGSSLAYDNGIWGEPYRLFAAKFLFVGVFGITVTAWVSPSSSPSLFAPVFSIVLVG

SEQ ID NO: 92532 - protein, 88 aa, Glycine max
  Coding DNA Sequence Number=SeqID_847
MVAITPTKVPQPLYFLGYDSNATCAYHGGGPGHSIKHCRTPIHKVTMKDNDRHLRALHWGNERHLHHPQANLGAHKKFSPGRFPATWS

SEQ ID NO: 92533 - protein, 76 aa, Glycine max
  Coding DNA Sequence Number=SeqID_848
MAAEWRRKRERRRHFKEKMSLEEAHYHRRPWIRAWRKKEMNEGRGREEHGILCSKRALKYEPTNPRSIPRFSTKCA

SEQ ID NO: 92534 - protein, 577 aa, Glycine max
  Coding DNA Sequence Number=SeqID_849
  Gene Ontology: Mol. function=DNA topoisomerase type I activity; Cellular component=chromosome; Biological process=DNA unwinding during replication
  Homolog annotation: Hit_ID=A9CJ94; Match level="QueryCoverage=57%, HitCoverage=42%, E-value=1e-169, Identity=91%"; Hit description =Exoribonuclease
  Pfam annotation: Domain name=OB_RNB; Domain location=428-487; Score= -6.3; E_value=0.081; Accession=PF08206.2; Description=Ribonuclease B OB domain
  Pfam annotation: Domain name=zf-C4_Topoisom; Domain location=20-59; Score=57.6; E_value=4.2e-14; Accession=PF01396.10; Description =Topoisomerase DNA binding C4 zinc finger
  Pfam module annotation: Pfam domain module=OB_RNB::zf-C4_Topoisom; Domain location=428-487::20-59
ALNEVLAPLVFPKREDGSDPRICQVCGTGNLSLKLGKYGAFVGCSNYPECNYTRQLTSDGAEAEAAALNEPKALGADPMTGEELTLRSGRFGPYIQRGDGKEAKRSSLPKGWKPEDIDHEKALALINLPRDIGKHPETGKMISAGLGRYGPFLLHDGSYANLESIEDVFSIGLNRAVTVIAEKQSKGPGRGRSGTPAALKELGDHPDGGPITVPEGDQGQGGDKEQDGRQAEGSGQTQEGSRVSKAPRQRQGSASDGFGRTGRGKRVSEGEGIIHGEVPSREVLLKFIADHPQQASKREIAKAFGLKGENRVVLKALLKELEVDGMVHKSRKSLTRPGGLAPVTVLDITTRDKDGELIGRPAEWPEDLGAAPAVLIRQSSQDRGKKAPAAGLGDRILAKIFPSKESTGPAYTARVVKLIDRRQNALLGVFKETPGGGGRLMPIDRRGEEMVIDPDGVGDAKDGDLIEVETSRNSGRYGLTRAKVLSVIGSVASEKAISMIAIHAHGIPHIFPQNVLAEADAAKAATMSHREDWRDLPLITIDPADAKDHDDAVYAEPDTSPDNLDGVIVTVAMPMSP

SEQ ID NO: 92535 - protein, 98 aa, Glycine max
  Coding DNA Sequence Number=SeqID_850
MAQPPPRERTLREIAAPNFTYESLCIQYPDEDVPYVLKTGLIHLLPKFHGPCSCPHYQISEQLLLQYFYEGLSNMERSMIDAASGGALGDMTLLKPEI

SEQ ID NO: 92536 - protein, 194 aa, Glycine max
  Coding DNA Sequence Number=SeqID_851
MIDTPWSYDSCPYCTTTFDPLKIGAACRSCQNHVTHTIPRYKLVVKMEQNGEKANFHFWDAVCIKIFGKTVDECRQELIASGDEIKVFPACVDQLLGKTWVVRFKHRIQMHQSSVLDFSEQEHHIQSLISTLGLQDEQCISNKSAAVGAASSSQQDYHPTSSEYDPGNVAFVTPAKRTYDQQGSSQFDSDDFTT

SEQ ID NO: 92537 - protein, 206 aa, Glycine max
  Coding DNA Sequence Number=SeqID_852
  Gene Ontology: Biological process=transposition, DNA-mediated
  Homolog annotation: Hit_ID=Q1J7G7; Match level="QueryCoverage=18%, HitCoverage=67%, E-value=2e-10, Identity=72%"; Hit description =Transposase
GPGLPRYQQGHQDLFILRSDLPSQWLLFLSAVPPVQLLTGWCVTAKAPPDISAGKCSGRVPFAIQAAQLLGRAIGAGLFAITPAGERGMCCKAIKLGNARVFPVSVAINAWYGPFYQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 92538 - protein, 95 aa, Glycine max
  Coding DNA Sequence Number=SeqID_853
MNKEEKTKHPASSPKTLTSRKSYWSVILEVDILSFILGYKEDYPWHKYIVSLRCGAFANDLFFFAKSMLSFKVEKPGGSFGPANILFRSRMNVIA

SEQ ID NO: 92539 - protein, 137 aa, Glycine max
  Coding DNA Sequence Number=SeqID_854
MMCKIQNEHAFPPYGLPLNYTPPNVAYTPNEDTHEIPHHNLADFEPCLGYATEGQAVGGIPLQNLLEGPQYHPQLHLLHSTTSKKPHAMAEMGKLDHLEERLRAIEGGEDYAFANLEELFLVPNIITPPKFKVLDFD

SEQ ID NO: 92540 - protein, 70 aa, Glycine max
  Coding DNA Sequence Number=SeqID_855
  Subcellular localization annotation: CTP_CleavageSite=19; ConfidenceScore=5.22e-01
MVMGDFISRLSFPGYVGARASLLSTTPPFVAMTQELVVRGDTLRLSAPFLSSRGGGPDDKQRPSLVILHP

SEQ ID NO: 92541 - protein, 75 aa, Glycine max
  Coding DNA Sequence Number=SeqID_856
MDKSLKVGEDEWWEREKRSTKFCASNEPMGPKSTLRLMRTLWPSLVSLAQSSWSPLYNALGGVGLHHSPPRECLG

SEQ ID NO: 92542 - protein, 15 aa, Glycine max
  Coding DNA Sequence Number=SeqID_857
MEFLNYECFTMSMIL

SEQ ID NO: 92543 - protein, 165 aa, Glycine max
  Coding DNA Sequence Number=SeqID_858
  Homolog annotation: Hit_ID=Q5QJQ3; Match level="QueryCoverage=46%, HitCoverage=89%, E-value=6e-28, Identity=59%"; Hit description =Putative uncharacterized protein
MAYERGGDFLEDARKILNREVRGPRQSRFSIGSAPLTSITKSDAQISGGETRQDYKDTRRFPLAAPSQFAPSWTVCTNPPFSPTAAPYPVTIVLSPTRKDMQKHHWQQPLAKLKGQVLVTALLQASYLGSRVGSSENLRKTALQGGFFVSEQEITRRPNDLKIIY

SEQ ID NO: 92544 - protein, 185 aa, Glycine max
  Coding DNA Sequence Number=SeqID_859
  Homolog annotation: Hit_ID=A5C7Z4; Match level="QueryCoverage=67%, HitCoverage=39%, E-value=3e-07, Identity=27%"; Hit description =Putative uncharacterized protein
GAVRPAKPADRPDDEVDDPLYLMTLTIPQLFLKPLQHEDLSEIAHGGQCLSISVIQLWILAHWQMVVILPKENVVIWFCSLHNKPDNYLKGMINRSVLFFNIFALALVSALKGLDDTQQSKSKTPARWIVVKCNRQKGSTECGYYVMHWMSTIILGNFQNNWEMYFTDPRPLEPERLKALRIQWA

SEQ ID NO: 92545 - protein, 59 aa, Glycine max
  Coding DNA Sequence Number=SeqID_860
MGQGGCLVGCIVVGAIVVIKGSCLGDLATMKVAASRTREVVVVISKVCWGLKKGAKKFV

SEQ ID NO: 92546 - protein, 627 aa, Glycine max
  Coding DNA Sequence Number=SeqID_861
  Gene Ontology: Mol. function=extracellular-glutamate-gated ion channel activity; Cellular component=integral to membrane; Biological process=G-protein coupled receptor protein signaling pathway
  Homolog annotation: Hit_ID=A7PXG8; Match level="QueryCoverage=100%, HitCoverage=68%, E-value=0.0, Identity=62%"; Hit description =Chromosome chr12 scaffold_36, whole genome shotgun sequence
  Pfam annotation: Domain name=ANF_receptor; Domain location=42-404; Score=314.5; E_value=2e-91; Accession=PF01094.19; Description =Receptor family ligand binding region
MKKFMVLHLLTWIWLCGVAHSGRPASVNIGAVFSFDSIIGRAAKTAMEMAVSDVNEDPTVLMGTKLNLIMKDAMCNAFLGSIGAFQVLEKGVAAIIGPQSSAVAHTVSQIADALQVPLVSYAATDPTLSSLQFPFFIRTTQSDLAQMTAMADIIDFHGWKEVIVVFLDDDYGRNGLSALSDELEKRKLKISYKLPLSIKFDLDEITNLLNQSKVVGPRVYVVHVNPDPRLRIFFIAHKLQMMAKDYVWLVTDWLSATLDSLSPVNQTSFSVLQGVVGLRQHIPDSSKKRAFVSRWIKMQKEGLANTGLNSYGIYAYDTVWAVARAIDIFIKVHNNITFSLPDNYNLSHTVGIGILLDKLKIFAGGSDLVDILLQSNFTGVSGQLHFNSDRSIVSGGYDIINVNQMGISGVGFWSNNSGFSVVPPTALKKRKYNRFSQDQKLGKVIWPGGVTDQPRGWVIADNTKPLRIGVPKRASFVEFVTELPDSHQIQGYCIDVFKKALEFIPYEVPFVFKPFGNGKENPNYDALVKMVDENVYDAVVGDIAIVTNRTMIVDFSQPFASSSLVIVAPINKARSNAWVFLQPFTADMWCATAASFLVVGVVIWILEHRVNNDFRGPPKKQLLTMLM

SEQ ID NO: 92547 - protein, 31 aa, Glycine max
  Coding DNA Sequence Number=SeqID_862
MEILKNDPVSAAPSPITEGLWGKWTSLSSRV

SEQ ID NO: 92548 - protein, 364 aa, Glycine max
  Coding DNA Sequence Number=SeqID_863
  Gene Ontology: Mol. function=oxidoreductase activity; Cellular component=cytosol; Biological process=metabolic process
  Homolog annotation: Hit_ID=A7PX31; Match level="QueryCoverage=95%, HitCoverage=96%, E-value=1e-129, Identity=64%"; Hit description =Chromosome chr12 scaffold_36, whole genome shotgun sequence
  Pfam annotation: Domain name=ADH_zinc_N; Domain location=172-321; Score=90.0; E_value=7.8e-24; Accession=PF00107.17; Description=Zinc -binding dehydrogenase
MGDHEEVRSLVVEEEMRVVESKEWYLVSYAPHGVPTTDHLKLRKVRLSIAPESIPDGHVAIEMLLFSIDPYLRGRLNGTLDGLYFPQFELNQVITIYGIGRVKRSNDSEYKEGDIVLSANFPAAEYCVMPSCEIVRKIDAACGISLPDYLSTLGVPGFAAWLGIEVLADPKPGSNVFISAASGGVGMIAGQLAKIRDCRVIGSTGSDEKVRLIKEEFGYDDGFNYKNEEDLDAVLSKFFPNGIDVYFDNVGGKMLESVLNHVNRYARIPLCGMISQYNQAWTEREGVRNLLNMVGKEVRMEGFLLNTHFDRFGEFAKEMEGHIKEGRLKPKTKINIGIESFLDSLNSLFSSTNIGKVVVQVNKD

SEQ ID NO: 92549 - protein, 219 aa, Glycine max
  Coding DNA Sequence Number=SeqID_864
MAKFDPEVVLEFYANAWPTEEGVRDMRSWVRSQWIPFDAKALSQFLGDLLVLGKARSVSSVRGGIGPTGSTRRPLPSYYAHRGRILPGPLQGGGDHNSDLLLLKCQLVYAILTRMSVHVAQVIADAIYLFAGMPPTRHPLDPDKSNRALGFSALITGLCLSFGVPVTPSKVIRLPITRAFIEKYCTPRQVQGDAPQATGAPPPPHQADPAGSLGMECYL

SEQ ID NO: 92550 - protein, 67 aa, Glycine max
  Coding DNA Sequence Number=SeqID_865
MRRVFLLAPKCLFAIHNGENARNWVANMVLKFHDDPTESEIVVFLRQIWWAAGKRKSFWEKGKGKRN

SEQ ID NO: 92551 - protein, 189 aa, Glycine max
  Coding DNA Sequence Number=SeqID_866
  Gene Ontology: Mol. function=enzyme inhibitor activity; Cellular component=integral to membrane; Biological process=response to antibiotic
  Homolog annotation: Hit_ID=Q37953; Match level="QueryCoverage=27%, HitCoverage=50%, E-value=8e-24, Identity=100%"; Hit description=LacZ protein
  Pfam annotation: Domain name=Microvirus_A; Domain location=1-63; Score=-43.2; E_value=0.063; Accession=PF05442.3; Description =Microvirus A protein
MDELAQCYNVLPQLDINNTIDHRPEGDEKWFLENEKTVTQFCRKLAAERPLKDIRDEYNYPKKKGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 92552 - protein, 70 aa, Glycine max
  Coding DNA Sequence Number=SeqID_867
  Gene Ontology: Cellular component=membrane
  Homolog annotation: Hit_ID=A8G8T9; Match level="QueryCoverage=100%, HitCoverage=6%, E-value=5e-31, Identity=88%"; Hit description=MscS Mechanosensitive ion channel precursor
MRIYAAEMGHRMPLRHEIHQLILAGYREHGITLPYPPFQVRTETLSRLTNNGRTPPSTPAPNTKRDAGGL

SEQ ID NO: 92553 - protein, 121 aa, Glycine max
  Coding DNA Sequence Number=SeqID_868
MAARFNKLAMGALGCQLAVSLMVMTPYTDKGRKSTRIADGKQRHRRRGRQFQKSQVLAGQQEEEKAGTKAGFAPVLVTARCAELPDRLLQHLRLRHAWCYRLKAARKAPVPRKSRQYFSLT

SEQ ID NO: 92554 - protein, 204 aa, Glycine max
  Coding DNA Sequence Number=SeqID_869
  Gene Ontology: Mol. function=unfolded protein binding; Cellular component=cytoplasm; Biological process=cellular protein metabolic process
  Homolog annotation: Hit_ID=Q57GP7; Match level="QueryCoverage=91%, HitCoverage=33%, E-value=6e-61, Identity=70%"; Hit description=60 kDa chaperonin
MIRQQIEEATSDYDKEKLQERVAKLAGGVAVLKVGAATEVEMKEKKARVEDALHATRAAVEEAAVAGGGVALVRVAAKIAASGLKGQNEDQNVGIKVALRAMEAPLRQIVSNAGEEPSVVANNVKAGDGNYGYNAQTEEYGNMIDFGILDPTKVTRSALQYASSVAGLMITTEAMVTDLPKGDAPDLGAGAGGMGGMGGMGGMM

SEQ ID NO: 92555 - protein, 80 aa, Glycine max
  Coding DNA Sequence Number=SeqID_870
MKNVEEQLKPLRNSSRKTLRKRFGSDEDMTKSKGKDPLEGLGGPMTRARARKAKEALQQVLSILFEYKPKFQGEKSKVSV

SEQ ID NO: 92556 - protein, 64 aa, Glycine max
  Coding DNA Sequence Number=SeqID_871
MRGVATNIYSRKMSEKPKWKSRRSAYFENEGSGVVYTWGRHAMTEDIVVFEMQMMVIVTFEGRQ

SEQ ID NO: 92557 - protein, 79 aa, Glycine max
  Coding DNA Sequence Number=SeqID_872
MQCGIISVKNLVERLGVHNNTNHTLASQLGSQCFARMLQPYGINIGLNEHSNRVTPKAYTPKSPSGPLLPDSGPTQKTF

SEQ ID NO: 92558 - protein, 143 aa, Glycine max
  Coding DNA Sequence Number=SeqID_873
  Pfam annotation: Domain name=zf-CCHC; Domain location=71-88; Score =20.1; E_value=0.0014; Accession=PF00098.14; Description=Zinc knuckle
MKKMIRRRRELLLKYHLQSKKKVIWKIQLTWMMMKNLVFVKRFNKFLRMRETQRRQNFKPKRRIEESSQTPRCYECNQLGHLRVYCPIFKKRMEKFENKNIGEKKAKKAYITWDDNDLESSDDSEKEVINLCLMGKNYESDEE

SEQ ID NO: 92559 - protein, 99 aa, Glycine max
  Coding DNA Sequence Number=SeqID_874
QNFAQVQKNAMHLLVVERAVQDEFWLGRIDGDPMLRETRIWATWEYVSSVGGGQQGMSGTGRYVAWVRRPWGRQASSWQSTDKRNKVHKARRLVVAGQL

SEQ ID NO: 92560 - protein, 117 aa, Glycine max
  Coding DNA Sequence Number=SeqID_875
MPGENDSADDSLDITLVALFQKQTWYPSGISLTPQCNPLHEPTRWDGFEADIFYQLKVFQIVLRSRFAKRSDDHGFFSGRMFLWLSAKRLNTLNPNSVPIKTWSFVNSAYIYMSQCF

SEQ ID NO: 92561 - protein, 134 aa, Glycine max
  Coding DNA Sequence Number=SeqID_876
  Homolog annotation: Hit_ID=A2Q533; Match level="QueryCoverage=83%, HitCoverage=36%, E-value=5e-07, Identity=31%"; Hit description =Putative uncharacterized protein
MSSLGGSSRTGSPLREEVGHLLFNCKRTIGLWWESMRWIQAVGPLPASPASHFAQFCDGFGADINHSRWCGWWVALTSAIWQHRNLLIFQGNPFDSSKVMEKAMFLVWSWLKARDKGFNTSFNHRSSNISDSFG

SEQ ID NO: 92562 - protein, 304 aa, Glycine max
  Coding DNA Sequence Number=SeqID_877
  Pfam annotation: Domain name=Transposase_23; Domain location=50-120; Score=19.9; E_value=7.8e-06; Accession=PF03017.5; Description =TNP1ENSPM transposase
ADSVDQGPARGGHHRESDEAGHGIFNQLQSQMQSQGSLEPLVGPGNDPETGDSDRCGLYIEADPARLVAVGRVYEGSTLVHNTPLFPGQVKVSVDEVKDADASVPVPTDEVSLVGQALHTFLAWLTHLVKSLSHQVLIVLTISVSPPKPPLKPDPEVDDPLYLMTLTIPELFLRPYQVRWDATVFGVVNPDFPLYIKHKDLSEIAHGGQCLSISVLQLWILHLTETCMRAGNYDIYGFLEPQSIRSGHWRMVVILPKEHLVVWFCSLHNKPDNYLKGIINSAIKGLDDAPQPKSKAPARWIVVK

SEQ ID NO: 92563 - protein, 51 aa, Glycine max
  Coding DNA Sequence Number=SeqID_878
MDPKRIKVIPEWPTPPCVEERIPEFQEPMDLRSNPFQGGGNDAILPPKSIG

SEQ ID NO: 92564 - protein, 267 aa, Glycine max
  Coding DNA Sequence Number=SeqID_879
  Homolog annotation: Hit_ID=Q9AVH2; Match level="QueryCoverage=17%, HitCoverage=16%, E-value=1e-19, Identity=97%"; Hit description =Putative senescence-associated protein
VLASRWLKFCPPVNFVVLPVVGLARVGGAGLRPRAKFRIGWPPPPPRDQFCCQDFANFGLAPRWLSLCLGGGSSCHNMAKTQGHTHTHTHTLTQAQGGGGAWSSVRPGTHLVSTRQANEREPTNGSLFWPNIVEEERDTGLIGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 92565 - protein, 57 aa, Glycine max
  Coding DNA Sequence Number=SeqID_880
PLMVRTCSPLKARTCSPLTVRSSHGDRYKYPRVHPYEKARDRLIERAGHPKSTRFGH

SEQ ID NO: 92566 - protein, 174 aa, Glycine max
  Coding DNA Sequence Number=SeqID_881
MDNEEGMQEQMKADLSALKDQMAFIMEAMLKLQKTIEDNVTAAASNTAREMEPVLQPAINLGRNMTVLGRRYSPQAYPYGLPPDFTPRTAPDDLSQAPTFEGQLPPYVDYPLQEDDEGDAHLGPLLPLKDPTPHELPQPNIVRHVPSSPAPVKESVPFAKDKGKIDSLEERLRA

SEQ ID NO: 92567 - protein, 243 aa, Glycine max
  Coding DNA Sequence Number=SeqID_882
MNCNFCGGEHYNDNCHFYSMKNSWWGQELYPYNQYEEERTPNLESVFTEFMAYHASSKPNQNSMQNQEIHVGKSYSMENCQWEQELQPYNQYKEERMSNLDNLLMQFKESFESTQQAFKSLEIQVGKLAKEVAKYVATREENFLEVEAHEESLIEEHDSREKDKEKSEEKAQQWEKCLQVEIHKKEERHGEHEKALSVILSLITSTSLAMIWKVFLEYMSFMESLAKRQKCKEDVFYVTFMPP

SEQ ID NO: 92568 - protein, 139 aa, Glycine max
  Coding DNA Sequence Number=SeqID_883
MNVSKYLILQSSMALIQKHGRNLQKAAKPLIVQACLFKGIRKKAQEIQKFNDCPHVLSRGGYELLDKKLMEEKSKRGHEEHSCTESPTLNVDPPSPVARHLKWKIARTKRHGQMTSEVAQEIADKICEFICFLVTVIAK

SEQ ID NO: 92569 - protein, 59 aa, Glycine max
  Coding DNA Sequence Number=SeqID_884
MAYQLATQEKLQYIRNIAQKELPQFKASSSIQEESDQENDPDDDDDLSLFVKRFNKFLK

SEQ ID NO: 92570 - protein, 396 aa, Glycine max
  Coding DNA Sequence Number=SeqID_885
MAPRKLASKRSRKDKAAEGTSSAPEYDSHRFRSAVHQQRFEAIKGWSFLRERRVQLRDDEYTDFQEEIGRRRWASLVTPMAKFDPEIVLEFYANAWPTEEGVRDMRSWVRGQWIPFDADAIGQLLGYPLVLEEGQECEYGQRRNRSDGFDEEAIAQLLCIPGQGFARTAAGRQVRIMRTNMTTLTQIWMTLLLSNILPTDHNSDLPMPKCQLVYAILTRMSIDVAQLIADAIYLFAGMAPTRHPMDPDKSNRALGFPTLITGLCQSFGVPVAPTKVIRPPITRAFIEKYCTQRQAQGDAPQAAGAPPPPHQAGSVGSFDMEQYLRHLLSLSMQSQGFASFSCPTPDQFRAEVAWPGDWPEAQAGEAPPEVPDDGEEAHEDEEMADLLDFLGGSGAT

SEQ ID NO: 92571 - protein, 77 aa, Glycine max
  Coding DNA Sequence Number=SeqID_886
MQNSKRDVYLGAYLNGPDNYLKGIINSALKGLDDTPQSKSKAAARWIIVKYFNDARPLEPERLKALCNCSLLYIFYK

SEQ ID NO: 92572 - protein, 54 aa, Glycine max
  Coding DNA Sequence Number=SeqID_887
MCSDALGSSLYEGMGEGYCTQPYPCICKEAVSGFEPMTNKSPRHNFTAAPGLAL

SEQ ID NO: 92573 - protein, 105 aa, Glycine max
  Coding DNA Sequence Number=SeqID_888
MSLATLFGKLQEHEMELMRLHQHEENDIKRKGIAVSASSSSIQEESDKEDLTGIEEDDDFRFFMKRFNKFLENKRNKRESNINPKKKEKDSSLAPKFYESDQPGP

SEQ ID NO: 92574 - protein, 449 aa, Glycine max
  Coding DNA Sequence Number=SeqID_889
  Gene Ontology: Mol. function=transporter activity; Cellular component= cell outer membrane; Biological process=transport
  Homolog annotation: Hit_ID=A1FXV4; Match level="QueryCoverage=100%, HitCoverage=48%, E-value=0.0, Identity=87%"; Hit description=TonB -dependent receptor precursor
  Pfam annotation: Domain name=Plug; Domain location=22-141; Score =70.9; E_value=4.2e-18; Accession=PF07715.6; Description=TonB -dependent Receptor Plug Domain
MAQDKATNLDKITVTGSLIPQTQVETQTPVMSITAEDIQTRGFSSVAEVLQQSSLTTGGLQGGQTSGSFTQGAEAAGMFGLNPGYTKYLINGRPMLSYPALYNGSETFNNISGIPIDIVERIEVLPGGQSSLYGSDAIAGVVNIILKERMDGGTMTLRGGTYTEGGGSNIRFSAAKGINAFDDRFHALFNVQIENGSPIWGYQRDITRQNNPVGYTAQVPSNDFAVITNADNKLLMMDPSRCANVAGLYDGTTVVGQRASGESCGSVYSAGYKTLKNGKNSGQFYSSMTFDVNDNFQLFADVLYSKEKTEFTSGSSALWWGTKSSLGSFYDQGLGKVVNLQRAFAPEEIGPGHYNNIMNSDESRAYQVTLGGKGMVGDWDYSASFTRGEYRLDQNRFVRWKDKIDGFFVDNVLGTSLGTTADGFDIYNPDYAAFYSPITPDQFASFTGY

SEQ ID NO: 92575 - protein, 56 aa, Glycine max
  Coding DNA Sequence Number=SeqID_890
MGIRGKYQELGMAMGSRGQGRGLSMEEEFGLGGLETWMDQSLEQEVREFKKSLTRD

SEQ ID NO: 92576 - protein, 125 aa, Glycine max
  Coding DNA Sequence Number=SeqID_891
MSLPSAVHVFSIIKREASGDWETRYSVVFQIGSFAKYKKKEGVETRVVITERVSKEGQLSYPNFVRGLLFDDIQPLIGRFETLGVLGCTMNEVPRRVRNQKESRVKQIQKIQESRFKIQRIKIQE

SEQ ID NO: 92577 - protein, 41 aa, Glycine max
  Coding DNA Sequence Number=SeqID_892
MAFMVLSRAPPPVALLGFLRVREKRTEMLLQSCSWFKFLYI

SEQ ID NO: 92578 - protein, 145 aa, Glycine max
  Coding DNA Sequence Number=SeqID_893
  Homolog annotation: Hit_ID=A5ATL8; Match level="QueryCoverage=59%, HitCoverage=68%, E-value=2e-20, Identity=65%"; Hit description =Putative uncharacterized protein
AHPGQAVETTKLEYETKARGANGIRYPSSPSRKRWILGAVRIDPCNAVANALSIPPGEYRRTLPGLDMPRILLKERGAFGNADTGGAWLSSARATAGDKPEEGEDDVKSSCPLCPGRHTCYNGRDKGSRSREGELTPKTRPQFGL

SEQ ID NO: 92579 - protein, 78 aa, Glycine max
  Coding DNA Sequence Number=SeqID_894
MCAHHGGAPGHSIEHCMTLKRKDFQVYAIIVNPSYNAKMEEFDIPVFFILSHTHLGLFNFHGNGGASHRSVCSSDLRS

SEQ ID NO: 92580 - protein, 159 aa, Glycine max
  Coding DNA Sequence Number=SeqID_895
SIWLEAYKNKIALIISKYACELGRINKNQAKAIVSYEVDPWVLVPITFRGLYVLAIRGLHILACRGLHALAFRRLRVLVFIPGPPPDIGGRPTVRAHPERKAITRLLCIPGQDFTRVAAKRRVWIMRTNMTTFTWIWMTLLFSNILPSDHNANLPLQMY

SEQ ID NO: 92581 - protein, 137 aa, Glycine max
  Coding DNA Sequence Number=SeqID_896
MRAGNSDLYGFLEPRSIQRSGQSQFETESYIKSWMQSSKCDVHLGAYLNAGHWQMVVIVPKEHLVVWFCSLHNRPYNYLKGIINSALKGLDDAPQPKSKAPTRWIVVKCNRQKGTSYYVMHWMTTIILGSFRNNWEA

SEQ ID NO: 92582 - protein, 236 aa, Glycine max
  Coding DNA Sequence Number=SeqID_897
VRKAWEVVQKEDKEFRGSNNGPIGGYHEWLKAHVQALDWLPSLRTAKREEVEAPKEDEEVARREEHGWNKFRGALWGSNSELKLWKEERDQSREDNLILKDELKACFRSKKSLSQRLCETKTNMLAIISKYQEELNLATTHEHRVADEYAQVYAEKEARGRVIDSLHQEATMWMDRFALTLNGSQEIPQLLAKAKAMADTYSAPALYVGLVLCHGKPEGPYHLLNCTHGALRPQMR

SEQ ID NO: 92583 - protein, 171 aa, Glycine max
  Coding DNA Sequence Number=SeqID_898
  Gene Ontology: Mol. function=nucleic acid binding; Biological process= DNA integration
  Homolog annotation: Hit_ID=A5BBN5; Match level="QueryCoverage=54%, HitCoverage=10%, E-value=2e-18, Identity=49%"; Hit description =Putative uncharacterized protein
YILCGTSRVYIYLGCNTENKRGYISCGLVQVEGISTWLFKENKGGYIPCGSLLVKDFTRLLEISRTSGCLGTGLFHIARCESAKEIWKMLEVTQEGIAVVRRARKNTLVSEYVAFQMKNGETIYELQTRFTHIVNHLLGLGKTYEDGELNIKILNCLTRTWESKIATIKVM

SEQ ID NO: 92584 - protein, 117 aa, Glycine max
  Coding DNA Sequence Number=SeqID_899
  Homolog annotation: Hit_ID=A2Q1D6; Match level="QueryCoverage=68%, HitCoverage=12%, E-value=8e-10, Identity=42%"; Hit description =Ovarian tumour, otubain, related
MDEDQWRYDFAMSPEVHMDYDYDNQEECGVNEPHVDCSNAFNTSQVFATRDDVLQWARTVTHENGFVAVVMRSDTETGSRGRSSFVLIGCERSGMYKCRNKEFVRKDTGSRKCGCPF

SEQ ID NO: 92585 - protein, 327 aa, Glycine max
  Coding DNA Sequence Number=SeqID_900
  Gene Ontology: Mol. function=sugar:hydrogen symporter activity; Cellular component=periplasmic space; Biological process =carbohydrate transport
  Homolog annotation: Hit_ID=P02924; Match level="QueryCoverage=99%, HitCoverage=99%, E-value=1e-165, Identity=89%"; Hit description=L -arabinose-binding periplasmic protein precursor
  Pfam annotation: Domain name=Peripla_BP_1; Domain location=25-320; Score=467.4; E_value=1.9e-137; Accession=PF00532.12; Description =Periplasmic binding proteins and sugar
MHKFTKALAAAGLAALMSQSAIAETMKLGFLVKQPEEPWFQTEWKFADKAGKDLGFEVIKIAVPDGEKTLNAIDSLAASGAKGFVICTPDPKLGSAIVAKARSYDLKVIAVDDQFVTAKGKPMDTVPLVMMAATKIGERQGQELYKEMQKRGWDVKQTAVMAITANELDTARRRTGGSMAALKAAGFPEKQIYQVPTKSNDIPGAFDAGNSLLVQHPEVKHWLIVGMNDNTVLGGVRATEGQGFKAPDVIGIGINGVDAVSELSKGAPTGFYGSLLPSPDVHGYKSSEMLYNWVTKGQEPAKFTEVTDVVLITRDNFKTELAKKGLM

SEQ ID NO: 92586 - protein, 54 aa, Glycine max
  Coding DNA Sequence Number=SeqID_901
MGARDESIMHKGNKNPDPVNDPVHAHSGPVLVQMMDPVKEAGPKLVQMAQVEEI

SEQ ID NO: 92587 - protein, 50 aa, Glycine max
  Coding DNA Sequence Number=SeqID_902
MAAEWRRRRVERRRHFKEKMSQEEAHHHRKPWIRAWRSNPRFSTEYAYVA

SEQ ID NO: 92588 - protein, 39 aa, Glycine max
  Coding DNA Sequence Number=SeqID_903
MSSHSDSVISNGLMAYGKKIKFWEEKGKNENEAKKRHLT

SEQ ID NO: 92589 - protein, 379 aa, Glycine max
  Coding DNA Sequence Number=SeqID_904
  Gene Ontology: Mol. function=aspartic-type endopeptidase activity; Cellular component=small subunit processome; Biological process=DNA integration
  Homolog annotation: Hit_ID=A5B973; Match level="QueryCoverage=56%, HitCoverage=27%, E-value=3e-26, Identity=34%"; Hit description =Putative uncharacterized protein
MASTSSVTPSKARAPIFSNLLLSIEKLDGSNYSNRTSEVTLWISRLGYKSHLTSTIDSILAVDRAQWAKIDANLCSVIKSTLHPSLKSIFLPHIICKSVWTEARALYTNDTQQLYGLLPLAASIPIEAKKELEKCSAFFMTLALYGMPPEYSATQDQIHGSPVAPMMASTCSTLLRIPPKPTTNIPTPMMGDTSTLASQSNNFGCSRTRSSNSELSQLHGKPPHPANVAQTTLLIPLIPLISLTVLQLPMRTFSSSVRLQFAPFSHSDPTTSTSTDLQRGVEILPPAASIPAKAKKESENRSAFFMTLAFYGLPTKYSVIHEQILSSPAVPMMTFASSPLLQISSKLHSKPLHPANVARTPVVEPTEPVDHPRATPAAC

SEQ ID NO: 92590 - protein, 136 aa, Glycine max
  Coding DNA Sequence Number=SeqID_905
MDFKYLSEYDTMVDILPNALVLHHFGSKAVEENLGHQHFGVFKEVMDAIQQEMGIDDIANAFQRVDVEEMLDMNSWFLVFHCDFGSENSHRCRPSNLNKGTFLRWRERLGCKEVSERESVKRLHKGEERERDHVGS

SEQ ID NO: 92591 - protein, 54 aa, Glycine max
  Coding DNA Sequence Number=SeqID_906
MEEKVNLKINRGLRSTNLKLLCSDNHLMEACLRSFYEGDAVEDKGEEVREGTIH

SEQ ID NO: 92592 - protein, 65 aa, Glycine max
  Coding DNA Sequence Number=SeqID_907
MEVIYLSLMEEVLKNTWEHVYGTLTSLHKLSSLITLLGKAWKRGRNGVSIPLDQLVKKRKNEHEW

SEQ ID NO: 92593 - protein, 58 aa, Glycine max
  Coding DNA Sequence Number=SeqID_908
MEMKRRESIGAEMERKSCLTPTAAQSNRFFDVSEKNVESNQKGGQKGHLEAFADPWLA

SEQ ID NO: 92594 - protein, 108 aa, Glycine max
  Coding DNA Sequence Number=SeqID_909
MGDTYEVPRDHTLADFEPHLRYATEGQAFCGIPLPNTLGGPQYRPQPQPLHFAVERLRVIERGRNYAFADMAKLCLVPDIVIPPKFKVSDFDKYKGTTCPQESPKDVL

SEQ ID NO: 92595 - protein, 347 aa, Glycine max
  Coding DNA Sequence Number=SeqID_910
MSKKTRKSTWLTSLATRLVGAERPVVHVDPATGKVDGPYKREWWKPFKLDFTSKWALEDGKEGEYDKVCQKYDIRKEKWNQFCQSRREPSWEAHAIQKQNTTPYVLSRGGYDFLEEKLMEDKKKKRLEEATQSKSTNTILDLAFPIRRYVKWKMTRMKKSSHMTSEHPDHVRAVGVGVTIKQYIGSASRSSHTRRCNHRDSHNLLPPKPEVGTFAARVSTKESCFNPSGKDPDTDDSKKCGLYVDESPPCLVGLGRVYEGSMTIHNVPLGNDQVKHEKHDFPLSSSPKATKTLTPPSPPPTTTDGHHEPPLLAAEPPHQEKHCNQSGILLKDSVEKTPLTLPYVASM

SEQ ID NO: 92596 - protein, 113 aa, Glycine max
  Coding DNA Sequence Number=SeqID_911
  Gene Ontology: Mol. function=catalytic activity; Biological process =metabolic process
  Homolog annotation: Hit_ID=A8GKE1; Match level="QueryCoverage=96%, HitCoverage=41%, E-value=4e-52, Identity=87%"; Hit description =Putative uncharacterized protein
MNIDDAGHRFGLSSPQYRNAARRADGSLSRYLPEWLAAGYQVLVTADHGMNDDRSHGGVLPEERQVPLFVFGSGFSQDDADPQQTELCGTICDLLQVPHDKPRCRALLAQDAR

SEQ ID NO: 92597 - protein, 103 aa, Glycine max
  Coding DNA Sequence Number=SeqID_912
MGCTGSYLAHGPEIYPKAHKNPRAFSCISGPIYLEFFYPMPLRSRIASYTLFAIQRQSSLMAPEDKSWVIGTHFAIQRQSNLTVHRDKTESSRPSLASRDNQV

SEQ ID NO: 92598 - protein, 104 aa, Glycine max
  Coding DNA Sequence Number=SeqID_913
MGLCQFYVVPVAPSKIIRPPTNRAFIKKYCVPRQAQGETPQQPGDGRQRATDVPPSPLEFISTHPQKGHPLYPRTASKTLTYIMTSRSTSLEPESQLTINLDLG

SEQ ID NO: 92599 - protein, 31 aa, Glycine max
  Coding DNA Sequence Number=SeqID_914
MATPMSTACYLDKNETRQSKTLSNIEISIKS

SEQ ID NO: 92600 - protein, 63 aa, Glycine max
  Coding DNA Sequence Number=SeqID_915
EKVQKESGIRSRGQARGSDSITKAISKRKKFNNYLIWAAAAALLVLLLVVLGYISFLSGWLGL

SEQ ID NO: 92601 - protein, 125 aa, Glycine max
  Coding DNA Sequence Number=SeqID_916
MDQSRVDGMILKDELKTCLRSKRSLSQRLCETETNMLAIINKYKEELNLATAHEHKVADEYARVYAETEARGRVINSLHQEATMWMNQFALTLNGSQELPRLLAKAKAMADTCSAPEEIHRLLSY

SEQ ID NO: 92602 - protein, 81 aa, Glycine max
  Coding DNA Sequence Number=SeqID_917
MIMRGQDIYSSQEETISSPSSNGSEDEVRDEESSEEVYPHEEGDLLMKIIYNGLTNEITLTHLGTKFVLHPQTPSQVAKDQ

SEQ ID NO: 92603 - protein, 57 aa, Glycine max
  Coding DNA Sequence Number=SeqID_918
MSRERTSLEEYFLEASALKSDQRVMDGRNHRAIADALQALAQAIRNPNRGEAAGGIL

SEQ ID NO: 92604 - protein, 226 aa, Glycine max
  Coding DNA Sequence Number=SeqID_919
DEKEVLQTVNERRRQFKSYLTRKWALVADQDGVEDTVCEKYDISKEKWAQFCQTRRDPSWEDVRKKAHAIQKQNTAPHVLSHVGYEYLEHKLLVEKTKKKLEEAAQSGSVDCIIDPPSPVRCHVKWKMARTKKTGDMTIEAAKKIAEKIAAQGSFVPHGRQDVLTVTIGSPEHPGRVCAVGASVTIKQHFRSAPRTSRSSSSLPLEELQQLTQQIRDQLEESITEK

SEQ ID NO: 92605 - protein, 43 aa, Glycine max
  Coding DNA Sequence Number=SeqID_920
EKGSYGKRIVHERSKESTFSIYTWVAMHVVGSHVDLNESSFPR

SEQ ID NO: 92606 - protein, 64 aa, Glycine max
  Coding DNA Sequence Number=SeqID_921
MSVHVAQVIANVIYLFAAFIEKYCTPRQAQGDAPQAADAPPPPHQADPARSLGMECYLQHLVRQ

SEQ ID NO: 92607 - protein, 25 aa, Glycine max
  Coding DNA Sequence Number=SeqID_922
MKAKCNQRWLGGAKTVSPGLLAQAS

SEQ ID NO: 92608 - protein, 81 aa, Glycine max
  Coding DNA Sequence Number=SeqID_923
MCCTLHLKTLSGGNMRKGKRGAVDLDGDKVTACANLAGPRCVGESGWCWVAAHVEEIWSNGGSGDGLGRRRERGRGAKKGY

SEQ ID NO: 92609 - protein, 90 aa, Glycine max
  Coding DNA Sequence Number=SeqID_924
MVWKADPSGFYSTKSAYRLLMTFSKPIPQRRILQTIEACNAHKKFSIETKWGTMMGSYPFSEEQPIPLTLNTREISNAYVGFCLPKIDSP

SEQ ID NO: 92610 - protein, 30 aa, Glycine max
  Coding DNA Sequence Number=SeqID_925
MPSQLTSTLLFDERLGQLENEEAREWGATT

SEQ ID NO: 92611 - protein, 59 aa, Glycine max
  Coding DNA Sequence Number=SeqID_926
MRKAPRFPKGERRTGGRSLWKNASNAAFLRFLAFCWPFAHMFFPALSPDSVDNRITAFE

SEQ ID NO: 92612 - protein, 269 aa, Glycine max
  Coding DNA Sequence Number=SeqID_927
  Gene Ontology: Mol. function=4-aminobutyrate transaminase activity; Cellular component=cytoplasm; Biological process=gamma-aminobutyric acid metabolic process
  Homolog annotation: Hit_ID=A8GJW0; Match level="QueryCoverage=95%, HitCoverage=62%, E-value=1e-108, Identity=76%"; Hit description=4 -aminobutyrate aminotransferase
  Pfam annotation: Domain name=Aminotran_3; Domain location=5-261; Score=99.0; E_value=1.4e-26; Accession=PF00202.12; Description =Aminotransferase class-III
MCGFYAERAENATLWDVEGREVIDFASGIAVLNTGHRHPKVIAAIEKQLQAFTHTAYQIVPYESYVSLAERINQRAPIAGPCKTAFFTTGAEAVENAVKIARAYTGRPGLITFGGGFHGRTYMTMALTGKVAPYKLGFGPFPGSVFHGQYPNALYGVTTEDAMNSLDRLFKADIDPKQVAAIVLEPVQGEGGFNVAPGRLYAGVARAGATSTAFFSLPTKNRPASPRTGQAVSPWSTTVVKTGSDHHGEKALAGRAWPLVGGGGAAARV

SEQ ID NO: 92613 - protein, 125 aa, Glycine max
  Coding DNA Sequence Number=SeqID_928
MTKLGLCLSSGSPPLDDKKVRITVRMTKLGLCLSSGPPPLDDKRVRITVRHLRVSWVQNDCHTLISSGNLCSMTCDHSLVLVRPIWALQKIPPEGGCFWRKQPCSPGRAELAWASWAASISPILL

SEQ ID NO: 92614 - protein, 168 aa, Glycine max
  Coding DNA Sequence Number=SeqID_929
MWEVPFIPEPLAHVAQVIADAIYLFVGMPPTRHPLDPDKSHRALGFPALITGLCQSFGVPVTPSKVIRPSITRAFIEKYCTPRWPTTVGRCRYMSVSIGSASVSRVRVPLLLHYLLQSSLGAKVAWPRDWPEAQAGEEPAGSPGEADEACMDEDMTDLLGFLGGSGAT

SEQ ID NO: 92615 - protein, 117 aa, Glycine max
  Coding DNA Sequence Number=SeqID_930
MDISEDTDIRVSLGRPFMLTASCIVDMGKGKLELGFEDQKIDFDLFVEDKPTPEHNVCLQVMGEGQEVLKVRTKTPFTKRLLLAKRIIVHALSHEIQALGAQPWHLRLTNSTKLAKV

SEQ ID NO: 92616 - protein, 261 aa, Glycine max
  Coding DNA Sequence Number=SeqID_931
AEMDFDRHRFQSAEHQQQFEAIKGWSFLRERRVQLRDEENVEFQEEIARRQWAQLVSPMAKFDLEISVAMRSGVGLCPKRSGETGADHVHQHDHHHADLDDFARITPPRHPVDPEKSNKALGFFPLITGLYQFYGVAVTPTKLIRPPINMAFMEKYCVPRQVQGQAPQQPEEDQQQPAADVPLSPLEEVSSLRSIFDHLQRIELQMHGYMHHVTSQQAANHRGQPGDETDFETRAGPAGAPGDDGGAQEDDDMADALDFFT

SEQ ID NO: 92617 - protein, 151 aa, Glycine max
  Coding DNA Sequence Number=SeqID_932
  Homolog annotation: Hit_ID=UPI00006A2D9E; Match level="QueryCoverage =88%, HitCoverage=77%, E-value=1e-12, Identity=15%"; Hit description =UPI00006A2D9E related cluster
GLRVLTFRGLHVLTIRGLQVLAFRGPHVLAFRGLHTLAFSGLHALALRGLHVLAFRGLHTLAFRGLHVLAFRGLHVLTFRGRHALTFKGPHVLTFRGLHAFAFRGLHVLTFRGLHVFAFRGLHVLAFKGLQVLAFRGYTPSPFEGCTPSPS

SEQ ID NO: 92618 - protein, 124 aa, Glycine max
  Coding DNA Sequence Number=SeqID_933
PPPTLADPSAQSSQTSDAKLQSLFEGQILIMQSLQELAQQRQIMSVEKFIEKATHPRPMPVSADAPFPGVDPSSPQHVADSSIPVLEIPEGQTIPVLTLDTSPPATPVLHLIDEEDVQTQDTQD

SEQ ID NO: 92619 - protein, 113 aa, Glycine max
  Coding DNA Sequence Number=SeqID_934
  Gene Ontology: Mol. function=transporter activity; Cellular component= membrane; Biological process=oligopeptide transport
  Homolog annotation: Hit_ID=A7P784; Match level="QueryCoverage=72%, HitCoverage=13%, E-value=8e-24, Identity=63%"; Hit description =Chromosome chr9 scaffold_7, whole genome shotgun sequence
MMKSSDAANEKLLENGTSSSQIKKGGLRTMPFIIVNECLEKVASYGIMPNMILYLRDDYLMPIAKGTSVIYTWTAASDVLSLFGAFLSDSYLGRFLVIAIGSFSSLLVSLLFF

SEQ ID NO: 92620 - protein, 442 aa, Glycine max
  Coding DNA Sequence Number=SeqID_935
MASRKRKSISSRPTTQYDTRRFHSLDAWNRYMDNVFGRNILPERKVEIYHTELDDFKTELERCNFHKHFTNLVDGIIDLALLKEFYANLFSSESPSPKQVRVRGQRVKIDADSLNIFLETPVVLEEDYREIEAALCIPGRGFILNAEGHPRKILRKDLTTLAQVWSILSYSNLASTSHTSDMIVDRARLIFDLVSHMDMNVVALISSQITSIAQSNSSRLGFPALITALCRARGVVSDSLVFERLSSIINLAYIRKNCWNPDDLTVTIRGARRARPAELPSTYVVPTPASSSAATSVPAHTDSQRFEAMLQSIHQGQIILLQSLQVVAPPGSIPSVEQFREMVAWPGTQPSLHREDEGPTAQVPQHVEDESSEATIPEPFIIGEEAEPPTPVMDISSPQHAADPSTPILEIPEDLTTPVLNLNTSPLATLVLHLIDEEDVQT

SEQ ID NO: 92621 - protein, 63 aa, Glycine max
  Coding DNA Sequence Number=SeqID_936
MKKMKVSSFLAKRGFISKSVERKIEAQNKARKPKTSDFKRILGLGVISRFLEVEETSPPLCNL

SEQ ID NO: 92622 - protein, 170 aa, Glycine max
  Coding DNA Sequence Number=SeqID_937
RKTKMFVDPKNENMATLAEVAETLQYMVSPQGRNTWAIDDLVPCVEKITILSEEQERITEPLSHGPTTEPEFPAQQLNILQSSVETKGITKRRETVEVKPYVYSQMAERGHGMYYTPPTFSQYPTRMYQYSFEAHQSDTSASKHSLGGVAETWEFSMAYYDLFTATQCSN

SEQ ID NO: 92623 - protein, 108 aa, Glycine max
  Coding DNA Sequence Number=SeqID_938
  Homolog annotation: Hit_ID=A6H5N3; Match level="QueryCoverage=43%, HitCoverage=70%, E-value=4e-07, Identity=64%"; Hit description =Putative uncharacterized protein
MPPAFIVSQDRTLHEIPSCITYSFSFVDKGDSEFSSIPRHNLYPGASYSTGVRSQKYSPPTPRVIPRACYPFSIIIRSRHTNRKTYIGFRDNQARTDNFHHVKVTLYR

SEQ ID NO: 92624 - protein, 149 aa, Glycine max
  Coding DNA Sequence Number=SeqID_939
AFHKGRQIDWAHLVRYRMHKALRLNAPLPYPHLVTLFLQHFNIPLDSEPYVPIKRSFLIGAVVIASFGYRKEHDGSWLRKGAQPIDEEGNLHGGEDSSLLQKILDRFDTLELQVDMRFNEMESWITKVEEDVSYIHTSFDLPPPLPPSS

SEQ ID NO: 92625 - protein, 102 aa, Glycine max
  Coding DNA Sequence Number=SeqID_940
  Pfam annotation: Domain name=zf-CCHC; Domain location=30-47; Score =32.4; E_value=1.6e-06; Accession=PF00098.14; Description=Zinc knuckle
KFHKFIKNRRIERSHNFNNGKRSQEVSPTLKCYKCNQPGHIKAKCPSNESWSEKNEKKSYKERRSKKAYIAWDDNDSSDGSEKEISLLSKDYESDENISQED

SEQ ID NO: 92626 - protein, 142 aa, Glycine max
  Coding DNA Sequence Number=SeqID_941
  Pfam annotation: Domain name=zf-CCHC; Domain location=80-97; Score =9.9; E_value=0.049; Accession=PF00098.14; Description=Zinc knuckle
MELQRLNQHEENDRKKKGITLKASFSIQEESDIEDSIDLDEDEDLSLFVKRFNKFLRMRGNQRRPNFKPKRRIEESFQTPKCFECNQPGHLRKIIGEKKAKKPYITWDDNDLESSDDSEKEVINLCLMGKNYESNEEELDTN

SEQ ID NO: 92627 - protein, 71 aa, Glycine max
  Coding DNA Sequence Number=SeqID_942
MAEEKPRRVTFEDYSSTSVPQYFSRVAQLEVQAQNLTYPPSLIQLIQSNLFHGLPNEDPYSQFVRAKRLDP

SEQ ID NO: 92628 - protein, 142 aa, Glycine max
  Coding DNA Sequence Number=SeqID_943
MTTLTQIWMTLLLSNIQSSDHNSDLPPAEVSVGMAPTRHPLDPDKSNRALGFPALITGLSQSFGVPVAPSKVIRPPITRAFIEKYCTQRQAQGDLRRPQTRSHLIRLVQLDHLIRSSIYDIWFASRRPTTGRMYRPMIVFTS

SEQ ID NO: 92629 - protein, 115 aa, Glycine max
  Coding DNA Sequence Number=SeqID_944
VEGQAVTWEAFKRGNMIVAEYAVMFEELVRYFPHYQRRDGEIGGLVGACVLSAILARLARISEFRLSAHLFAYRMDSSGALSGISPRSANMHNSSFFQILPRAQPQEWCAQRMAR

SEQ ID NO: 92630 - protein, 34 aa, Glycine max
  Coding DNA Sequence Number=SeqID_945
MGRKKLELDFEDQKIDFDLFVEDKPAPEQNVRLQ

SEQ ID NO: 92631 - protein, 153 aa, Glycine max
  Coding DNA Sequence Number=SeqID_946
  Gene Ontology: Mol. function=chitin binding; Cellular component =extracellular region; Biological process=chitin metabolic process
  Homolog annotation: Hit_ID=UPI00006A17C9; Match level="QueryCoverage =91%, HitCoverage=100%, E-value=5e-18, Identity=31%"; Hit description= UPI00006A17C9 related cluster
MATTCSPLKERTCSPLKVGACSPTKAKVHDPLMARTCSPLKVKVHDPLKAKTCSPLKVKTCSPLKARTCSPLKARACGPLKARTCSPLKARTCSPLEARTCSPLKVKVHDPLKVRTCSPLKVRACSPLMARTCSPMMARTCNPLKVKVHDPLK

SEQ ID NO: 92632 - protein, 76 aa, Glycine max
  Coding DNA Sequence Number=SeqID_947
MSLFDWSKKGPLLFLTVTHTQSQKTTTRQLAGYLTLLQCWIYEHFPSVHRVTPKAYTPKSPSGPLPPDLGPTQKTF

SEQ ID NO: 92633 - protein, 84 aa, Glycine max
  Coding DNA Sequence Number=SeqID_948
MMSPPDSIPTVEQFNEMVAWPGTQPSLHKEDEGPTAQVPQYIEDESSETTIPKPFDIGEEAEETQVRQVDATTLIETIPESNKH

SEQ ID NO: 92634 - protein, 76 aa, Glycine max
  Coding DNA Sequence Number=SeqID_949
MALTRDLCKETTHGAFWFAHIFYFLGHAFIPEKGIRNTRMCTYAIFDSQSALSMHEMAPKEACLKEVQEGQGGRRI

SEQ ID NO: 92635 - protein, 74 aa, Glycine max
  Coding DNA Sequence Number=SeqID_950
MAEEDALSLDNIECGVCAEYTDAGVYGRRNSGSNKEAFEMGERRLHLSWTHSERNYETLLNPSIWQKMPQVTNS

SEQ ID NO: 92636 - protein, 114 aa, Glycine max
  Coding DNA Sequence Number=SeqID_951
MPPTRHPLDPDKSNRALGFPALITGLCQSFGVPVTPSKMIQPLITWAFIEKYCTPRQAQGDALQAADAPPPPHQADPAGSFGMERYFQHLVRQQAANHRGQVQIHECLYQLSLS

SEQ ID NO: 92637 - protein, 140 aa, Glycine max
  Coding DNA Sequence Number=SeqID_952
LFVLQIAKKNVYTDNHSGISARQRDLKVSMTDLVSAEDDAFVLQIAKKNVYTDNHSGISARQRDSKVSMTDLVSAEDDVNLRVSTGLSAAIDEGRRRRRISACQRDSKVIMTELVKMADKSEALAPTYPPMRNSDLRSSG

SEQ ID NO: 92638 - protein, 154 aa, Glycine max
  Coding DNA Sequence Number=SeqID_953
DHVALSTFIVAVDQNDADAKRAYALSVNNELDRRHWWEELTDFLDGNIDVAIVKEFYANLYDPEDKSPKQVRVRGHLIEFDEDTLNTFLKTPSTSAPSEAPTPSSSPVPPSSSTQIPVIPPASLQMPLPAPLYAGPSYFLFTPQMLHSMMQSLH

SEQ ID NO: 92639 - protein, 109 aa, Glycine max
  Coding DNA Sequence Number=SeqID_954
MKNWMQNSKRDVYLGAYLNGPNNYLKGIINRPVLFSNTFALALLSNINIVMFLVFNSALKELDDTPQPNSEVGDRWIVVKCNRQKGSTECDYYMMHWMSTIILGSFRNN

SEQ ID NO: 92640 - protein, 123 aa, Glycine max
  Coding DNA Sequence Number=SeqID_955
  Gene Ontology: Mol. function=peptidase activity
  Homolog annotation: Hit_ID=Q8H6W2; Match level="QueryCoverage=54%, HitCoverage=70%, E-value=2e-09, Identity=52%"; Hit description=Gag -protease polyprotein-like protein
MASSNYLFPEGNSMNRSPIFNGVAYHYWKTRMQIFIEAIDLNIWEAIEIGPYIPTMVAGNVEAMTSKIILMIPKNQELSKFQRIRSQKASRIKFQRIKIQEQSSFKIQSSFKNQDSRTIKIKI

SEQ ID NO: 92641 - protein, 99 aa, Glycine max
  Coding DNA Sequence Number=SeqID_956
MEANWEGVEVGVSLSEANALSEYHPLSEASARLASQRNLEGNLPRKHAPSAPSARLAIRLFLLALSVPSSLSQKRSVRNKERKRKTEPGSQKPQLSRGS

SEQ ID NO: 92642 - protein, 182 aa, Glycine max
  Coding DNA Sequence Number=SeqID_957
MLPERNDNLFVTEYDDFRRELIRRNCHRAMTQHVDGHIDVALIKEFYSNLYNPEDKSPRQVQVRGKLIKFDGESLNAFLETPPVIQPGEQYTSYSLFCKSRPGPQEFAARLCIPGTLKARARGFEGPSSSAPPVPASTSALPSVSAPLPPPSLAVRIGASAQSSDLMVSMLQSLHHGLCIVM

SEQ ID NO: 92643 - protein, 83 aa, Glycine max
  Coding DNA Sequence Number=SeqID_958
MPMRGGSNTTVNLAGIVNTHGGAVAERNADEEDNDDDTHGGNKCVANDDDGVRKETKSFSKEEEEKNGEQEEAERGREGERRE

SEQ ID NO: 92644 - protein, 120 aa, Glycine max
  Coding DNA Sequence Number=SeqID_959
MVSTRGLGRVLGHVTGRGDRDDSDDTPQRRRPTASARRQRVHVTATHDEPVLPAPDVEADVFPDDPMAPADVEDTGGDIPADTGAQATEDEHGRFPGGLSDPSVLTQYADHVACSVWTGE

SEQ ID NO: 92645 - protein, 132 aa, Glycine max
  Coding DNA Sequence Number=SeqID_960
MCHFGYTQTIRAPPVDSWVSYDDIYDSECTIRIIWFQQPRVVPRAPETDIPHVSEPGAPSTSARTAMEKPRHAVEVCHGIAERLERHHSLGVVTPGSSTHEVIEECFRMARSVTQDQLVYVRSRRRRCTDQV

SEQ ID NO: 92646 - protein, 101 aa, Glycine max
  Coding DNA Sequence Number=SeqID_961
MHGASSDGAFKLDEARGHENAIVSSVFAFVELALEAPAAVATAVQALGPLEAPAAVATAVQALGPCCSAEACREAPVITAFSLLMLWKRHWYLPFAWKRQW

SEQ ID NO: 92647 - protein, 91 aa, Glycine max
  Coding DNA Sequence Number=SeqID_962
MEVVGTSMMFESWNVNLLGEPLPLNFVASMVDSSAMELKQKGCTEAVMMIKFIWSPPLSLPPLKPSDLNFHAGTVGRSQLKLQGVQLSSSN

SEQ ID NO: 92648 - protein, 200 aa, Glycine max
  Coding DNA Sequence Number=SeqID_963
MPSKHKPKTHLCYSHPNIIEVPSVYHKQWAPDYPNYVVLDYNGKKHHIRVRKFNNRVYIADGLKHFRRDMGIYEGVMITFAAPDKNWKFDIHFSPPLHAQTCGRPAHSAREYILPLDAVNYVNAGDEYITVLGVRGHRHFWKLSMHNGLQCFAEPWFQFLTENDLMAGDEVVFYFRPNQLLWEVIARKQTVWDEDEDDSP

SEQ ID NO: 92649 - protein, 200 aa, Glycine max
  Coding DNA Sequence Number=SeqID_964
  Homolog annotation: Hit_ID=Q9SH74; Match level="QueryCoverage=95%, HitCoverage=43%, E-value=9e-11, Identity=26%"; Hit description =Putative replication protein A1
MWRLNKHNGRQSIEMVLMDHTGTKIGATLWQELFTEFEPKLHCGGAYVIQNVKVVDTHSDYKTTSVKEVDRPEIPPNVHAITSFADIISGVAKPNTLVDIVGVIAEVIERKTVNPAYRVTVKLRDNSHAEIIMTVWKEYALQLDDAIKKNHFVQKSLVVMLTLAKIKEPKDKYPLNVQNIKHGSKLYVNGDIVEIQQFHD

SEQ ID NO: 92650 - protein, 84 aa, Glycine max
  Coding DNA Sequence Number=SeqID_965
MEIFNRSIDPSAWNAIVKGPFIPNKEVNGELVPKEWDEMKDDEKRKVQDDQKAKSILTFFILQGAKVKRKYGKCLMSLIQALRM

SEQ ID NO: 92651 - protein, 260 aa, Glycine max
  Coding DNA Sequence Number=SeqID_966
MDGVIFFEVHKIPIVVDQSLFYSLTKLSSQGVPFEGTLVDDWKHIYSSHDARKMVRNDHADMNGRLFAGSFTFECRIMHYILCRVLLPHSTNLAQASEEDLILLWTLQIDRQIDWAHLVKYRMHKALWANAPLPYPHLVTLFLQHFNVSLEDEPFVKVKHSFAIGVGVVASFGYQKDVDGQWVRKHNLPPLIPDERTPSSPLQRDSSSSLLNDVLIELRDLQAFVDDHFYAMDSRITHLEDDMSFIRRSLILLQIHRRFF

SEQ ID NO: 92652 - protein, 551 aa, Glycine max
  Coding DNA Sequence Number=SeqID_967
  Homolog annotation: Hit_ID=A7UQU7; Match level="QueryCoverage=61%, HitCoverage=68%, E-value=2e-27, Identity=28%"; Hit description=IMP dehydrogenase/GMP reductase, putative
MVKTRGLGHALGRVVGRGLGRGDGDDSDGAPQHRRPTASAHRRRVTVIVDDVVPAVPADSSAVPETEAVVARDEPMVDADAQDTGPDTDAQDIGTQDAADEPEGFLGGPKDPSVLTEYADHVAANVWSGQECPELMLCSHGRKEHNLGRLVPAIDDMETSSFHLPVGEVSITLDEDASLLHLPIVGTFHDFQPLRTDEVVVLLVELLMVLAEVAMTETGQYGGPYVRLQCLRDVYQCRCQTQHWIAAARAYLLHLLGCTLFANKSATHVHVSHLQALCYLTLAGRYAWGAADLVHMYDQLNDASLNTSRQLAVAECNADLDYDEVSPHVCWWITTKKTMKKVSTAMYRQRLDHLRIPDVCWMPYTEHQPVQDFHPISCFSGQLRWGPVVIRYRLERVMHQFSYVQCILAHSVHSWVSYDDVDNTWMHYSDHLVAADAYAMQPNHIPHEAALASTQADLDADEPRHAVEACHAITEALEQHLNAPGTSTHEEVIQKCLSIVRGVTEDRNVYIKLICVWLTDQLDPHLVRLCYTDYLDPQETFADQVDPQIFY

SEQ ID NO: 92653 - protein, 93 aa, Glycine max
  Coding DNA Sequence Number=SeqID_968
MMTKSSKSQDHFMITKMMTFKNEFKIESRTLQGSRGNLISRIKIQDSKIQESREDLIKISIKKSKLHDESRLIQRVLMITKMMTKSSKVKNTS

SEQ ID NO: 92654 - protein, 54 aa, Glycine max
  Coding DNA Sequence Number=SeqID_969
MVLITPLFCSAGSCSGSSNLQCCDQYHNDICSTCLHLTPVSEVSSSVAEWVPPS

SEQ ID NO: 92655 - protein, 144 aa, Glycine max
  Coding DNA Sequence Number=SeqID_970
  Subcellular localization annotation: CTP_CleavageSite=70; ConfidenceScore=5.09e-01
MESPTVTTYPLVGGRCETQGCVFQRRKMRRSRHQRLFEKNVRKTKKGSANFKNKGSGVVYVRGSSPRRVVASTRSNLAHPARPSELVTSPLSYLGSPGELEASLGEPGIRKSFKMTLLPSYLDSKFVADYARIDSRHVRWLPSK

SEQ ID NO: 92656 - protein, 250 aa, Glycine max
  Coding DNA Sequence Number=SeqID_971
MVSNPSRAQKKAKTSKRKFTDESKKNDYKMIYAIKNVRIPKYLDLEWFSQQGFNFPNLLEAQGLLKLVQMKKTFYPKLVKVFSTCARADFEGGVRKFDETPDEYNKMQYYKGMLLDPARNLRNHLGVGGLTIEDSILVYLITYIFTLRSRNHAQSHHLVDYEFPYVVLASRFIDYFNVDVSNKIVDFTKVSSEIIERHQVTWNEMNTMFHLHQEHSDEVHSLLENITTQLENIETRLTLNNLLNLDEDEA

SEQ ID NO: 92657 - protein, 161 aa, Glycine max
  Coding DNA Sequence Number=SeqID_972
MEETSLDENSFKCTRCGRGDLFDDFASTESLEGKDKGSPMSKWDDNGSRALNADKGKTVITWEYKTLGHGLRFSNERRLNGRFRRNLGVPGEGPEDKGVQEKEKRTSKDAQADALKLWELSKKSGVNNKENESKMVKRFTDLEARDKEEFEKLSQKNKKGY

SEQ ID NO: 92658 - protein, 70 aa, Glycine max
  Coding DNA Sequence Number=SeqID_973
  Subcellular localization annotation: CTP_CleavageSite=28; ConfidenceScore=5.42e-01
MPKNQKNIDAQSHPGPFGPSRRFLQKAVASGGSNPARLGELSSPGRAGRNHLPYFAINRGGREEGNGRAP

SEQ ID NO: 92659 - protein, 127 aa, Glycine max
  Coding DNA Sequence Number=SeqID_974
MRYRMKTREKKERRRRRREGELESDKAWFHCDGGGRCINPSVATYPSAGGRRVTRVMRVPRKEYARSRHQRLFEENVGKTEKDAIYELLSERFGSCIYARGRVFPFAPTYSSIAMRKSDLRSSFFIK

SEQ ID NO: 92660 - protein, 107 aa, Glycine max
  Coding DNA Sequence Number=SeqID_975
  Gene Ontology: Mol. function=catalytic activity; Biological process =trehalose biosynthetic process
  Homolog annotation: Hit_ID=A7NV04; Match level="QueryCoverage=71%, HitCoverage=21%, E-value=3e-28, Identity=78%"; Hit description =Chromosome chr18 scaffold_1, whole genome shotgun sequence
  Subcellular localization annotation: CTP_CleavageSite=21; ConfidenceScore=5.15e-01
MDATSTLPTPASPTLLCTPPGSSQKKSWAALVEKVRLVLNEYPQLRLTQGRKVLEICLTIKWDNGKALEFLLESLGYENSNDVFPIYIGDDRTNEDAFRLTNVATPS

SEQ ID NO: 92661 - protein, 229 aa, Glycine max
  Coding DNA Sequence Number=SeqID_976
MASKKLLAKRARKTATGEGSSTALPIDIGFNGHRFQSEEPQRRFKEEIVRRHWTQLAEPMAKYDPEVVMLISDAIHQFVGIAPPRHPVEPKKSNRALGFPALITGTAIGARPAVAAGRRRTTIASTSATILRAANHRGQMQLNDSFYQYTLHQHHQDPNPYPWPTLEQFKATIAWPRDRPNFLEEAGPTDAQGAATGTKVELRMMERWQICLISSLEEAELLDHDLLNL

SEQ ID NO: 92662 - protein, 213 aa, Glycine max
  Coding DNA Sequence Number=SeqID_977
MDKKELRKFFSHPLAQRTLCAKRMILHALSESSPALSRVISLSAQHSLAKRICALSAIISLPGPSLFKAFGILLAAKRVSLAKPPCLFSLNMPGLSEWPLGRGNLLPLDPRSPMTPLDSYLRAPGRNMHRTFTPGTSFQRGTQPDGHIDVALVKEFYANLYDPEDKLPRFYSTHPDPQELASKLCILGRSFVLNDEGAPWKLLRKDLTTLAQT

SEQ ID NO: 92663 - protein, 181 aa, Glycine max
  Coding DNA Sequence Number=SeqID_978
MEERLRAIEGGGNYAFADMAKLCLVPGMVIPPKFKDSPNVRTNPLANHGSSSVNAIEKRESQELEKIEDVSTPRLFILEALRKAGMVKYNGDKGDRCLLHPGELHDVETCPLSKELLQGFIDEGTPSPFLYISDKAVPWRYNVHGSNRRKDMFGASMPTAKGKVREDVVEREKVGLVTNNK

SEQ ID NO: 92664 - protein, 204 aa, Glycine max
  Coding DNA Sequence Number=SeqID_979
  Homolog annotation: Hit_ID=A5C169; Match level="QueryCoverage=75%, HitCoverage=13%, E-value=1e-07, Identity=27%"; Hit description =Putative uncharacterized protein
MTGRLLSGSLAFESRILHYLIVRILLPRSSNLAQVSEEDLIVMWAFHTGRQIDWAHLVQYRMHKALRLNAPFPYPHLVTFFLQHFNIPLDSEPYVPIKRSFLIGAAVIASFGYRKEHDDSWVKKGAQPIDDEGHLPVGEDSSLLQRILDRFDGLQTYVGERFDALELQVDMRFDEMESRITKVEGHVTYICTCFDLPPPPPPSS

SEQ ID NO: 92665 - protein, 134 aa, Glycine max
  Coding DNA Sequence Number=SeqID_980
MFLFVLSATCSHACIPILCHHSCIAFVSSFCHGKSEEPRGSQFARARAADGPTPTSSLPQDIWEKLGLGYGRSFCGSHRIPYLLVPTVEEFEGILGCPLGGRKSYLFSGLYPSMARVAKVVKISTQELGPSETK

SEQ ID NO: 92666 - protein, 83 aa, Glycine max
  Coding DNA Sequence Number=SeqID_981
MELVSLGSSSSMDSFASWRLMVAEWRRKKDDWRRHFKEKMSQEQAHHHRKPSIRAWRIASPGYKAHHLKVCDNVWVKYVNGAT

SEQ ID NO: 92667 - protein, 198 aa, Glycine max
  Coding DNA Sequence Number=SeqID_982
  Homolog annotation: Hit_ID=Q2HW90; Match level="QueryCoverage=34%, HitCoverage=13%, E-value=4e-08, Identity=45%"; Hit description =Putative uncharacterized protein
MARVAKVVKISTQELDRVKQNRNGVVGIPKKHLEEKAKALADQGEWTSFIYVLALLVFGVILFPNVDGLVDLAAIDAFLAYHHNKESPTVAILADAYDTFDQRCKKSSTRIICCTPALYDKELIRSNNGVIGGQRRSASLESRTGKNASGQGKFQNDSHQRTQASKGREGRVKIGKYDIRGQVEGLSKFKEELDRTVE

SEQ ID NO: 92668 - protein, 88 aa, Glycine max
  Coding DNA Sequence Number=SeqID_983
MQLCLLKGSSPAHQPYHHPPELQPRLWGPLQVLPLALSSVGERRWTPGMVAAVEVVATYLRLAAAGPPPDAAVPDPTVVPASTYNIFL

SEQ ID NO: 92669 - protein, 206 aa, Glycine max
  Coding DNA Sequence Number=SeqID_984
  Gene Ontology: Biological process=protein modification process
  Homolog annotation: Hit_ID=A8MR52; Match level="QueryCoverage=34%, HitCoverage=34%, E-value=2e-23, Identity=67%"; Hit description =Uncharacterized protein At4g32270.2
MATVAELKDAVEAVFSHVPHKGPAKISWAHVWGQFCLCYDGQKLVTEKDYLRNYGIKDGDQLRFIRHVTNNCCVQRKRLKKRVVYLKQHRRSLQVDGHLPKGNCDDNDIGSDDEATDSGKIKHHIEEEEEEEEREEECVGKNKLAGFLGDLFSYTPLAVVRRTRTKSRIWPTTMPKCLLGSLRKIRSIVCFGRRRHYSRRLPWRPH

SEQ ID NO: 92670 - protein, 131 aa, Glycine max
  Coding DNA Sequence Number=SeqID_985
MGNPKGLSIESSSPEFLDEASRGAWKRVSRDGVARVEEEEGGWFVHGQGGGLEVMHAEEKEGAMGHREERKKKKKIWCLAKEREEGMHEVCSSMDVAKRTGDIGVPPLQMARSTLSWRVPPVTQARHADVH

SEQ ID NO: 92671 - protein, 63 aa, Glycine max
  Coding DNA Sequence Number=SeqID_986
MHLWLGQETSLLLEGGRNMMRNRLKHQNAREKGVEGGNDAGTKKEGSGCTNAFWDHLTVECGE

SEQ ID NO: 92672 - protein, 105 aa, Glycine max
  Coding DNA Sequence Number=SeqID_987
MEVVTCEYDWMILWLMSMTENMQTEEPSSHQPTPQSSHYPTPLSSHQPTPVESSIVQLKVKKRLSFELQNIAVGLSSTFGLSTYPPLSYPNFVWGPSIWWDATFA

SEQ ID NO: 92673 - protein, 60 aa, Glycine max
  Coding DNA Sequence Number=SeqID_988
MATKEAFVSSLKHDVLMVDVGSSTVALEVMEDKWCGGLWIEVFGGKCVVDEEREDFTLRE

SEQ ID NO: 92674 - protein, 195 aa, Glycine max
  Coding DNA Sequence Number=SeqID_989
MAGHNVTSKDCDPSSTDAGCTGKSSHSTAPDPYDWPPAGRPHAAYRVPSSACKQRWTLGMVVAIEGAVVHLRLAADGPAPCCCAYLGMQYFSMKVLLMGGRISFVGLALRQGKIKIMITREDVVEEQRHPDLCQGGHASMHDPHPSLHVTRWAKSYLGTHSSWPMASSSNLEAWLLLLLNLQRYPSFRTNGCPKN

SEQ ID NO: 92675 - protein, 56 aa, Glycine max
  Coding DNA Sequence Number=SeqID_990
MLLSQLPLKVTQPVGAVEADLKSNKTEQSVKNANKSEVDSSKDKNKFEEDNLDKEI

SEQ ID NO: 92676 - protein, 159 aa, Glycine max
  Coding DNA Sequence Number=SeqID_991
MDSFLEIRKVTIVIKKKDHALRHPYWKHAKTKIMSEIEEVQEQMKTDMEAMKEQMKKMIEAMMDMRKIMEVNVAASTATERNPTHSPIFNQESNLVLGVEGQGGATGVTAYGPKYTKSHNRYIFPPYGLPPNYTPPMVVLVPAENVTNPIPICTENSPT

SEQ ID NO: 92677 - protein, 61 aa, Glycine max
  Coding DNA Sequence Number=SeqID_992
MKYNDNVMVEIEPGGNNDVEHGKGMMVMGEGVLELNKNPLIGILFETSTIALIPLVTLQDH

SEQ ID NO: 92678 - protein, 48 aa, Glycine max
  Coding DNA Sequence Number=SeqID_993
MKKEYMHICMEKRRGKTGEAGKGTTEKPSPSHQRGLKSKHVTSFKNHM

SEQ ID NO: 92679 - protein, 326 aa, Glycine max
  Coding DNA Sequence Number=SeqID_994
  Gene Ontology: Mol. function=hydrolase activity, hydrolyzing O -glycosyl compounds; Biological process=carbohydrate metabolic process
  Homolog annotation: Hit_ID=A7QRZ5; Match level="QueryCoverage=66%, HitCoverage=89%, E-value=1e-16, Identity=43%"; Hit description =Chromosome undetermined scaffold_155, whole genome shotgun sequence
  Pfam annotation: Domain name=Glyco_hydro_18; Domain location=37-246; Score=34.6; E_value=1.3e-09; Accession=PF00704.19; Description =Glycosyl hydrolases family 18
MPLKRLIITSLWVLFMSTHSLASVESSDSKYAQNIRSVRAAYWPASDDLSPSSIDTKYFTHIYYDFIQQDPQLFHLSVTEFDEKWIPKFINGLRYCYPPVKTLLSIRGGSSNSTAFSFMASNKHTRKVFINSKPFATFWIGQVQCALITMGPGTILWANAALYDLKSNINPNVHGVEAKAVGEATDMNGTMDYDEILVFNKENIATVVYDDVAVAFYSYAGTTWIGFDDGPSIKKKGYFFWAVGKDKDWTISRQGEVPLTGGGTCETKDSDAQRGLMEPTFILVEHGCWSLFVGAVVAFVDNFRLVDNSWELIDNVKDKNLLIDKR

SEQ ID NO: 92680 - protein, 74 aa, Glycine max
  Coding DNA Sequence Number=SeqID_995
MVVGSARSLGWKIKEVLRMTQLSRDDPKSMRHLRMTLTLMPSALLGSSMWKIVFVEVDGEGRDGRMGCGGGGHL

SEQ ID NO: 92681 - protein, 100 aa, Glycine max
  Coding DNA Sequence Number=SeqID_996
GHWQMVVILPKEHLVVWFCSLHNRPDNYLKGIINSAIKGLDDAPQPKSKAPARWIVVKCQQRLEDFKVIKGVVEGDKATKIRCLEKNEPHLDGKGVRGSS

SEQ ID NO: 92682 - protein, 151 aa, Glycine max
  Coding DNA Sequence Number=SeqID_997
  Homolog annotation: Hit_ID=A2Q1D6; Match level="QueryCoverage=71%, HitCoverage=17%, E-value=4e-13, Identity=40%"; Hit description =Ovarian tumour, otubain, related
  Pfam annotation: Domain name=AFT; Domain location=44-140; Score= -45.7; E_value=0.052; Accession=PF08731.2; Description=Transcription factor AFT
  Pfam annotation: Domain name=FAR1; Domain location=58-142; Score= -19.5; E_value=0.0076; Accession=PF03101.6; Description=FAR1 family
  Pfam module annotation: Pfam domain module=AFT::FAR1; Domain location= 44-140::58-142
MLVSSRSFILVRGEVHCVLFGQGESLTKVHRQVVVVWLLTVEVFATRDDVLNWARAVAYEISFVTVIMSSDTNTGMRGKTSFVLIGCEMSGQYRARKKDLVRTNIGSRKHGCPFKLCKKPVVGGQGWMVKLMCGSHNHELAKSLVGHPYVG

SEQ ID NO: 92683 - protein, 241 aa, Glycine max
  Coding DNA Sequence Number=SeqID_998
  Homolog annotation: Hit_ID=A7Q8P9; Match level="QueryCoverage=32%, HitCoverage=11%, E-value=1e-13, Identity=51%"; Hit description =Chromosome chr5 scaffold_64, whole genome shotgun sequence
MLGRDERWRSRHYLQISISFDVLPHIKCSRKHKHPHAYIRGLLEFQYHRCLSTPQTTIGCKRIRNMCTEILPSHSYSLDLIINPPLQKQKQNPRAEKNQRMATMTGVSLSCPRVFFNASGSPQNAHAVKFYDLTGLQNGILKRGREIFLTGCYLRTPTGGSGHSRLLPTEYLVILLDEDFQKEIVKAAKTFTAIGYKHIETVIILKSLQKNKFLLTTDVECSLFYIEGRETFNIVSYDDTS

SEQ ID NO: 92684 - protein, 131 aa, Glycine max
  Coding DNA Sequence Number=SeqID_999
  Pfam annotation: Domain name=DUF1723; Domain location=84-130; Score =9.6; E_value=0.039; Accession=PF08330.1; Description=Protein of unknown function (DUF1723)
MTRDADEAPQQRRSITYARRKWEAAPVHQQPQEAVVDDVVLNADGFSGGPHDTLVMIDYAHHKRPELKLSSHGRKVEKFGKSALKIEGLMAAMGLSPLIACSLDTGEVTITLDDVALLLHLPITGAFHSFK

SEQ ID NO: 92685 - protein, 1578 aa, Glycine max
  Coding DNA Sequence Number=SeqID_1000
  Gene Ontology: Mol. function=microtubule motor activity; Cellular component=microtubule associated complex; Biological process =microtubule-based movement
  Homolog annotation: Hit_ID=A7P9D5; Match level="QueryCoverage=99%, HitCoverage=72%, E-value=0.0, Identity=32%"; Hit description =Chromosome chr3 scaffold_8, whole genome shotgun sequence
RYQDFYEEGEKEILLTEVSSLRDQLLQYHGRNSMQGNSNHDIQPQKAQCCNKENNLVDLELRNTLDELQECRRNLNYCLEENAKLNREVDSLHSMLSSTNSTKVSTKEPFIEAQAVPRMGVKHETHLSQHTNDILNLQLELDIINVILKEERSFRGILEEKKTCLNQDFMMAKDKLEQTSKQLEDAKDQLGEAKSVIEALELQQILSIKEIEEMRTKNNHFMELMGKQEHEIMTLKNQLASKEFRDNLLSNNPEFENKSPLQVKLRRMHDSLEKAKQLNMSYQSDHAFQISNEEERDEIHRQAEAETVEVIISMQEELAQLQHQVNDSHLKETEMKESMLHLETELKELQKKMLTTIDDNRSLKEELGQKDIELTSLAEEWELLTYEIEEVLLYGCEAIVDASEELGNIRNSFPQKRIWISEQVGMIVRKISENELLIDELRRCLEDASNKRSDMECMLKSLRSAALVITESHQKECAEYEKEILLLTSQLSEKTSTMAQLKEHLVMAEDHIRKASNCSTVAFVVVNRLSEVNLGYLDDLKHKDILLSELAETNNKKDVLLSDQSTSFVQAERQITELHEKCNDLWQKLSEEQEHSRALEQKLEDIEKNAISKTREQLVTLQDGVSSIRSCMASFADHPGSLDNRNSLDACTSDYDDIGEQRHTSLETHQNSDLDPLSVEEHIVDLTDLQLVKSGYDMKYLKSRKVGKNVLERDATIRLLRKEIECALESLKEVQYEMARLHDEKKEMPVSEKKSRQSIECLTNQILFLQEAMYHFEEKSKVKIDVLSHKLRGLEKPLKEASSHWYQRKESLELEVGEAKIIQAQKAQEASCILAKFEEAQDTMREANTMINGLVKTNESMKIDIERLKDRTLLNEKGTLVSNIESLQIVVDLKHQEIENLVESSLVETRDLIVTLDDVIKDVQLTMAENFKSLACDLECLKSQCLYSTKLIQPWLEKIWSEIVFKDCAMSVLHLCHMDLQLQEEIMLQRSNEMGSQLAKLMRELDVSNTDIVTSLLDQEKLLKQKVVAIECEVEFFMADWYAKDFESLIHASELKNMSCNIANMEEHFVKYSILIEQLKKETIFSQVETELAKQILMDKEVEVSLLEREVQQGKVERKDLVTKLNRNVLRITEMGEVNKVLEQNIEFLKDVTCSNHALKGELVEANKAKKRLLDRILDLEADYDKVIGDVIGKDVASEFSFQQVYFLEHQNTELKKVNYMLENSSCRLKNELNLKDSDLTRMQNLLEVELSRKDDVVKGLLYDLSLLQESASNNKDQKDEVEKIVATMEALEVELAVKSGELADVAANCQLLEAQLQDKSDIIRALELDLSKEREALALQVSENQELRTHIEGTLTARKLADNELTERMKITKSLEDEILEMNSVFSQMNDSFKNLSSDLDDVTNERDQLQGQGICLKNKLEKAEAQAKANEAIVQEAQKVAESRKIYAEDREEEVKLLARSVEELESTVNVLENQVDILKGDAERQRLQREDLELELHALKDQMQNVRNFDGDMRRFLDEKEKSLNEALNHIQVLKRELAGKDAEIRQIKAHISELNLHAEAQAMEYKQKVSNYVE

SEQ ID NO: 92686 - protein, 49 aa, Glycine max
  Coding DNA Sequence Number=SeqID_1001
MTIVKGPGISVLELEDDKFGLERSTKDGRSESSMLRNSYGVLSMMKETL

SEQ ID NO: 92687 - protein, 134 aa, Glycine max
  Coding DNA Sequence Number=SeqID_1002
MLVWEPYTTIVISLLPLICVLGSVAWCAVVLGISPSCMHDSALATCKWLTNNALSCLAGSNGGTACQWFSQDALASFMHTWGRLLASGAGDTPTSPCISPVVLAAHVPCSHITKLLAIDNGGTPISPILLTAST

SEQ ID NO: 92688 - protein, 63 aa, Glycine max
  Coding DNA Sequence Number=SeqID_1003
MANYSATATRGNNNDTKRKRVREMKVSRVTSESGESEQCHECVSRVWEAPRLRVVMRASAKRD

SEQ ID NO: 92689 - protein, 137 aa, Glycine max
  Coding DNA Sequence Number=SeqID_1004
  Gene Ontology: Mol. function=carbon-nitrogen ligase activity, with glutamine as amido-N-donor; Cellular component=chloroplast
  Homolog annotation: Hit_ID=Q9MUK5; Match level="QueryCoverage=83%, HitCoverage=19%, E-value=1e-33, Identity=65%"; Hit description=Toc64
MMHRVVEALDANVKRWSRKVLKHINLGDYFSSRVPSLKGFSEQKPNSKVKASSLKLLAHIMQFLQRHEFRLKHDDWMNTVKPDLHLGVSAQLHEKFEVSNAEIENSKSVRSEMCAAVNSLLKSSDHDYARVLPRIFP

SEQ ID NO: 92690 - protein, 99 aa, Glycine max
  Coding DNA Sequence Number=SeqID_1005
MDSLKQSWYIDSGCSKHIARDSSKVILISPRNCEHVTYGNNNKESNKVTSTNIQRLSIASRLIQGQANKIKKKIRPQTISLVDQAFCLKTHCFQHPRLW

SEQ ID NO: 92691 - protein, 467 aa, Glycine max
  Coding DNA Sequence Number=SeqID_1006
  Homolog annotation: Hit_ID=A7UQU7; Match level="QueryCoverage=21%, HitCoverage=19%, E-value=3e-13, Identity=38%"; Hit description=IMP dehydrogenase/GMP reductase, putative
PRPSSPPPTTTGDRHEFSLLAAKPPHGEEHFNQSRIFKTQLEDSVENEVSNLVFVVSSRVMGRALGEKVIMIQMKLPGSEGPQHPHVGNRKLPMLLRMLLTWMTQPLIGIDRNVQKFGRPAIKIEGLVVATRLSPLITCSLDTGDRGLISTFMERKGPIALDDVAYLLHLPIIGAFHSFETLHVDKAVLMLEELLEVNGDEAIVETGENYTWGATALVHMYNNLDDACKSGDRKLAGYITLLQAFTDEDYDERSPHAYHWTSTKALPTSTYRKRLYRMTTADVCWMPYSDHRAVKDFDLISCFSGHIRWCPTIPPHSSGSRLCLEDIDYRWMHFSYYLTPVGQICVVPEQRAPDYMDWFYMISHPFMRLTQPGDPPRHPPVMQDETYFEPDMPQYSVAATTMKETPSHAPSDVEHPRHAVRLLNLRIVTKGTKTYDVMQDWLRIARGVSVDRNVYVRSRRKRHTDHA

SEQ ID NO: 92692 - protein, 82 aa, Glycine max
  Coding DNA Sequence Number=SeqID_1007
MTTLLPRVHAAYVGSIVVGIGREPSMKATLFFTERALPSLHDSMWCSSCDQEAGRKYMKKGRKDIEKALEFVLINNKKITSV

SEQ ID NO: 92693 - protein, 195 aa, Glycine max
  Coding DNA Sequence Number=SeqID_1008
  Homolog annotation: Hit_ID=A6FJQ2; Match level="QueryCoverage=19%, HitCoverage=84%, E-value=5e-11, Identity=92%"; Hit description=50S ribosomal protein L5
MRKEKIPHQAPFAIQAAQLLGRAIGAGLFAITPAGERGMCCKAIKLDFVKGFYKEKGKSQVGCLRIGRRHKGVAEPEFDQSAQQEELINDKKKVEIIEGIKKKISNHEKMVSMKAIENEMLPKAIESINKNFNVVVQDLAETKNIVKALNDQLTVGEEEKKALELERDNLLKEKEICQINNLPNYKQNFPIRIKQ

SEQ ID NO: 92694 - protein, 111 aa, Glycine max
  Coding DNA Sequence Number=SeqID_1009
MFTSTFVDCASSSWVRWERLGAVKVPALSVAVVDDNKRGSQMVMDEDEWMYEIMSERADMDYENAEACGANESHVDCSDAFNISQVIMCLSAERMFCGGLDPWLMKTDLWQ

SEQ ID NO: 92695 - protein, 270 aa, Glycine max
  Coding DNA Sequence Number=SeqID_1010
  Gene Ontology: Cellular component=nucleus; Biological process =multicellular organismal development
  Homolog annotation: Hit_ID=A7P5Z8; Match level="QueryCoverage=77%, HitCoverage=42%, E-value=3e-31, Identity=37%"; Hit description =Chromosome chr4 scaffold_6, whole genome shotgun sequence
MADVHRLSLGSEEAELETELLRLQILYLKFAINWRGAQRRNSELFLVYTSCNACKNGLPSGHDLEEVAQTAKENLIAIKDELRNNQTKRWQAIGTLKHVPMKHGHTSPLPCLVSDTSPCRHDTRTTFYILDITGVHVSVPCPVSVSVLIAIFIDLARKEMHTAICSSRSIVKDAPPIDNKSFLDTSFWNTGILELVELVQRPPQGGPPSLPEQSDASNSEDFTISLVVTEKTNYTRVLSRNSLLKAYNEWLLPLRTLVTGIMAESKSDYD

SEQ ID NO: 92696 - protein, 75 aa, Glycine max
  Coding DNA Sequence Number=SeqID_1011
MGIHLTHQLMARWGLGSPYCTHCGDACPTKPIRIGALIHWRAPSDRWVTLNYDGSVRSIDGMASCVGLVHDSWGG

SEQ ID NO: 92697 - protein, 336 aa, Glycine max
  Coding DNA Sequence Number=SeqID_1012
  Homolog annotation: Hit_ID=A5ASR8; Match level="QueryCoverage=82%, HitCoverage=59%, E-value=1e-11, Identity=23%"; Hit description =Putative uncharacterized protein
  Subcellular localization annotation: CTP_CleavageSite=41; ConfidenceScore=5.37e-01
MAESSKKQKGSSSTTTAAVHRRHGTSENQPAPIPPSLSSPRSSTLFSSDDQCQRYYSQFCNRVILDPKYIDLEFFNGETFDCYQVFQNSELIEFMSLKLPYFPKLVKVFYNNFKIQDDVLYSEVHKIPIIVDQSFFYSLTKLPSQGVPFEGTLVDDWKIDYSSHDARKMVCNDHADMTGKLLAGSFTFECRIMHYIICRILLPRSINLAQASKEDLILLWALQTGYQIDWAHLVQYQMHKALRANAPLPYPYLVTLFLQHFNVPLDDEPFAKVKRSFSIGAGTVTSFGYRKDMDGHWVRNQDLSPPIPDERTSSPPPQHDVSSSLLTEVLIKLRDL

SEQ ID NO: 92698 - protein, 89 aa, Glycine max
  Coding DNA Sequence Number=SeqID_1013
MWYHVSEKPHRAPKRRPVRVTVFCENAPTIWDLSQRALLRASEARLTGALSKGGKMRGVATNVYLWKMSENLKETGQNEISKFGSCIYA

SEQ ID NO: 92699 - protein, 288 aa, Glycine max
  Coding DNA Sequence Number=SeqID_1014
  Gene Ontology: Mol. function=helicase activity; Biological process =viral genome replication
  Homolog annotation: Hit_ID=Q9LW42; Match level="QueryCoverage=85%, HitCoverage=14%, E-value=3e-61, Identity=50%"; Hit description =Helicase-like protein
MDNENFQSKANEPQINAEGYSELGDQLMQCRHCNAKMCQHNGIQRHIVSTLSQMLDQHNAHAKSFRMARDRLANSQVDNVRLKLVAARETDGHVYNLPNVAEVVALIVGDFDGNSRRDIIVETQNGELQRIDELHSRYLGLQYPLLFPYGEDGYRPDILHRSTSATKKRKRNRLTMREWFAYRLQSRPNEAQTLLHSKKLFLQFIVEAYTMVESERLSYIRHNQKKLRVDKYSSLQGSLDAGTSKGLSKGKRVILPSIFVGSPRYMDQLYFDCMTICSHVGFPNLFIT

SEQ ID NO: 92700 - protein, 108 aa, Glycine max
  Coding DNA Sequence Number=SeqID_1015
MASELSTDSTDTSTSSNSSSATSKDMIEVPSFYHQQWALEYPEFVNFRYDGTTYQIRLRQHRAKRLPNCAITHVNASGQHMTILRRFGPPLQWNVVVVDSGVGRKYVV

SEQ ID NO: 92701 - protein, 86 aa, Glycine max
  Coding DNA Sequence Number=SeqID_1016
MVKKGVEALGHYGLIATLLVDHDPHELTTIVSTLESGHVPAAGASVTIKQYIGMASKSSRTSTSMTPKDLEQLTQKIRDQLEEFNH

SEQ ID NO: 92702 - protein, 104 aa, Glycine max
  Coding DNA Sequence Number=SeqID_1017
MSSSNNSTKSFMMITRHTLSPQPLLIKFTRLGLIKQTEHGEKEHYQSLKIVAKNNKSDAMIPLEVGEPFLQNVNFMEEENNEMLKEALDLAEETIKEVHMRAEL

SEQ ID NO: 92703 - protein, 84 aa, Glycine max
  Coding DNA Sequence Number=SeqID_1018
MVPKRNETVVILGITIEENAKHIFPKKSFIPKQWVNFQGLEEEDRVNIKGTIEGNEVIISHATNVVASGCVEEGLVFEKDWKRR

SEQ ID NO: 92704 - protein, 69 aa, Glycine max
  Coding DNA Sequence Number=SeqID_1019
  Subcellular localization annotation: CTP_CleavageSite=37; ConfidenceScore=5.44e-01
MAARGGHRWSWVVKKISLNKLGSLSGSPLFSLSAQILCTMATQRANSRSVQFPLRLELRLACPSRLSRY

SEQ ID NO: 92705 - protein, 68 aa, Glycine max
  Coding DNA Sequence Number=SeqID_1020
MSAEHFFRECQRKKNYGRTFFRGTTRKNFFRENQRKKVLPWVITEEEMKNKAKGKGMEVAGKGSTGKR

SEQ ID NO: 92706 - protein, 344 aa, Glycine max
  Coding DNA Sequence Number=SeqID_1021
  Homolog annotation: Hit_ID=A7UQU7; Match level="QueryCoverage=40%, HitCoverage=24%, E-value=7e-10, Identity=32%"; Hit description=IMP dehydrogenase/GMP reductase, putative
  Subcellular localization annotation: CTP_CleavageSite=80; ConfidenceScore=5.21e-01
MEAKARKVERSKGREVRELLLPPSISSSSSTTQSFFTFEFFFFRDQSSTRPTVFSPRPGLLLRARRPPLLAFEALKHSCYALQVEDELSSAEDSNGRWKIWHFRGIPRKNHLPRVSKTFHFLLAEDGSSTNSHGRAISSIFRWSLRKKGSSVGVCFLPAEEPSSASTGRGRGLSQDVAEDVPHRRRPTASARRQRVTQRVEDVPQLPEDVPQLAEDVPHVFDGSPERTGAADGAESDRVASNGTAADDEGFPGGPHDPSVLIGFADHVAHNIWSGQRPDLKLVSHGRKVDKFGRPAAKIECMIAATRLDPLIRCSVITSDPGLISAFVERWHRETSSFHLLVGE

SEQ ID NO: 92707 - protein, 247 aa, Glycine max
  Coding DNA Sequence Number=SeqID_1022
MSWINIKGAAPLTPKMNFNQHMGLQVDGVRSNRWQCWWLALTWSIWKTRNSIVFSNASFDANKVFEDAIFILWTWLRNYEKGFTEHFNYWSSNIRQSFCTTREHSRNAQVITVTERNSSNKSKTEEHVELPSPAAVQTELWRTSTAEAANHISSPMGSPSRVMGRSDCGPLIVDTAGLGKWMVCCAVWSGQVAYHADTALRQVSRGNRCVALPLSLSVEGQFSFTHETLTRVLIISVVLKGLSNLCK

SEQ ID NO: 92708 - protein, 1644 aa, Glycine max
  Coding DNA Sequence Number=SeqID_1023
  Gene Ontology: Mol. function=zinc ion binding; Cellular component =nucleus
  Homolog annotation: Hit_ID=A5BAK8; Match level="QueryCoverage=31%, HitCoverage=99%, E-value=7e-53, Identity=31%"; Hit description =Putative uncharacterized protein
  Subcellular localization annotation: CTP_CleavageSite=31; ConfidenceScore=5.02e-01
MESPWERKCDSPLQPSTSATVLSAPPPETVQRMKIASSKTLFASKEALENTILFLVFQMDQEINTSYCLYPQVAHGLRSKFVGGKQGHVYQSFPHSTAHGSGQADTRNSFLSLLYGPPSLLQHEFRDLSDRKLCFSSGDCTAAIGNSVVGSIESGTFQTSGVGAMVGLNNSNNFVFHDIQSSNTAIQPPIPGSEKARESFSSPGQCQGTIPASSLNVCCSDIQTTQTIALEPSSSKYATPFMSGCPRVFCMGKSGHLLLSNTGLLGIVCSCHCCHMSVLKFCEHSGLHGIDPGEAVRMESGETISQWQKLYFLKFGIRSLGNENEWDWPDVLSTRGSLMRSNSSAFDMSKTNLSHMLSSSAVMSRKQATTIQDGCNIPLKGFTCISQNSLYDQLKNQLMVSNLAMYTTAPNFIGTQLDDGCQPIPPSFDSLKRKRNLSSAHSPLQTSTSLLKDHDCIKKKNASDGLVGRDAASSNIDLRLGQPPQTGNPLPSFVEPPLFNALASPPKSQPLKQMITSALNQYVVLADYLSREEELQNNFSYAAGSIKMVEEMPQLKLKKYMSAVVNASARARSETKNVAKGLSFSPFLQFDNQYGGKTKTSENLWNDGSPIMPKKLYSDYGHTGRQSTNSGIRTNKCLNNDKGVNFAKDSGVKINSGFGIGQLMKYPSSIKRAVGGSDISVVNGKIHELNHESSLPSDTSVCADILRGSNNVSFLGLENHTPETSISFKGILKGLSHHVSSSVSNQTPTLPQQQQGINMDSCLLDENLRLLALTQILELSKQQHALYFNNMNQKQGGSNSISKVQHYMYEASTSEQGTSGMNSYCHLSGLSPRPLHSKEKESQCNHSYDLQNEETSLSLGINKDNTRSSVFEKCSEQPSNICFGGKYTCAAQINCCKSNFFSGIEPLCYIIKQKLANASGETSLKMASDLSRDMNSFKGENIEQGGKLDGQDSIKIGFRTPQWRDVPSKVRKAVCDATSLGQTATGMDWEGQDSVQLGNISMKRFKRTIDMGDMSKEQENSNVSSGCSAPVVTQASLEVNKIEPCMGDAVDTGFVNNLVVDEGSGIDKGWSSDLVEKSDEFLGSSSGSCLKNDYLRVLNDQPCCNLLDDLKLLDSLIWKKGWNQNNFVLSSNCKSNQSQKVKKGLKGKKRKRNLVRILDASLSSEFPSLLHKKNEEVTGICNSSSSCSKEMQMRPLSSLQKSSNKSSFVQPSNKQKHTAFSSKFLSCKNHLNKHQSYKVGYESESSSDAEFRTLPGVSGSKKLKKDLTSDCFEQFQMQEPAYEEPENDKLRPFSCRKENAHRITRPVVCGKYGEISSGHLAREVQKPVKIVSLRKVLKSSKRCTGHTNGKPIPTSKKKWKRLSIGTSSGHCCGNPDLDRGGKPPVVYKGKRDAKAKQGNSVGNRAYVSLKVKNKEIRKQRSITELTAKESYFTEKCLLTMVCKCMPETKVMDMMNSAQDQEPGGAMTRAIMSHTIVKSLLKVWNGEKDGMPKNTTSHEVFEKEIDAFLSSKDGQEVDQESVLKPKIVDTSTDLMKVTNHIQHTPTSVSNFKVHNSITEAVLDPTVKQWIHMVCGLWTPGTRCPNVDTMSAFDVSGVSRPRADVCRIADCSIKFHPWCAHQKVDASLPLDVPKDISKVSVSDLEN

SEQ ID NO: 92709 - protein, 61 aa, Glycine max
  Coding DNA Sequence Number=SeqID_1024
MKEYTRRCKSLAKGNFIKADLPHFIPHKGPVTRVMSKRLQEDWARAVEEGPKVLMNLRVDF

SEQ ID NO: 92710 - protein, 78 aa, Glycine max
  Coding DNA Sequence Number=SeqID_1025
MGCIASTKKGCRASMEKRRERGREIQVRRELGSSSESDARPGELMLSSKGMSLPRQAGCLGTKLFHGPGKPDASLSEL

SEQ ID NO: 92711 - protein, 142 aa, Glycine max
  Coding DNA Sequence Number=SeqID_1026
MKADMEAMKEKMTTMMEAMMSMRKMMEVNTAIVVIASTATKVDPTHPSGLNQVNRPVSDMVGQGGRALGCTGSPHFVQVQSKHSFPAYGLPPNYTPPNVAYAPNENVDNSTPIPIESQPPQSGHAQVPQPMGRHMKYPETIL

SEQ ID NO: 92712 - protein, 169 aa, Glycine max
  Coding DNA Sequence Number=SeqID_1027
  Pfam annotation: Domain name=zf-GRF; Domain location=81-127; Score =26.9; E_value=1.7e-05; Accession=PF06839.3; Description=GRF zinc finger
MFYGLVAASSVSLPVRRHYVIVVAGSLLHHHHRCLITALLSKQESSPVWVSSLKPTVWASSLNLVMERSSSSYTSEARSHVMCLCNIEAPLVTSWTEYNLGRHFYAFGQYKVTGRKECNYFEWHDPVANSLQKRIIVALMKKVDELNLREKDLQTKISDMKMKGNFLGI

SEQ ID NO: 92713 - protein, 228 aa, Glycine max
  Coding DNA Sequence Number=SeqID_1028
  Gene Ontology: Mol. function=transcription factor activity; Cellular component=nucleus; Biological process=regulation of transcription, DNA-dependent
  Homolog annotation: Hit_ID=Q4QYE1; Match level="QueryCoverage=68%, HitCoverage=50%, E-value=1e-70, Identity=82%"; Hit description=DREB2
  Pfam annotation: Domain name=AP2; Domain location=7-58; Score=62.6; E_ value=1.3e-15; Accession=PF00847.11; Description=AP2 domain
MATKTAKLYRRVRQRHWGKWVTEISLPKNRTRLWLGTFDTIEEAALVYDNTAFKLRGKFARLNFPHLRHHEAFVFGEFEDYRPLPSSVDSKLQAICKSLVKQEEKSCCFVKDVKPVIHATELAEVESGVAKLNVEYVYPEFEDFKVENENPMLPSNSLVLSVAKIAKKMKLKFTKAWIAYLRLPLPIDVYKEVIHKCLKVVMRSNVGAEGGKKHKWWNYSMGCKILVE

SEQ ID NO: 92714 - protein, 43 aa, Glycine max
  Coding DNA Sequence Number=SeqID_1029
  Homolog annotation: Hit_ID=A8IXV9; Match level="QueryCoverage=86%, HitCoverage=5%, E-value=5e-09, Identity=72%"; Hit description =Dehydration-responsive protein-related
MIFGGFQGWVIIRDTIPLIESARPLTAQLKWDARVIEIESDSD

SEQ ID NO: 92715 - protein, 92 aa, Glycine max
  Coding DNA Sequence Number=SeqID_1030
MLAWCCSSSQENVKERERHLSFSERKIKMHWSLGSVRVNTGLLRVKDEPIKPPPIPRSPLLVNFQLDKSNLLQFQGNMTLLLCNNMEGYVCQ

SEQ ID NO: 92716 - protein, 171 aa, Glycine max
  Coding DNA Sequence Number=SeqID_1031
MKPRFDGSSNEAPSFNKELKRSFTSERTTLVGKKSHEENKSKQGTLFRNNKFMGHASVPLVSQPAEKESLLVESNDDDDDDDIETEDQDVEGGRTVAQNNDKGKCPLVIGGESSKIDGDEGPDVDKKVDEFIAKRIESIKRSRRSARNSSSTTCISKIPLGEDYSQILIRC

SEQ ID NO: 92717 - protein, 143 aa, Glycine max
  Coding DNA Sequence Number=SeqID_1032
MILFVCLWRLRSEGHTFHMHFGYIRRHFLLSDEPQIPLITVEALVTYHVPFECTPRCDINHIIIYLGFERSHNPLWFMRHFFEHDVNGRVTISTFCQYMIVKVYADVGDFIDDEDLTSFEIVFYQGVCDEEISKEEMILSDKE

SEQ ID NO: 92718 - protein, 186 aa, Glycine max
  Coding DNA Sequence Number=SeqID_1033
MTKDGGFPLRDRPRLWIALRLGVSFLSTSSSLYRLQLSPNFSQYYQMTLLDEPGDMGHLEERGELLPDVKPQFLEKGFNFVAFKVCEEIMEFLIANGVFACAKSSSDLFVVRLGSIESMNDRVIIIQKWRGVPCLFGGQDIAKHGNHILIHRRDDDLHDEVVLSSPLAKVLMIGCGACVCAINKLN

SEQ ID NO: 92719 - protein, 201 aa, Glycine max
  Coding DNA Sequence Number=SeqID_1034
MATPMSTACYLDKNETRQSKTLSNIENHRRSAKDLPPPPPLLATVATNFLEHPQHLFLLPFHLHDHLPCFLQMINAKVRVFYNNLKIQDGVIFSEVHHVPIVVDQSLFFSLTKLPSQGVPFEGTLVNDWKFDFSSHDVRRMVCTDQANMTGKLLAGSLTFECRIMHYIIFCILLPQSSNLAQASEEDLILMWAFQTGHQIN

SEQ ID NO: 92720 - protein, 156 aa, Glycine max
  Coding DNA Sequence Number=SeqID_1035
  Gene Ontology: Mol. function=GTP binding; Cellular component =intracellular
  Homolog annotation: Hit_ID=Q9SHS8; Match level="QueryCoverage=80%, HitCoverage=25%, E-value=8e-13, Identity=37%"; Hit description =Putative nucleotide-binding protein
MGKKQNEIQKTGLGRVLLSRFYRKKFLESFTEVSDIDAVVEQSLEPLPKLAAAASTTLISLSEPGSVPDETTTPEEARKQQKQEEALHASNLRVPRHPLWTPNMSADELNASETQVFLTWRRSLARSNPVIKSASADFWLIILEESHASCCAVNVN

SEQ ID NO: 92721 - protein, 423 aa, Glycine max
  Coding DNA Sequence Number=SeqID_1036
  Gene Ontology: Mol. function=transmembrane transporter activity; Cellular component=membrane; Biological process=transport
  Homolog annotation: Hit_ID=A7P636; Match level="QueryCoverage=87%, HitCoverage=93%, E-value=1e-127, Identity=65%"; Hit description =Chromosome chr4 scaffold_6, whole genome shotgun sequence
  Pfam annotation: Domain name=DUF6; Domain location=34-244; Score= -2.7; E_value=0.098; Accession=PF00892.11; Description=Integral membrane protein DUF6
GASPGVGGCRGWLNYAASEQIVLRVHHMRAIGAGLFAITPAGERGMCCKAIKLGNARDSHKQPFAVTYLGASLMVVYLPVAFIKDWLYKLFKHCSSKSGRSAKVGDDFSVTCTSPLKGNGVQKTTEVELGSMTRKDSDANLSVQEQVKPLVAKYNDATAIKAEKELTTREIATYGFYIAPIWFITEYLSNAALARTSVASTTVLSSTSGLFTLFIGVFLGQDNLNVSKVVAVLVSMSGVVMTTLGKTWAADDALSSASNGQRSLVGDLFGLLSAMSYGLFTVLLKKISGEGGERVDVQKLFGYVGLFTLVALWWLIWPLSALGIEPKFTIPHSARVDEVVLANGFVGSVLSDYFWALCVVWTTPLVATLGMSLTIPLAMLADMVIHGRHYSALYILGSVQVLLWLKMSATLIFSQLSYSTVGP

SEQ ID NO: 92722 - protein, 221 aa, Glycine max
  Coding DNA Sequence Number=SeqID_1037
  Gene Ontology: Cellular component=membrane
  Homolog annotation: Hit_ID=A7P636; Match level="QueryCoverage=76%, HitCoverage=42%, E-value=2e-55, Identity=67%"; Hit description =Chromosome chr4 scaffold_6, whole genome shotgun sequence
MGWRYKAGLFLILTVVVIWVTSAEVTQDIFIDYKQPFAVTYLGASLMVVYLPVAFIKDWLYKLFKHCSSKSGRSAKVGDDFSVTCTSPLKGNGVQKTTEVELGSMTRKDSDANLSVQEQVKPLVAKYNDATAIKAEKELTTREIATYGFYIAPIWFITEYLSNAALARTSVASTTVLSSTSGLFTLFGTELEFVIMVIAVSCVKLLSAHNSTQHTSRKHKV

SEQ ID NO: 92723 - protein, 624 aa, Glycine max
  Coding DNA Sequence Number=SeqID_1038
  Homolog annotation: Hit_ID=A7PX88; Match level="QueryCoverage=99%, HitCoverage=84%, E-value=0.0, Identity=59%"; Hit description =Chromosome chr12 scaffold_36, whole genome shotgun sequence
MYILVDNRPWLLSDLGSRGVHIWQLMVTKSRLSPFAYSKARRERKEGKEICPQSSSSKPKKFMRWFPLIEAVMLSRKKVLLPVKNLRNSLQLSSELHRTLYGFIVFEVAWAGVRGINYYNELQTDTSLAIEAKLMKRWEFDSIAQAAGCMSSWFSGTPSEQLLLKEHLDSASGDIFYDASEDFSGTVSVDDGDDNICRILTVEDSLGTNVGVYTDDTEETTDMLHAPPPSGPNKRRKLMNSFSAGVEVDSYSTAEIDNSLDYSQTSSCVSDDTVETTQDDTLETTQDDIVETTQDDTVEATQYSDVLLSFRFDDHDLPFKFREVIVSDLRLLTLLEAGLPSWVIFLQSYPVLCNLYRPWMCPLARLLYFLISFVTVLIGFYDLYKNVPVLKATASRLCGPLLDWIETWEMVSRVKYLGTMLFLHNFQKAVRWFLAFTHTMRSFFSILVQPLVESLVEIFGFLLPSLKFLFELAESIFSVIWLVVDTSFDIVGNVLELLFSPLWFVLNVVWSIATCILYPLFWVLWELLYAPVRLVLVIFSFVASISSYICNTLGNTWQFVSSIFQFAASSEATVSVSEVSMWQRTLWNDLFSQVIFRALKSILYGFAAFFTACNRHRLSLKDSA

SEQ ID NO: 92724 - protein, 56 aa, Glycine max
  Coding DNA Sequence Number=SeqID_1039
MRPPVKQVEPTGGTVSPSAVVPLGREGSQLVVEVGPIVGVAKASPSVSSSIFVNRK

SEQ ID NO: 92725 - protein, 85 aa, Glycine max
  Coding DNA Sequence Number=SeqID_1040
METAGNNAESVKWGQQAYKNLQRDLKNLSKDHLKLEKTLQDQVDDSLDESARSCKAYEALKEKESKSCIEIETNANEKATLLKNF

SEQ ID NO: 92726 - protein, 253 aa, Glycine max
  Coding DNA Sequence Number=SeqID_1041
MGGTHEIPHHNLANFEPCLEYAIEGQVVGGVPLPNTLEGPQFFPQTQPLHFAVGRALSAMPEKEKLDQIEERLRVVEGGKDYSLANMEDFCLVPDVVIPLKFKVLDFNKYKGTTCLKNHLKVISGTLMAKREMITSKGARIFQRIRPKVEGSGIPSGTPNDEKGDDNNDSRHSTGVLLRENGGIEVGLRRGKFDHPTLMNEKTGANREKEMEGGTHVVVIVPTWPNFPPTQQCHYSANIIPSHYPPPNQPRRH

SEQ ID NO: 92727 - protein, 182 aa, Glycine max
  Coding DNA Sequence Number=SeqID_1042
MFIFGNKCIDERPSQRVNIVLSHKAKALWTQSPLSLSFIGLKVFCHICFSEAIEVSFANKRQVSLLARGDKLWSSAPLCLPKTSEFVGTRRQIMVFRFSLFSRPLKSPLPTRDQGVRWHGETNHGLPLFIVFKTIEVSLANQRQASPLARGDHHGHPHPLPSRDNQVRWHTETIMSLFTFRR

SEQ ID NO: 92728 - protein, 398 aa, Glycine max
  Coding DNA Sequence Number=SeqID_1043
  Gene Ontology: Mol. function=transporter activity; Cellular component= integral to membrane; Biological process=transport
  Homolog annotation: Hit_ID=Q9SHZ3; Match level="QueryCoverage=100%, HitCoverage=76%, E-value=0.0, Identity=83%"; Hit description =Nucleobase-ascorbate transporter 1
  Pfam annotation: Domain name=Xan_ur_permease; Domain location=1-312; Score=58.4; E_value=2.4e-14; Accession=PF00860.11; Description =Permease family
  Subcellular localization annotation: CTP_CleavageSite=34; ConfidenceScore=5.03e-01
MRAIQGALIVASSIQIVLGYSQVWGLFSRFFSPLGMAPVVGLVGLGLIQQGFPALGNCVEIGIPMLLLVVGLSQYLKHVRPFRDTPIFERFPVLICVTIVWIYSVILTASGAYRHRPTITQNSCRTDRANLISTAPWFMFPYPLQWGPPTFSAGHSFAMMSAVIVSMVESTGAYKAASRLAIATPPPAYVLSRGIGWQGIGILLDGLYGTGTGSTVSVENAGLLGLTRVGSRRVVQISAGFMIFFSTLGKFGAVFASIPFPIFAALYCVLFGLVAAVGISFLQFTNMNSMRNLIITGLTLFLGISVPQFFSQYWTSSHHGPVHTNAGWFNAFLNTIFSSPATVGLIVAVFLDNTLEVERSKKDRGMPWWVKFRTFRGDNRNEEFYTLPFNLNRFFPPT

SEQ ID NO: 92729 - protein, 109 aa, Glycine max
  Coding DNA Sequence Number=SeqID_1044
MGIALCTQQHFKILKVPLPANFFFFVFLLHAAFILVRGGGPLLCPFGHDNLVTTVHWQVVIVMVVGVAVNGGVHWQVVIVMVVGAAVNGEGTILFFCNFDVVYTDLQPV

SEQ ID NO: 92730 - protein, 112 aa, Glycine max
  Coding DNA Sequence Number=SeqID_1045
  Homolog annotation: Hit_ID=A5BFT3; Match level="QueryCoverage=53%, HitCoverage=3%, E-value=5e-07, Identity=50%"; Hit description =Putative uncharacterized protein
MCTCAKSGIVKPRLNPTLLLTHLEPKTIKSALSNLTWLAAMKVEYDALLRNGTWILVDLPLDPLPGKALAATAGCQQCFPQWNSSRGIHDSTSRLSPPTNSLCEDFTKPLMA

SEQ ID NO: 92731 - protein, 685 aa, Glycine max
  Coding DNA Sequence Number=SeqID_1046
  Gene Ontology: Cellular component=outer membrane
  Homolog annotation: Hit_ID=A9AH87; Match level="QueryCoverage=61%, HitCoverage=24%, E-value=2e-40, Identity=32%"; Hit description=Outer membrane autotransporter barrel domain protein
LAKQLYHDAPPVVPRVAVGDVAAGTWRVLSVERPSAGQNVVANADRHAGRGEFVELIPVTARFLVYYTAGFALYVNREKIARYANSKLMNGWLVAALVLAVWAACYVVAHNHITGVMKYVPVMLGSVLSVMLSYWLVFSFERINVKESRILTAIVDSALIIYLLHYPVVIIFSWLLDVWLPDNLSVLYVLIDFALGIALSAVCYAIVKRSRFASIHAVSAIPKAYRRHHNSLSQTRRFKLIAGLMLPATPVSAVVLTPFTPERNDNKVGAYCLCNGSTQTLSGVPRFTAGESGMSSVTLGELQKVGRIINDNLIGEPRLQLGAQNYAIGIPDEETGSYRVYQVYNSAEMIAPAEINGATVVPDYYDVNDKQYIDARVATVTNGRLNINIGQQGAAANASTNRWSMAAKQSQLFASSNNGHINWDSNNRIRFTAATPPYGGDRLAFDAGGVVTYAGLFDVTLKDGSSNAYYVSNLNELRNYNDWLIDQISGGNLSPESYNAALNQAFSLRDGRVVYRMSTGNYDDEVAAALGDQVVLSADGAKASVKINRGKTLEVANSASAVMRASNGATAIIAGKLATSNALSSEAGALELISGARGINNGVINSGFFNAANGRGVAEDSLGYAGTAVSAIYDSEFRNNGVLNVHIGDAPWGTAGLFLGSSSAVNHGNINIGIHDVANGSSAAA

SEQ ID NO: 92732 - protein, 336 aa, Glycine max
  Coding DNA Sequence Number=SeqID_1047
  Gene Ontology: Mol. function=pyridoxal phosphate binding; Cellular component=cytoplasm; Biological process=amino acid metabolic process
  Homolog annotation: Hit_ID=A6UC71; Match level="QueryCoverage=94%, HitCoverage=83%, E-value=2e-74, Identity=47%"; Hit description =Cystathionine beta-lyase
  Pfam annotation: Domain name=Cys_Met_Meta_PP; Domain location=1-331; Score=127.6; E_value=3.7e-35; Accession=PF01053.11; Description =CysMet metabolism PLP-dependent enzyme
RHEQDACRNAIPIYLFLFTVSDYDSIDRSATFALPALGSAGEPALASLPAKAWPPSATRFLSVVQPGAKVRFGITTQFVDGDDEAAMAAALPGASLLYLESPSSWVMSEQNLRQLATLARDAGVVTLIDNSWASPIFQQPLLCGIDIVVHSASKYISGHSDVVAGLVIASHQHINNIARHISPFLGGKLSANEASLLMRGLRTLPLRMKQHQHSALQLAEKLRDHPQVSAVCHPGLNPPTWSTLRGYSGLFSFAVTEQVDIPQFCNALQLFHMGVSWGGFESLVMPAISVINQASEFNSAQDFGVSPRLIRISVGLEETDDLWTDLNQALAAATHR

SEQ ID NO: 92733 - protein, 100 aa, Glycine max
  Coding DNA Sequence Number=SeqID_1048
  Homolog annotation: Hit_ID=A5APK5; Match level="QueryCoverage=67%, HitCoverage=5%, E-value=4e-27, Identity=91%"; Hit description =Putative uncharacterized protein
MSPPCGDMDGVEKTLALPEKEVIQPHLPVRLPCYDFTPVTSPAFGIPLLAVKVTTSGMASSHSVTGGVYKARERIHRRMADRRLLAIPASCRRVAAYNPN

SEQ ID NO: 92734 - protein, 189 aa, Glycine max
  Coding DNA Sequence Number=SeqID_1049
MAYFNQLQSQMQSQGLTVPPEPLVGPSGPRVSTKGSCVDPSGNDPETGDSDRCDLYIEADPARLVAMGRVYEGSTVVHNTPLLPGQVKVSVDGADTSHLPCLVDTSGQVFITTAVSPPKPPPKPDPEVDDPLYLMTLTIPELFLRPYQVRWDATVFGVINPDFPLYIKHKDLSEIAHGVQCLSISVLQL

SEQ ID NO: 92735 - protein, 51 aa, Glycine max
  Coding DNA Sequence Number=SeqID_1050
MAPNKVFPLFMPFGKSNALKCENMDESILWHLRLHLWQDAQVTISKNILES

SEQ ID NO: 92736 - protein, 97 aa, Glycine max
  Coding DNA Sequence Number=SeqID_1051
MATIALSSRYGSKLAYGPGIWGESYRLFAAKFLFGLRYRWCLGIGHVEWQPQHGFPSSFSSSSFGPSFLIHQSRMIKFASFQTRFDPFPDEDQIRKA

SEQ ID NO: 92737 - protein, 24 aa, Glycine max
  Coding DNA Sequence Number=SeqID_1052
ASNEVFHRHGTTFRIGLSLSVSVA

SEQ ID NO: 92738 - protein, 96 aa, Glycine max
  Coding DNA Sequence Number=SeqID_1053
MQATYPSFLSKVIPLSDKGALSAILTEGNCVERPKAALSPTPAERKCAERPEGQLSESCRPPVAAVSRRCLPLNPHTKRSTLIGAVATCPFTGERR

SEQ ID NO: 92739 - protein, 33 aa, Glycine max
  Coding DNA Sequence Number=SeqID_1054
MEVLLRPTALKVVGPLLLDSNSSRDGTNPPRLV

SEQ ID NO: 92740 - protein, 54 aa, Glycine max
  Coding DNA Sequence Number=SeqID_1055
MGHCAPECATPRPTWALQNIPPEGCCFWRKQPGSPGRAELAWASWAATTSPIVL

SEQ ID NO: 92741 - protein, 191 aa, Glycine max
  Coding DNA Sequence Number=SeqID_1056
DTSFAVKVEGTSTWVVVTENKKGYISCGSVQVEGTSTRLFKENKGGYIPCGSLLVKVFTRLKAISRTAGCLGIGCRHGLLPNQSPTGNLVPLDLEIEATLRRNWDESRRKLLQDRTVTSILEEETHFSDSLSPDSPSSRESATQFPEATIMADEQHQRITLEDYSSSSVPYKTQSILILIGRRGKEVASLV

SEQ ID NO: 92742 - protein, 288 aa, Glycine max
  Coding DNA Sequence Number=SeqID_1057
MEESMSPFLVRDFGAQNFKAIQRIHKAWETPLRKDQELRGIRNGIIGGYHEWLKLKVVIEESFEAPEEDEEVQALKSELGKAKLAKEKFKLAATHIRKECAGLREENATTARALEQETKRARKEEYGRNKFRGALLGSNSELKLRREERDQSRAHSMVLKEELVTCSRSKRSLSQCLCETETNMLAMIAKYQEEFGLAMAHEHRVADEYAQVYAEKEARGRVIDSLHQEATMWMDRFALTLNGSQELPRLLAKAKAMADTYSAPEEIHGLLGYCQHMIDLITHIIRNR

SEQ ID NO: 92743 - protein, 122 aa, Glycine max
  Coding DNA Sequence Number=SeqID_1058
  Homolog annotation: Hit_ID=A5B3Q0; Match level="QueryCoverage=100%, HitCoverage=9%, E-value=5e-10, Identity=32%"; Hit description =Putative uncharacterized protein
MYDIHSTRFEVKETFNPITQRGGQKWAVNLNGHYYQCEKHYALHYPYSHIIAACGYVSMNYYQYIDVVYTNEHILKAYSTQWWPLGNEVAIPPSDDASTLIPIPKSTRIRNEMDWLEPSEHR

SEQ ID NO: 92744 - protein, 170 aa, Glycine max
  Coding DNA Sequence Number=SeqID_1059
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=67%, HitCoverage=12%, E-value=4e-10, Identity=35%"; Hit description =Gag/pol polyprotein, 3'-partial, putative
  Pfam annotation: Domain name=G-patch; Domain location=60-104; Score =32.2; E_value=1.8e-06; Accession=PF01585.14; Description=G-patch domain
MVGGQLVIVSSEEDILVSCLSSTPYVEAAEKSLEMFFQALEIVNNAYVESPPIQPSLSDTSLMVARVMLKDGYEPGMGLGRNGDGAVGLLEIAENRGRFSLGYKPTCVDKKRIALERKEKCLAHLQGQEPQVGRVPICHINESFVSARWMHEDQVAMLDEETDQDQSNWV

SEQ ID NO: 92745 - protein, 377 aa, Glycine max
  Coding DNA Sequence Number=SeqID_1060
  Homolog annotation: Hit_ID=Q6WAY6; Match level="QueryCoverage=54%, HitCoverage=38%, E-value=9e-19, Identity=30%"; Hit description =Putative uncharacterized protein
MANQGDWVPFMDVLTLLIFGVVLFPNVDGFVHLAAIDAFLAYHHSKESPVVAVLADLFDTFDRRCEKSSARIICCLPALCVWLVSHLFQQDTRHPCPLLSHRSCTEKRRIDWDQLLAGIGGTRGCINYNPALAIRQLGYLMRGAPTEESMSPFLVRDFGAQNFKTIQRIHKAWETPLRKDQELRGIRNGIIGGYHEWLKVHIRGLDWLAKLKVVSEESFEAPEEDEEVQALKSELGKAKLAKEKFKLAATHIRKECAGLREENAITARALEQETKRARKEEYGRNKFRGALWGSNSELKLRREERDQSRAHSMVLKEELVACSRSKRSLSQRLCEMETNMLAIIAKYQEELGLAMAHEHRIADEYAQVYAEKEARGR

SEQ ID NO: 92746 - protein, 68 aa, Glycine max
  Coding DNA Sequence Number=SeqID_1061
MSSVIACFQKETMTLIYISKMTMSSVIACFQKATMTLIYILKTTMSSVIACFQKATMSSFAFRRRQCL

SEQ ID NO: 92747 - protein, 355 aa, Glycine max
  Coding DNA Sequence Number=SeqID_1062
  Gene Ontology: Mol. function=transporter activity; Cellular component= integral to membrane; Biological process=transport
  Homolog annotation: Hit_ID=A6TFT9; Match level="QueryCoverage=100%, HitCoverage=34%, E-value=1e-150, Identity=80%"; Hit description =Acridine efflux pump
  Pfam annotation: Domain name=Exosortase_EpsH; Domain location=142 -339; Score=-140.4; E_value=0.058; Accession=PF09721.1; Description =Transmembrane exosortase (Exosortase_
MASGGTDRDSLMKLRSQLLAAANQSGELQSVRANDLPQMPQLQVDIDNNKAVSLGLSLSDVTDTLSSAWGGTYVNDFIDRGRVKKVYIQGESDARAVPSDLGKWFVRGSDNSMTPFTAFATTHWEYGPESLVRYNGSAAFEIQGENAAGFSSGAAMDKMEKLANSLPAGSTWAWSGISLQEKLASGQAMSLYAISILVVFLCLAALYESWSVPFSVIMVIPLGLLGAALAATLRGLSNDVYFQVALLTTIGLSSKNAILIVEFAESAVDEGYSLSRAAIRAAQTRLRPIVMTSLAFIAGVLPLAIATGAGANSRVAIGTGIIGGTLTATLLAVFFVPLFFVLVKRLFTRPRPSQE

SEQ ID NO: 92748 - protein, 146 aa, Glycine max
  Coding DNA Sequence Number=SeqID_1063
MAGMGKLDHLEERIRAIEGGEDYAFANLEELFLIPKHGHSQIQGAGLWQIWSSPAKRSKWIRKEANLIILLGRLRKLGANEEGEKEGETHAVTAIPIRPSFPPTQQCHYSANNKPPPYPTTQLSTKAIPKSTTKSVYRTSNDEDHL

SEQ ID NO: 92749 - protein, 104 aa, Glycine max
  Coding DNA Sequence Number=SeqID_1064
MTTLASAHQSHLGSLNDEVRITVRCLAGYQLLGHGNKRWCGRQKQGSCSYVSSNEELKPTISFLNDHLEETLGSTKIEEIHSKCINLAQCGAKKSLAHNILIGN

SEQ ID NO: 92750 - protein, 116 aa, Glycine max
  Coding DNA Sequence Number=SeqID_1065
EWEESKEFSDCVVLNSLTREKEDTKEFRRLVLCSFGKGRRETQKEFRRLVLGEFFLAKGEENEKMNSTSFQGLENQKTSESFWYKEEEEEEVQRDSRLVKDCKRLIGKVFKIESMN

SEQ ID NO: 92751 - protein, 456 aa, Glycine max
  Coding DNA Sequence Number=SeqID_1066
  Homolog annotation: Hit_ID=Q6WAY6; Match level="QueryCoverage=28%, HitCoverage=21%, E-value=1e-08, Identity=33%"; Hit description =Putative uncharacterized protein
MIEVSVEAIASLVQYYDQPLRCFTFGDFQLLPTVEEFEGILGRPLGGRKPYLFFGLYPSMVRIAKVAKVSIKESPIVAVLVDAYDTFDRRCEKSGARIFYCTPALYVWLVFHVFRHESRLVCPLQGHRMCAKKGKANWEQLLAGMVGTSVNWFPQWKEGGARVLSSCEGFPNIPLMGMRGCINYNPRKDKKLRGSSNGIINSYHKWLKARTQEITWLPKLKVSSEEEVETPEESEEVQALKAELERTQVVKEKFKMISIRVRKECDKLRDANMATDEALERETKRARKVEWGRNKFRGALWGSNSELKLRRAERDQSRVEVMILEDKLKACQRSKRSLSEQLSRTEENMWAIIDQYREKLSLVAGHEQRLEDEHEKVSALQAETEVREKVIDSLHGEAMMWMDRFAFTLNGSQELPRLLAKAKATVDVYLLLEEVRRLFDYCQHMIDLMAHIIRSC

SEQ ID NO: 92752 - protein, 754 aa, Glycine max
  Coding DNA Sequence Number=SeqID_1067
  Gene Ontology: Mol. function=GTP cyclohydrolase I activity; Cellular component=cytoplasm; Biological process=aromatic compound biosynthetic process
  Homolog annotation: Hit_ID=A7ZNX6; Match level="QueryCoverage=28%, HitCoverage=97%, E-value=2e-87, Identity=77%"; Hit description=GTP cyclohydrolase 1
  Pfam annotation: Domain name=DUF1228; Domain location=14-96; Score =116.4; E_value=8.2e-32; Accession=PF06779.5; Description=Protein of unknown function (DUF1228)
  Pfam annotation: Domain name=DUF405; Domain location=563-651; Score= -67.7; E_value=0.07; Accession=PF04171.3; Description=Protein of unknown function (DUF405)
  Pfam annotation: Domain name=GTP_cyclohydroI; Domain location=447 -551; Score=193.5; E_value=5.1e-55; Accession=PF01227.13; Description= GTP cyclohydrolase I
  Pfam annotation: Domain name=MFS_1; Domain location=10-335; Score= -5.0; E_value=0.028; Accession=PF07690.7; Description=Major Facilitator Superfamily
  Pfam module annotation: Pfam domain module=DUF1228::DUF405::GTP _cyclohydroI::MFS_1; Domain location=14-96::563-651::447-551::10-335
MAWRVALSAFLSLVVAMGIGRFAFTPQVPLMIHDGQLTLASASLVAALNYLGYLAGSFDAMRAQRRVEWRLQLGVWGAVVLTLLSACISGPWLHAVVRFLIGVASGWAMVLVAAWSNEQLLHHGRPGLSAAVFAGPGTGIFISGMLAVMLHASGVSAAFAWAAYGVLALLLIAAIARFLPRSGQLHRPQQAAAPLLLTRDLKRLILSYSLAGFGYILPATFLSQMAAARFPDSAFAQFVWPVFGGAAPSAAGAGAVGAGAGRIAAIVLPGINAVAAVQPGAGAAPRALSRRPAYYRLCHRTARWTAAVLDFQPAVAPARSGAVGGRRRFAAGGGAGADLRAHHLPEKSTMSTLSQEAALVHEALLARGLETPLRAPVRDMDDASRKREIAGHMTQIMQLLNLDLEDDSLMETPHRIAKMYVDEIFSGLDYANFPKITVIENKMKVDEMVTVRDITLTSTCEHHFVIIDGKATVAYIPKDKVIGLSKINRIVQFFAQRPQVQERLTQQVLVALQTLLGTNNVAVSIDAVHYCVKARGVKDATSATTTTSLGGLFKSSQNTRHSMQRYLALDFIRGCAILGILLLNIVGFAKIPDAVCAAVWCRTGPAGAARQPLDLLTLNAAGLHRVHPRGVPVGRRHPAGLWADWVDCLAHAAPQPTRSWLPGAADLEYESYWKLVGGWEAVQNRLEHLSSGLMALASQYGWQLAGLMLIGAALMRSGWLSGQFSLQHYRRAAALLLTIGWLIAIPGVLAQWLL

SEQ ID NO: 92753 - protein, 430 aa, Glycine max
  Coding DNA Sequence Number=SeqID_1068
  Gene Ontology: Mol. function=nucleotide binding; Cellular component =cyanelle; Biological process=response to stress
  Homolog annotation: Hit_ID=P36928; Match level="QueryCoverage=100%, HitCoverage=100%, E-value=1e-174, Identity=69%"; Hit description =Uncharacterized chaperone protein yegD
MFIGFDYGTANCSIAVTDSGTPRLLTLENGQRLLPSMICAPTREAISEWLHRHHQVPTPDSESTALLQRALRYNREEDIEVTPASVQFGLTALQHYMVDPEEVWFVKSPKSFLGASGLKPQQIAFFEDLVCAMMLHIRQQGETQLDQPIDQAVIGRPINFQGLGGEDANQQAQGILLRAAQRAGFRDVEFQFEPVAAGLEFEATLQQETRVLVVDIGGGTTDCSMLLMGPQWRNQSDRRASLLGHSGCRVGGNDLDIMLAFKTLMPLLGLGGNTLKGTALPALPWWNAVAINDVPAQSDFYSAASGKLLRDLVRDAEQGDKVAHLLKVWQQKLSYRLVRAAEESKIALSDQRETAASLAFIAQTLQAEISAAQLEEAINQPLARILEQVQLALASCDTRPEALPDTPIASGDDFGSVTAGLARWAEVMFR

SEQ ID NO: 92754 - protein, 249 aa, Glycine max
  Coding DNA Sequence Number=SeqID_1069
GVLLAELNKARGDVGGDFIGLEMAGAGEIFKRGELAGVKAAEPLVAGFAADAVAVTQLRHGFPACLAGEDEFKALHGNSLSPGHRCAADNPRRATPHLRPARAAGYPSAIPPAYAAMLCGLNIVTGINLFPFIGQVAGDGLHHVAQRYHAFHRTKLIHYKGKMGASMAKLLQRLQQGDALGKHQRLANQRTQIQRFTVQRLMQQIDHMHHAQWLASLFGDQQARMLVAVEFIHDRLRVFAQIDVLDVMA

SEQ ID NO: 92755 - protein, 93 aa, Glycine max
  Coding DNA Sequence Number=SeqID_1070
MRTLRGRCRRIDLFAGAHKCTDGQNRARGCRVAIHGDRQTAFSNITPCMATKFFGAFCTIQHTHSTILGISVTNKADSFLQAARVTVESGTAV

SEQ ID NO: 92756 - protein, 707 aa, Glycine max
  Coding DNA Sequence Number=SeqID_1071
  Gene Ontology: Mol. function=racemase and epimerase activity, acting on carbohydrates and derivatives; Cellular component=cytosol; Biological process=carbohydrate metabolic process
  Homolog annotation: Hit_ID=P35673; Match level="QueryCoverage=46%, HitCoverage=97%, E-value=1e-152, Identity=79%"; Hit description=UDP -glucose 4-epimerase
  Pfam annotation: Domain name=3Beta_HSD; Domain location=284-566; Score=-43.0; E_value=3e-07; Accession=PF01073.10; Description=3-beta hydroxysteroid dehydrogenaseisomerase family
  Pfam annotation: Domain name=Epimerase; Domain location=283-542; Score=280.0; E_value=4.7e-81; Accession=PF01370.12; Description=NAD dependent epimerasedehydratase family
  Pfam annotation: Domain name=KR; Domain location=281-425; Score= -71.2; E_value=0.0033; Accession=PF08659.1; Description=KR domain
  Pfam annotation: Domain name=NAD_binding_4; Domain location=285-488; Score=-45.7; E_value=7.9e-06; Accession=PF07993.3; Description=Male sterility protein
  Pfam annotation: Domain name=NTP_transferase; Domain location=5-280; Score=19.8; E_value=1.6e-08; Accession=PF00483.14; Description =Nucleotidyl transferase
  Pfam annotation: Domain name=NmrA; Domain location=283-568; Score= -96.1; E_value=0.0099; Accession=PF05368.4; Description=NmrA-like family
  Pfam annotation: Domain name=Polysacc_synt_2; Domain location=283 -538; Score=-143.3; E_value=8.7e-05; Accession=PF02719.6; Description= Polysaccharide biosynthesis protein
  Pfam annotation: Domain name=RmlD_sub_bind; Domain location=281-621; Score=-147.1; E_value=0.00041; Accession=PF04321.8; Description=RmlD substrate binding domain
  Pfam annotation: Domain name=adh_short; Domain location=281-410; Score=-13.6; E_value=9.7e-05; Accession=PF00106.16; Description =short chain dehydrogenase
  Pfam module annotation: Pfam domain module=3Beta_HSD::Epimerase::KR::N AD_binding_4::NTP_transferase::NmrA::Polysacc_synt_2::RmlD_sub _bind::adh_short; Domain location=284-566::283-542::281-425::285 -488::5-280::283-568::...
  Pfam module annotation: Domain location=283-538::281-621::281-410
MTKLKAVIPVAGLGMHMLPATKAIPKEMLPIVDKPMIQYIVDECVAAGIKEIVLVTHASKNAVENHFDTTYELEALLEARVKRQLLSEVQSICPPGVTIMNVRQANPLGLGHSVLCARPMIGDNPFVVVLPDVLLDDSTADHLRYNLAAMVARFEETGRSQVLAKHMPGEDLSEYGVLTTEQPLDNPGDISTITNFVEKPEHPSELNSDLTAVGRYVLSADIWGELERTEPGAWGRIQLTDAIASLSQKKPVDAQLLTGTSFDCGRKLGYMQAFVSYGVHMAILVTGGAGYIGSHTVLALLERGDDVVVLDNLCNASREAINRVEKLAGKKAVFVEGDIRDRAYLRDLFASNDISAVIHFAALKAVGESTRMPLEYYENNVAGTVVLLEEMRAAGVWNFIFSSSATVYGADAPVPYVETTPIGGTTSPYGTSKLMIEFVMRDFAKAEPNFKAIALRYFNPVGAHESGEIGEDPTGIPNNLLPYIAQVAIGRLDKLGVFGDDYATPDGTCQRDYIHVVDLAEGHLKALDHLPKVEGYKAYNLGGGKGFSVLEMIKAFEQASGKQIPFEFKPRRDGDLPAFWADASLANKELDWRVTRGIDAMMRDTWNWQNGAGKSTSLGLVAGVIKPSSGSVVTRGRVASMLELGGGFHPELTGRENIRLNATLLGLRRKQLNERINKIIEFSELGEFIDEPIRVYSSGMLAKLGFS

SEQ ID NO: 92757 - protein, 272 aa, Glycine max
  Coding DNA Sequence Number=SeqID_1072
  Gene Ontology: Mol. function=phosphogluconate dehydrogenase (decarboxylating) activity; Cellular component=cytosol; Biological process=D-gluconate metabolic process
  Homolog annotation: Hit_ID=Q74V90; Match level="QueryCoverage=98%, HitCoverage=55%, E-value=1e-134, Identity=88%"; Hit description=6 -phosphogluconate dehydrogenase, decarboxylating
  Pfam annotation: Domain name=6PGD; Domain location=1-269; Score =637.7; E_value=1e-188; Accession=PF00393.10; Description=6 -phosphogluconate dehydrogenase, C-terminal domain
AYALLKGALGLNNEELAKTFTDWNNGELSSYLIDITKDIFTKKDEDGKYLVDVILDEAANKGTGKWTSQSSLDLGEPLSLITESVFARYLSSLKSQRVAASKVLSGPQAQAFTGDKAEFIEKVRRALYLGKIVSYAQGFSQLRAASEENNWDLHYGEIAKIFRAGCIIRAQFLQKITDAYATDANIANLLLDPYFKNIADEYQQALRDVVSYAIQNGIPTPTFSAAIAYYDSYRSEVLPANLIQAQRDYFGAHTYKRIDKDGVFHTEWLVNN

SEQ ID NO: 92758 - protein, 200 aa, Glycine max
  Coding DNA Sequence Number=SeqID_1073
  Gene Ontology: Cellular component=integral to membrane
  Homolog annotation: Hit_ID=A7MLJ3; Match level="QueryCoverage=65%, HitCoverage=55%, E-value=3e-63, Identity=90%"; Hit description =Putative uncharacterized protein
  Pfam annotation: Domain name=DUF218; Domain location=1-115; Score =95.6; E_value=1.6e-25; Accession=PF02698.8; Description =Uncharacterized ACR, COG1434
GALNAYNSGKVNYLLLSGDNALQSYNEPMTMRRDLIKAGVDPSDIVLDYAGFRTLDSIVRTRKVFDTNDFIIITQRFHCERALYIAQHLGIQAQCYAVPSPKNMLSVRFREVGARLGALADLYLMKREPRFLGPLLPGGHTGTVARAGREAAEITGERAAAGSDVGKLSRIAAMLPVRINAHPTKYRPSPASLTAILIVQ

SEQ ID NO: 92759 - protein, 479 aa, Glycine max
  Coding DNA Sequence Number=SeqID_1074
  Gene Ontology: Mol. function=phosphoribosyl-AMP cyclohydrolase activity; Cellular component=cytoplasm; Biological process=amino acid biosynthetic process
  Homolog annotation: Hit_ID=Q6D405; Match level="QueryCoverage=41%, HitCoverage=95%, E-value=2e-77, Identity=72%"; Hit description =Histidine biosynthesis bifunctional protein [includes: phosphoribosyl- AMP cyclohydrolase ...
  Homolog annotation: Hit description=and phosphoribosyl-ATP pyrophosphatase
  Pfam annotation: Domain name=His_biosynth; Domain location=2-107; Score=-53.4; E_value=1.9e-06; Accession=PF00977.12; Description =Histidine biosynthesis protein
  Pfam annotation: Domain name=PRA-CH; Domain location=147-221; Score =149.3; E_value=1.1e-41; Accession=PF01502.9; Description =Phosphoribosyl-AMP cyclohydrolase
  Pfam annotation: Domain name=PRA-PH; Domain location=229-317; Score =158.2; E_value=2.2e-44; Accession=PF01503.8; Description =Phosphoribosyl-ATP pyrophosphohydrolase
  Pfam annotation: Domain name=YbaK; Domain location=334-477; Score =156.2; E_value=9e-44; Accession=PF04073.6; Description=YbaK  prolyl -tRNA synthetases associated domain
  Pfam module annotation: Pfam domain module=His_biosynth::PRA-CH::PRA -PH::YbaK; Domain location=2-107::147-221::229-317::334-477
MKPAASITSISIPATKPRTRVTQWETLDWVEEVQKLGAGEIVLNMMNQDGVRNGYFLVQLKKVRDVCKVPLIASGGAGTMAHFLEAFEQANVDGALAASVFHKQIINIGELKNFLIDNEQLARLDWAKTAGMMPVIVQHNVSGEVLMHGYMNEDALHKTLADGNVTFFSRTKNRLWTKGETSGHFLKVVSITPDCDNDTLLVLANPIGPTCHLGTSSCFSPAAPDWTFLYQLEQLLASRKSADPASSYTAKLYASGTKRIAQKVGEEGVETALAGTVNDRHELTNEASDLLYHLLVLLQDQELDLSTIINNLRARHKMETPMTTHEKLLALLDQHNARYRLMEHEATGKCEAVAAIRGTEVGQGAKALVCHVKGNGIKQHVLAVLPADQQADLSKVAAAVGGRRASLASPAEVDALTGCVFGAIPPFSFHADLQLVVDPLLFERYDEIAFNAGLLEKSVVLQVEDYRALHNGNVMKIIL

SEQ ID NO: 92760 - protein, 159 aa, Glycine max
  Coding DNA Sequence Number=SeqID_1075
MIVAAFGFQVQRAHHGVRQRAEEVLDHFGAQVANALVAELGFVFEVRTAGDIQRAARQALIHRQHEAEAADAALVAQRLQQRFAQRQAGIFHRVVIVDIQVAFHLNVHAEAAVHGDLIQHVIKEADAGVDFAAAFAIQPHFHFNLRLFGVAVNQRVTIA

SEQ ID NO: 92761 - protein, 185 aa, Glycine max
  Coding DNA Sequence Number=SeqID_1076
  Gene Ontology: Mol. function=phosphogluconate dehydrogenase (decarboxylating) activity; Biological process=pentose-phosphate shunt
  Homolog annotation: Hit_ID=A7MJP1; Match level="QueryCoverage=95%, HitCoverage=64%, E-value=1e-58, Identity=64%"; Hit description =Putative uncharacterized protein
  Pfam annotation: Domain name=NAD_binding_2; Domain location=1-118; Score=-90.0; E_value=0.095; Accession=PF03446.6; Description=NAD binding domain of 6-phosphogluconate dehydrogenase
  Pfam annotation: Domain name=UDPG_MGDP_dh_N; Domain location=2-155; Score=-64.6; E_value=0.00058; Accession=PF03721.5; Description=UDP -glucoseGDP-mannose dehydrogenase family, NAD binding domain
  Pfam module annotation: Pfam domain module=NAD_binding_2::UDPG_MGDP _dh_N; Domain location=1-118::2-155
MKKVAIVGLGWLGMPLAMALSARGWQVTGSKTSPDGVDAARRCGIDAFQLVLSPELECEADDLAALMAVDALVVTLPASRTVQGGEDYMQAVQNVVDTALANKVPRIIFTSSTSVYGSGDGVRKESSALQPETVAGKTLVELENWLHDLPGTSVDIVRLAGLVGPNRHPGRFLAVKPTWKTARTR

SEQ ID NO: 92762 - protein, 471 aa, Glycine max
  Coding DNA Sequence Number=SeqID_1077
  Gene Ontology: Mol. function=glutamate-putrescine ligase activity; Cellular component=cytoplasm; Biological process=nitrogen compound metabolic process
  Homolog annotation: Hit_ID=A8GGS4; Match level="QueryCoverage=99%, HitCoverage=99%, E-value=0.0, Identity=75%"; Hit description =Glutamine synthetase catalytic region
  Pfam annotation: Domain name=Gln-synt_C; Domain location=132-393; Score=333.3; E_value=4.3e-97; Accession=PF00120.15; Description =Glutamine synthetase, catalytic domain
MTNLVEVEDFTRHSEEKRTSAFQLEVKTWLERHPETQYVDILLNDLNGVFRGKRIPVSALAKLEKGCYFPASVFAMDILGNTVEEAGLGQALGEPDNLCIPVPGTLIPSASDPQRIAQLLLTMCDQDGTPFDVEPRNVLNRLWQQLRNRGLFPVVAVELEFYLVDKKRDAEGYIQPPCAPGSEERNMQSQVYSLDNLDHFADVLRDIDALAKLQNIPADGALAEASPGQFEINLHHTRDILKACDDAILLKRLVRQVAENHGMTATFMAKPYEEYAGSGMHVHISMLDAADHNAFALDDGSDSPLLKRALAGMIDLMPASMALLAPNVNAFRRFLPEAFVPLQASWGHNNRTVALRIPCGDVENHRVEYRVAGADANPYLVVSAIIAGILHGLDNQLPLPHPVKGNGHEAEGLELPIRQSDALYEFENSYPLQKLLGERFSGVWHSCKQYELREFERLITATEIDWMLKNA

SEQ ID NO: 92763 - protein, 480 aa, Glycine max
  Coding DNA Sequence Number=SeqID_1078
  Gene Ontology: Mol. function=exodeoxyribonuclease I activity; Biological process=response to DNA damage stimulus
  Homolog annotation: Hit_ID=A7MJN8; Match level="QueryCoverage=90%, HitCoverage=87%, E-value=0.0, Identity=75%"; Hit description =Putative uncharacterized protein
  Pfam annotation: Domain name=Exonuc_X-T; Domain location=17-200; Score=90.7; E_value=4.6e-24; Accession=PF00929.15; Description =Exonuclease
  Pfam annotation: Domain name=Exonuc_X-T_C; Domain location=218-472; Score=536.7; E_value=2.5e-158; Accession=PF08411.1; Description =Exonuclease C-terminal
  Pfam module annotation: Pfam domain module=Exonuc_X-T::Exonuc_X-T_C; Domain location=17-200::218-472
MAIEVVLYRADDYSFTFLFHDYETFGKSPSLDRPAQFAGLRTDKAFNAVGEPQVFYCQLADDYLPQPEAVMITGITPQVANARGVPEVEFAQRIHALFSEPQTCVIGYNNVRFDDEVTRNIFYRNFIDPYGWSWQNGNSRWDLLDVMRACYALRPEGIVWPENDDGFPSFKLEHLTQANGVAHEQAHDAMSDVYATLAMAKLVQEKQPKLFEFLFTHRNKQKLMTLIDIPQMKPLVHVSGMFGAARGNTSWIVPLAWHPDNKNALIVADLAGDMTPLLTLSPDELRERLYTRYSDLGDLPAVPIKLVHINKCPVLAPANTLRPEDAERLGIDRQHCLANLALLRQHAEVRENVVTLFAEAEPFTPSEDVDAQLYDGFFSDADRAGMNILRQTPPQNLPALDLTFEDKRIAKLLFRYRARNFPGTLDDKEQQRWLQHRREQLNAERVQAFLLELESLASLHEADAEKMGAAESAVFVCAGA

SEQ ID NO: 92764 - protein, 140 aa, Glycine max
  Coding DNA Sequence Number=SeqID_1079
  Gene Ontology: Mol. function=protein kinase activity; Biological process=protein amino acid phosphorylation
  Homolog annotation: Hit_ID=A7ZNH9; Match level="QueryCoverage=65%, HitCoverage=85%, E-value=8e-31, Identity=78%"; Hit description =UPF0265 protein yeeX
  Pfam annotation: Domain name=DUF496; Domain location=47-136; Score =156.7; E_value=6.4e-44; Accession=PF04363.3; Description=Protein of unknown function (DUF496)
MVKGETEQVIANSHELEAITQELEALIANGSARLETTAIYGYVWLSLEQARQLERMTDLREITDNEKKIRDNQKRVLLLDNLSEYIKPGMSVEAIQEIIASMRVDYEDRVDEYIIKNADLSKERRELSKKLKAMGEPKGQ

SEQ ID NO: 92765 - protein, 189 aa, Glycine max
  Coding DNA Sequence Number=SeqID_1080
  Gene Ontology: Mol. function=2-dehydropantoate 2-reductase activity; Cellular component=cytoplasm; Biological process=pantothenate metabolic process
  Homolog annotation: Hit_ID=A9HCI9; Match level="QueryCoverage=65%, HitCoverage=41%, E-value=2e-21, Identity=39%"; Hit description=2 -dehydropantoate 2-reductase
  Pfam annotation: Domain name=ApbA_C; Domain location=41-166; Score =76.5; E_value=9e-20; Accession=PF08546.2; Description=Ketopantoate reductase PanEApbA C ter
MQLSPLHVLYYGALDGNNDARLARVDAALRDAQFDSVFADNIISELWEKWLLLSTLGAVCCVARGNTQHILRSAGGEALLQGIFAEVLAVITADGYQQRPAVTAKIYETLNNPDAAMTSSMYRDLTQGYDIEADQIIGDLLVRGARHAVATPLLNAVPVRGVPGAHECAPYGPVRGNNLVRMNAHPTIL

SEQ ID NO: 92766 - protein, 402 aa, Glycine max
  Coding DNA Sequence Number=SeqID_1081
  Gene Ontology: Mol. function=transporter activity; Cellular component= integral to membrane; Biological process=transport
  Homolog annotation: Hit_ID=B0J449; Match level="QueryCoverage=42%, HitCoverage=79%, E-value=7e-52, Identity=62%"; Hit description =Binding-protein-dependent transport systems inner membrane component precursor
  Pfam annotation: Domain name=ADH_zinc_N; Domain location=199-321; Score=-21.3; E_value=0.045; Accession=PF00107.17; Description=Zinc -binding dehydrogenase
  Pfam annotation: Domain name=BPD_transp_1; Domain location=1-198; Score=52.4; E_value=1.6e-12; Accession=PF00528.13; Description =Binding-protein-dependent transport s
  Pfam annotation: Domain name=Epimerase; Domain location=203-400; Score=-62.4; E_value=0.016; Accession=PF01370.12; Description=NAD dependent epimerasedehydratase family
  Pfam annotation: Domain name=KR; Domain location=201-376; Score= -59.4; E_value=0.00068; Accession=PF08659.1; Description=KR domain
  Pfam annotation: Domain name=adh_short; Domain location=201-364; Score=74.6; E_value=3.2e-19; Accession=PF00106.16; Description=short chain dehydrogenase
  Pfam module annotation: Pfam domain module=ADH_zinc_N::BPD_transp _1::Epimerase::KR::adh_short; Domain location=199-321::1-198::203 -400::201-376::201-364
MTAVAGLFSLLAGLPLGLILVTTSPGGIAENRSINRLLGVVINGFRSLPFIILLVALIPFTRLLVGTSLGTWAAIVPLSITATPYFARVAEVSLRDVDRGLIDAVRAMGASKLRIVWEVLIPEALPGILSGFVVTLVALIGASAMAGAIGAGGLGDLAIRYGYQRFDTAVMVAVIAVLIVLVCGIQWLGDRLESFMELTGNTILITGGGSGIGRAMAEALLAAGNQVIIAGRRKEVLDETIAANPGMHAIVMDMDSHDSILSGAQTVIQRWPALNVVIHNAGIMRREDLKRGDVTVAEAEITTNLLGPIRLTAALIEHFLAQPRAAILTVSSGLAFVPLSLTPAYCATKAAIHSWTQSLRYQLRDTAIQAARNESGSDAVGGVYAGNAANIAGTAGHCRGAG

SEQ ID NO: 92767 - protein, 61 aa, Glycine max
  Coding DNA Sequence Number=SeqID_1082
MAKGDRGMAQDGGAEIQPRTNRSGAIHCAFRQLCNVSHSAINRAATMCAELWCRTTMSHGS

SEQ ID NO: 92768 - protein, 441 aa, Glycine max
  Coding DNA Sequence Number=SeqID_1083
  Gene Ontology: Mol. function=hydrolase activity, acting on carbon -nitrogen (but not peptide) bonds; Cellular component=membrane; Biological process=phosphonate transport
  Homolog annotation: Hit_ID=A6TH14; Match level="QueryCoverage=76%, HitCoverage=88%, E-value=1e-141, Identity=73%"; Hit description =Phosphonate metabolism
  Pfam annotation: Domain name=Amidohydro_1; Domain location=26-339; Score=-30.5; E_value=0.0013; Accession=PF01979.11; Description =Amidohydrolase family
  Pfam annotation: Domain name=Amidohydro_3; Domain location=26-337; Score=-13.7; E_value=2.2e-06; Accession=PF07969.2; Description =Amidohydrolase family
  Pfam module annotation: Pfam domain module=Amidohydro_1::Amidohydro _3; Domain location=26-339::26-337
MRGGRIASFSDSGSQQPGALDGGNAFLLPGLVELHTDNLDKFFTPRPKVDWPAHSAMSSHDALMVASGITTVLDAIGVGDVRDGGHRLENLSKMITAIQDSNRKGINRADHQLHLRCELPHHTTLPLFEALMSTPELSLVSLMDHSPGQRQYASLEMYRTYYQGKYQLNDEQMDQFEREQLALAAEFSTPNRNAIAGLCQARGIPVASHDDATAAHVAESHAVGSAIAEFPTTLEAARASRDCGMRVLMGAPNIVRGGSHSGNVAAWQLASHGLLDILSSDYYPASLLDAVFRLVADERNALTLPQAAALVTRNPAQAIGLHDRGTIAEGLRADLVLAHTDHGQAGVLMARLIWLTGPSGSGKDSLLNALREAPPDKLVIAHRYITRPADAGGENHVALSEAEFRRREALGLFAISWRAHGLSYALGKEIDHWLARGLNVL

SEQ ID NO: 92769 - protein, 164 aa, Glycine max
  Coding DNA Sequence Number=SeqID_1084
  Gene Ontology: Mol. function=phosphonate transmembrane-transporting ATPase activity; Cellular component=plasma membrane; Biological process=phosphonate transport
  Homolog annotation: Hit_ID=A8GBM4; Match level="QueryCoverage=93%, HitCoverage=56%, E-value=4e-47, Identity=64%"; Hit description =Phosphonate ABC transporter, ATPase subunit
  Pfam annotation: Domain name=ABC_tran; Domain location=53-159; Score=- 32.9; E_value=0.00038; Accession=PF00005.18; Description=ABC transporter
MERNMAQALLKTVVDNAHPAQRHGDKVLSVQGLCKAFGDNRVLDDVSFDLHAGELVAVIGRSGAGKSTLLHMLNGTIASSEGAILSMRHGEADRDVVTLNSRQMREWRSECGMIFQDFCLVPRLDVLTNVLLGRLSQTSTLKSFFKIFSDTDRAQAIEGCCSGR

SEQ ID NO: 92770 - protein, 387 aa, Glycine max
  Coding DNA Sequence Number=SeqID_1085
  Gene Ontology: Mol. function=transferase activity, transferring phosphorus-containing groups; Cellular component=integral to membrane; Biological process=two-component signal transduction system (phosphorelay)
  Homolog annotation: Hit_ID=A8GAJ2; Match level="QueryCoverage=97%, HitCoverage=45%, E-value=1e-100, Identity=55%"; Hit description =Multi-sensor hybrid histidine kinase precursor
  Pfam annotation: Domain name=HAMP; Domain location=285-347; Score =26.7; E_value=8.6e-05; Accession=PF00672.16; Description=HAMP domain
MSHSLHWHAGARGRLLMFNLLVVSVTLAVSLVAIFGFRHAGHIQEQAQAQTLADMNGSLALARDTANVAIAAVRLAQVVGALEYQSESARLQQTQQALQQSLSQLASAPLAAQQPALLARIRERSQMLEQSISQLLLEGHQRHLQRNVMLSGLWQAQLLLNRIDLLASDGAFLPLRQQTAALLTVAIQSATPQAAVQQLNSVLPIWSALPLQGVLAMQRARLVSTSQQLLPVAGQLEQSDIAIAYATYRIKALVAMLNEDITHYVQLVAQQSDARSATAHQELDSIIGFIGLFMLTGAADYRLTAIAHAMTRLAQGEKSVSVPGLARRDELGDLARAFNVFARNTASLAHTSQLLKEKSNQLESTFLAMRDGFALFDNSGQLVVWNA

SEQ ID NO: 92771 - protein, 440 aa, Glycine max
  Coding DNA Sequence Number=SeqID_1086
  Gene Ontology: Mol. function=two-component response regulator activity; Cellular component=intracellular; Biological process=two -component signal transduction system (phosphorelay)
  Homolog annotation: Hit_ID=A8GAJ9; Match level="QueryCoverage=55%, HitCoverage=100%, E-value=3e-89, Identity=69%"; Hit description=Two component transcriptional regulator, winged helix family
  Pfam annotation: Domain name=Response_reg; Domain location=195-308; Score=107.1; E_value=5.2e-29; Accession=PF00072.15; Description =Response regulator receiver domain
  Pfam annotation: Domain name=Trans_reg_C; Domain location=347-423; Score=83.4; E_value=7.2e-22; Accession=PF00486.19; Description =Transcriptional regulatory protein, C t
  Pfam module annotation: Pfam domain module=Response_reg::Trans_reg_C; Domain location=195-308::347-423
  Subcellular localization annotation: CTP_CleavageSite=65; ConfidenceScore=5.94e-01
MPISTAPVTRRASSTTMIKKPSSASSGPGLVRSPRPTSVAGLSTTMPAPSSAISARNRPMPAAIPARSGSGMLAIIHSRILKIDSAKKITAERNTAPSAICQAHQNRTDGRGQTGGNKHRAFIHTGRPEDAGIHKQDVGHCQKGRDTGNDFGAHRGVRAVAAKKILNQNEARLWCIAPPARKRFPAVRSRGAMKPAILVVDDDRAICELLHDVLSEHVFTVYSCHQGRDALALLAQHPEISLVMLDMMLPDTNGLLVLQQMQRQRPELLVIMLTGMGSEADMVVGLEMGADDYIAKPFNPRVVVARARAALRRCGRLAQPETVIDEGWQFNGWRLDDVRCQLFNPQRESVPLTQGEYSLLRALVGHARKVLTRDQLLELTHSESLDVFDRTIDVLIMRLRRKIEANPHQPILIRTIRGLGYVFSADVMRPSAAARETQIA

SEQ ID NO: 92772 - protein, 118 aa, Glycine max
  Coding DNA Sequence Number=SeqID_1087
  Subcellular localization annotation: CTP_CleavageSite=84; ConfidenceScore=5.06e-01
MASLTGCAFMRTGIMQEFSNDYASNAHCGGRRQLNAPGCTSITNSLPDSGSPSRLKVISCGERMVSDVSCAATMFGFSSSRVSECSNVGSSSWAVTMLRLSCPSLISASGHNRCPPPA

SEQ ID NO: 92773 - protein, 844 aa, Glycine max
  Coding DNA Sequence Number=SeqID_1088
  Gene Ontology: Mol. function=CDP-glycerol glycerophosphotransferase activity; Cellular component=membrane; Biological process=teichoic acid biosynthetic process
  Homolog annotation: Hit_ID=Q2T8Z7; Match level="QueryCoverage=42%, HitCoverage=91%, E-value=6e-49, Identity=34%"; Hit description =Putative uncharacterized protein
  Pfam annotation: Domain name=Glyco_transf_25; Domain location=13-161; Score=-22.7; E_value=4.7e-05; Accession=PF01755.8; Description =Glycosyltransferase family 25 (LPS biosynthesis protein)
MGVEMMAVNWQTIDKVVYINLNKRKDRRVRIARQLKAIGVPREKIVRFEAIEETPGYIGCIKSHILVLQMAQQNGWKNVLILEDDMVFHDDIQTKQRIDLFLSSLQQINWHVALLAANYDNVVPLKSVDYIVKPQYAWCACAYIVNGDYYSTLIDNYAESLQGLLAGGVPQCWALDVRWNSLIKRDRWLGIFPNAGYQAADKSDIENQPVDYRAHFAKKLEEIVWPAYQPGEEKIKVDIFFQWAPGWTNFESVYRAMQAKPHFDCQIILAPYFSRGTKAPDYTAQRDLLNDKGIRYTEYHEYEITARKPHVVFLQNPYDDARPNELQSLTLNRRNISIAYIPYGLDMGDGERNRVYQYNLPCQNVARWVFVRSQRHKDEFAKYCGNGNHHVYVSGHPKLDNYPSRFGVQTDGKVNKGKPTLLWAPHFVMPDDEKMWSTFNLYTQAMLDIIKRDDVNLIIRPHPLFKQFLDIRKERGTHSETAQNWQMLREYSHLKSHVEWDFSADYRYAFSQSDALMADAGSFLLEYLPSRKPILFLTHENCLGINSSAEFIYDAYDVANESADIKTFVDNLVSGKDPMRDKRLQVLRDELHMPEQGAGRNENGALTLNYPKCLLPVGEITVLDRLLTELLKCGEREIVLVTGHQSSVVERWIKDNYADANIKLAHNDNYKNDVNILSVEKGVSALNHPEYGYTIIETDVLLDPRVWPRLMQAEMGSDSFWLTHGYYNSCLTGGIVEASKAEPAIKKIAYVPDYDSAFDGWMKMVGLLSVSPEQVENDRRLRQTFLQTSTQQYYMAPWIVHRSCLPCRAVDITDLFARSFNEEVDYRQAVADYHLLLENFEALK

SEQ ID NO: 92774 - protein, 594 aa, Glycine max
  Coding DNA Sequence Number=SeqID_1089
  Gene Ontology: Mol. function=hydrolase activity; Cellular component =intracellular; Biological process=two-component signal transduction system (phosphorelay)
  Homolog annotation: Hit_ID=A6T9G8; Match level="QueryCoverage=48%, HitCoverage=88%, E-value=1e-118, Identity=69%"; Hit description =Putative epoxide hydrolase protein
  Pfam annotation: Domain name=Abhydrolase_1; Domain location=212-432; Score=25.5; E_value=4.4e-05; Accession=PF00561.11; Description =alphabeta hydrolase fold
  Pfam annotation: Domain name=Response_reg; Domain location=435-549; Score=118.4; E_value=2.1e-32; Accession=PF00072.15; Description =Response regulator receiver domain
  Pfam module annotation: Pfam domain module=Abhydrolase_1::Response _reg; Domain location=212-432::435-549
MGASATCAWAERLSAADVLGPAAVAPLDHPQPPARLIVDAPLAGPLRKGAVFIQYRAENLRIEPVFGQEALKITPRIGHIHVIVDDNPWHWADTSGEPVILVGLPVGPHKVTLILADPTHKPIDSKTITFNVPTLLATLVLTAAGTAFAATPASRDYAADFSHVQQINAGVLNTGYVDIGPRDGQAVILLHGWPYDIQSYAQVAPALAAKGYRVIVPYLRGFGSTRFLSDKTPRNGQPSAIAADVVALMDALNIKQAVLGGFDWGARTADIVAALWPERVKSLASVSGYLISSQQLGKKPLPPQAEQQWWYQFYFATERGQQGDATFNQSAKALDNPDQVAITISNYRWRLGLEKGEQKYAAYEKTLATLPTIRVPTITIEGDNNGAPHPAPETYRTRFSARYQHRTFTGNIGHNPPAEAPQAFVQAEAVLEHVDHILVVDDDRDIRELITDYLIKSGYRATGAANGREMRAVLSSSLVDLVVLDIMMPGDDGLTLCRQLRSDPRQNLPVLMLTARSEETDRILGLEMGADDYLIKPFVAPGYLRAPSAGQRRRDCGAEWRRVPPAARVSRPSAARAESRSAAQPDAGSRRGAV

SEQ ID NO: 92775 - protein, 1085 aa, Glycine max
  Coding DNA Sequence Number=SeqID_1090
  Gene Ontology: Mol. function=nucleic acid binding; Cellular component= intracellular; Biological process=proteolysis
  Homolog annotation: Hit_ID=A5FDX5; Match level="QueryCoverage=72%, HitCoverage=74%, E-value=1e-110, Identity=33%"; Hit description =DEAD/DEAH box helicase domain protein
  Pfam annotation: Domain name=DEAD; Domain location=564-735; Score =59.7; E_value=1e-14; Accession=PF00270.20; Description=DEADDEAH box helicase
  Pfam annotation: Domain name=Helicase_C; Domain location=903-1000; Score=35.4; E_value=2e-07; Accession=PF00271.22; Description =Helicase conserved C-terminal domain
  Pfam annotation: Domain name=ResIII; Domain location=538-731; Score= -26.1; E_value=0.0074; Accession=PF04851.6; Description=Type III restriction enzyme, res subunit
  Pfam module annotation: Pfam domain module=DEAD::Helicase_C::ResIII; Domain location=564-735::903-1000::538-731
MPITFNQALTAECEFSEWTISNKNRAKLIEVIAYLYLRQEENAQRVIDALEPRWRVSKGRVAENVVRKLTAPRAEDVELLQSGTEAQKEAARKRINTSIIHRDGLLFQHISWIAARLELSDGYMTSPHVRQADKGFDGFIIELDERVCEIKRIVLCEDKASKSPRNLITSSVWPEIRTIRSGDRDDEILADLVTLLRSVPSIDAEEAVDKIFWEGAREFRVAVATGEDQRRAGDFLHIIAGFKTAAGGELEARMAGVLAFEDVRTGLDLLAGEVAAKVEEIANAPDLPGLAPETLDELLTAAHIELATVRLLSREGEPEAISDVLDQVRRLASTFEAYVALDLRPEQTRATAFVAASAHQILSRVRETATDRPTVVSSDAIGSSISATLLFLIAGRAADAAEVASQLRAKGERRAVRRSLILSLRELATGNLTTLIERDLGEHIIATRDSREVATDLLLRECAYVVQGLGQEARGSAVPDTDIRSRLKRVLHLSEASEVEINAALEGKVHHQFAGPHHLATLLSRLIDGVQAAMLIRLPAPSGAQPKTWADWLLSQTHSRPFLWINHLKAIGTGYLNRGRSMVMTSPTGSGKTTLSVLKIAATLCAGESVVYLAPTHALVDQVETDLSAQIGELEVVSVVEDVALEELGEKLPPFSVMTPERCLALLGFAPELFDKVGLLVFDEFHLISADDPATSSKISTRAIDSMLALLTFLRHRKRADLLLLSAMVSNGAEIARWLRSVTGREVESFDDPWKPTRQLRSCVIYDRSDVREAVQVASKAKTKAARNRVYAQPLGLFSLISGWHPKRPEKLVIQALTDQRPSLLKNAKGKLTSNRNEVAARIAADYAAIGKRVIVFCNDTKACGSVAGQINELLAPATIALDVTQEEMRKSVIRDIGAVEATFDPMGCRAAVHHGDLLPLERRLTESVFRARRDTDSEDLGLDVVAATSTIAQGLNLPCDVVILAGTDRSAVDDPSGNPRADLRPHEILNALGRAGRAAYAATGLAIVVPATPICVEIDNLSLPSDGIMKIIFSEQDACEEVYDPIELLLDRIEISANSDPKVQSIIRRMSAVTATGESGFDDI

SEQ ID NO: 92776 - protein, 514 aa, Glycine max
  Coding DNA Sequence Number=SeqID_1091
  Homolog annotation: Hit_ID=A4WA46; Match level="QueryCoverage=50%, HitCoverage=75%, E-value=9e-98, Identity=65%"; Hit description =Lysophospholipase-like protein
MVCGVRGAGRTKSTYYVWRSPGREDVEVIALTTVLLVMQIMLADAATYLSLLVGVLALFGIGGGVTYRIRQQNNIKQKAKKTEGDVNQAGRDINQTTNVYHTSNESAEDPVKKKQNEHDLKIIDQILELLPYEDTTQWVEQSYLSGIRQDVCLNIEKAEKFSGEKYRLFNTEVNGAKDAFMDAMTAYVDSTLPFMSVDYPNRKPVMLSLPHDWKSKSVESEANFRFHQQNVRETSGPSLRGRLFYDYHGQNHLNVQVGFPDMTSRNVRFVPRAEVEDQDQERRLNIRIFEPASTVEDILIVYHGGGVNSDAGYDMLAHHISHHGAICTCLIDIRGHGRSLGNKGSVSNPEQVWQDIDTVLEHVRVKFPWARVHLLGHSSGGGMLINYFTRFTPSQQSDSLILLAPEFGPFAPAKICRKTMVPFASVSKWPFVLNALSVGLLCGNRYAVTLNFPNEVMLLRPEFVQRYSVNMANALTPRQPARQIAALPLPVTVLIAEKDELFDARQMSEFVEGC

SEQ ID NO: 92777 - protein, 552 aa, Glycine max
  Coding DNA Sequence Number=SeqID_1092
  Gene Ontology: Biological process=conjugation
  Homolog annotation: Hit_ID=Q6D6S2; Match level="QueryCoverage=100%, HitCoverage=87%, E-value=0.0, Identity=85%"; Hit description =Mobilization protein
  Pfam annotation: Domain name=TraG; Domain location=75-500; Score= -195.2; E_value=0.0075; Accession=PF02534.5; Description=TraGTraD family
MGPVLIWIFQWLYRGLVIGSVPVLTWPVLISFTIAGIIFHILLRRVLTPELDKIKKRLVRKTTLERELRTDVRTVKSLLPETLHYDPLDYIDLNKGLFIGMDRDIQPMYLPVKDWQKQHADIIGTTGAGKGVATGILLYQSILAGEGVFVMDPKDDEWAPHLYRKACEDAGKPFALIDLRKPQYQLNLIEAITADELEELFVAGFSLAEKGQESDFYRIDDRKAARIAAQFVTRNTAATIRDVYNGDYVQGIADKIKAFFGKIEELALLNAINAPTGFSLNKIFKEGGCCYVIGSMRNSKIITAQRMLLVRLYQLAEKRERVKKVPRPIAIYLSELKYHLSRTALEGLGAARDKGVHIIMDHQSIADLKDCPADLKGDAVVGAVVENAKFKLVYRVMDPDTAEWVARMSGTILVDDEVRKAKTDAVLTETIDSERTIRQAERFFTDSNMILNLPDFVSFIFTTKALPSASLISPIRVKKRELEICAVSPAIAATAATINIALDFSEEEISPGPASTPDITTTRPDLFFDNTDEEDTTTPNAEKEENPSLMDF

SEQ ID NO: 92778 - protein, 587 aa, Glycine max
  Coding DNA Sequence Number=SeqID_1093
  Gene Ontology: Mol. function=peptidase activity; Cellular component =cytoplasm; Biological process=proteolysis
  Homolog annotation: Hit_ID=P76403; Match level="QueryCoverage=62%, HitCoverage=91%, E-value=1e-167, Identity=71%"; Hit description =Uncharacterized protease yegQ
  Pfam annotation: Domain name=DAGK_cat; Domain location=414-537; Score= 92.2; E_value=1.7e-24; Accession=PF00781.15; Description =Diacylglycerol kinase catalytic domain (pres
  Pfam annotation: Domain name=Peptidase_U32; Domain location=60-298; Score=308.9; E_value=9.4e-90; Accession=PF01136.10; Description =Peptidase family U32
  Pfam module annotation: Pfam domain module=DAGK_cat::Peptidase_U32; Domain location=414-537::60-298
MRYAFAYGADAVYAGQPRYSLRVRNNEFTHENLAKGISEAHALGKKFYVVVNIAPHNAKLKTFIRDLTPVIEMQPDALIMSDPGLIMLVRDAFPQMPIHLSVQANAVNWATVKFWQQMGLTRVILSRELSLEEIAEIRQQRDPNQGTCTNACRWEYNVAEGQQDEVGNIVGFHQPVAVQPATLGVGQPTDRVFLLEEKMKPGEVMSAFEDEHGTYIMNSKDLRAVAHVERLSQMGVHSLKIEGRTKSFYYCARTAQVYRRAIDDAAAGKPFDPALLETLEGLAHRGYTEGFLRRHTHDSYQNYEAGFFHFGASAVAVKNKFMLGDSVEIMTPDGNLNCTLQAMQNDKGAAVEVAPGDGHRVWISVPEGDHRPPLRRALESRLLLTSNNKQQVVPGTTSFTRPAPPEAIMQNKPLTLLILNGKGAGNEELRAAVNTLRDEGFNLAVRVTWEKGDGDRYVQEALQLQAETVVAGGGDGTINEIATALAALPPAQRPVLGILPLGTANDFATSAGIPAEMEAALRLAVLGKATPIVMGRVNCDRYFINMPTGGFGTRITTETPEKLKSALGGVSYFIHGLMRVDALKPNS

SEQ ID NO: 92779 - protein, 319 aa, Glycine max
  Coding DNA Sequence Number=SeqID_1094
  Gene Ontology: Cellular component=periplasmic space; Biological process=pathogenesis
  Homolog annotation: Hit_ID=Q6D6R6; Match level="QueryCoverage=92%, HitCoverage=100%, E-value=1e-116, Identity=71%"; Hit description =Putative conjugal transfer protein
  Pfam annotation: Domain name=CagX; Domain location=53-298; Score =79.2; E_value=1.3e-20; Accession=PF03524.6; Description=Conjugal transfer protein
PARSEPAGLYRHQLPARQRVEGGMMLKYILLLTGLLVSCVAWSSATPRGSAYDSRMQNVTYNSQNATVVSTRPGYVTMLVFDDDETVIDAQAGFPRGWTVTKSDNRVGVSPNPITQPVTDASGNTVSQVFLPTAKDWKTNLFVVTSKRDYSLELNVLDKDSPVQAFVIRYRYPDEQRKKSAAASATRQQRQQETLDRKRIAAAFGKATTPRNWRYTKRVAAGSAFIAPDFTWDDGRFAYIGFSPTKTLPSVFRVVNGQEQAVTPGTVKRGSYTVVVVPASTQLVLRYGTSVVGVENDGSGRIPLTNSDTVSPSVTLEAK

SEQ ID NO: 92780 - protein, 161 aa, Glycine max
  Coding DNA Sequence Number=SeqID_1095
  Homolog annotation: Hit_ID=Q6D6Q4; Match level="QueryCoverage=100%, HitCoverage=82%, E-value=3e-46, Identity=61%"; Hit description =Putative uncharacterized protein
MNALNQLSLDELFAVSRAAAPFVSVSVRHDVLHHLLAQARQEYRQQQQINRAIRLGGSIALLNHYFGLTSNDVCLQRRLLGVSVPYGRTPEPDEETDAEIWRQWQKCRVGNLESPDALIAMMQVTEALKRKVEGLSLTMVWKRIALCEQDAAADRRTPHAG

SEQ ID NO: 92781 - protein, 658 aa, Glycine max
  Coding DNA Sequence Number=SeqID_1096
  Gene Ontology: Cellular component=integral to membrane; Biological process=transport
  Homolog annotation: Hit_ID=Q216Y8; Match level="QueryCoverage=90%, HitCoverage=86%, E-value=1e-154, Identity=50%"; Hit description =Fusaric acid resistance protein conserved region
  Pfam annotation: Domain name=DUF939; Domain location=22-315; Score= -150.9; E_value=0.0051; Accession=PF06081.2; Description=Bacterial protein of unknown function (DUF939)
  Pfam annotation: Domain name=FUSC; Domain location=350-468; Score =177.4; E_value=3.8e-50; Accession=PF04632.3; Description=Fusaric acid resistance protein conserved region
  Pfam module annotation: Pfam domain module=DUF939::FUSC; Domain location=22-315::350-468
MASPSLLNDANALLYSAKSFTAAMLAYYIALSIGLERPSWAIITVYIVSQTSVGASLSRSLYRLVGTVIGAGMTVLIVPTFVNSPVFCSVILAGWITFCLYLSLLERTPRAYGFVLAGYTASLIGFPAVSDPGAIFDIAITRVQEIMIGIFCAALIHRYVLPARISGQFNSKLSQTLLAARQRIAETLTGKPDPVSSPLHMALALQFLQGISHHIPYDFAFSVPVRQARKRLHDRLARLVIVNCELRDRLALIAKIPFDVQILMDDVEVWLACKDEGKFKSEGEALKKRSEKLLQRYVVHELTFVEALHVSFMRYLTEAIVLVQQCYRLSDAIHHANQMPAHSEMNNVKGYVFHRDPLTAARTALGAFTIILSGCMVWIFSAWPDGGTAVSILGVCCTLFGSFDTPAPHIVKYIIGSLWGVVISLIYSFVLLPQVSDFIVLVVVLAPVYLLAGSLQARPPTTFMAMGITLTLPILCELGAHYSGDFAVAVNTSIALFSATGFAVFSMGFLQTVQADAAIKRLLKLCQRDINRSVKGVLNTDETLWINLMIDRAALILPRLPRSGQSSEQALNHLLHTLRIGLCVMRLRRWDAHADKEIKEVLTCLTHSTDINTLLERIVSLTERSLSVADELSRHHVNQLVDLYCALSTQEMEHADDQ

SEQ ID NO: 92782 - protein, 232 aa, Glycine max
  Coding DNA Sequence Number=SeqID_1097
  Gene Ontology: Mol. function=oxidoreductase activity; Cellular component=cytoplasm; Biological process=metabolic process
  Homolog annotation: Hit_ID=A4WGZ7; Match level="QueryCoverage=98%, HitCoverage=85%, E-value=6e-28, Identity=34%"; Hit description=Short- chain dehydrogenase/reductase SDR precursor
  Pfam annotation: Domain name=KR; Domain location=1-144; Score=-90.5; E_value=0.043; Accession=PF08659.1; Description=KR domain
  Pfam annotation: Domain name=adh_short; Domain location=1-141; Score=- 0.4; E_value=1.3e-05; Accession=PF00106.16; Description=short chain dehydrogenase
  Pfam module annotation: Pfam domain module=KR::adh_short; Domain location=1-144::1-141
MVARREPELILAAKKISEKYGVSVLPIAGDVTDPKLPSLVVEQAEKVFQRIDLLVNNAGRAHAGTLLTTSEEDWQIMTETKFSAMRRFCKVIIPGMQRRNWGRIVNISSIGGIYPNPQLTVSHALSAAINNLTRSLALSVAPDGILVNAIGVGAVATDNWAQNMLPNVRNRRPELADRTDEEVMALLGKEKTPVGRFGLPEDITAIAAFLLSGRNQFVTGQTIEASGGADRF

SEQ ID NO: 92783 - protein, 1120 aa, Glycine max
  Coding DNA Sequence Number=SeqID_1098
  Gene Ontology: Mol. function=two-component response regulator activity; Cellular component=intracellular; Biological process=two -component signal transduction system (phosphorelay)
  Homolog annotation: Hit_ID=A5ED47; Match level="QueryCoverage=45%, HitCoverage=70%, E-value=8e-52, Identity=25%"; Hit description =Transcriptional regulator
  Pfam annotation: Domain name=DUF6; Domain location=287-396; Score =16.8; E_value=0.0075; Accession=PF00892.11; Description=Integral membrane protein DUF6
  Pfam annotation: Domain name=DUF6; Domain location=417-543; Score =2.3; E_value=0.051; Accession=PF00892.11; Description=Integral membrane protein DUF6
  Pfam annotation: Domain name=HMGL-like; Domain location=55-275; Score= -119.6; E_value=0.1; Accession=PF00682.10; Description=HMGL-like
  Pfam annotation: Domain name=HTH_6; Domain location=17-123; Score =24.5; E_value=7.3e-06; Accession=PF01418.8; Description=Helix-turn -helix domain, rpiR family
  Pfam annotation: Domain name=Multi_Drug_Res; Domain location=306-387; Score=-26.2; E_value=0.048; Accession=PF00893.10; Description=Small Multidrug Resistance protein
  Pfam annotation: Domain name=NB-ARC; Domain location=625-904; Score= -89.3; E_value=0.00014; Accession=PF00931.13; Description=NB-ARC domain
  Pfam annotation: Domain name=SIS; Domain location=141-271; Score =54.3; E_value=4.2e-13; Accession=PF01380.13; Description=SIS domain
  Pfam module annotation: Pfam domain module=DUF6::DUF6::HMGL-like::HTH_ 6::Multi_Drug_Res::NB-ARC::SIS; Domain location=287-396::417-543::55 -275::17-123::306-387::625-904::141-271
MKNENGNRVSESEQRLQQWLGSIHARSGDLAASEAKVVDLLLVDPLFVGTSTTAQVATRAGVSPPTVIRAARAIGFTGFTELKIEIARARGTARFFAPPEVLTADATLASVLETSVRAGADALTALSGAIEISALDEAVDLIQSARQVFAFGAGPSATVAADAVFRLRTAGVITISIQDYLSAMIAARLLGSGDVMIVVSSTGRTSSTLAVADAASSAGASLIAITNQYDTPLATLANVSLVVGGAPLPAQMAAAGSRLAQLVVIDTLVAALTLRDKEQSRRAERAVAHAVWNIASKYKKEDTLLFVWAYSCASALLWVPISLILTVEGQQELDWRLAVGAAGYERAELGVVYPIARGSGPVLTILFATLLMGERLSASALLGALLVIAGIFVVTGNPFRSGSRPLKGMIWGAATGTAIAGYTLWDGYSVISLHLDPVSYYASTLLLQSLILTPGAMRRRYRIPTAVRVDRVPILIIAVCSPLAYILVLTAMQSMPLALVAPLRETSIIVGSLLSYWLFRENHLARRIAGAVVVSSPLPLSVAVSAIEIRLYIPPSVLREFVMLKTEDLNTMISIDEIHFADWQIWPQLRILLHRGKPVRISARAFDVLVALAQISAIRRILGHDRHLLVTEFGCASILGRDKAVQELCALLDQYRLVTITGSGGVGKTRLAWEVVSLTHTHFPDGICVAELAHITEASSLLSVISQALHLPLAAIHNDADLRQQLARRRCLLLIDNCEHVALQVAGEQHYLLPPLQVPESEEADTHELLTFSSVRLFIERGQANRHDYHPSASELSLIGELCRHLDGLPLAIELAASRLPVMSVKEIYSRLEDRFQLLSNTHRSLEPRHQKILTALEWTYQLLNTREQRLFCSLGIYTDMFSVKSVSDLLLIKDKHRWQVVDDLQRLLCFIPDSGQYSGTRDPFPPAGNHAPPTGQWRERYSHMLNDLRSVLQQTLTEGADPSKGLKILQAMTPFWIEYSLYDECKASTWAKGPTPETHSAWKTALTIAEKLDDKEIRLQAHYGLWLYYLRTGELDKALEHAQSMCELARSITDEEAMATGMRILGVSLHFLGRHDVGRDYLQQSLDWYEHGELSHSFRFGLDQESARSGLSVSFTLVT

SEQ ID NO: 92784 - protein, 144 aa, Glycine max
  Coding DNA Sequence Number=SeqID_1099
  Gene Ontology: Mol. function=DNA binding; Biological process=DNA recombination
  Homolog annotation: Hit_ID=Q9RM38; Match level="QueryCoverage=96%, HitCoverage=45%, E-value=5e-66, Identity=82%"; Hit description =Integrase
  Pfam annotation: Domain name=Phage_integrase; Domain location=1-111; Score=-5.4; E_value=0.0027; Accession=PF00589.13; Description=Phage integrase family
MRTAHIVPLSQQAIAILKRIKEISGVYELVFPGDHNPYKPMCENTVNKALRLMGFDTKKDICGHGFRAMACSALMESGLWSQDAVERQMSHQERNTVRLAYIHKAEHLEARKAMMQWWSDYLDICRVAYVPPFNTGRDKNNEAA

SEQ ID NO: 92785 - protein, 635 aa, Glycine max
  Coding DNA Sequence Number=SeqID_1100
  Gene Ontology: Mol. function=transporter activity; Cellular component= integral to membrane; Biological process=transport
  Homolog annotation: Hit_ID=A7MHJ0; Match level="QueryCoverage=98%, HitCoverage=60%, E-value=0.0, Identity=74%"; Hit description =Multidrug resistance protein mdtC
  Pfam annotation: Domain name=ACR_tran; Domain location=1-620; Score =405.5; E_value=8.1e-119; Accession=PF00873.10; Description =AcrBAcrDAcrF family
MALTIATGFVVDDAIVVLENIARHVEAGMKPLQAALTGVREVGFTVLSMSLSLIAVFLPLLMIGGIIGRFFSEFAITLSVAILISLFISITLTPMMCAYLLKPQAKRSQPRTRGFGRVLLAVQQGYARSLGWVLNHAIWVLLLLLGTVGLTIWLFIAIPKTFMPEQDTGRLNGFISADQSISFQAMRGKLQDFMNIIKADPAVDNVTGFTGGSRTNSGSMFVSLKPLSERSESAQEVIARLRVKLAKEPGANLYLNAVQDIRVGGRESNASYQYSLLSDNLADLREWEPKIRQAFAALPELADVNSDQQDNGSEMALTYDRESMARLGIDVSAANALLNNAFGQRQISTIYQPLNQYKVVMEVDPRYTQDVSALDQMFVINSDGKAIPLSWFAKWQPANAPLSVNHQGLSAASTISFNLPEGVSLSQASEAIDRTITAIGVPSSVRGSFAGTAQVFQDSQSNQLWLMLAAIAAVYIVLGILYESYVHPLTILSTLPSAGVGALLALQLFNTPFSLIALIGILLLIGIVKKNAIMMVDFALEAERNGNLSARDAIFQACQLRFRPILMTTLAALFGALPLVLTSGDGAELRQPLGITIAGGLVMSQLLTLYTTPVVYLMMDKLRRRKKQPRLITEP

SEQ ID NO: 92786 - protein, 162 aa, Glycine max
  Coding DNA Sequence Number=SeqID_1101
  Gene Ontology: Cellular component=integral to membrane; Biological process=cellulose biosynthetic process
  Homolog annotation: Hit_ID=A4WBY5; Match level="QueryCoverage=78%, HitCoverage=23%, E-value=1e-12, Identity=33%"; Hit description =Diguanylate cyclase
  Subcellular localization annotation: CTP_CleavageSite=51; ConfidenceScore=5.10e-01
MSLSLFTFFLISACTPFSHLTTLLQFVVIRSLATDANLATVITPHDACAARASLLDSRFQESLDELNYYQRMLSYALTHPLNADYGQHALQRFQQLRHQPVWQLQIANLRSMPINGVSDEWLQRDALLQRDDTYLLPELRAALEFSFIMQFSDEAQDFHSRF

SEQ ID NO: 92787 - protein, 115 aa, Glycine max
  Coding DNA Sequence Number=SeqID_1102
  Homolog annotation: Hit_ID=A4WBY3; Match level="QueryCoverage=66%, HitCoverage=98%, E-value=6e-15, Identity=56%"; Hit description =Putative cytoplasmic protein
MATAKEYSDNVQREVNIDVDALLEAIQKKTSGEVQEFMQAEDAHRVKVNGEAFDSYTELAEAFELDIRDFTITEENLNTASEYALAEVRQVSILHAIRTNLHNHALLLPKTSRYG

SEQ ID NO: 92788 - protein, 2295 aa, Glycine max
  Coding DNA Sequence Number=SeqID_1103
  Gene Ontology: Mol. function=motor activity; Cellular component =flagellin-based flagellum basal body; Biological process=ciliary or flagellar motility
  Homolog annotation: Hit_ID=A8GG11; Match level="QueryCoverage=14%, HitCoverage=72%, E-value=1e-153, Identity=86%"; Hit description =ATPase, FliI/YscN family
  Pfam annotation: Domain name=ATP-synt_ab; Domain location=400-601; Score=328.4; E_value=1.3e-95; Accession=PF00006.16; Description=ATP synthase alphabeta family, nucleotide-binding domain
  Pfam annotation: Domain name=ATP-synt_ab_N; Domain location=273-340; Score=9.3; E_value=0.028; Accession=PF02874.14; Description=ATP synthase alphabeta family, beta-barrel domain
  Pfam annotation: Domain name=Bac_export_1; Domain location=2040-2285; Score=272.0; E_value=1.2e-78; Accession=PF01311.11; Description =Bacterial export proteins, family 1
  Pfam annotation: Domain name=Flg_hook; Domain location=882-1024; Score=127.3; E_value=4.4e-35; Accession=PF02120.7; Description =Flagellar hook-length control protein
  Pfam annotation: Domain name=FliG_C; Domain location=1-57; Score =16.5; E_value=5.8e-06; Accession=PF01706.7; Description=FliG C -terminal domain
  Pfam annotation: Domain name=FliH; Domain location=126-257; Score =178.6; E_value=1.6e-50; Accession=PF02108.7; Description=Flagellar assembly protein FliH
  Pfam annotation: Domain name=FliL; Domain location=1091-1228; Score =99.0; E_value=1.4e-26; Accession=PF03748.5; Description=Flagellar basal body-associated protein FliL
  Pfam annotation: Domain name=FliM; Domain location=1250-1443; Score =411.6; E_value=1.1e-120; Accession=PF02154.6; Description=Flagellar motor switch protein FliM
  Pfam annotation: Domain name=FliP; Domain location=1814-1957; Score =195.6; E_value=1.2e-55; Accession=PF00813.11; Description=FliP family
  Pfam annotation: Domain name=SpoA; Domain location=1579-1655; Score =134.7; E_value=2.6e-37; Accession=PF01052.11; Description=Surface presentation of antigens (SPOA) protein
  Pfam module annotation: Pfam domain module=ATP-synt_ab::ATP-synt_ab _N::Bac_export_1::Flg_hook::FliG_C::FliH::FliL::FliM::FliP::SpoA; Domain location=400-601::273-340::2040-2285::882-1024::1-57::126 -257::1091-1228::...
  Pfam module annotation: Domain location=1250-1443::1814-1957::1579 -1655
QPLREKFLKNMSARAADILRDDLANRGPVRMSAVENEQKAILLIVRRLAEAGEMPPEPELLLAEEPDSDLVLSEEDEQQQQLERLQQQMRKDAQTQGYSEGYQKGFAEAQQNGYDAGFQQGLADAQQQQAPLQARMQQLVTEFHHTLEALDSVIASRLMQLALEAARTVIGQATQVDGSALLRQIQQLIQQEPMFSGKPQLRVHPDDLQRVEQTLGPTLDLHGWRLLADSSLHPGGCKLSAEDGDLDASVATRWQELCHRISQVQTVRRYGRLTRATGLVLEATGLQLPLGATCIIERHDNGTITEVESEVVGFNGQKLFLMPLEEVDGILPGARVYARVHGDHSGKQLLLGPELLGRVLDGSGKPLDGLPAPETGYRAPLITAPFNPLQRTPIHDVLDTGVRAINALLTVGRGQRMGLFAGSGVGKSVLLGMMARYTKADVIVVGLIGERGREVKEFIENILGAEGRARSVVIAAPADVSPLLRMQGAAYATRIAEDFRDRGQHVLLIMDSLTRYAMAQREIALAIGEPPATKGYPPSVFAKLPALVERAGNGIHGGGSITAFYTVLTEGDDQQDPIADSARAILTATCVSCASPGGAGSGTGDPAMRRGSAQARSADMSGVRQSGADYSPAIQTLEKAIGTASPAAYWNQRLEQARMNTLPTLLTQLAKTGKAQPSAAVDNLSAADTLPQGFITELGNRLLTLVKQQGNGAQSADLAAEIDAKNVTKASLSALLLALDKPEALNALLQPENTKAGLKSADDNDKRAASSLTASDLQNVQALFAMLPAVVENRSSPPADNSTALETRGEARTSLNAALLNSSLQSALKEEQAKPDGQPSKGSDALTSLTGVSHSPVQSAAASGTPASNSGMTLDESFQQVLSTLSKPEERREMLSSHDSSAPAISSPLSSTSPLVSTTASPSSAPSTPMLNAQLGSNEWQQALSQQIVMFSRNGQQNAELRLHPEDLGAIQISLTLDKDQAQLTMVSSHSHVRAALEAALPQLRTALAESGINLGQSNVNSDAFAQGQSYQGQQEGRRDGQYGSFTLSQDSDNEITPIAVPAALQARATGNGAEVTANMSDNAKAKGRKRSLLIPVLLIVTLAACSVAGYAVWRMMNKHEGDKPEAAKVEPPPAPVFFAMDTFTVNLVNPDNDPDRVLYVGFTLRLPDEDTRRRLNDYLPEVRSRLLLLLSRQSASALATEQGKQALVEQIKQVLAPPLAEIDALLNGDSDSAEVENSSKGADGDIRPYDPNTQRRVVRERLQALEIINERFARHFRMALFNLLRRSPDISVGAIKIQPYHEFARNLPVPTNLNLIHLQPLRGTALVVFSPSLVFIAVDNLFGGDGRFPTKVEGREFTHTEQRVIRRMLKLALEGYSDAWKAIYPLEVEYVRSEMQVKFTNITTSPNDIVVNTPFQVEIGNLVGEFNICIPFSMIEPLRELLVNPPLENSRQEDNHWRDNLVKQVQHSELELIAHFAETSLRLSRILQLKPGDVLPIEKPDRIIAHVDGVPVLTSQYGTLNGQNSPMSDSKKPSDDISADDLWAEAMNEQAATSSAAEPGDNVFKSLEASAASGSLQDIDLIMDIPVKLTVELGRTKMTIKELLRLTQGSVVALDGLAGEPLDILINGYLIAQGEVVVVNDKYGVRITDIITPSEPGGVHQFSRWASQQRAGGDRAADSGLRLAGETPRLCAESGERPGAESQRQRADHPSALAAAAATGSVPARQRGAAGFSTWLNVPENPNDASIAPSSAAADAAGTGCPCAAAGFDQPAAGQWRSELVAAGANAGLHYLADLYSGGVADDDQLHPHHYCVWSAAQRTGYAVRAAESGDAGQDKISMDVAIDKGAQPLREFMLRQTREADLALFARLANSAPIQGPEAVPMRILLPAYVTSELKTAFQIGFTVFIPFLIIDLVVASVLMALGMMMVPPATISLPFKLMLFVLVDGWQLLVGSLAQRAQHDTGIGNGNGPGSDAYRPDDGRSAAAGGDDTVVYPENSCRCGHRRGGRTVDAQPDAGLHPYPVQQPALYHRLMVTLDSSQLVHWVAQFFWPMVRLLALFASAPLLNERSIPKRVKIGLAVVTTWILMPLLPPVEVTLFTPAGFWMLVQQLLIGVGIGLTMQLAFSAVRLAGEMIGLQMGLSFATLLDPNSRINMPLLARFLDMLAMLLFLTFNGHLWLISLLVDSFHTLPINDQPLNANAFMALTKAASLIFLNGMMLALPLIILLLTLNLALGLLNRVSPQLSVFAIGFPITLTVGILSLGMMMPLLAPFCEHLFGEVFDLLAQFVSELSPAR

SEQ ID NO: 92789 - protein, 212 aa, Glycine max
  Coding DNA Sequence Number=SeqID_1104
  Gene Ontology: Mol. function=protein binding; Cellular component =flagellin-based flagellum basal body, MS ring; Biological process =ciliary or flagellar motility
  Homolog annotation: Hit_ID=A7MJJ5; Match level="QueryCoverage=98%, HitCoverage=36%, E-value=1e-83, Identity=74%"; Hit description =Putative uncharacterized protein
  Pfam annotation: Domain name=YscJ_FliF; Domain location=23-212; Score= 264.0; E_value=3.1e-76; Accession=PF01514.8; Description=Secretory protein of YscJFliF family
MNASAAATQDTAKKGFNDLLARLRANPRIPLIVAAAAAIAVVLALVLWAKAPDYRVLYNNLSDEDGGAIVTQLTQMNIPYQFAENGGALMVPADKVHELRLRLAQQGLPKGGSVGFELMDKEKFGISQFSEQINYQRALEGELARTIETLGPVKSARVHLAMPKPTLFVREQKSPSASVTLNLQPGRALDEGQIQAIQHMVSSSVAGLPPGN

SEQ ID NO: 92790 - protein, 369 aa, Glycine max
  Coding DNA Sequence Number=SeqID_1105
  Gene Ontology: Mol. function=transporter activity; Cellular component= integral to membrane; Biological process=transport
  Homolog annotation: Hit_ID=A7MHJ1; Match level="QueryCoverage=100%, HitCoverage=35%, E-value=1e-150, Identity=74%"; Hit description =Multidrug resistance protein mdtB
MAQRTRDVASIIMKDPAVQSLTSFVGVDGTNAALNSARLQINLKPLDQRDDRIPAVQQRLQQAIDRLPGVSLWLQPVQDLTIDTQASRTPYQFTLQSGSLESLGSWVPKLLAQLNTLPQLRNVSSDWQDQGLEAFVRVDRDSASRLGISMADIDNALYNAFGQRLISTIYTQANQYRVVLEQDNTQTPGLASLDAIRLNSSDGGSVPLSAIAQVEERHAALSINHLDQFPSATFSFDVAHGYSLGDALQAITTAEDQVGMPAEMMTQFQGSTLAFEAALTSTIWLIVAAVVAMYIVLGVLYESFIHPITILSTLPTAGVGALLALMLSGNELDIIAIIGIILLIGIVKKNAIMMIDFALAAEREQGMAP

SEQ ID NO: 92791 - protein, 216 aa, Glycine max
  Coding DNA Sequence Number=SeqID_1106
  Gene Ontology: Mol. function=oxidoreductase activity; Cellular component=integral to membrane; Biological process=potassium ion transport
  Homolog annotation: Hit_ID=Q6D2B4; Match level="QueryCoverage=90%, HitCoverage=61%, E-value=1e-79, Identity=77%"; Hit description =Probable oxidoreductase
  Pfam annotation: Domain name=Aldo_ket_red; Domain location=22-214; Score=3.0; E_value=1.4e-08; Accession=PF00248.12; Description =Aldoketo reductase family
MTDQSRFTKEDHMRQHKTRQLGDSGISVPLLTFGGNVFGWTVDEKTSFSLLDALVEKGLFFIDTADVYSRWAPGNAGGESETIIGKWLKKSGKRDSIVLATKVGMELTPEKTGLKPAYIRQAVEDSLRRLQTDVIDLYQAHRDDDSTPLVETLKAFDSLIKEGKVRAIGASNYSAQRLQEALDISKQEGLARYETLQPEYNLYDRQEYESGLEQWR

SEQ ID NO: 92792 - protein, 18 aa, Glycine max
  Coding DNA Sequence Number=SeqID_1107
MGAKHLTRTKERSHVIKK

SEQ ID NO: 92793 - protein, 131 aa, Glycine max
  Coding DNA Sequence Number=SeqID_1108
  Subcellular localization annotation: CTP_CleavageSite=54; ConfidenceScore=5.08e-01
MAEQARQVFMCKTLVMKGGAWFYRAKQLVLKIMASPPASPPPPPPPSDTLASPSAVKRTCKATCLRSLSTRPPGAERLVVHIDPATGKADGPHRKKLRTYLGVVARDKVDVTYENWKEVPTAQKDLIWEDI

SEQ ID NO: 92794 - protein, 307 aa, Glycine max
  Coding DNA Sequence Number=SeqID_1109
  Homolog annotation: Hit_ID=A1G290; Match level="QueryCoverage=44%, HitCoverage=31%, E-value=3e-53, Identity=75%"; Hit description =Putative uncharacterized protein precursor
AAGGRSAAAVAAGVEPGRAGAVVEPGAAGALAVQRAGAAGTGEDPAAAVGIGHLRCADQPGAARRASVGRPVVEFVDDAFQPGADQPDRAVERARRDRLGLGFAPRPARVVDAPGQPAGHCIVHRLRPAVHGRGLSGTGTAERGADRGGKTMKTWSRALLPAMFGMLAAVTAQAADYRTQYAEQWPLTLSSAQSGAYRVVLEPAIYRRAGCADLGDVQVFNAAGQSLPSALLAPDQPLAQPPVQRELPWFALPPLAEAQRNDLQLLTERDTDGRVRRVEARVSGGWLADQRQCAVPAAAGGPGTGLD

SEQ ID NO: 92795 - protein, 24 aa, Glycine max
  Coding DNA Sequence Number=SeqID_1110
REEGETGVTYFKSFWVGTIVIEIN

SEQ ID NO: 92796 - protein, 120 aa, Glycine max
  Coding DNA Sequence Number=SeqID_1111
  Subcellular localization annotation: CTP_CleavageSite=34; ConfidenceScore=5.17e-01
MVKVGTSYVPINVSFSPKVGPGLPDQAYRYRRPRGGARYQLLFPLVRVNFEKLGVIMVIAVSFGKPVVLQGCINERSNARGEGRIELHRGGRRKKWPPGSQEFDTGDIPFLALIGYARVR

SEQ ID NO: 92797 - protein, 153 aa, Glycine max
  Coding DNA Sequence Number=SeqID_1112
  Homolog annotation: Hit_ID=Q6WAY6; Match level="QueryCoverage=55%, HitCoverage=15%, E-value=6e-07, Identity=34%"; Hit description =Putative uncharacterized protein
MGPIHRHPHAFDLQRSPLSKCGWVGGPSGCISYNPVLAIRQLGYPMRGAPLKEELAPIIAPGFNNTNAKALQKVRKAWEMVQKKDKELRGNSNGPIGGYRRWLKAHMQGLDWLPSLRTTKGVEVEAPEEDEEVQALRAELEKAQTVKEKFKSE

SEQ ID NO: 92798 - protein, 15 aa, Glycine max
  Coding DNA Sequence Number=SeqID_1113
GECCEISPDARNGLG

SEQ ID NO: 92799 - protein, 139 aa, Glycine max
  Coding DNA Sequence Number=SeqID_1114
  Homolog annotation: Hit_ID=Q3ECZ9; Match level="QueryCoverage=73%, HitCoverage=27%, E-value=5e-07, Identity=33%"; Hit description =Uncharacterized protein At1g40087.1
MVAHIPNPRVDPSQFCDLVHYWCSEKGQTTKAKGVQPSREEIYIDTRTQKDGSIVTEKAATDELKKKMVEAESSQNLQSIQDSINWTNDTYSKVKGPEKRGHVRCLGKLPHQASSSQSSCANNRIQKLENLLGNLVVVL

SEQ ID NO: 92800 - protein, 83 aa, Glycine max
  Coding DNA Sequence Number=SeqID_1115
PLGPSRIFLQKAVASGGSNLARLGELGGNHLPYFAINRGGSEKEKAEALPKRFRNVFREEFRKGFDRSSTFFIRSSSFFDLQR

SEQ ID NO: 92801 - protein, 88 aa, Glycine max
  Coding DNA Sequence Number=SeqID_1116
MSKFDPDIVLEFYANAWPTQEGVRDMRSWPVPGISFSARGGPRVRVWPEEEPGRWVDEEAIAQLLCIPGAGFCPDCCWETRCRSCAPT

SEQ ID NO: 92802 - protein, 70 aa, Glycine max
  Coding DNA Sequence Number=SeqID_1117
MGCKSDGLPPSHTLHSACTQLFALVIIAFFGQWRPQPAYGRLSRCRKFFSTPNAYIINAILITGAKVMAV

SEQ ID NO: 92803 - protein, 165 aa, Glycine max
  Coding DNA Sequence Number=SeqID_1118
VPPVQLLTGWCVTAKAPPDISAGKCSGHAARRVPFAIQAAQLLRRAIGAGLFAITPAGERGMCCKAIKLGNARVFPVTTLANWSSTAVAAALELVDPPGSRNSMFHDCLSADPQGNPPFSPLFRSSMNCVYVHVYSTFELGAVFHDCLSADPQGNPPFSPFFGAP

SEQ ID NO: 92804 - protein, 224 aa, Glycine max
  Coding DNA Sequence Number=SeqID_1119
KVAGGQEGPLGDLGSQQEMRREYSNPGNWGLAKVQGGSKFDQADPCPGIILQVIKPTRTTKEEEEKKAYDEHLFESINHPLHHPYTDSLVPLIIILCVLSGLESGYTLHMMDLAGGQPAANPTAEQPSNVPSGASTSGWRSFEEGVLLESSNESSEASVNQQPVIPELEPPLLDDNTRRAELAVRLRANWWGIAYNERILDSFVRSQLAIERHIEAALVADGYS

SEQ ID NO: 92805 - protein, 131 aa, Glycine max
  Coding DNA Sequence Number=SeqID_1120
MPISPYSSIGWSVPSRHRDHAHKTPSGPGEVQQGPGVSSFGYGPLSVLQGAHPPQQGIAPTRHPVDPKKSNGVLGFPALIMGLCQFYGVPVAPSKIIRPPINRTFIEKYCAPGRHMARHHSSGQQAHRHYL

SEQ ID NO: 92806 - protein, 147 aa, Glycine max
  Coding DNA Sequence Number=SeqID_1121
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
  Subcellular localization annotation: CTP_CleavageSite=41; ConfidenceScore=5.36e-01
MVPFPRLHFFMVGFAPLTSRGSQSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 92807 - protein, 368 aa, Glycine max
  Coding DNA Sequence Number=SeqID_1122
  Gene Ontology: Mol. function=metal ion binding
  Homolog annotation: Hit_ID=A7P1V4; Match level="QueryCoverage=55%, HitCoverage=40%, E-value=7e-45, Identity=47%"; Hit description =Chromosome chr19 scaffold_4, whole genome shotgun sequence
  Pfam annotation: Domain name=PHD; Domain location=315-359; Score= -7.5; E_value=0.099; Accession=PF00628.20; Description=PHD-finger
  Pfam annotation: Domain name=zf-C3HC4; Domain location=316-356; Score= 42.4; E_value=1.7e-09; Accession=PF00097.16; Description=Zinc finger, C3HC4 type (RING finger)
  Pfam module annotation: Pfam domain module=PHD::zf-C3HC4; Domain location=315-359::316-356
MDQMSQQVYFHSESIHFSGTNICLASGNGISLDCHYVLDAHDSYLDQHFQPYVQGHALAWHLSLPVPYVQAFIANGSSSENGRIGPQRYHDTTSSRGGHRFPQRYHDTTGSRSGHRFPQRYHDTTGSRSGHRFPQRYHDSTGSRSGHRFPHPPPQYHSFHHQVLPAQVIRGHSFNIHPPVTAPSYRVPTNPSHGSSILIHDAFEMGARHPGFAPFAGARIRQSHRGNLQEMITLINLPPAVFFPDDDVALLVDHHTDMHLDTEDMSYEASEQIGNAKSGLSEKIITSQMKTKTYILPTNATNLEEADSEEQETDLCIICQDEYKNKENIGILRCGHEYHADCLRRWLLEKNVCPLCKSVALTPPGEKQ

SEQ ID NO: 92808 - protein, 54 aa, Glycine max
  Coding DNA Sequence Number=SeqID_1123
  Subcellular localization annotation: CTP_CleavageSite=24; ConfidenceScore=5.10e-01
MDSGRFQVSVPGNSYPQWFLGQVVPFYLSKSGTLNLGGVMILGTRNNSSRLAKA

SEQ ID NO: 92809 - protein, 106 aa, Glycine max
  Coding DNA Sequence Number=SeqID_1124
MTTTRVKKECNELRYVNMVVAEVLERETKRARNKFRGALWGSNSELRLRRAGRDIKGGKYDIRGQVEGLSKVRSHFEWESRASKAVSQSQGYGGRILLSRGSSWAF

SEQ ID NO: 92810 - protein, 93 aa, Glycine max
  Coding DNA Sequence Number=SeqID_1125
MMRCTCEDTLMLKLEMQRHTDTQVSDTEVRRCHPILLPGSLHGLTSQWLEICAKRLMIEAQSILKNSSNYNLDPNSGSARNSTGTSPTKSIDT

SEQ ID NO: 92811 - protein, 143 aa, Glycine max
  Coding DNA Sequence Number=SeqID_1126
  Gene Ontology: Mol. function=phospholipid binding
  Homolog annotation: Hit_ID=A7R0I0; Match level="QueryCoverage=27%, HitCoverage=11%, E-value=3e-09, Identity=67%"; Hit description =Chromosome undetermined scaffold_309, whole genome shotgun sequence
MTSFRKPNRLNCFNVLGIKLNNFFATYLSIMEASGQSITEQGGATLQMHHTLPSARHEPRFLHAPHMQASSHAPLLWRQLTRHHLGYCIGPNGPPSGDQQHRRALKCMIALHHIIYHNNFILQDQLSVYPYVGGKNYLNLSNF

SEQ ID NO: 92812 - protein, 134 aa, Glycine max
  Coding DNA Sequence Number=SeqID_1127
  Subcellular localization annotation: CTP_CleavageSite=29; ConfidenceScore=5.06e-01
MSPPPLGPHNRLQTHLKLSGQLPLPALVSADLHTTNSLKLSGTWTFLSLELSNYAESSRKGQTPLQNLISILNRWLSRLFSLSGWTEVMRLVGWPFAQRTSTTHPSSRFFLALSRGLLRSADSSLSQQIGLVRG

SEQ ID NO: 92813 - protein, 150 aa, Glycine max
  Coding DNA Sequence Number=SeqID_1128
QAQGETPQQPGDGRQRATDAPPSPLEFTSAHPQKGLSIAYTTWPTNRRPSPKPKGENVNPYPRKQKRREGKFPIKEKDKESFQSKEKRKQGNSQSKRGRKKKRKERKFPTKEWEKVKKEKKKAPGQRNQKKCAERSLDRTISEQYRIVTK

SEQ ID NO: 92814 - protein, 188 aa, Glycine max
  Coding DNA Sequence Number=SeqID_1129
MLAIIAKYQEELGLAAAHEHRIADEYAQVYAEKEARGRVIDSLHQEATMWMDRFALTLNGSQELPRLLAKAKAMADTYSAPEEIHGLLGYCQHMIDLMAHGKNTITKRAARDPYRTRSKSRTMGDQEETQEQMKADMSALKEQMASMMEAMLGMKQLMEKNAATAAAVSSLPKQTRLSWQLRTILPQT

SEQ ID NO: 92815 - protein, 82 aa, Glycine max
  Coding DNA Sequence Number=SeqID_1130
MTKGADNRKVSPRIIGPARLWMTQGCRMTKLGLCLSSGPPPLDDKRATSSWVMVTESSVVDKSEAFAPTYPPMRNSDLRSSG

SEQ ID NO: 92816 - protein, 143 aa, Glycine max
  Coding DNA Sequence Number=SeqID_1131
  Subcellular localization annotation: CTP_CleavageSite=78; ConfidenceScore=5.11e-01
MTLLFSNILPGRPQCQSPPADVSGLRPQDAQWARRSPTGPWGFQLWLWASVSPTGCLFPQRRSCHRDIGPWGFQLWLRASVVLQGARSPRQGHVIIGIAPAGHPVDPKKSNRVLELSSSSYGAKHHSSLGMAGSGQQTHRHHL

SEQ ID NO: 92817 - protein, 27 aa, Glycine max
  Coding DNA Sequence Number=SeqID_1132
SKCFRNASVSDSVEILHRSSPFFVLRR

SEQ ID NO: 92818 - protein, 117 aa, Glycine max
  Coding DNA Sequence Number=SeqID_1133
MKFPTHLANFEPCLGYATEGQAVGGIPLQNPLEGPQYHPQLHLLHSTTSKNPHAMAEMGKLDHLEERLRAIEGGEDYAFANLEELFLVPNIITPPKFKVLDFDKYKLTFPKRTHRVS

SEQ ID NO: 92819 - protein, 239 aa, Glycine max
  Coding DNA Sequence Number=SeqID_1134
  Subcellular localization annotation: CTP_CleavageSite=53; ConfidenceScore=5.00e-01
ILSFSHCGSSAKSFFSSLFPDKLLLRELLRQPLDPFASRSLPEDPLGVLPEVPEERFPESFRKKCSSGSNQTSSGRTLLPEDFRKTSSGNFPEEVVHPEEFRKTRTSGRSFKLPEDLSGRTLLPECFRKNHFFRKDRAAGEDAGDVPERRRPTASARRLRVHQMTTEGRDMAEDVADMTDDLPEQPTEAPEMRADAQGADSGEGSDGDDAAEGFPGGPRDPSVLTSFAEHVAHAVWSGQ

SEQ ID NO: 92820 - protein, 122 aa, Glycine max
  Coding DNA Sequence Number=SeqID_1135
MGTSKPYTRAMRGIVHEPQVNIGADQKFSPFDDPWVHALAFKGLDALTFRGLHTLTFRGLYVLLLRGLHVLTIIGLNGLTFRGLHVLTFRGFHALAFKGRHVLNFRGLHALAFRGLHTLAFK

SEQ ID NO: 92821 - protein, 159 aa, Glycine max
  Coding DNA Sequence Number=SeqID_1136
MLEDEQAKVSALQIEREVRERVIELLHGEAMKWMDRFALTLNESQELPRLLARAKAVADTYSAPDEVHDLFDYYQHMARIMNGIEEVHEQMKADMEAMKDKMITMMEAMMSMRKMMEVNAAAVATTTVTTEVDLTHPSGLNQVSCSVPDMVGQGGEALG

SEQ ID NO: 92822 - protein, 190 aa, Glycine max
  Coding DNA Sequence Number=SeqID_1137
MTCGEPFGPAPFFTFCHPEAASPMTCGEPFGLALFFTVCHLEAAGPMTCGGPDDMRGIIWSRTFFTFCHPEAEGPMTCEEPFGPALFFTFCHLEAAGPMTCGEPYDSTPDSTQRLTSSSAPFVIQGQRVRWWAEIPCGHPRLSSIEGNELGSIRMMFFTLVVRKHSSLATHGILLCWAETIGCNGKGKCH

SEQ ID NO: 92823 - protein, 87 aa, Glycine max
  Coding DNA Sequence Number=SeqID_1138
MCKIRMLRIRMLKIIMLKIRMFKITNNGMHRFTSYGMLRMIKRIAFFGRWRPQPAYGGLPRRRKFLSTPNAYIIIAILITGAKVMAV

SEQ ID NO: 92824 - protein, 43 aa, Glycine max
  Coding DNA Sequence Number=SeqID_1139
ESSIGNSDLSKQHIPLPFPPRAIPNKKMEEAEKEILETLRKVE

SEQ ID NO: 92825 - protein, 189 aa, Glycine max
  Coding DNA Sequence Number=SeqID_1140
MENNAVAIATTSTTAEADPTHPFAINQANQAIPNMVGQGGEVLGSMGSSHMGQNNNAFPYGLPPNYTPPNTMHMPNENANHVVPVPFEGQQPQASGHALGDFEPYPMFSTEGLTCSGMPQPNAMGVPQHRPLQPLHFSVGRLPLAVEGREKLDLIEERLRDIEGISDYPFVDMAELCLVPDVVIPPKFK

SEQ ID NO: 92826 - protein, 531 aa, Glycine max
  Coding DNA Sequence Number=SeqID_1141
  Gene Ontology: Mol. function=transferase activity; Biological process= small GTPase mediated signal transduction
  Homolog annotation: Hit_ID=A8G7V9; Match level="QueryCoverage=37%, HitCoverage=100%, E-value=4e-84, Identity=79%"; Hit description =Glutathione S-transferase domain
  Pfam annotation: Domain name=GST_C; Domain location=430-523; Score =40.5; E_value=6e-09; Accession=PF00043.16; Description=Glutathione S- transferase, C-terminal domain
  Pfam annotation: Domain name=GST_N; Domain location=329-402; Score =22.5; E_value=0.0015; Accession=PF02798.11; Description=Glutathione S-transferase, N-terminal domain
  Pfam module annotation: Pfam domain module=GST_C::GST_N; Domain location=430-523::329-402
MARGAGEVQQLRADPRSQLLVAGQRAGGGEGGKLRRLRHLPEDPVSGKRPAGRSGGRRSGFAGAGRPHGRRRLRPQQHQSVPVPGGVTARPRSRGAGPAISARASGIRPDELLRLGHNAPSERNHDVKHPGKTDRGRRAGGRTGGLRQQRRHQTGGAATGHQADRDAARATAAACAGRNPARAAGAERRSNAEQRHHQRQHLHHSALSRRQVAPERGLFRSDPAGRHEAQHQRQNAERAGAERHHGAGRALSEYPDHQRRELQRRQTEVSPGGYRADRQRAKGGLHAGVDGVQQAGGDAANAVAGQNAGSASGAGAADYRYPGGRSGGDRMKLIGSYTSPFVRKISVMLLEKGIAFEFVNDPPYEPGSRVKELNPLGKVPVLIADDGEVFYDSPVVAEYLELLTVEPAFLPADRAAALRVRQVAALADGVTEAAATLFRESRRAPEKQDENWMLRQRDKLTHGLDALEALARDKTWLNAERLTLADIATGCALGYLNFRRILPNWCVGRPALVKLAERLFARESFARTAPP

SEQ ID NO: 92827 - protein, 104 aa, Glycine max
  Coding DNA Sequence Number=SeqID_1142
FFLNPGEEQLDKRIRASLLRTLTYLTAINHELAGRTAFEAGIAKATVQQAMLSAMPRSGDQQSIIERRQQSSGGVALLVDLPSASRLIQREGKETDATTNTRYR

SEQ ID NO: 92828 - protein, 275 aa, Glycine max
  Coding DNA Sequence Number=SeqID_1143
  Gene Ontology: Mol. function=helicase activity; Biological process =viral genome replication
  Homolog annotation: Hit_ID=Q9LX60; Match level="QueryCoverage=94%, HitCoverage=15%, E-value=3e-65, Identity=46%"; Hit description =Putative uncharacterized protein F4M19_60
MYTIEFQKRGLPHVHLLFFLHPDNKYPSSDEIDQIISAEIPSQQDDPELYSLVKNHMVHGPCGTLNPGSPCMKEGKCSRFYPKMFQPHTVLDVDGFPIYRRRNNGHSIEKNGVIIDNRDIVPYHPRLLRKYQAHINIEWCNQSTSIKYLFKYINKGYDRVTTVLIHEDNDQTQNGGIHNDEIKEYLDCRYICPRESTRRIFGFPIHGRKSAVERLHFHLPGQHIVLYEDHDDIDDVLSKPSISDSKRKDVGTLGRKATPLADYYGSHQLQGNYFI

SEQ ID NO: 92829 - protein, 60 aa, Glycine max
  Coding DNA Sequence Number=SeqID_1144
MEWYHDLRCLKFLPTDHAFRRNKNVEAMSSKVILMMPKNQELRIKNQVSRIKIQDSRIKF

SEQ ID NO: 92830 - protein, 92 aa, Glycine max
  Coding DNA Sequence Number=SeqID_1145
MKGTGFGSILGRIDSLLNGNPSLALEGMDLFTSWRGSIIMPIGWTSQESGANIEEEEPTDLRSNPLQGGGDDAIHPRKGPVTRAMSKRLQED

SEQ ID NO: 92831 - protein, 168 aa, Glycine max
  Coding DNA Sequence Number=SeqID_1146
MTSRFNGIDRPLASLYDLKLGKFHLVTYQSVTIHCHPSMGRMIDPKALCFLVVQNNQRGVLHPWAHQESSGGSNSLLGQACCFKLKPPAHLGVLGGKLLLHFSYKMALGAEGKGFNTFGNHISFKISEERKKEGEKSRSRHFRNASVIKSVNVLRRSSFVLRCSSIFD

SEQ ID NO: 92832 - protein, 262 aa, Glycine max
  Coding DNA Sequence Number=SeqID_1147
MAESSKKQKGMSSTTIVAGHRCHRPSEAPIALVPPSFQGVPFEGTVVDDWKFDYSSHDARRIVCNDQADMTGRLLAGSLTFDCCIMHYIIVHILLPCSSNLAQASEEDLILMYQMHTALRANAPLPYPQLVTLFLHHFQIPLDIEPFVQVKRSFAISAGVVTSFGYRKDIDGKWIKKQDLPPLIPNERTPSPPSQRDASSTLMHVVLSKLCGLRAFVGDRFDAMDSRLDAMDAHFEGRDTQINQLKDDISFIRRCFDPSTAP

SEQ ID NO: 92833 - protein, 135 aa, Glycine max
  Coding DNA Sequence Number=SeqID_1148
MAEPSKKRKGTSSRNQRHSESQETPIPSSIPSGSLFSSEEQRIQYTNLFSSRSIIDPKFIYMDFFSNESFECFQAFENSNLIPFMSLKLPIYSDLVKAFYSNIEIQEGTLMFKVYGIKMVIDQSLFYDLTKLPSE

SEQ ID NO: 92834 - protein, 55 aa, Glycine max
  Coding DNA Sequence Number=SeqID_1149
MGSSSKQPFSYKPNPYSATNYLTSKSFPVIISVSLADEQEEKLLSVLKKHKKAIA

SEQ ID NO: 92835 - protein, 78 aa, Glycine max
  Coding DNA Sequence Number=SeqID_1150
MLIVLSDNDEKKNKEGLQKENKKNDEVVNSEKVKEKVINIPFSETLEQMSTYAKFMKDFLMKKKRIMNDEIVKPQPQQ

SEQ ID NO: 92836 - protein, 99 aa, Glycine max
  Coding DNA Sequence Number=SeqID_1151
  Homolog annotation: Hit_ID=Q2AA09; Match level="QueryCoverage=66%, HitCoverage=24%, E-value=2e-07, Identity=43%"; Hit description =Retrotransposon gag protein
  Pfam annotation: Domain name=Retrotrans_gag; Domain location=33-99; Score=4.6; E_value=0.019; Accession=PF03732.8; Description =Retrotransposon gag protein
MAEEPRRVTLEDYSSSTVPQFFTSTARNAIRLSLFSFSLAGEAKRWLHSFKGNNMKLWDEVVENLLKKYFPKLKTAEGKVAISSFHQLPDESLSEHLKI

SEQ ID NO: 92837 - protein, 163 aa, Glycine max
  Coding DNA Sequence Number=SeqID_1152
  Subcellular localization annotation: CTP_CleavageSite=70; ConfidenceScore=5.14e-01
MESRKRARTEDIPSSSTPAPPSVTVGQDVQSSQTLVPMLQSLFRGQFIIMRNLQEFAHNRPIITMEHFLEQATPTKPSPTQVDPEPADPQSLVVNPLSSPEREVVPPSPPLIIISDASSDEAAAPLDSPAGETTDLPTSPVGGISDLSDLSSGEAVALTDSPF

SEQ ID NO: 92838 - protein, 95 aa, Glycine max
  Coding DNA Sequence Number=SeqID_1153
MAMRGDFHDQINKFSQLRNIQCYYCSENDHVQVRYKQMKEDLKKLRDMNKDSANSQANVVKSVGDEDDVFLAINDDVAKTKWVMNSVVSKHICKD

SEQ ID NO: 92839 - protein, 407 aa, Glycine max
  Coding DNA Sequence Number=SeqID_1154
  Gene Ontology: Mol. function=nucleoside-triphosphatase activity; Cellular component=chloroplast
  Homolog annotation: Hit_ID=Q2PMM5; Match level="QueryCoverage=98%, HitCoverage=17%, E-value=0.0, Identity=95%"; Hit description=Protein ycf2
MSRENWIWLDNVWLVNKDRFFSKVRNVSSNIQYDSTRSSFIQVTGSSQLKGSSDQSKDYFDSIRNEDSKYHTLINQREIQQLKERSILCWDPSFLQTERTEIESERFPKILSGYSSMCRLFMEREKQMNNHLLPQEIEEFLGNPARATRSFFSDRWSELHLSSNPTERSTRDQKLLKKEQKKHLVLSRRSENKEIVNLFKIIMYLQNTVSIHPISSYPGCDMVPKGELDSSNKISFLNKNPFWGLFHLFHDRNSGRYTLHHDFESEEIFQEMADLFTLSITEPDLVYHKRFAFSIDSSGLGQKHFLNELFNSRDESKNHSLLVLPPLFYEENESFYRRIIKKWVQTSCGNNLEDPKPKLVVFTSNNIMEAVNQYRLIRNLIQIQYSPHGYIRNVLNRFNTTSNMEFK

SEQ ID NO: 92840 - protein, 148 aa, Glycine max
  Coding DNA Sequence Number=SeqID_1155
MAPRKLASKRSRKDKAAEGTSSAPEYDSHRFRSVVHQQRFEAIKGWSFLRERRVQLRDDEYTDFQEEIGRRRWAPLVTPMAKFDPGIVLEFYANAWPTEEGVRDMRSWVRGFCPDCCREASANHAHQYDHPDPDMDDVAPQQHPAHRS

SEQ ID NO: 92841 - protein, 46 aa, Glycine max
  Coding DNA Sequence Number=SeqID_1156
MELGRLIKRLSDSGIDDAEEEEEAAEEEEDAAEDTESDDDDSEATP

SEQ ID NO: 92842 - protein, 138 aa, Glycine max
  Coding DNA Sequence Number=SeqID_1157
MARISRYILCGTSRGYIYLGCNTENKRGYISCGSVQVEGTSTWLFKENKGGYIPCGSLLVKDFTRRSTAVDLIPIDLEINATYRRRNSERIKFFWQDLEAAATPEEEPQSSEASSSFPIAGNSHIKSVEDTIMDEEPR

SEQ ID NO: 92843 - protein, 67 aa, Glycine max
  Coding DNA Sequence Number=SeqID_1158
MEGGIGPILDPTPKEEKRIEDNVEAYPDWEMKGKVPLATLSFQGYALYWWTPLVREKRIHRDPPVEH

SEQ ID NO: 92844 - protein, 86 aa, Glycine max
  Coding DNA Sequence Number=SeqID_1159
LFGAFGRTEISVYVGLTMFTESQSQSQDYFGECGYYVMHWMSTIILGTFRNNWEAYFNDPRPLEPERLKALRIQWAQFYLRVRDQA

SEQ ID NO: 92845 - protein, 169 aa, Glycine max
  Coding DNA Sequence Number=SeqID_1160
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
MKHFTDTLISANIGTKAGTGPPLEVDGIDKLDDSLNSEIGHCNGTPWFTSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 92846 - protein, 199 aa, Glycine max
  Coding DNA Sequence Number=SeqID_1161
  Gene Ontology: Biological process=transposition, DNA-mediated
  Homolog annotation: Hit_ID=Q6UUU1; Match level="QueryCoverage=30%, HitCoverage=40%, E-value=2e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLARTGSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 92847 - protein, 186 aa, Glycine max
  Coding DNA Sequence Number=SeqID_1162
  Homolog annotation: Hit_ID=A5BRA1; Match level="QueryCoverage=96%, HitCoverage=24%, E-value=6e-16, Identity=32%"; Hit description =Putative uncharacterized protein
MATLFKTKDVNEEITPKDIRSLMEQTNYTDKYLQVLGESISKEKVFTKPKDHGLPSLAVQMEKPLFKPFKEIGDNNSELLRKINSLLKTVPETPQSSEESSKIRTRHTSELINAINKDTDNNSEQVSEEGSVSEKVINPINTKHWKTPSKLYYQRPTAPDLLLEERGESNFKSFSANNIYEWNTTS

SEQ ID NO: 92848 - protein, 94 aa, Glycine max
  Coding DNA Sequence Number=SeqID_1163
DPPGCRNSMSFLHPAAADCAAPREAIHSNLSLPSKIRLVLPPLAYLSRKLEQSPISKAKPRGSHSNENQRQSGTGFHPPFLFSSKQSAQSRTYK

SEQ ID NO: 92849 - protein, 121 aa, Glycine max
  Coding DNA Sequence Number=SeqID_1164
MPADVGQEKMTDRGLKKKHDRMTPIEHFQIDIVQPTLRNFFHKRWPIIFLYGKGSARFFRANSTKVVFRPTPACSRLFCQEHINPPRANNHYSPILIEKNNSRCRPGKMTDRGLKIKSLTR

SEQ ID NO: 92850 - protein, 18 aa, Glycine max
  Coding DNA Sequence Number=SeqID_1165
MVKDGIRWRVGNGKRIRV

SEQ ID NO: 92851 - protein, 39 aa, Glycine max
  Coding DNA Sequence Number=SeqID_1166
MQGIKWLPKLKSLSGKEAEIPEESEEVQALKAELEWDPL

SEQ ID NO: 92852 - protein, 86 aa, Glycine max
  Coding DNA Sequence Number=SeqID_1167
MKDSGIRMLCMENKWVYDPNMVDSWYLTHATNNRKTQGSCMSKHENKRGIIPFEKHIAAVGTTNNNMLSKRKTLDEGSLLSSKLET

SEQ ID NO: 92853 - protein, 47 aa, Glycine max
  Coding DNA Sequence Number=SeqID_1168
MSVKNLVGRPRVHDKTDHTLLKGALKSGVFTPRPRLRRVRQGLSLLI

SEQ ID NO: 92854 - protein, 118 aa, Glycine max
  Coding DNA Sequence Number=SeqID_1169
MGINQTGKRFYQVKIKGLDITSLKELGRLMGPLQMQAFRKAYGKILDLTIAEGFDKRVGSCKANSKRRSGPIAEVLGRQGKRYGESRGVGPVCGRISFANLWGCPLSKRGRFGGLSRD

SEQ ID NO: 92855 - protein, 186 aa, Glycine max
  Coding DNA Sequence Number=SeqID_1170
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=27%, HitCoverage=50%, E-value=8e-24, Identity=100%"; Hit description=LacZ protein
QNNVYTDNHSGISARQRDSNVSMTDLVSAEDDIAKECFESADYHLGISAYHMTPVAKKSLTHRIPAARGIPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 92856 - protein, 247 aa, Glycine max
  Coding DNA Sequence Number=SeqID_1171
  Gene Ontology: Mol. function=receptor activity; Cellular component =integral to membrane; Biological process=protein amino acid phosphorylation
  Homolog annotation: Hit_ID=A7QTQ4; Match level="QueryCoverage=91%, HitCoverage=23%, E-value=1e-23, Identity=37%"; Hit description =Chromosome undetermined scaffold_171, whole genome shotgun sequence
  Pfam annotation: Domain name=LRR_1; Domain location=122-145; Score =12.6; E_value=1.4; Accession=PF00560.24; Description=Leucine Rich Repeat
  Pfam annotation: Domain name=LRR_1; Domain location=148-170; Score =11.9; E_value=1.9; Accession=PF00560.24; Description=Leucine Rich Repeat
  Pfam annotation: Domain name=LRR_1; Domain location=172-194; Score =10.2; E_value=3.9; Accession=PF00560.24; Description=Leucine Rich Repeat
  Pfam annotation: Domain name=LRR_1; Domain location=202-223; Score =18.9; E_value=0.02; Accession=PF00560.24; Description=Leucine Rich Repeat
  Pfam annotation: Domain name=LRR_1; Domain location=67-89; Score=8.5; E_value=8; Accession=PF00560.24; Description=Leucine Rich Repeat
  Pfam annotation: Domain name=LRR_1; Domain location=96-119; Score =6.1; E_value=23; Accession=PF00560.24; Description=Leucine Rich Repeat
  Pfam module annotation: Pfam domain module=LRR_1::LRR_1::LRR_1::LRR _1::LRR_1::LRR_1; Domain location=122-145::148-170::172-194::202 -223::67-89::96-119
NIPSQIGKLSNLQKLYLGRYSDGGALKIDDGDHWPSNLISLTHLSLLSISNLNTSHSFLQMIAKLPNLRELSLYDCSLSDHFILSLKPSKFNFSTSLSIFDLSWNSFTSSMILQWLSNVTSNLVELDLSHNLLEGSTSSNHFGMVFNSLEHLDLSFNNFKGEVFKSFINVCTLHSLYMKNNNLSEDLPSILHNFSSGCVRHSLQELDLAYNQITGSLPDLSVFSSVDKRIKVNKGKLILIESEKGKL

SEQ ID NO: 92857 - protein, 81 aa, Glycine max
  Coding DNA Sequence Number=SeqID_1172
MNHTLKQSQARMVYYVDDVVNEGWSVVVHIKPRDLYDMGEEVEENAYENEPYQEQQLEQFSRLDDQYVQLATNHLNDDIVD

SEQ ID NO: 92858 - protein, 102 aa, Glycine max
  Coding DNA Sequence Number=SeqID_1173
MSSNSNSGISNEFPNVRETEKGLKPPFYTASCDAYFSLHRHVFSNSNGGGFCGKGKGYDTKGISISSDMISKFPTVGDLREKENFERRKEKNENEAKRRHLT

SEQ ID NO: 92859 - protein, 86 aa, Glycine max
  Coding DNA Sequence Number=SeqID_1174
MIDFRVCRNVPFAGERGRGSRVHFPKKERCTESPPTFICGKRRENRRKPVKMKILSSGVVFLLEEGRQKRGFCSYVPSFGEEIRPT

SEQ ID NO: 92860 - protein, 81 aa, Glycine max
  Coding DNA Sequence Number=SeqID_1175
GQNRLRTRSEVETKLKAEANPEAKVMTDRLSSLPSSGQAKNAAARQSRDGLRPMLHPEAMGHATLPPFSCYSCLNMRPPSA

SEQ ID NO: 92861 - protein, 73 aa, Glycine max
  Coding DNA Sequence Number=SeqID_1176
  Gene Ontology: Mol. function=indole-3-acetic acid amido synthetase; Biological process=response to auxin stimulus
  Homolog annotation: Hit_ID=A7P139; Match level="QueryCoverage=63%, HitCoverage=7%, E-value=2e-17, Identity=80%"; Hit description =Chromosome chr19 scaffold_4, whole genome shotgun sequence
MVATDSLVLLVLSLDIGARMLPTSDFIILKYKAPRCVKFAPIVELLNSRVTSNYFSPKCPKWVPGHKQWIHQN

SEQ ID NO: 92862 - protein, 668 aa, Glycine max
  Coding DNA Sequence Number=SeqID_1177
  Gene Ontology: Mol. function=protein binding; Cellular component =nucleus; Biological process=regulation of transcription, DNA -dependent
  Homolog annotation: Hit_ID=Q00LP6; Match level="QueryCoverage=75%, HitCoverage=88%, E-value=1e-175, Identity=61%"; Hit description=GRAS2
  Pfam annotation: Domain name=GRAS; Domain location=168-480; Score =438.3; E_value=1e-128; Accession=PF03514.5; Description=GRAS family transcription factor
  Subcellular localization annotation: CTP_CleavageSite=59; ConfidenceScore=5.64e-01
MDSQQLFSFGGVTSAGLPYMSSFPTVPSLPNSLLRSLKYDTGNSPNSPFSTYFDSDTLSALSDGQEQYSPGEILSGVSSSLETNHYMYNRSISTLDSFPLYSDRNSLLQNASSNQKIQHALLELETALMAPDDDQVTTPNTLAERHRSWNNENHVSQHNTQAQPSYATGNRQSSEVVHVEKRQKLMEEEATLEAFPPNNLKQLLIACAKALSENNMNDFDQLVGRAKDAVSINGEPIQRLGAYMVEGLVARTQASGNSIYHALRCKEPEGDELLTYMQLLFEICPYLKFGYMAANGAIAEACRNEDRIHIIDFQIAQGTQWMTLLQALAARPGGAPHVRITGIDDPVSKYARGDGPEVVGKRLALMSEKFGIPVEFHGVPVFAPDVTREMLDIRPGEALAVNFPLQLHHTADESVHVSNPRDGLLRLVRSLSPKVTTLVEQESNTNTTPFFNRFIETLDYYLAIFESIDVTLPRDSKERINVEQHCLARDIVNIIACEGKERVKDGRLPAMSFEFLCEFCDKKPSEVLFRTLYTGGEGWSHVVRVEGQKFDISFSLALLKHRLCSSRNIMMMGEADHGLCFIASAISSHDENIGDATKPPQVQLRRSNRERQPSRRYSTNEYVILTDDGGLECFREAMESEEKKKCLDAMKFEACCEIVGLTITSTKL

SEQ ID NO: 92863 - protein, 213 aa, Glycine max
  Coding DNA Sequence Number=SeqID_1178
  Gene Ontology: Mol. function=structural constituent of ribosome; Cellular component=ribonucleoprotein complex; Biological process =translation
  Homolog annotation: Hit_ID=A5B7W2; Match level="QueryCoverage=82%, HitCoverage=81%, E-value=1e-62, Identity=69%"; Hit description =Putative uncharacterized protein
  Pfam annotation: Domain name=KOW; Domain location=73-104; Score=40.6; E_value=5.8e-09; Accession=PF00467.20; Description=KOW motif
  Subcellular localization annotation: CTP_CleavageSite=48; ConfidenceScore=5.37e-01
MAAMAALQSSMAGLSLSSKSFLGQLLPPITLPSLLPGKSTEKQCPIVMRLKRWERKECKPNSLPILHKMHVKLGDTVQVISGRERGKVGEITKIFKHNSTVIVKDLNLKTKHVKSREEGEPGQIIKNGVIRLTRWLKEEGRGEGCIEGPIHSSNVMLYSKDQKVASRVGHKVLDNGKKVRYLIKTGEIIDSSENWKKLKEATKKSEEAAAAAA

SEQ ID NO: 92864 - protein, 123 aa, Glycine max
  Coding DNA Sequence Number=SeqID_1179
MAPTRHPLDPDKSNRALGFPALITGLCQSFGVPVAPSKAANHRAHVQTHDCLYQLSLSLQSQGFTSFPCPTPDQFRAEVAWPGDWPEARAGEAPSEAPDEADEAREDEEMTDLLDFLGGSGAT

SEQ ID NO: 92865 - protein, 50 aa, Glycine max
  Coding DNA Sequence Number=SeqID_1180
MSLSGHSHIGLKEHSNPVTPKAYTLKSPSGPLPPDSGPTPKIILAHRHCS

SEQ ID NO: 92866 - protein, 94 aa, Glycine max
  Coding DNA Sequence Number=SeqID_1181
MEGAVTSLDIPGGGDRVVKEFYAFLEGDGLESLIIHGQCIDGVHVSYVFFMRKNTCTWGHVTWFGTPLRLRLITMGGVLHVHDRVTSTLTAQFS

SEQ ID NO: 92867 - protein, 102 aa, Glycine max
  Coding DNA Sequence Number=SeqID_1182
MSLPNNNRRAPVGGARKKEGDAYGVTTAPTWMKAPQNIQSSYQPNPPNFLIRAGNSLPTQVKGPPAAERVPAQRTAPAAPRPVNNTAPGATYKHAQPPPRKK

SEQ ID NO: 92868 - protein, 266 aa, Glycine max
  Coding DNA Sequence Number=SeqID_1183
DLSDPPSSKTSSYRQTVSRDTSFWLTLGHGDDIKPDKTERKDIIKTRKARHFDGPADICNYINNSLAAYFRDNPDKINGVISDMLYSLKRKTPPEGEVAWIKSDKRACFWLWTEIYCLNHDDTPREEVKGFIAHSHQERHREDQEIGQVIIPSATVQYAGECAADFGPASMAHDSVRRSTVSTGRQIVLLPPARSYTGLTTAGGEQPLLFPYHALRRGDKTYYNNTSAWAPLRIPYFPPPNGFQPFKQPRRHPFPARWHTTIPGSR

SEQ ID NO: 92869 - protein, 80 aa, Glycine max
  Coding DNA Sequence Number=SeqID_1184
  Subcellular localization annotation: CTP_CleavageSite=27; ConfidenceScore=5.20e-01
IAPTRCPVDPKKSNRALGFPALVTGLCQSYRVPVGPSKVISPLPIELSSRSTAAPDRRRAKHHSSLGMAGSRQQARRHHL

SEQ ID NO: 92870 - protein, 107 aa, Glycine max
  Coding DNA Sequence Number=SeqID_1185
MPLWGRIASLWLRAPESRPQDTQWTRRSPTGYWSCQALIMGLCQFYRVPVAPSKIIRPPTNRDFIKKYCVPRQAQGKTPQQPRDGRQRATDAPPSPLEFTSAHPQKG

SEQ ID NO: 92871 - protein, 52 aa, Glycine max
  Coding DNA Sequence Number=SeqID_1186
MRKLIKERMENKVANFVGLNKVVLGIKWMNGMGDDERKERITLSSEGNAQRL

SEQ ID NO: 92872 - protein, 217 aa, Glycine max
  Coding DNA Sequence Number=SeqID_1187
  Gene Ontology: Mol. function=binding
  Homolog annotation: Hit_ID=Q1RPM1; Match level="QueryCoverage=34%, HitCoverage=2%, E-value=4e-22, Identity=69%"; Hit description =Putative uncharacterized protein
MQTDLRLQKGAAAFFAHNDAKCFPALERLAHRITADAQFLRQLALRRQATARLRAGMRHVARERIKNQRIAARRNNGMEFSRVMHRFALIGCTVVWRYSAVAQGTIVVRDQANQQQDVAALSRDTEHANDSISPIFDKEKEQKRLQTAQLLGESGSQVADIARTQGQIEATEAGFGGWQSGAQAGMNAVENNSLSDIAQAQSEGKTLEQKAGEPKNF

SEQ ID NO: 92873 - protein, 297 aa, Glycine max
  Coding DNA Sequence Number=SeqID_1188
  Gene Ontology: Mol. function=motor activity; Cellular component=cell projection
  Homolog annotation: Hit_ID=UPI00016621D1; Match level="QueryCoverage =52%, HitCoverage=40%, E-value=7e-13, Identity=33%"; Hit description =UPI00016621D1 related cluster
LHVLAFTGLHVLAFRGLHILVIRRLHVLAIRGLHVLTFIGLHVLTYTRLHTLAFKGLHVLAFRGLHVLAFRGLHVLTFRGLHLLILRGLHLPTFRGLHALAIRGLHALAIRGQHALTFRGLHVLTFRGLHVLAFRGLPVHTFRGLHVIPFRGLHVLAFRGLHRTAHPRHQRNTHPRLQTTAHPRYQRTTRPRLQRATRARLQRTTRPHLQRTTRPRHQRVACRRLQRATRPHLHRTTRPRIQRTTSPRLHRTTHPRHQRTTHPRHPRATCPHLHLTIRPHLYRATRPRLQRTTRPQI

SEQ ID NO: 92874 - protein, 100 aa, Glycine max
  Coding DNA Sequence Number=SeqID_1189
MTLFLHATSYRIIDQTYDHGPIGFSRAFHSLSLEEISLSFASGERMRIPFLQAKVQKGPRLCFNGVFYRGNPILISRAKQIWVTRCRSRAELPHYSIRHA

SEQ ID NO: 92875 - protein, 209 aa, Glycine max
  Coding DNA Sequence Number=SeqID_1190
MASRKRKAPSTPTQARFDRSRFTSQEAWERYTDIVVSRKLLPERNVVVYYTEFDEFKEELERRHWDEELTDFVDDNINLCIPGRGFELNANGQPLKILRKNMTMLAQTWSILSFSNLIPTSHTSDVTLYRAKLIYGIVMKMDMNSLSPAINLAYIKKNCWNLDDPTVTFRGARKARGKRSEALSTLALEAPTPSSSTVPHAILPCKGIG

SEQ ID NO: 92876 - protein, 158 aa, Glycine max
  Coding DNA Sequence Number=SeqID_1191
MTNKRKVLGKNNEETRSYFTWNLEMERVLADVLRDQRNLGNKGDGGWKRSALNVAAAVLSTSFNVNVTSDNVKTISNYGDRGMVLATGHRAETAMDADEATSRETNEVEFMGLGATAIDLEEPSSNTKGKRQGSTSSGTHPHKRKKDGRKRRNSSFFG

SEQ ID NO: 92877 - protein, 93 aa, Glycine max
  Coding DNA Sequence Number=SeqID_1192
MVVRAFDGTRREVRGEIDLPIQIGPYTYQLSFGMSVDPLGGSRSLYTPPKTEIRSRGAFGYCVGGGRHLGKLPVLYAICGSRRGVIRNNLPIF

SEQ ID NO: 92878 - protein, 63 aa, Glycine max
  Coding DNA Sequence Number=SeqID_1193
MSKTVSNYGDCDMVLAIGHGAETTMDVDEAMSRETNEVEFMGLGATATIYLEEPSFNTEGKRQ

SEQ ID NO: 92879 - protein, 79 aa, Glycine max
  Coding DNA Sequence Number=SeqID_1194
MTSSSSSRPFHLLYWLKPDTVHHCLFLRWMPLHRQPDLDYIELCQQHRCSSHQLGPQSESLALDVCGGCCTATNCDLIF

SEQ ID NO: 92880 - protein, 175 aa, Glycine max
  Coding DNA Sequence Number=SeqID_1195
  Gene Ontology: Mol. function=lipid binding; Cellular component =anchored to membrane; Biological process=lipid transport
  Homolog annotation: Hit_ID=A7QR85; Match level="QueryCoverage=69%, HitCoverage=77%, E-value=2e-31, Identity=52%"; Hit description =Chromosome chr13 scaffold_149, whole genome shotgun sequence
  Pfam annotation: Domain name=Tryp_alpha_amyl; Domain location=34-109; Score=12.9; E_value=0.016; Accession=PF00234.13; Description=Protease inhibitorseed storageLTP f
MDSNACLPHLLVLAITLVLVSHAMGDSAKDKQKCAESLTGVATCLPYLGADAKAPTADCCSCLTQAMKTNKKCVCLILKDRDDPDLGLKINMTIAVGLPSLCKTPDNLSVFWHIYCAVIPREGSNIDDAEVLRYCKKNLASFKVPEKVFITDSLPKTATGKILRRLVAEHIVSQI

SEQ ID NO: 92881 - protein, 317 aa, Glycine max
  Coding DNA Sequence Number=SeqID_1196
  Homolog annotation: Hit_ID=Q9SWB3; Match level="QueryCoverage=93%, HitCoverage=98%, E-value=8e-95, Identity=54%"; Hit description=Seed maturation protein PM39
  Pfam annotation: Domain name=CAP160; Domain location=16-42; Score =28.9; E_value=1.9e-05; Accession=PF07918.2; Description=CAP160 repeat
  Pfam annotation: Domain name=CAP160; Domain location=69-95; Score =38.5; E_value=2.4e-08; Accession=PF07918.2; Description=CAP160 repeat
  Pfam module annotation: Pfam domain module=CAP160::CAP160; Domain location=16-42::69-95
  Subcellular localization annotation: CTP_CleavageSite=74; ConfidenceScore=5.09e-01
MTLTPKQLNQGITKRTQAQQLAIADKAVSAKNTVASNLGYGNNTETKTTQTTQTRNQLKNTGNEKPSTISSATSAIADKAFSAKNTVASKLGSGDTATTTPQEKRTDHAAAPTEYGKSVAQSLTEKLAPVSGKDAGVGSGVKSKVSGTQTSSMGVEQDKGVSVKDYLVDKLRPGDEDRALSEVIPETLHKKELPPVEVTEEGVRKVVSDAVHKREDDPERRMEHQRILGKVTESEEVKRRLGGESVVTEKKYQEMYVNSPGKGVVDKLKGVVGTWFTDPAENQSSQDSSMNYEAGRAEVEQVNQGAAGERRLQESSN

SEQ ID NO: 92882 - protein, 242 aa, Glycine max
  Coding DNA Sequence Number=SeqID_1197
  Homolog annotation: Hit_ID=Q9SWB3; Match level="QueryCoverage=76%, HitCoverage=42%, E-value=3e-68, Identity=73%"; Hit description=Seed maturation protein PM39
MWDRISSLYKQEKRTDHAAAPTEYGKSVAQSLTEKLAPVSGKVAGAGSGVKSKVSGTQTSSMGVEQDKGVSVKDYLVDKLRPGDEDRALSEVISETLHKKELPPVEVTEEGVRKVVSDAVHKREDDPERRMEHQRILGKVTESEEVKRRLGGESVVTEKKNQEMYVNSPGKGVVDKLKGVVGTWFTNPAENQSSQAKCHINFEFVFAWCEGQKWNKLTKVQQVKEGCRSHLIEEGSLLWVIV

SEQ ID NO: 92883 - protein, 72 aa, Glycine max
  Coding DNA Sequence Number=SeqID_1198
MGWYKGPCGSHHAQQCKFPDLVIKARKEFVITTESKSSVTFGNMPRFLLGIRMYPRSIQKNYASCRKSARRE

SEQ ID NO: 92884 - protein, 115 aa, Glycine max
  Coding DNA Sequence Number=SeqID_1199
MTITLDDMAMLLHLPITGAFHTFESLHVDDTILQLVELLEDYDERKPRAYRWKSGKALLVSMYRRRLDRLTSDAVCWISYGHHCAFIEFEVICLFLGHIRWGLFIVIHQVKRVVR

SEQ ID NO: 92885 - protein, 61 aa, Glycine max
  Coding DNA Sequence Number=SeqID_1200
MTGVFGAMLLNQSMGLKGIRKFRCCEESLPLVERFGKEYWRLGSCRDAKFGLDSLNPWIEN

SEQ ID NO: 92886 - protein, 280 aa, Glycine max
  Coding DNA Sequence Number=SeqID_1201
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRWCMELEFALPMDEPSITTVESAQVDKETMSRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 92887 - protein, 54 aa, Glycine max
  Coding DNA Sequence Number=SeqID_1202
MTGWLAKPADLMQAPLELLGLGSSSSMDSFASWKMNGSGMEKGRERGDATSRRR

SEQ ID NO: 92888 - protein, 107 aa, Glycine max
  Coding DNA Sequence Number=SeqID_1203
  Subcellular localization annotation: CTP_CleavageSite=40; ConfidenceScore=5.39e-01
MNTQSFTILQFPKIGLAHKNSPQWSRQLSQRTLLWASEARLSGAFSKGGKCAESPLTFICGKRQKNRKKSFMKNILDSGVVFTFEEGRQKRGSCSYVPSIEEEIRPT

SEQ ID NO: 92889 - protein, 136 aa, Glycine max
  Coding DNA Sequence Number=SeqID_1204
  Gene Ontology: Mol. function=tetracycline:hydrogen antiporter activity; Cellular component=integral to membrane; Biological process=response to antibiotic
  Homolog annotation: Hit_ID=O21999; Match level="QueryCoverage=64%, HitCoverage=61%, E-value=3e-24, Identity=63%"; Hit description=LacZ -alpha
RPPPRWSSNSPYSESYYNSLAVVLQRRDWENPGVTQLNRLAAHPPFASWRNSEEARTDRPSQQLRSLNGEWDAPCSGALSAAGVVVTRSGTATLASADVRGCFCRYAPPPSVAEREGQLIETEATGAPQKHHHTLN

SEQ ID NO: 92890 - protein, 239 aa, Glycine max
  Coding DNA Sequence Number=SeqID_1205
  Pfam annotation: Domain name=G-patch; Domain location=76-120; Score =22.2; E_value=0.00039; Accession=PF01585.14; Description=G-patch domain
MRGTPTEGSLSPFLVKDLGAQGLKVIQRIHKAWRSPLRKDKELRGIRNGIIGGYHGWLRVHTRGLDWLSKLKVINEAIMVARVMLRNGFEPGMGLGKDGLGNAYVVDIKGNPYKYGLGYEPGMPGRRNVPSRFRADRVWPGRISQCFTSAGMVSEEEVAAIEEEFPQDPPSFVQPCHPDSQVGNWRVISQSEVYTANSIYEGRFFEDPNNEGLKIDFDRDISQTINEEEEEDVLSPELE

SEQ ID NO: 92891 - protein, 36 aa, Glycine max
  Coding DNA Sequence Number=SeqID_1206
MATKMKRCPLEALGSVAPITSMPHIENGQGAAKMFN

SEQ ID NO: 92892 - protein, 198 aa, Glycine max
  Coding DNA Sequence Number=SeqID_1207
MAQPPPRERTLREMAAPDFTYESLCIQYPDEDVPYVLKTGLIHLLPKFHGLAEGVAKDWLYYLAPRSITSWDDLKRVFLEKVSLLPGPQPSGRISQFSARNDAIVIRGVHEVATNPSASSETKKLEGKLDALVNLVTQLALNQKYVPVARVRGLCSSADHHTDLCPSMQQPGAIEQPEAYAANIYNRPPQPQQQNQPQ

SEQ ID NO: 92893 - protein, 114 aa, Glycine max
  Coding DNA Sequence Number=SeqID_1208
  Homolog annotation: Hit_ID=Q6L4N7; Match level="QueryCoverage=60%, HitCoverage=9%, E-value=5e-09, Identity=44%"; Hit description =Putative uncharacterized protein P0473H02.5
MRRFLVDRASIENVNVVQQEAELEPPPNVVNEFNPNEIVRDPVDVVKARLGTMRESGWNNFFADVQGFCVAKSILVPNMDDEIPVRGRSRAEGRTITNLHHYRAEIFYVAIDKI

SEQ ID NO: 92894 - protein, 84 aa, Glycine max
  Coding DNA Sequence Number=SeqID_1209
MVGIYDMGSTFMELFRRNRGSTFPSTRSVCLVEFVLTDGEVGGWVLTWTMWQHRNKIIFSNQTFDGNKLMEDAIFYTMDMAEEL

SEQ ID NO: 92895 - protein, 61 aa, Glycine max
  Coding DNA Sequence Number=SeqID_1210
MGKAVASGGSNLARLGELGGNHLPYFAINRGGSEKEKEFREGFDRSSTFFIRSSSFFDLQR

SEQ ID NO: 92896 - protein, 165 aa, Glycine max
  Coding DNA Sequence Number=SeqID_1211
  Gene Ontology: Mol. function=chlorophyll binding; Cellular component =integral to membrane; Biological process=photosynthetic electron transport
  Homolog annotation: Hit_ID=Q2MI75; Match level="QueryCoverage=98%, HitCoverage=34%, E-value=1e-86, Identity=89%"; Hit description =Photosystem II P680 chlorophyll A apoprotein
  Pfam annotation: Domain name=PSII; Domain location=1-157; Score= -106.7; E_value=1.1e-06; Accession=PF00421.10; Description =Photosystem II protein
MDNGDGIAVGWLGHPVFRDKEGHELFVRHGDGIVRADVPFRRAESKYSVEQVGVIVEFYGGELNGVSYSDPATVKKYARRAQLGEIFELDRATLKSDGVFRSSPRGWFTFGHASFALLFFFGHIWHGARTLFRDVFAGIDPDLDAQVEFGAFQKLGDPTTKKQVV

SEQ ID NO: 92897 - protein, 184 aa, Glycine max
  Coding DNA Sequence Number=SeqID_1212
  Gene Ontology: Biological process=transposition, DNA-mediated
  Homolog annotation: Hit_ID=Q1J7G7; Match level="QueryCoverage=17%, HitCoverage=45%, E-value=4e-11, Identity=100%"; Hit description =Transposase
VLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMLQSIKLIDTVDLEGGPVGKPVVPAALMNRPTRGERRFAYWALAECILAYYVGTDEGVSEVLHVAGEKRLH

SEQ ID NO: 92898 - protein, 140 aa, Glycine max
  Coding DNA Sequence Number=SeqID_1213
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=21%, E-value=3e-42, Identity=84%"; Hit description=DNA -directed RNA polymerase subunit beta
  Pfam annotation: Domain name=RNA_pol_Rpb2_7; Domain location=52-128; Score=97.1; E_value=5.4e-26; Accession=PF04560.11; Description=RNA polymerase Rpb2, domain 7
MPYLQEGRPVDMLFDPLGVGSRMNVVQIFECSLGGHYALVTQQPLRGRAKQGGQRVGEMEVWAWKDLVCSYLQEMLTYKSDHIKTRQEVLGTTIIGGTIPKPTDAPESFRLLVRELRSLAMELNHFLVSEKNFRIHRKEA

SEQ ID NO: 92899 - protein, 408 aa, Glycine max
  Coding DNA Sequence Number=SeqID_1214
  Gene Ontology: Mol. function=cyclopropane-fatty-acyl-phospholipid synthase activity; Cellular component=cytoplasm; Biological process =lipid biosynthetic process
  Homolog annotation: Hit_ID=A6SXB3; Match level="QueryCoverage=89%, HitCoverage=82%, E-value=9e-66, Identity=37%"; Hit description =Cyclopropane fatty-acyl-phospholipid synthase
  Pfam annotation: Domain name=CMAS; Domain location=163-408; Score =156.5; E_value=7.3e-44; Accession=PF02353.11; Description =Cyclopropane-fatty-acyl-phospholipid synthase
  Pfam annotation: Domain name=Methyltransf_11; Domain location=229 -328; Score=53.4; E_value=7.7e-13; Accession=PF08241.3; Description =Methyltransferase domain
  Pfam annotation: Domain name=Methyltransf_12; Domain location=229 -326; Score=49.9; E_value=8.8e-12; Accession=PF08242.3; Description =Methyltransferase domain
  Pfam module annotation: Pfam domain module=CMAS::Methyltransf _11::Methyltransf_12; Domain location=163-408::229-328::229-326
EYTMRHHLATALQFEPPLLDQPQPWQWDEDVQTTAGGETSQARFILNRLFQDYPGAFSVRLWNGNLLNIGEGDPAFTFCLQQASVLRNMVWFCDPKCLAEAYFSGQIQILGDFHAAMQLREHFESLSLPLHEKLGLIFRALTLATDFAQPEQTSLPQIDPTPNQLDTSSPVALSYDNVPEDFYQCWLDEHMLHSCAYFSGNTRDLAQAQRNQLDLICLKLHLQHGDSLLDIGCGWGGLACWAAKHYGVFVHGITQNASQYAYATKQVKRLGLEHLVTIELGNYQDLPATGSYDKAACIGIADHIGEAHFPDYLAKVHAALKPGGLFLTHGMTNEQLAGQQDASSAFINRQLFPQGDLSTFPHFLQQMDAAKFDVFNVESLRRHYVMTLHQWLAGLEANHATVASLVGE

SEQ ID NO: 92900 - protein, 173 aa, Glycine max
  Coding DNA Sequence Number=SeqID_1215
TRMYPDKSNRALGFPALITGLCQSFRVPVAPSKVIRPPITRAFIEKYCVQRQAQGDAPQATDALPPHQAGPAESFDTEQYLWHLVHQQAANHRAHVQTHDCLYQMSLSLQSQGFTSFPCPTPDQFRAKVAWPGDWPEARAGEAPAEAPDEADEAREDEEMTDLLDFLGGSGAT

SEQ ID NO: 92901 - protein, 68 aa, Glycine max
  Coding DNA Sequence Number=SeqID_1216
MAGHGRDQNRDVLDCITAVLETLLQERDVESADYRALMAFRKKAMGCLEEHKVPYATFMLQGEAENWW

SEQ ID NO: 92902 - protein, 18 aa, Glycine max
  Coding DNA Sequence Number=SeqID_1217
MVCLLECENLEHKGERSQ

SEQ ID NO: 92903 - protein, 144 aa, Glycine max
  Coding DNA Sequence Number=SeqID_1218
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=9e-25, Identity=54%"; Hit description =Putative uncharacterized protein
  Subcellular localization annotation: CTP_CleavageSite=38; ConfidenceScore=5.33e-01
MTMITPSSKLTLTKGNKSCRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 92904 - protein, 135 aa, Glycine max
  Coding DNA Sequence Number=SeqID_1219
MTQDDTSKEVNYMANHNRQGFHPGGYAGYQQGGNFSHNQGQGWQSHPGNQFNRDQRGPSNRPPNQGPNLYERTTKLEDTLTQFMQLVENSSRNFGANTEKNPKEECKAMITRSQWRMLVGKESKNSEGELEEEEK

SEQ ID NO: 92905 - protein, 147 aa, Glycine max
  Coding DNA Sequence Number=SeqID_1220
  Subcellular localization annotation: CTP_CleavageSite=45; ConfidenceScore=5.40e-01
MSPPSVWQEQAVCDIFTVRLSQFFGSTMNRFFFKVSPPLWLEVVRDVGNSPSPFFWSPQNWVFVHVFSTFEFGSMRSDCLVQFFLLHFFGSPMNCVFVHVSSPFELGAMRSDCLVQFSIFHLFGAPRIAFSFMFPPPSSWELCVVIA

SEQ ID NO: 92906 - protein, 64 aa, Glycine max
  Coding DNA Sequence Number=SeqID_1221
MLVATPCIFPPLESAPVSLALARPRRARCDSWRLHWGRLGPYTRVHGNLRSGGESIIMLGLRLA

SEQ ID NO: 92907 - protein, 75 aa, Glycine max
  Coding DNA Sequence Number=SeqID_1222
MDRSWMNESRMSPAYKEDVDAILPRKGPVTRAMSKRLQEDWARAAEEGPRVLMNLRVGYPRNIGFFSPCILGHLD

SEQ ID NO: 92908 - protein, 102 aa, Glycine max
  Coding DNA Sequence Number=SeqID_1223
MEEGYAASVNQNYQWKVHLRMKKMLLVESFSSQVLQGKVAEEPQLFVVYGAVAVVVAGLVEERHNCSIVADFAADVEEVCCRCLQHKLQAVQLLQIVAQKGK

SEQ ID NO: 92909 - protein, 52 aa, Glycine max
  Coding DNA Sequence Number=SeqID_1224
MGCSKQMLTSPLGWHRAIKIGDIGCCHMRKIKTNQYLGLQELVRNQLVVKDL

SEQ ID NO: 92910 - protein, 100 aa, Glycine max
  Coding DNA Sequence Number=SeqID_1225
MQSCHQRLFVENVGKTGTCGLRTLSVKGSGVVFMHGEEKETESDEMKMKASKTRNELKASDSSTYRLKTEEGTKNGEERRKIFTESPMETSRKRYRGTSA

SEQ ID NO: 92911 - protein, 80 aa, Glycine max
  Coding DNA Sequence Number=SeqID_1226
  Subcellular localization annotation: CTP_CleavageSite=44; ConfidenceScore=5.44e-01
MKNGGKPSRNRPQKRLRSVTEAPRLGFSSRKQFFSLISRRWLPPSSPRRAGLLPPEGTVFCWNTLEGPSGPGCYLHTPVY

SEQ ID NO: 92912 - protein, 320 aa, Glycine max
  Coding DNA Sequence Number=SeqID_1227
GTWRYVAGVRRPWGRQASSWQSTDERNKDHKARRLVWWLASYESCVIYGLWPLEAMRASSNRLPRGCNRLPGLEMKATGCGGFHVLKLCDSSLASGNRLPRLCNRLPGMKSLEIPLLLACSGYETNCIVMAAQLIHDRVEMECLEGAWETLEGNMRCRFRGMIRFTATSLVHPNEPVRTLQRTVEWILPTPTPYRLVEPVQVIEVTSSEEDPEEDPEELPPEPAVDALDFLEGDEDPLPEVDFPEEVMSASEADSTEDSGLREMATTTTVDTFALDDTMYFVKLPIFWTALDDECPSMVIFHHGDAVEDKGEVVRGGTIY

SEQ ID NO: 92913 - protein, 50 aa, Glycine max
  Coding DNA Sequence Number=SeqID_1228
MKSLRGKEIALVKVQWGPDEGDSTWELEDRVYCGKDKQVRLINEEKSITG

SEQ ID NO: 92914 - protein, 39 aa, Glycine max
  Coding DNA Sequence Number=SeqID_1229
MVSKVWSFNGGFNGGGEREKKQLPRVSLHPSRPVFESEQ

SEQ ID NO: 92915 - protein, 116 aa, Glycine max
  Coding DNA Sequence Number=SeqID_1230
MKRSIAGRKNNGQSSRWKQESEGSPPCHISRSFISAGLGDEGQVFAICEDDVPSTLDLVRPCPPDFQLGNWRVEERPGIYATSIISDDESPPKVLIPGAPSIDFEQEKNQTEDEGK

SEQ ID NO: 92916 - protein, 82 aa, Glycine max
  Coding DNA Sequence Number=SeqID_1231
  Subcellular localization annotation: CTP_CleavageSite=40; ConfidenceScore=5.15e-01
MKAIPSKPTRKGRKCFSLGSLLNQSQTYQGNPCGVYPDLSSFTRSGVYPDLSSFTGSGVIQKTLQPVSSDLPRKVHIMMYEN

SEQ ID NO: 92917 - protein, 149 aa, Glycine max
  Coding DNA Sequence Number=SeqID_1232
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
MTMITPSSKLTLTKGNKSCEDPKGKSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 92918 - protein, 42 aa, Glycine max
  Coding DNA Sequence Number=SeqID_1233
MSVKNLVGHPGVKSWGCQSGSRCCARMLQPCGIDTCLKEHSN

SEQ ID NO: 92919 - protein, 128 aa, Glycine max
  Coding DNA Sequence Number=SeqID_1234
MWLPPKPWNEKPRGLVGKNAAGTNSEGLCGVATASLNSEERKGTNRGVEDEYAQVYVEKEARGRVIDLLHQEATMWMDRFALTLNGSQELPRLLAKAKAMADTYSAPEEIHGLLSYCQHMIDLMAHIT

SEQ ID NO: 92920 - protein, 131 aa, Glycine max
  Coding DNA Sequence Number=SeqID_1235
  Homolog annotation: Hit_ID=A9MXJ3; Match level="QueryCoverage=98%, HitCoverage=55%, E-value=6e-50, Identity=76%"; Hit description =Putative uncharacterized protein
MFPPAPEHFLIAETECRGRAVSLADFIKVTDECNLWHDVARFLAYRLMVMNVRDRELVGVDSYLKVRALLIEIAAYNDEYRQSINVLNFIQRRTGISRSRTMKLLSELRKGGYINIDGGRLLGIKKLPLAY

SEQ ID NO: 92921 - protein, 146 aa, Glycine max
  Coding DNA Sequence Number=SeqID_1236
MLYLGCDSIPEAVENEDDLDDVHVVGHEEDVGGGGREVGAGEHVGAGEQRDAGEQRDVDAGEKRDGSGEERDVGGSEEEKEVDSDEWFTNFSCMMNEVEVETYGYHSEELKIPISSHDEDEDVEVYPQYSQSSGVGEQKLEIGMKF

SEQ ID NO: 92922 - protein, 135 aa, Glycine max
  Coding DNA Sequence Number=SeqID_1237
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=46%, HitCoverage=50%, E-value=2e-25, Identity=88%"; Hit description =Putative uncharacterized protein
METATLIAISISGLLPGDPLVLERPAPAVGAPISPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 92923 - protein, 140 aa, Glycine max
  Coding DNA Sequence Number=SeqID_1238
MRFWMLAFVSKPTFRGNIGFNKIEENHSKCINLTQRVSSSIVNDLFFFLGDPIVPSSEDTDGNSHPGSRFMVVCVEAKLHDDDKGDDKKLKDQSRTIQEFKIRIKKNSRLKNQDSRFKISRIKIKIQDSRFKNEEKTQSR

SEQ ID NO: 92924 - protein, 164 aa, Glycine max
  Coding DNA Sequence Number=SeqID_1239
ALGCSALITGLYQSFEVPVTPSKVIRPPITRAFKEKYCTTRQAQGGNPQAPDAPPPPPQADPAGSFDMEQYLRHLVRQQAANHRAHVQTHDCLYQFSLSLQSQGFASFPCPTLDQFRAEVAWPGDWPKAQAGEAPAEALGEANEARMDEEMTDLLDFLGGSGAT

SEQ ID NO: 92925 - protein, 105 aa, Glycine max
  Coding DNA Sequence Number=SeqID_1240
MLAIISKYQEELNLATAQEYRVADEYAQVYAEKEARGRVIDWLHQEATMWMDRFALTLNGSQELPWLLAKAKAVADTYSAPEEIHGLLSYCQHMIDLMAHIIRNR

SEQ ID NO: 92926 - protein, 424 aa, Glycine max
  Coding DNA Sequence Number=SeqID_1241
  Gene Ontology: Mol. function=glucose-1-phosphate thymidylyltransferase activity; Biological process=extracellular polysaccharide biosynthetic process
  Homolog annotation: Hit_ID=P61887; Match level="QueryCoverage=48%, HitCoverage=70%, E-value=1e-103, Identity=89%"; Hit description =Glucose-1-phosphate thymidylyltransferase 2
  Pfam annotation: Domain name=Acetyltransf_1; Domain location=335-414; Score=63.2; E_value=8.7e-16; Accession=PF00583.15; Description =Acetyltransferase (GNAT) family
  Pfam annotation: Domain name=NTP_transferase; Domain location=1-170; Score=143.8; E_value=4.7e-40; Accession=PF00483.14; Description =Nucleotidyl transferase
  Pfam module annotation: Pfam domain module=Acetyltransf_1::NTP _transferase; Domain location=335-414::1-170
FGINLSYAEQPSPDGLAQAFLIGEEFLAGEPSCLVLGDNIYFGQGFSPKLRSVAARTTGATVFGYQVMDPERFGVVEFDDHFRALSIEEKPVKPKSNWAVTGLYFYDSQVVEFAKQVKPSERGELEITSINQMYLERGELNVELLGRGFAWLDTGTHDSLLEASSFVQTVEKRQGFKIACLEEIAWRNGWLDDEGVKRAAQTLAKTESAKLHFDSSAAPVAEADLDAYALVQAKIPAYRLGWADALSTLGFRLVEGEVDLVVNVAPESAMADAASAVAVRQAVPEDIPSLRAAAGEVFAASRFRAPWYDRADSGRFYAAWIEKAVQGTFDHQCLLVLDSQGQPEGFVSLRDIGGQEMRIGLLAAFPGASGRGVGARLMTAAIAECRQQGMQRLRVATQVGNIAALRLYQRQGAVIESTAYWLYR

SEQ ID NO: 92927 - protein, 81 aa, Glycine max
  Coding DNA Sequence Number=SeqID_1242
MENCTKQSLRMAPNSKVEDTLSQPTLLREGDARLAGCVFHERNTRGVATNVYLRKTSEKPEKTRSTNFEVKGSGVVFTRGE

SEQ ID NO: 92928 - protein, 129 aa, Glycine max
  Coding DNA Sequence Number=SeqID_1243
MAGAGDNGGVYHQLDGSQRLLLDAMTTQMQRLLNRNKEELCRQIVKSSLFTLKPLSPREVCDDQIRMREKREQEKENSEATQRNRKKKSDAPEGKSDTHKREREFENVFPKEIPHGLPPSILELHCLTG

SEQ ID NO: 92929 - protein, 108 aa, Glycine max
  Coding DNA Sequence Number=SeqID_1244
MGVQIATRPTWALQKAVASGGSHLAHLGELGGKHLPHFAINRGRNEEEFRSSLLVIQESLEISEKNWFREENPSRGASVTFSWGFSRRSSAVLRRSSFVRHRSSVFNG

SEQ ID NO: 92930 - protein, 124 aa, Glycine max
  Coding DNA Sequence Number=SeqID_1245
ERSGYRYIEQLTEMPQNVLYDALGYINGGTPGFIFSAKWSSVTGIYSAQSASGAPVASVSISCPSCSATDGGGGGASHSPIQAAQLLGRAIGAGLFAITPAGERGMCCKAIKLGNARVFPVTTL

SEQ ID NO: 92931 - protein, 64 aa, Glycine max
  Coding DNA Sequence Number=SeqID_1246
MEKSEKKNHSEKKLKKAYITWDENDMESSEDSENEEINLCLMAKSYESDEEISKCILQFIKRNR

SEQ ID NO: 92932 - protein, 92 aa, Glycine max
  Coding DNA Sequence Number=SeqID_1247
  Subcellular localization annotation: CTP_CleavageSite=85; ConfidenceScore=5.11e-01
AKAPLLSTTPPVAIVTCESDDMWRCPSDSESGSMQRLTSSSASFVNQGQANPLTRRDLRRVLRLCHPDLQRYPSGYPHKHSFTIRQTQSPVA

SEQ ID NO: 92933 - protein, 84 aa, Glycine max
  Coding DNA Sequence Number=SeqID_1248
RKRLQYERYFSQLKQYIKIPNGENSRNRASNVVLKFHDDPTVNESEIVVFLRQVRWPAGKIEGFGRREKNEIVRQRRLRSQSEN

SEQ ID NO: 92934 - protein, 165 aa, Glycine max
  Coding DNA Sequence Number=SeqID_1249
MHIRAQTHRHHLGRPIQLGHWAWSVIYSIWFASMRPTTVGRCRYMSVSTGSASVNKGKVPPLLYALPRSNLGLRSHGLETGPMPRQGREPTGSLGEADESQFGIMALSYFVTIFIATVATCPFAGVQGEAHGCAFQRRKDARSRHQRLFVENVGKTEGNRSKRKF

SEQ ID NO: 92935 - protein, 67 aa, Glycine max
  Coding DNA Sequence Number=SeqID_1250
MTETSMRAENADYDKGDEQKKAQRSKNNSSESRTSQEFKNQEGFKISRIKIKIKDSRFKNEEKTQSR

SEQ ID NO: 92936 - protein, 170 aa, Glycine max
  Coding DNA Sequence Number=SeqID_1251
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=89%, HitCoverage=44%, E-value=3e-10, Identity=30%"; Hit description=CTV.20
EVQQGFQQFNKLYNSKESRIPADLKYFSSFALSWIFSWQYRYGKTENSKQYPPLQRHAFVKWWSQFDTSKAAPDQVNNWFQSNPEFLKPADQETSLFLNQKSQLAAFLASSKSKESLAQNFKEVLQLLQQEVEEEPSKKEAESSETNDDQEDDPFYQNEDDCFGISLDDD

SEQ ID NO: 92937 - protein, 140 aa, Glycine max
  Coding DNA Sequence Number=SeqID_1252
  Homolog annotation: Hit_ID=O52175; Match level="QueryCoverage=58%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPPRKDMQKHHWQQPLVIDLEELVLKSCAG

SEQ ID NO: 92938 - protein, 297 aa, Glycine max
  Coding DNA Sequence Number=SeqID_1253
MACNRFQGIPVYKYLHFCITLIPHSCVMTPLAPKSPYLTHFLTKSLQTKHNLHHFQFFFKPTDQNPLQHLQMTESSKKRKESSSTTIAAGHRCQGTSGNPPTPVPPSLSSTRSSTLFSSDDQCQRYYSQFCNRVILDPKYLDLEFFNGETFDCYQVFQNYGLIDFMSLKLSYFPELVKVFYNNLKIQDGILYSEVQNIPIVIDQSLFFSLTKLSSQGVPFEGTLVDGWKFDYSSHYARRMVCNDQADMIGRLLAGSLTFDCRIMHYIIVRILLPRSSNLAQAFEEDLIMMWAFQTSR

SEQ ID NO: 92939 - protein, 141 aa, Glycine max
  Coding DNA Sequence Number=SeqID_1254
RWVCLFVPSCSDKGKEDGDETDDELEMPNLITDGLQVVQSRFISGREGSRGGSRVLVTMEVNGYSSHAARVMEDTQREVVSSNPQKGQSWVVPRSSYCFDYYQGGSRSRKPKSVRQWFPWGGNMFPHEGSFAKHKGDTGST

SEQ ID NO: 92940 - protein, 194 aa, Glycine max
  Coding DNA Sequence Number=SeqID_1255
  Homolog annotation: Hit_ID=A7NVY6; Match level="QueryCoverage=90%, HitCoverage=45%, E-value=2e-75, Identity=80%"; Hit description =Chromosome chr5 scaffold_2, whole genome shotgun sequence
  Pfam annotation: Domain name=TPT; Domain location=1-109; Score=59.1; E_value=1.5e-14; Accession=PF03151.7; Description=Triose-phosphate Transporter family
MYAYLQILHAIFVFLFVPWYLLEKPVMEVSQIQFNFWIFLSNAICALALNFSIFLVIGRTGAVTIRVAGVLKDWILIALSTVIFPESTITGLNIIGYAIALCGVVMYNYIKVKDVRASQLPVESIPDRITKDWKFEKKSSDIYVPDNIGDDEGSSGANGTASDMKIDEETPLISSSRLSHIGRTQLTNQYATGK

SEQ ID NO: 92941 - protein, 266 aa, Glycine max
  Coding DNA Sequence Number=SeqID_1256
  Gene Ontology: Mol. function=hydrolase activity, acting on ester bonds; Cellular component=endoplasmic reticulum; Biological process =protein folding
  Homolog annotation: Hit_ID=A7NYG7; Match level="QueryCoverage=69%, HitCoverage=42%, E-value=1e-78, Identity=74%"; Hit description =Chromosome chr6 scaffold_3, whole genome shotgun sequence
  Pfam annotation: Domain name=Phosphoesterase; Domain location=1-228; Score=84.0; E_value=4.9e-22; Accession=PF04185.5; Description =Phosphoesterase family
GFQNGAAVPVPTSTQPNRFYVHSATSHGAMNNVRKDLIHDFPQKTIFDFFNENDLSFDVYYQNMLATLFFKCLHKLKNAVKLHDYALKFKKHALKGKLLNYVVVEQRYFDVEVFPTNDDHPSQDVAVEQMFVKEVYEVLRKSLQWEEMAVLITYDEHGGFYDHVTTSVEGVPNADGIIGPRPYYFRFDRRMGIKIVGLNQIGKKDENLVREWNHTSGQWNGDTNDKVEYPEFSNKDKTLVFQFSVKHEQKLDCGGGYMKLLSGDVD

SEQ ID NO: 92942 - protein, 33 aa, Glycine max
  Coding DNA Sequence Number=SeqID_1257
MAVKQARLVKCRFHELAKPLIFWQSASFAKCPI

SEQ ID NO: 92943 - protein, 78 aa, Glycine max
  Coding DNA Sequence Number=SeqID_1258
MSKSCGFGMTSPLDESISCFLIRGYTPSPWVLVTLTVRGLHVLALRGLHVLTQRAARPHLQRTISPRLERATRPHLGY

SEQ ID NO: 92944 - protein, 41 aa, Glycine max
  Coding DNA Sequence Number=SeqID_1259
HGNKNPDPVNDPMHAHSGPVLVQMMGPEKEAGPTLVQMAQA

SEQ ID NO: 92945 - protein, 96 aa, Glycine max
  Coding DNA Sequence Number=SeqID_1260
LSSHGGGEAFAAQEPQPDLETTPTAQEDDSEATPLESFAPETDPKADPVIAEASPQASPISTPVLELSTPQGSPVGTPVLHLTGDEAMDQDPPQDQ

SEQ ID NO: 92946 - protein, 120 aa, Glycine max
  Coding DNA Sequence Number=SeqID_1261
MGDQEETQEQMKADMSALKEQMASMMEAMLGMRQLMENNMVTAGAVSSTAEADPTLPATTHHPLPNAVGRERSILGHISNSHWGYNRVAYPYGLPPNYTPPVMRDEAGHVPSPVLEGEPP

SEQ ID NO: 92947 - protein, 127 aa, Glycine max
  Coding DNA Sequence Number=SeqID_1262
MINAGMICPLRFHEEMHDAIKEQARVSLLCAPLMERIQKSPSIDNSQGWFHVTLLASRDIILLDNTLWRYGLSAIMHHKNRKTLYEASLLSSESETQHDHRSTSTPYGSHRPGYRAYISTCVRGVGA

SEQ ID NO: 92948 - protein, 137 aa, Glycine max
  Coding DNA Sequence Number=SeqID_1263
MTTLAQTWSVLSFSNLIPTSDTFDVTLDRAKLIYGIIMKMDMNVGGPRKAKGKRSEAPSTTSSEALAPSSSTLPPSSYTQILRIPPAPIHIPLPAPLSVGPTDFIFTPQMLHSMLQSIHRGQSIIMQSLRAWACPPL

SEQ ID NO: 92949 - protein, 222 aa, Glycine max
  Coding DNA Sequence Number=SeqID_1264
  Gene Ontology: Mol. function=transporter activity; Cellular component= 1-2nm peptidoglycan-based cell wall; Biological process=transport
  Homolog annotation: Hit_ID=Q8Z836; Match level="QueryCoverage=100%, HitCoverage=100%, E-value=6e-88, Identity=72%"; Hit description =Arginine transport system permease protein ArtM
  Pfam annotation: Domain name=BPD_transp_1; Domain location=12-217; Score=57.6; E_value=4.2e-14; Accession=PF00528.13; Description =Binding-protein-dependent transport s
MLAYLPELLKGLHTSLTLTAASLVAALLLALLCTIVLALKLPLLNWLVKGYITLFTGTPLLVQIFLIYYGPGQFPSIQNVPWLWHLLSQPWLCAMLALSLNSAAYTTQLFYGAVRAIPAGQWQSCAALGMRRRDTLRILLPYAFKRALSSYSNEVVLVFKSTSLAYTITLMEVMGHGQLLYGRTYDVTVYAAAGLIYLVVNGLLTLLMRLVEKRALAFERRN

SEQ ID NO: 92950 - protein, 108 aa, Glycine max
  Coding DNA Sequence Number=SeqID_1265
  Homolog annotation: Hit_ID=A5BEL1; Match level="QueryCoverage=74%, HitCoverage=5%, E-value=7e-09, Identity=41%"; Hit description =Putative uncharacterized protein
MEMDESALLTTAYGRTKQLSLKLIRRGMGHMKKNCLEFQKWLEKKGYAKPKETSILSGNKLGSHVEAIGTCILSLRHISIGRIKRLVKDEVLNTLDFADFKTCVDCVK

SEQ ID NO: 92951 - protein, 79 aa, Glycine max
  Coding DNA Sequence Number=SeqID_1266
MSRNLTDYAIVPSLASEMLRNFTDYALTLPFDSRHVAELHGFPNNGCQVPRGGQVKVASQQTDGPRTKLGYDTGLSLSL

SEQ ID NO: 92952 - protein, 94 aa, Glycine max
  Coding DNA Sequence Number=SeqID_1267
MRLPGKESLLMKPPITINEILDVSISFLNDHLEETLGSTKIEEIHSKCINLAQGKDWHSHPGSRFMVSQDFGLKLVDWPDMMYVRVLVWPVVQG

SEQ ID NO: 92953 - protein, 61 aa, Glycine max
  Coding DNA Sequence Number=SeqID_1268
  Subcellular localization annotation: CTP_CleavageSite=35; ConfidenceScore=5.09e-01
MSPPPLKISQSLKNSFKALQDASFVPISRLAWKMMDDSLSERQRAERMLARQILFQILVSR

SEQ ID NO: 92954 - protein, 208 aa, Glycine max
  Coding DNA Sequence Number=SeqID_1269
QAWPHTHQCMRMNYVPDSDKIERALLNRLFDFGVPAKTGVEPEAVIVAVIGGEDVPGRDADARVARLEKQRAHVQRLLRHLHPQHLAPQLAQVRIVTAAAQQFGNRRLRQHRRAHAGGVLQRGDFAHVLGAVHPANTDAGRHGFGKAAAQDGIGAEGAHRKRPALAESRIAKDIVLNDYHIILIGLARDIRLVLVGNTFAQRIIDVVD

SEQ ID NO: 92955 - protein, 61 aa, Glycine max
  Coding DNA Sequence Number=SeqID_1270
MGHLSDQGVPTDPKRIKVIPDWPTPPSVEGSSPEYEEPWDLRSNLFQGGGDDAILPPKGIG

SEQ ID NO: 92956 - protein, 158 aa, Glycine max
  Coding DNA Sequence Number=SeqID_1271
  Gene Ontology: Biological process=transposition, DNA-mediated
  Homolog annotation: Hit_ID=Q1J7G7; Match level="QueryCoverage=24%, HitCoverage=67%, E-value=8e-11, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVTTLASCIKLIDTVDLEGGPVGKPVVPAALMNRPTRGERRFAYWALAECILAYYVGTDEGVSEVLHVAGEKRLH

SEQ ID NO: 92957 - protein, 173 aa, Glycine max
  Coding DNA Sequence Number=SeqID_1272
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
MGDEMQVGIHQLRITQDWHEVTEEWEQRGNWVFLDLVEEQKRKSFVAVSAKQICPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 92958 - protein, 150 aa, Glycine max
  Coding DNA Sequence Number=SeqID_1273
  Subcellular localization annotation: CTP_CleavageSite=18; ConfidenceScore=5.45e-01
MASPPASPPPPPPPSTPSDASASPFAVKRTRKASHPATGKADGPYKKKLRTYLGIVACDKVDVTYENWKEVPTAQKDLIWEDIQRLLTVGRKGSYFRLWGRDGGSLNQTSRGNELLQPIRTVWRTLSVRNMTLARKNGPSFARLTDTLLG

SEQ ID NO: 92959 - protein, 203 aa, Glycine max
  Coding DNA Sequence Number=SeqID_1274
  Gene Ontology: Mol. function=nucleic acid binding; Cellular component= nucleus; Biological process=regulation of transcription
  Homolog annotation: Hit_ID=A2Q246; Match level="QueryCoverage=100%, HitCoverage=99%, E-value=1e-101, Identity=77%"; Hit description=CENP- B protein
  Pfam annotation: Domain name=DDE; Domain location=1-102; Score=2.2; E_ value=1.3e-06; Accession=PF03184.10; Description=DDE superfamily endonuclease
MYGRRVLLVVDNCPAHPRNIEGLRNVELFFLPPNMTSKIQPCDAGIIRAFKMHYRRRFYRKILEGYEVGQSDLGKINALDAINLAIPAWTIDVRKETIANCFRHCKIHSASDVARNLDESTFDEETQDLETMINQCGYHTVSLEPVTRKEALMASNTLHNFMIQYKNTTPELLDAIRKVRDELQIDLNFKEKQTTIESYFNRV

SEQ ID NO: 92960 - protein, 104 aa, Glycine max
  Coding DNA Sequence Number=SeqID_1275
DGPSGTSTLASRGLHVLTFGGLHVFALRGLHVLAIRGLYALTFRGLHTLAFRGLHPQTSEDYTSSPSEGYTSVATYPSAGGRRETRGMRVPRKGIRAESPPTFI

SEQ ID NO: 92961 - protein, 121 aa, Glycine max
  Coding DNA Sequence Number=SeqID_1276
MDFVASKHICRDQKMFDTLKTDGESGHFKLGNGGKMKVEGIGSVRMKLHGGAIRTFLNVRGTNMLVQSGDAKCTREDTWCCEDRKIERNHDSKVKKKVKFSNVVEVLGDTSVEGGVCSLSN

SEQ ID NO: 92962 - protein, 325 aa, Glycine max
  Coding DNA Sequence Number=SeqID_1277
  Gene Ontology: Mol. function=motor activity; Cellular component =flagellin-based flagellum; Biological process=ciliary or flagellar motility
  Homolog annotation: Hit_ID=Q6AGA7; Match level="QueryCoverage=85%, HitCoverage=80%, E-value=6e-71, Identity=51%"; Hit description =Flagellar motor switch protein
  Pfam annotation: Domain name=FliG_C; Domain location=179-286; Score =111.3; E_value=2.9e-30; Accession=PF01706.7; Description=FliG C -terminal domain
AAEIIDLQGLDAATTAQALGQFHRIATGHLPPARGGRDIAAGLLEASFGAERAAAVLGRVGSTSMTSSFEFLGSADPAQLATLLDGELPQTVALVLAHLPTDRAAAVLAAFPDPVRTDIAQAIASMGTASQEAIAIVADALKTRTGTFATRDAPEMLGGVEPLVEIIARSGATVEKALLASIEDRDSVLAEDIRSRMFTFADIVKLDDRDTQRVLRGMDIRSLALALKGANQGIADLIRRNVSERNRENLDEEARTLGPVRMSQVEEARAEIVRTIRALGGWQETSPYSAPTRTSMSTDAFAPVLFPASGRRRRTARSMPAPAFA

SEQ ID NO: 92963 - protein, 151 aa, Glycine max
  Coding DNA Sequence Number=SeqID_1278
  Homolog annotation: Hit_ID=Q9SKG7; Match level="QueryCoverage=43%, HitCoverage=32%, E-value=2e-07, Identity=39%"; Hit description =Putative uncharacterized protein At2g13770
MWYRPPSSNVEPPNNDISQNHDEVHVFLRSALLLFVYWLMAHLLIVWMSMFRLLKPLQDKYLRRPNNEDNERLLQMGATLGFPVFGTTGSNNGIIMLNASNVFNEVLSGHVSAVQYIVNGTQYDMGCRTGCHDITLQNMQIVFDCMNRLNK

SEQ ID NO: 92964 - protein, 63 aa, Glycine max
  Coding DNA Sequence Number=SeqID_1279
MGKESSEDRRKNACRKPCGRFIIQGEKVYYDKPWQLRKRSVRAAKKSTARDVTLDTNEEGDAS

SEQ ID NO: 92965 - protein, 146 aa, Glycine max
  Coding DNA Sequence Number=SeqID_1280
MASPMTCGGTLWFYFHHPETFKPDDAQGSAGWDIDRPNDGKEGRANGFNPSAIEKSLKISEKNCFREKNPSRGASITLSRRFRGDSSLFFIVLCSFFVVLWSLTGLISSSQLRIHRSKSPAFIDHPKRSLIVQRLNVSLLSKPRDR

SEQ ID NO: 92966 - protein, 140 aa, Glycine max
  Coding DNA Sequence Number=SeqID_1281
MATTPTPKAGSLSKQSRWEKFSRVEEEVEVAEANVDVNGDHREAQVERSRKRTRRKQQMRKDEQRECHSPGLAINSLGLVTFLQHEGTNSSAQVGLAPLGLFQLKAMHNSKKKTREQKPEEEPMTKEREERKSGSRATEK

SEQ ID NO: 92967 - protein, 137 aa, Glycine max
  Coding DNA Sequence Number=SeqID_1282
MLCTLLEEEYTKVHNLKSAKQIWDNFAVTYKGTSQVTTLRVLKNLESISLEELIGTLKVHEQELQQDKGLAREKSLALSSKKNKKEPSSREQKTWMRTISPSSITKSIRCGETKVGLSGEALQEECPRTRRKKTKAP

SEQ ID NO: 92968 - protein, 157 aa, Glycine max
  Coding DNA Sequence Number=SeqID_1283
MKELQPVQVEPNTNPHAKLDKVILQYVLVASINEDLIVADVVEIDDRVLGVVPRPMTAEDEKKVIETLEKHMEACRLQRIRTYKMLKKMKKHYGRIYYLITCLLKTNNKCCSKVPVSKLDHQTLSKFGTSKANIHRTSKGHIYQCQTQPQVEEKVCE

SEQ ID NO: 92969 - protein, 176 aa, Glycine max
  Coding DNA Sequence Number=SeqID_1284
MSVSACYQAFCLTDSKKNVYTDNHSGISARQRDSKVSMTDLVSAEDDVNLRVSTGLPAAIDEGCRMTIICLCVPSDTTVSEWQKVCGMTIICLRMSSGPHLWMGQKGAELTIICLEKVVHSDTTGLTFRKGAEDRKASLRATSSWVMVTKSGVVDKSEALAPTYPPMRNSDLRSSG

SEQ ID NO: 92970 - protein, 169 aa, Glycine max
  Coding DNA Sequence Number=SeqID_1285
  Gene Ontology: Mol. function=RNA-directed DNA polymerase activity
  Homolog annotation: Hit_ID=Q2HW20; Match level="QueryCoverage=84%, HitCoverage=72%, E-value=1e-10, Identity=30%"; Hit description =Putative uncharacterized protein
MRDYNRSRGIRGDTEDVIFVILWKLKIPPKAAVFTWRLIKDRLPTKMNLRGRQVEISDPMCPLCNNSEESLSWVNSVGAFPKEQKDHYMQHSRRNATRTKDIRWSYWWIALTRTIWQHRNKVVFDNQTFNASKLMDEALLLVWSWLKAMEKDFYTHFNQWSSNLTNAFV

SEQ ID NO: 92971 - protein, 329 aa, Glycine max
  Coding DNA Sequence Number=SeqID_1286
  Gene Ontology: Mol. function=siderophore-iron transmembrane transporter activity; Cellular component=integral to membrane; Biological process=siderophore transport
  Homolog annotation: Hit_ID=Q47162; Match level="QueryCoverage=93%, HitCoverage=42%, E-value=1e-107, Identity=62%"; Hit description =Ferrichrysobactin receptor precursor
  Pfam annotation: Domain name=Plug; Domain location=74-171; Score =93.7; E_value=5.8e-25; Accession=PF07715.6; Description=TonB -dependent Receptor Plug Domain
MSEHPQNTANQPLRHPVAKLLLTSAMLLAPGVQAGTDNVERDITVVAGAQESVTAPLQGIVAKESAAGTKSAAPLVKTPQAITVVTRDQMDQQDAASVAQALRYSSGVVAEYRGTSNRSDEVIVRGFRYAPKYLDGLSYQSGQIDPWLLERVEVVRGPASVLYGQANPGGLVAMTSKRPVAQAIRKLQLSAGNLHQGEAAFDFGGALDEDAKLLYRLNGIAGTKETGIKDHKENRFAIAPALTYIANEDTTFTLLTSYQKEPENGYRNFLPTSGVAIKSSAGYLPYDFNVSDPGFNQARREQTSFGYIFEHYINDVFSFQQNMRYTTVG

SEQ ID NO: 92972 - protein, 98 aa, Glycine max
  Coding DNA Sequence Number=SeqID_1287
MASVETSAMVRSQILLNAYGTDAFYEYGSPGNCPLLRYNIRAAWCPTYAFKKVTQTLRRFDKVRGSRRNPCMMQMQKAQHGDVHSTTISINNYKQRRT

SEQ ID NO: 92973 - protein, 42 aa, Glycine max
  Coding DNA Sequence Number=SeqID_1288
MVIFHHGDAAEHKGEEVRGAKLTSLRSFLEKLGLSYTHPSNS

SEQ ID NO: 92974 - protein, 85 aa, Glycine max
  Coding DNA Sequence Number=SeqID_1289
  Subcellular localization annotation: CTP_CleavageSite=53; ConfidenceScore=5.64e-01
SWLLHLPLPPPPPPPPSDASASPSTVKRTRKASCLRSLSTRPPGAERPVVHVDPATGKADGPHRKKLRTYLGIVACDKVDVTYEN

SEQ ID NO: 92975 - protein, 91 aa, Glycine max
  Coding DNA Sequence Number=SeqID_1290
  Gene Ontology: Biological process=transposition, DNA-mediated
  Homolog annotation: Hit_ID=Q1J7G7; Match level="QueryCoverage=36%, HitCoverage=47%, E-value=1e-11, Identity=96%"; Hit description =Transposase
MVKVGTSYVPINVSFSPKVGPGLSRYQQGHQDLFILRSDLPSQVLQWLLFLSAVPPVQLLTGWCVTAKAPPDISAGKCSGHAARNHHTRRA

SEQ ID NO: 92976 - protein, 110 aa, Glycine max
  Coding DNA Sequence Number=SeqID_1291
MKKKIDPSLLRNFINTLTHELIGVRISIMEENHKRILKSLGVTNATQLVTSRPTVHQMKNGRRKVKRKELTKEELKKAYIAWDDNDSSDGSEKEINLLTKDYESDENISQ

SEQ ID NO: 92977 - protein, 193 aa, Glycine max
  Coding DNA Sequence Number=SeqID_1292
MDNEEGVQEQMKADLSALKDQMASITEAMLKLQKTLEDNATATASNTVREAEPVLQPAINLGRDRNTTVFGRRYSPRAYPYGLPLDFTPRAAPEDVSQAPTFRGQLPPYADYPLQEDDEGDAHLGLPLPLKDPAPHELPQPNIVRHVPSSPAPVKESVPFAEDKGKIDSLEERLRAVEGLGNYPFSDLADLCL

SEQ ID NO: 92978 - protein, 164 aa, Glycine max
  Coding DNA Sequence Number=SeqID_1293
MEIIISIPQINCDFCRREHYKENCYLYSTNNSGWRQEFNPYNHYEEERAPDLESVFKEFMAYHASSKANQNSMQNHEIHFGKSYSLEDHQREPELQTYHQKEAERGFNMDNLLMQFKDTIESIQRAFKSTEIQVGKLVEEVTQAVGRREEEFVEVEAQEESPVN

SEQ ID NO: 92979 - protein, 115 aa, Glycine max
  Coding DNA Sequence Number=SeqID_1294
MEEGNKHTRVFILVRQQPVPTSSPQATCGPSDFFQPCKNPFTSKDPQGMEWEESKEFSDCVVLNSLTREKGDTKEFRRLVICSFGKGRRETQKEFRRLLLGEFFLAKGEGNEKDE

SEQ ID NO: 92980 - protein, 76 aa, Glycine max
  Coding DNA Sequence Number=SeqID_1295
MVFHLRLVMSFKTKKGKHRLKGLSKGLIQASTRIKPRLLCKQSMGKNTPNDYDDGSNSHKGKLITSKLSFQNYHDM

SEQ ID NO: 92981 - protein, 319 aa, Glycine max
  Coding DNA Sequence Number=SeqID_1296
  Gene Ontology: Mol. function=motor activity; Cellular component=cell projection
  Homolog annotation: Hit_ID=P15305; Match level="QueryCoverage=90%, HitCoverage=78%, E-value=3e-18, Identity=23%"; Hit description =Dynein heavy chain
KGGPLGTSTLTLRGLHALAIRGLHVLTFRGLHVLASRGLHVLTFRGLHVLTFRGLHVLAFIGLHALTFRGLHILTFRGLHVLPFRGLHVLALRGLHVLAIRGLHALTFRGLHPLTFRGLHVLTLRGLHALAFRGLHALTFRGLHGYTSSPSEDYTSPPSENCTSSLFRELHALAIRGLHVLTFIGLHTLTFRGLHILIFKGLHVLAFVGLHALTFRGLHVLAIIGLHALTFRGLHVLTFRGLHVLAFRGLHALAIRGLHVLTFVGLHTLAFRGLHVLAFKGLHVLAFVGLHVLAFVGQHALTLQRATRPHLQRTARRRL

SEQ ID NO: 92982 - protein, 255 aa, Glycine max
  Coding DNA Sequence Number=SeqID_1297
  Gene Ontology: Mol. function=motor activity; Cellular component=cell projection
  Homolog annotation: Hit_ID=UPI00016621D1; Match level="QueryCoverage =89%, HitCoverage=43%, E-value=2e-16, Identity=34%"; Hit description =UPI00016621D1 related cluster
GLHVLTLRGLHVLSFVGLHALTFRGPHVLTFRGLLALAIRGLHVLTFRGLHALAIRGLHVLTFVGLHALTFRGPHVLTFRGLHALAIRGLHVLTFRGLHALAIRGLHVLTFVGLHALTFRGPHVLTFRGLHALAIRGLHVLTFRGLHALAIRGLHVLTFVGLHTLTLRGLHVLANRGLHALTLRGLHVLANRGLHTLTLRGLHVLANRGLHALTLKKTTRPRQRRAARLHLEEDYTSSPTEGCTPSPPEDYTSSP

SEQ ID NO: 92983 - protein, 80 aa, Glycine max
  Coding DNA Sequence Number=SeqID_1298
MTFFLSYTKAKAELRAHSRHMIKDPNGQIVDNCHVKLLAKVGEDPTVNEGWTAFLLRQLHVASSRSFIKRLLQEASPWLL

SEQ ID NO: 92984 - protein, 59 aa, Glycine max
  Coding DNA Sequence Number=SeqID_1299
MLGIGSTFGRPPVLGWNWLCDSDLVSPTGIERVLTEKDLLADAYSDLEASILDAHPFSY

SEQ ID NO: 92985 - protein, 96 aa, Glycine max
  Coding DNA Sequence Number=SeqID_1300
MVLGKPWSLTTSLKKSFEIWDASSTLWHGIKCAILLKLIHHYKDRVYTSLGSREPKDKVHTNVYPGADGMGLVYPKVAHEPTLMALLHNNFLMVPW

SEQ ID NO: 92986 - protein, 36 aa, Glycine max
  Coding DNA Sequence Number=SeqID_1301
MSNAISRPSGPKMYEKPHRRRAELVDLGSSTGEDKK

SEQ ID NO: 92987 - protein, 131 aa, Glycine max
  Coding DNA Sequence Number=SeqID_1302
MYPLQFSCEVESECVGGIFVHVLRKKRQQSYDPINLETLDDHIDWEIEESPPFLTNEETYALSKDLSNMTIQLGPLNLDDEDDLEDAQGNTMKNMNLNESNVDEAIMEDSLFFNEEGVLEYDNDITYAPWS

SEQ ID NO: 92988 - protein, 111 aa, Glycine max
  Coding DNA Sequence Number=SeqID_1303
MADSKGTTSTSISRKEVSDRIAKGLCRFCGDKWDKNHRKKCNVWGVDGDPVLRGTRIWATWEYVSSVEELICAIARSPPSTTYDGVVPGDMSRGSGDLGDVRWGAIAQNQA

SEQ ID NO: 92989 - protein, 96 aa, Glycine max
  Coding DNA Sequence Number=SeqID_1304
MTVPKLEKIKRQDETNKKQGFVLYRNRKPSWKIPLRLKGSSQCGVSMENNDGLWWLMVAVGDGKSVWDVRNDFGRKKREEMMFFLSYTKAKAEMLK

SEQ ID NO: 92990 - protein, 133 aa, Glycine max
  Coding DNA Sequence Number=SeqID_1305
MLCIENIDNRWIQLFEYLAPVGQICVVPGQCAADYMEWFYMIFQPFMSPTQLGDPPRHPSVMHNDTFVELDIPQHPVVATTMDTAPVDAPGHAEQPRHVLEACQEIVERLERLFNLRIVTKDEGDVWKTHEDI

SEQ ID NO: 92991 - protein, 74 aa, Glycine max
  Coding DNA Sequence Number=SeqID_1306
MVVVVATTTIGGIVVEAVHDNDNGGDIMVVAVAAAGIVWCGDGGGGIVTMEVATMGCGGSGSGMVALEVTTTMW

SEQ ID NO: 92992 - protein, 143 aa, Glycine max
  Coding DNA Sequence Number=SeqID_1307
MVVPKVSTENYGGSWWLLVVVGGEEEAWDIGEGFWKKERESNGCFPRLHEKKRFSHTRRHCRSQRSDHGHLPYEPPDQISRRSNVSAALSPSLVASKGVAAGVASGVSSGDAYGVAFGSGCGSWGVGASPPPAGEGWTLGQAT

SEQ ID NO: 92993 - protein, 113 aa, Glycine max
  Coding DNA Sequence Number=SeqID_1308
  Homolog annotation: Hit_ID=A7Q2X5; Match level="QueryCoverage=47%, HitCoverage=6%, E-value=1e-15, Identity=70%"; Hit description =Chromosome chr12 scaffold_47, whole genome shotgun sequence
  Pfam annotation: Domain name=DUF1296; Domain location=60-111; Score =63.5; E_value=7e-16; Accession=PF06972.2; Description=Protein of unknown function (DUF1296)
MVLNCSNKIDCSVGVLGGIEDAGEPKSAAIRELREETRIVSTEIIAKFAKMSGAGFRASIPSSVRRTIQNIKEITDNHNEENVYAMLKECSMDPNETTQKLLLQGRDFDLESY

SEQ ID NO: 92994 - protein, 42 aa, Glycine max
  Coding DNA Sequence Number=SeqID_1309
MRRGGSLQSTWDPWPTSAQDIPTPAQDAPSPPQDDPVPAQED

SEQ ID NO: 92995 - protein, 169 aa, Glycine max
  Coding DNA Sequence Number=SeqID_1310
MASMGASCSSFGFDCVRCLRNKPIIQLTSRTKKHPDKIFWLYVECNEDRRCKFWIWDDDLVKQLNQGCTSSLEVNPYLSQVEELKQKLIAVEEKLAFHEDRIHVYDGQIQELKKMVAKEEAYCQGYATGVEELQKKLAKQQMKTNIRGYATGVEEPQKKLAKQQMKTNI

SEQ ID NO: 92996 - protein, 99 aa, Glycine max
  Coding DNA Sequence Number=SeqID_1311
MASSRALYIDANLKEQLSGKECQKEKDMTKSNGKDPLEGHGGPMTRARARKAKEALQQVLSILFEYKPKFQGEKSKGPIGNLGISLLGDQMVADLLAVG

SEQ ID NO: 92997 - protein, 69 aa, Glycine max
  Coding DNA Sequence Number=SeqID_1312
MKGKKELVLWVLQKVRGGGGQQQQWWRKILCASSMILSFDEVLMNFNRRFVVTMASNSGGGGRSFALLR

SEQ ID NO: 92998 - protein, 104 aa, Glycine max
  Coding DNA Sequence Number=SeqID_1313
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=64%, E-value=3e-11, Identity=53%"; Hit description=LacZ protein
MKGPKFNPTIDRPAAAKNITKNHADWTERSPAAIAHPPFASWRNSEEARTDRPSQQLRSLNGEWDAPCSGALSAAGVVVTRSVTATLASADVRRCFLPLRTTRQ

SEQ ID NO: 92999 - protein, 204 aa, Glycine max
  Coding DNA Sequence Number=SeqID_1314
  Gene Ontology: Mol. function=nucleotide binding; Biological process =defense response
  Homolog annotation: Hit_ID=A2Q4E5; Match level="QueryCoverage=74%, HitCoverage=17%, E-value=2e-30, Identity=43%"; Hit description =Disease resistance protein
MEKSSEQQEAKGSYRQDKKKQLSVREEEEEEATQWTKLPIHSIIVSFGFKGFDMQDFATFHCVKSLLLDVTNFPELETLFVQDCVNLDLDLWKDHHEEQNPKLKLKLVGFGDLPQLVALPQWLEETANSLHSLFMMNCDNLEMLPEWLSTMTNLKARTISDCPKLISLPDNIHHLTTLEYLYIDGCLELCKKYHPHVSEFWSKI

SEQ ID NO: 93000 - protein, 201 aa, Glycine max
  Coding DNA Sequence Number=SeqID_1315
NYEDKRDKEEKLEKQKKKKDSKALSSKAKGKEKEEKDSSKKIVKKENHYPTKGDIKRALLLKQSFYLLLSRETSLSTTISLELEGLVHKSLNPCALLVPKIGIMRHRISMIVGMMNVMSGATLFCKISRASNIFMINIHRDSLGSDQGVPTNPKRIKVIPEWPTPPSVEGRSPKFQEPLDLRSNPFQGGGNDAILPPKGIG

SEQ ID NO: 93001 - protein, 147 aa, Glycine max
  Coding DNA Sequence Number=SeqID_1316
MVEREMVTMMVDTLPVFYCEKLVGYMPSSFADLVFAGERIEVGLKRGKFDYVSSTGTNARRIEATGAKRKEGDTYAITSTPTWIKPLQISHGTHQYAQHYPSFSACAGDSSNSAAVQPRALAPIQREAPKLRLQPRLARPAMPTLAS

SEQ ID NO: 93002 - protein, 163 aa, Glycine max
  Coding DNA Sequence Number=SeqID_1317
MASGFHVLKLCNSSLASDRDGAAQLIHDRVEMECLEGVWETLEGNTRCRFWGTIQFTATSLVHPDEPARTLQRTMEWILPTPTPYRLVEPVQVIEVTSSEEDPEEDPEEIPSEPAVDALDFLQGDEDPLPEVDSPEDVMSASKPDSTEDSGPGEMAISGGSSS

SEQ ID NO: 93003 - protein, 142 aa, Glycine max
  Coding DNA Sequence Number=SeqID_1318
RTDHRLCQSFGVTVAPTKRQAQGDAPQAAGAPPPPHQAGQAGAFDMEQYLRHLVRQQAANHRAHVQTHDCLYQMSLSMQSQGFASFSCPTPDQFRAEVAWPGDWPEAQAGEAPPEAPGDGEEAHEDEEMADLLDFLGGSGDT

SEQ ID NO: 93004 - protein, 95 aa, Glycine max
  Coding DNA Sequence Number=SeqID_1319
MDMNVGYLISHEISIIPQHDSSRLGFPTLITALCKARGVTSDSRSLESLSPAINLAFIKKNCWNLDDPTVTFRGPRKVRGKRSEAPTTSAALETI

SEQ ID NO: 93005 - protein, 111 aa, Glycine max
  Coding DNA Sequence Number=SeqID_1320
MGSNQTPRLKKRFYQVKIKSLEDASLLKLGQLMGQLQRQAFRKAYGKIWDLATIEVPVEVIASLTQYYDQPLSTFEDFQLVTTVEEFEEIMRCPLGGRKPYLFSGFYPLHG

SEQ ID NO: 93006 - protein, 72 aa, Glycine max
  Coding DNA Sequence Number=SeqID_1321
MRNDCLVQFSILNPFSEPMNCVFVHASSTHEFGAMRSDCLVQFSILNPFSEPHEFRFRSCVPTSLQPCVVIA

SEQ ID NO: 93007 - protein, 162 aa, Glycine max
  Coding DNA Sequence Number=SeqID_1322
MPWVKHPRHYMKGLRAYRGFSKEAQNIPWWFQSQKRCKDKLKLPRNKHRIMVTSRKITKVMEKVLGMLEMVLEERRRRKWRFSKATRKAKVETLKCFCSRERKPSSDARHCIRDRNGHIVDIYQMNPQTKFREDPTVNEGWEAFLPRQLHVACLRSFIKRLS

SEQ ID NO: 93008 - protein, 109 aa, Glycine max
  Coding DNA Sequence Number=SeqID_1323
GKTIGVNVEDDDSYMDTYVSPLTAQITPNIVGEEEADDRHRSPKQIALCISEAEPLEHTKKRDTGHQSVSLENKTGDSIVLKIVNSDKVVIKQDMKGRRHKYGFNNNKR

SEQ ID NO: 93009 - protein, 78 aa, Glycine max
  Coding DNA Sequence Number=SeqID_1324
TCKGLLQVSGTLKRVAWGLDVGTKREYISCGSVQVEGTSTWLFKENKGGYIPCGSLACKGFYKVERNLKNRWLLGDWM

SEQ ID NO: 93010 - protein, 140 aa, Glycine max
  Coding DNA Sequence Number=SeqID_1325
MGSFGEESWQWEFSWRRNLFDNELGSASDFIEQVTALSPNAALKDYWVWGADPKGIFTTSTAYLCIKGHQHNLHQGPSPSTSPNKNDMEVKDDDYQDLAKELGVFFADDKSSGTKLKTDMDNTENSPKSAAVLGNEDNGS

SEQ ID NO: 93011 - protein, 44 aa, Glycine max
  Coding DNA Sequence Number=SeqID_1326
MEIEEPWLGLWLPLNYRVDMGASEHKTLGIGVNSTGFLAAKFIS

SEQ ID NO: 93012 - protein, 211 aa, Glycine max
  Coding DNA Sequence Number=SeqID_1327
VGIEEVKDADAPVPVSTDEVNLVGQTLNTFLVWPTHLVKHLSEHGVVGPTKLVDRPDHEVLWDATVFGVFNQDFPLYIKHEDLSEIAHGGQCLNISVIQLWILLLTETSIRAGNFDVYGFLEPQSIQRSGQSTHWQMVIILPKKNLVVWFCSLHNSALKGPYDTPQSKSKAGARWIVVKCNKQEGSTECGYYVMHWMSSIILGSFRNNWKT

SEQ ID NO: 93013 - protein, 403 aa, Glycine max
  Coding DNA Sequence Number=SeqID_1328
  Homolog annotation: Hit_ID=Q1QUY3; Match level="QueryCoverage=98%, HitCoverage=71%, E-value=3e-44, Identity=30%"; Hit description =Putative uncharacterized protein
MPQEKKVNHLSIFLIKQQFTTNHQVIKIEDCDAPVEVAIAGHGAGQLFVKKNPPLPPKWSALFNEFINPKSLAVEGVAAAFFVKIDERCFVLVFGQAGRFLLRDDVIEERFGLLCALNAVDPKTFRCVDVQSLNAIESHMRIQSGQETTPDQFGLSVEQDMLKAIVGAPKNPILGNRMAGSDALAVSVKLDLSDLPFLLDQYRRLFEAELNAEDYQWVNNISTTKSAAVISVLENALEAKMAAGQFDGIWLSIPEIIEWTMVKGFMYSPYGGGILHPDINMEGFRGTVDGPITLEVLRARHVHCADADHKKVFKSWSVFKCLYAEIELNGVTHVLNDGKWFSIAKDFVERTNHDYAAIPPSNIKLPEYQGGGEGAYNAQVAALEPAIYDLLDDKKKVMHGGGH

SEQ ID NO: 93014 - protein, 280 aa, Glycine max
  Coding DNA Sequence Number=SeqID_1329
  Homolog annotation: Hit_ID=UPI00006A2939; Match level="QueryCoverage =88%, HitCoverage=96%, E-value=1e-10, Identity=29%"; Hit description =UPI00006A2939 related cluster
MSKSCGFGMTGPLDESISCFLIRVDPWVLVPITLRGLHVLALRGLHVLALRGLHVLALRGLHVLTIRGLHALTSRGLHVLALRGLPALALGTSYPHLQRATCPHFQRTACPHFQRATCPHFQRTAWLHALTFKGLCVLTFKGLHVLTFRGLHVLTFVGLHALTFRGPHVLTFRGLHALAIKGLRVLTFRGLHTLAIRGLHVLTLVGLHALTFRGLHVLANRGLHALILRGLHVVANRGLHALTLRGLHVLANRELYALTLRGLHVLANRELHALTLRGLH

SEQ ID NO: 93015 - protein, 40 aa, Glycine max
  Coding DNA Sequence Number=SeqID_1330
MRDSSRFPFMVGDTINGKLDESLILEVVADGGKRNVLGFE

SEQ ID NO: 93016 - protein, 135 aa, Glycine max
  Coding DNA Sequence Number=SeqID_1331
MEGYTWENKMKNKEIKENSPNKKIEEAKEHHLDEDALIPHDVSFVGACRPGIFFINGVLCFLRSDCSGMEKEKDDCSGRRRKRERRRHFKEKMSLEEAHHHRRPWIRAWRKKEMNEGRGKEEHEILCFKRALKSE

SEQ ID NO: 93017 - protein, 489 aa, Glycine max
  Coding DNA Sequence Number=SeqID_1332
  Homolog annotation: Hit_ID=O49432; Match level="QueryCoverage=92%, HitCoverage=93%, E-value=1e-150, Identity=61%"; Hit description =Putative uncharacterized protein AT4g20050
  Pfam annotation: Domain name=DUF1565; Domain location=126-318; Score=- 110.8; E_value=0.094; Accession=PF07602.2; Description=Protein of unknown function (DUF1565)
MATISRMWFIFLGITCFYVTYSYGENMPQRTLSRGTHQEALLGLKALKASITRRDSIASTPPSFSPSPTPSPLPPQEIKKPHVYLVTSYGADPTGNSDSTEALLAAIADAAKGPSEGFLMKDIKDLGGAQINLEGGKYIISQPLKLPLARAGNLMIHGGTIRASNLFPPDGHLIDLSTSGESNSYNYEYITLKNLLLDSNFRGGGIAIKNSLRINIDNCYITHFSTTGILVQSGHETYIRNTFLGQHITAGGDKHERDFSGTGISLQGNDNAVTDVVIFSADIGILVTGQANTLSGVHCYNKASGFGGTGIYLKLPGLTQTRIVNSYMDYTNIVAEDPVQLHISSSFFLGDAGIVLKSVKGVVSGLNIVDNMFSGLNKGVDIVKLDQSNSHFNQIDQVFVARNVVRGMNLKATAAKMSLLGNGTSWTADFNKVLLFPNLIKHVVYSLSASGNTFPNHALRNVSQNRVVIETDEAVNANVFVTVDQGNAS

SEQ ID NO: 93018 - protein, 46 aa, Glycine max
  Coding DNA Sequence Number=SeqID_1333
MGEEEKKPEENKAEEEEKKEEEKKPEESKDEKESKEESTLPEMGIL

SEQ ID NO: 93019 - protein, 488 aa, Glycine max
  Coding DNA Sequence Number=SeqID_1334
  Gene Ontology: Mol. function=translation initiation factor activity; Cellular component=protein complex; Biological process=translation
  Homolog annotation: Hit_ID=A7PAB0; Match level="QueryCoverage=77%, HitCoverage=87%, E-value=1e-154, Identity=72%"; Hit description =Chromosome chr14 scaffold_9, whole genome shotgun sequence
  Pfam annotation: Domain name=PCI; Domain location=345-447; Score =77.0; E_value=6.1e-20; Accession=PF01399.18; Description=PCI domain
MEGQYQLREARVCKRHGRQKVCKVASDCGRDRHERVECENCACKINWADLDTHPVIFFLFCAALSLAVTETMTTVVPTSEEDAALSVVRFASELAWADAGPEPTSPGGIRPLFFVLRDKVAEPQVSRLCMEAEEFIVMGKWLELASLMITSAELVFSKVSETDIESIFTIICNLVTKTENPDEVMEIVKVITAKIIQQPNEKPAVRLKTLINLYNLLETPYCQFYVYMKALNLAVNGKVTEYIIPSFKKIDSFLKEWKIGIPEQRELFLTISNILKENKSMSKDAFKFLSNYLSTFSGEDAHVLSEAKEEAARAIVEFVRAPDIYQCDLLDLPAVGQLEKDAKYALLYQLLKIFLTQRLDAYLEYQAANSTLLKNYGLVPEECISKMRLMSLMDLTSDGSGQIPYELIRDTLQINDDEVELWVVRAITAKLIDCKMDQMHQSVVVSLCHSGHMDLHLLAIVIVFRVRYPILLKIHLAIMHDLITNGKH

SEQ ID NO: 93020 - protein, 117 aa, Glycine max
  Coding DNA Sequence Number=SeqID_1335
  Gene Ontology: Mol. function=helicase activity
  Homolog annotation: Hit_ID=Q8SBB7; Match level="QueryCoverage=69%, HitCoverage=7%, E-value=3e-10, Identity=40%"; Hit description =Putative helicase
  Pfam annotation: Domain name=DUF889; Domain location=1-116; Score= -83.9; E_value=8.7e-06; Accession=PF05970.5; Description=Eukaryotic protein of unknown function (DUF889)
MWHMRDNMTNPHGGSESPILSHENDGYATIEIPAHLLIIEYDDLISAIVKSTFPDLHQHHNNPQFFKSRAILASTNETVEQINDYALSFIPAEIILGKNIGHSVYIPRISMSPSQSP

SEQ ID NO: 93021 - protein, 89 aa, Glycine max
  Coding DNA Sequence Number=SeqID_1336
MEPVVYLNHDKQQLMVNDRPILKGMTENFTLSSVTEGHGHFLEVNNSAHVVSLEVLSCLSFTASFRRDRWYMARETGDWGDLKWDVLEK

SEQ ID NO: 93022 - protein, 47 aa, Glycine max
  Coding DNA Sequence Number=SeqID_1337
MEKFNRLLPKTSALVQLPTVVSGDYIGKEEEKEADGGVVDAAGHGHG

SEQ ID NO: 93023 - protein, 279 aa, Glycine max
  Coding DNA Sequence Number=SeqID_1338
MTPFVCFFSVILLHVKAKVLDLIKEHGRMLIAKNEYSIVPFAKRLSDIRKVNFGCLFIFMVFVKKVFPEMAFTLVIHHNGTFSMVRHLHYIETDKDAIYNQDVDTWSYFEAMVVVHELGYSKENFKLWWKKNDECFEDGLKLIIEDQQTLELAKYAIDHNVEVHMYVQHIPHAEVEILEHMGWGNDGQDVGGNAEMVDGDGVVSDVDMQHLANEGSIDQGDVHAVDDHVVGAVDVVENGEVHDQKVVVDEDVADQGDVLIVDDHVVGVVDVAKKGEVHD

SEQ ID NO: 93024 - protein, 416 aa, Glycine max
  Coding DNA Sequence Number=SeqID_1339
MKNKKVVVAGVSLSEAHVVSEQHPLSETLARLASEENLEENLPRMHVLSTPSARPARQKTLLKAEVGKIKEEHIQEHREKNRGEKQSKEAKNLSFQEDSRTCKRNLQDSGTLKRVAWGLDVGTKGLTVFGVVALVCLVPPVRFVQVGLGVYFALVVLLFGEEHGMKRYLGIEILDLDGYSRKFVHELSEGLVVFLSLIGQGGRGHAVRPVTDDLCTESFDKGVEAVYAPRKTSRCSFGSVVSSYRLRLSGFHPKGMSASKIWSTKRCRRTICALRCMWERLKSSAVLPMCWGCDFPWVRSGEPLAGHGQHLALSTLPPGVAPSKQCSFGVVVVFVFVIDRVLTMGECERIDEKPQEWMWLSEVLNFTRRLESKYMLSGARMRERGRGRHKGYCSLVDNSLELIDNVRDKHLPIDKR

SEQ ID NO: 93025 - protein, 59 aa, Glycine max
  Coding DNA Sequence Number=SeqID_1340
MAHRGPREILPYWSNKFGSLHLIILWSGMMDNDFFIDNAVFNSDKKEMYELLFLYVNVM

SEQ ID NO: 93026 - protein, 221 aa, Glycine max
  Coding DNA Sequence Number=SeqID_1341
MDLEPTQPATPPEKKQVSGHIQKGPFMLNLLDFSAAFRKENRGKELCQGRAMLALMSLRGVARCTQQYCWCTQQFIETTSNCFFFSPGTASSSLPEPASSSLLCEASSLRGAPRLSSSSPRTDERGEDETTPKKMAEKADGGVFRKTRYGFFRKFRKNIFRKVSGRSVLPEITKRLPEEHFFRKLSGRSGSSGRTFKFPEELSGRSGSSGTIPEDPLLPES

SEQ ID NO: 93027 - protein, 423 aa, Glycine max
  Coding DNA Sequence Number=SeqID_1342
  Gene Ontology: Mol. function=phosphoglycerate kinase activity; Cellular component=chloroplast; Biological process=glycolysis
  Homolog annotation: Hit_ID=A7PT69; Match level="QueryCoverage=99%, HitCoverage=69%, E-value=1e-126, Identity=56%"; Hit description =Phosphoglycerate kinase
  Pfam annotation: Domain name=PGK; Domain location=5-372; Score=-19.7; E_value=1.6e-19; Accession=PF00162.10; Description=Phosphoglycerate kinase
MVRFDSNILLRRECDKKNQSVYNATYTIKYLHEAGANVILVSDWNMNTPEFHIESVADFVSEVLQIQVVPLHGSSFNKLSKTNGLEKENILLLENLSNIKEEVANSLEFARVLSSGVDIFVNDSFSNSHKVLASTVGVTRFCYVCIAGFHFEERLCLLKNLAEESRKPYVAILGGGNLYDKAASFQFLASRCQGFVFVGMMSFQVMHALGVSVPRNLVDHKAFNEALDIVRLARDRNVQILYPKDFWCRKKCDPTQLQVFPSHEISDGWVPVDLGPASLEEICSMLTNCKKIIWIGPVKFTDSSKYTYGASKLTRILEQLSQNSCEITVVGTMASKLVRQEKSSLSLINMVENASVLWEFLKGRKLPGVMAVDRLILVFHFNHADKSDLALSNGYPFEINWNSIYSDPAQSLVVDIGSGIFSF

SEQ ID NO: 93028 - protein, 337 aa, Glycine max
  Coding DNA Sequence Number=SeqID_1343
  Homolog annotation: Hit_ID=A2Q533; Match level="QueryCoverage=32%, HitCoverage=35%, E-value=8e-08, Identity=32%"; Hit description =Putative uncharacterized protein
MKLTMQLLLLHTRNGLKVLVQSIPQMPRETIGSANDVVVTIFNGEKFLRNLRSENVIEKTMPNDYSIGTGSRGGGREELLFAEAIFRSKDLTELFDTIKKFREKRERGKAERPPSATDTSVAERFRFAAGAAAIAVARGRAARFLERFFAPLLRSLHLFLLHPSSSFPSCASARHSVEDVFSGEEAGAGDDVVVLVREGSEGAMERALEVVEVADYGERWWTWWEDTTCPLCGDVQEEVGHLFFNCEKIVGLWWESMSWIQAKGPLAVSPVDHFLQFCDGFGAVRNHSTCCGWWVALISTIWKHRNFLIFQNKPFEPQKVMEDAMFSIWSWLKARQK

SEQ ID NO: 93029 - protein, 401 aa, Glycine max
  Coding DNA Sequence Number=SeqID_1344
  Gene Ontology: Mol. function=caspase activity; Cellular component =cytoplasm; Biological process=proteolysis
  Homolog annotation: Hit_ID=Q6XPT9; Match level="QueryCoverage=89%, HitCoverage=93%, E-value=3e-67, Identity=42%"; Hit description =Metacaspase 3
  Pfam annotation: Domain name=Peptidase_C14; Domain location=106-378; Score=130.9; E_value=3.8e-36; Accession=PF00656.13; Description =Caspase domain
MASRQVRCNQCGSLLMVSAETRVVECTVCHGMTQIRPSITGAWSEVVYNSFHQFGGRLRSFANTIMPGSGSVNNSNPRGYYGTPQIAYYPPPPQSLRPSYNAYGPKRAVLCGICYHGKDNQLNGTVNDVKNMNIFLVKECGFPRESILILTDDMEERNPQKFPTKYNILKAMRWLIEGSQSGDSLVFQFSGHGCQELDTNGDFDELDERDEAICPVDWEKQGIILDDDINAAIVRPLPYGAKLHAIIDSCNSGTVLDLAYVWSQRDTWDYQYGGPDKDTSGGLAICISGCGDYQSSKEIPVLSGGGGGNAVTGVFTYSFIYTMLNEPAGLSYGGLLSSMRSTIRGMLNNPNASLFNTDFTLAPRQMFTLTHILTRNYFSLNTRNYGYFLSILAKIFLDDVG

SEQ ID NO: 93030 - protein, 288 aa, Glycine max
  Coding DNA Sequence Number=SeqID_1345
  Gene Ontology: Mol. function=protein kinase activity; Cellular component=plastoglobule; Biological process=protein amino acid phosphorylation
  Homolog annotation: Hit_ID=A7PI63; Match level="QueryCoverage=51%, HitCoverage=18%, E-value=1e-61, Identity=78%"; Hit description =Chromosome chr13 scaffold_17, whole genome shotgun sequence
MACSIFDFRPKFALMRVSKKPRQDNGKPDHTIHLSVIVPFELKTNPVEAFFSKLSQQSVWLLCFINHTLTVPRVVLHPSSRRGLIGPRDVALRSVAVPRNEADERAQEAQERALEFERDLCLLEQELIKYKQQNESICLPRFLDFGLLCQMDKRHQLAMLASIIHIVNGDWASLVRALVDMDVVRPGTNIRLFTLELEQALGEVEFKEGIPDVKFSRVLGKIWTVALKHHFPMPPYITLVLRSLASLEGLAIAADTNFNTFEAAYPYVVRKLLTDNSAATRNILHWVL

SEQ ID NO: 93031 - protein, 61 aa, Glycine max
  Coding DNA Sequence Number=SeqID_1346
MPMFDQFHPCIHDFIENIVDVKDDGIGEDSWSLVHNHLLKELAKWSDEYMNLLGGIDRFEE

SEQ ID NO: 93032 - protein, 255 aa, Glycine max
  Coding DNA Sequence Number=SeqID_1347
MIRSCRGENPARTAAQQVQIAKGGVPIAEIKWAARRAALSARPRAKRPGIITLSLAHRLSGSKPSEEQHEERAKPLQVTGATTKRSLSRTVALSALNCISERAKRVRAALSACQQQRAGWRQARGWALGPPVLMASRKRRAVPTPGEASNWDTSRFTSEIAWHRYQDNIQLRNILPERNVELGPGMFDEFLQELRRRRWDQVLTHLPEKRIDVALVKEFYSNLYDPEDHSPRFCRVRGQVVRFDADTINDFLDAP

SEQ ID NO: 93033 - protein, 344 aa, Glycine max
  Coding DNA Sequence Number=SeqID_1348
  Gene Ontology: Mol. function=hydrolase activity; Cellular component =monolayer-surrounded lipid storage body; Biological process=lipid metabolic process
  Homolog annotation: Hit_ID=Q9LF16; Match level="QueryCoverage=97%, HitCoverage=95%, E-value=1e-131, Identity=68%"; Hit description =Lipase-like protein
  Pfam annotation: Domain name=AXE1; Domain location=12-327; Score= -225.2; E_value=0.1; Accession=PF05448.3; Description=Acetyl xylan esterase (AXE1)
  Pfam annotation: Domain name=Abhydrolase_1; Domain location=106-326; Score=51.9; E_value=2.2e-12; Accession=PF00561.11; Description =alphabeta hydrolase fold
  Pfam annotation: Domain name=LIP; Domain location=93-339; Score= -132.3; E_value=0.061; Accession=PF03583.5; Description=Secretory lipase
  Pfam module annotation: Pfam domain module=AXE1::Abhydrolase_1::LIP; Domain location=12-327::106-326::93-339
MGIPGVDGELKKILNANMDEVGARRRAREAFKDIQLGIDHILFKPKGILGRGVLTPCDGIKMEESYEKSSKGLEIFCKSWLPSASKPKAAVFYCHGIARKLASSGYAVFAMDYPGFGLSEGLHCYIPSFDGLVDDVIEHYSKIKENPEFHSLPSFLFGQSMGGAVALKIHLKQPKAWDGAILVAPMCKIADDMVPPKFLTHILIGLANVLPKHKLVPNKDLAEAAFRDLKKRELTAYNVIAYKDKPRLQSAVEMLKTTEEIERRLKEVSLPLFILHGEADTVTDPSVSKALYENASCSDKKLQLYKDAYHGLLEGEPDEIITQVFGDIISWLDEHSLKHNQSSS

SEQ ID NO: 93034 - protein, 217 aa, Glycine max
  Coding DNA Sequence Number=SeqID_1349
  Homolog annotation: Hit_ID=A7PAQ8; Match level="QueryCoverage=79%, HitCoverage=100%, E-value=4e-46, Identity=58%"; Hit description =Chromosome chr14 scaffold_9, whole genome shotgun sequence
MLGGEGQASGIEGSLGEKEGVGWGPGALNGLEGAFYCGKKVILKMNCYGLQQNAFAACEEMRGSVNFVDQKEPVICPKPRRVGVASNMPTRHFRWHFNPQAEGSDTKAGAELLEIMFKKESHGQEYANQVASSPPFFCGSPPVRAANPLVQDAHFGDEKHCPSLLISSPSGLLSPSSASRKGGCVRMTFGLKPAAVRVEGFDCLNKDCQNSRITVVA

SEQ ID NO: 93035 - protein, 53 aa, Glycine max
  Coding DNA Sequence Number=SeqID_1350
MGTINDPERSQAMSELVVKAERKAFQALDHSADNDDVEGNWFKEVEVIGFVKK

SEQ ID NO: 93036 - protein, 381 aa, Glycine max
  Coding DNA Sequence Number=SeqID_1351
  Gene Ontology: Mol. function=oxidoreductase activity; Cellular component=integral to membrane; Biological process=electron transport
  Homolog annotation: Hit_ID=A7PAQ2; Match level="QueryCoverage=93%, HitCoverage=69%, E-value=1e-150, Identity=71%"; Hit description =Chromosome chr14 scaffold_9, whole genome shotgun sequence
  Pfam annotation: Domain name=p450; Domain location=44-380; Score= -85.5; E_value=1e-08; Accession=PF00067.13; Description=Cytochrome P450
MAMVILTTLLVIFVTVLLKVAYDTISCYWLTPMRIRKIMERQGVHGPKPRFLIGNIIDMTSLVSRAVSQDMKTINHDIVGRLLPHFVAWSNQYGKRFLYWNGTEPRLCLTDTEMIKEFLSKYSTTSGKSWQQQQGTKHFIGRGLLMANGEEWRHQRHMVAPAFMGDRLKSYAGHMVECTKDMLQSLQNALEVGQSEVEIGECFTELTADIISRTEFGTSYQKGKQIFYLLTQLQSRVAQATRHLFFPGSRFFPSKYNREIKSMKMEVERLLMEIIESRKDCVEMGRSNSYGNDLLGILLDEIKKEGGTLNLQLVMDECKTFFFAGHETTALLLTWTAMLLASNPHWQDKVRAEVKEVFKGEIPSVDQLSKLTLVSTFFGFI

SEQ ID NO: 93037 - protein, 183 aa, Glycine max
  Coding DNA Sequence Number=SeqID_1352
MPCLKNVFHCLFGPWQQKINEGYSNLALKGVKYMKSFVTSEESFKGFKDKYVFLRPTKNVWNDLFEVEPSGENKYRSWFPLYWSYTHYIEKAKAYVVKEEDLNPEEKDAKKGLNICLTKSGFISLRKRLKPVAKAKAVVTTKAPAFDCSSKSGYAHEKRIPPISSPSKRQKHNANRLTSIVIV

SEQ ID NO: 93038 - protein, 170 aa, Glycine max
  Coding DNA Sequence Number=SeqID_1353
MKGRAWIPEFIVAMTVACLLFGIGSVVDAVDVTVVVGIPPDGVDVLNSDIESGESSEPELSELPAVPSRSGRTILMTLVLGTSYATHEWNCDIVMAEWTKRMRNINMRVVAIDKICIVAKKSLHAFGLPMNDTSIKLNVFSDDPVTCTKPLGGCNEMLTTNVTMNAAQHM

SEQ ID NO: 93039 - protein, 226 aa, Glycine max
  Coding DNA Sequence Number=SeqID_1354
MQLRDFIVPVVARPIVEVEVQEALGDDDSVDLSTKALGLLPIVAHELVVEDVVGESRAVLDVAIYEEESIVSLIVTSRRHFGSKVSSCLIATTRLHQGESLPQRTLSPSLSTHCSQLHPHLRLSPRQRVFCALAAHSVISRALRVDIATSSPFLVPIRRHLALTTVWSAVIATYLAVNVRGSREALPQFRDQYTLGVYDDQLDGSSDLRIIKKGGGGGGELMINVS

SEQ ID NO: 93040 - protein, 113 aa, Glycine max
  Coding DNA Sequence Number=SeqID_1355
MPIATSKRTYGMETFVFHIIPITIKHETPPECLNQFQQHPCNATIEIHLNWSIDKPLSGCQMITILLEHRQGSNNGRGQFVRVMVNQEGCSQSIIAKASAPLPTTSMVDSPWP

SEQ ID NO: 93041 - protein, 718 aa, Glycine max
  Coding DNA Sequence Number=SeqID_1356
  Homolog annotation: Hit_ID=A7PAL1; Match level="QueryCoverage=36%, HitCoverage=49%, E-value=8e-52, Identity=42%"; Hit description =Chromosome chr14 scaffold_9, whole genome shotgun sequence
  Pfam annotation: Domain name=DDT; Domain location=463-525; Score =14.7; E_value=0.0084; Accession=PF02791.8; Description=DDT domain
  Subcellular localization annotation: CTP_CleavageSite=17; ConfidenceScore=5.30e-01
MAITAISNSSQNMNEVAAGGVKPKRSNSRGVRIVGSRIYDSANGKTCHQVLFFFEILRIPVSFFLVFLRCGVCWFVESAKSECGVESGCGNCVKKGNCGGWGYFEVCLDDNIFVCLVFTLKCRQKTRDFAVSCMGRRQKRWSSWVIGCVQNVETFATAVFAAKASGFKSVSEMLVSKTAESNDLESNKVNRVFPSKEATEVKKQKRVNKSSSDKVPVSKAVSPMKQIASDKELVVLLSGEIGKENSSDGKLDPVISQKASTKKSKKTKREELKEISNENNVESAGKKKSLKRPKICKVPSEEAKGKANDETKVCNGVSKKETKVDRKHDTAHILMDSPEAQAANDLLLFGKYAKGNPFSEVQPQMHKNPDTIFEDPANDPIVPVTVAPKHYLFNSKHPDMKHMHGENWNNTVLVDGNAGAKFQVGIATFPSIGMNLVVEKIEEEIPLPPGTELTEILDTELPPEDVGNALQLLEFCRVFGKALDLKKGEAEAILRELVRKQNLRRGQNTLVVQFQIRVLTLILTDSGNESPSLTTSNGNNSWLKPLEDLIAGSDHILKDFPLDWLQEGVGGYYNLDLSKKLTLLNFLCDEALITDKLRSCIEDQNSRHAEEVKEAKNKIAAAKEKEKGLRQKLQNEMVKAVLSNAAPLRMEKHDALLKMMKSEVAQAHAVVLKLKGTIPKGLKFFNLILMSEYLADGTKFCHLEDYPCCKQVIINTGK

SEQ ID NO: 93042 - protein, 101 aa, Glycine max
  Coding DNA Sequence Number=SeqID_1357
MAQPGFYNLRVLGRDEFVEVNGKRVVVDEVVSDDLVVVTGFTEKEEMVLKAKVGDDAIIGDDGATTGVKDLEMCYDKWGSGATERMSGRLQIESERGSVKS

SEQ ID NO: 93043 - protein, 69 aa, Glycine max
  Coding DNA Sequence Number=SeqID_1358
MENKMKNKELSQLTKQKDRGSKRTSHEDALIPHDVAPCGALEWRRKKDDWRRHFKEKMSQEEAHHHRKP

SEQ ID NO: 93044 - protein, 110 aa, Glycine max
  Coding DNA Sequence Number=SeqID_1359
MPFSIKGKRNPNGVEEEDAWVGKNKLKQGLKRAQKNTTRRLGLVRQAFSGRTAARGLHASELARTGVSRAPQGAPNPGFAGRYGGWRQLVVDNGGWWQTVADGDQNGYPL

SEQ ID NO: 93045 - protein, 365 aa, Glycine max
  Coding DNA Sequence Number=SeqID_1360
  Gene Ontology: Mol. function=nucleic acid binding; Cellular component= spliceosome; Biological process=mRNA processing
  Homolog annotation: Hit_ID=A7PAL0; Match level="QueryCoverage=88%, HitCoverage=41%, E-value=5e-68, Identity=48%"; Hit description =Chromosome chr14 scaffold_9, whole genome shotgun sequence
  Pfam annotation: Domain name=PSP; Domain location=106-152; Score =75.4; E_value=1.9e-19; Accession=PF04046.7; Description=PSP
  Pfam annotation: Domain name=zf-CCHC; Domain location=46-63; Score =20.7; E_value=0.0011; Accession=PF00098.14; Description=Zinc knuckle
  Pfam module annotation: Pfam domain module=PSP::zf-CCHC; Domain location=106-152::46-63
MLCMYGLGVGFISQAAYGSRLCCVFFSQLTSASWHIVGLEIIDAAARCFNCGSYNHSLRECPRPRDNTAVNNARNKHKSRRNQNSSSRNPTRYYQNSPAGKYDGLRPGALDDATRQLLGLGELDPPPWLNRMRELGYPPGYLANFITYVWSLDVDDEDQPSGITIYTDREIADQEDGEIMEADASKPKRKKTVKFPGINAPIPDNADERLWGTRAGPSSSDISRNLSLPQHRSNYSTDYGSRGYHREHRLGDLRDDGPPGDPGHSSSKFSFHPRFGGHDSALRSPSMARSQSDRSRSPMHDEESPMPFSFHSLHYSSSERHFSPLDPDSGRPGSRTSESMYYDRDRDLSSRVKDRPDDRHHRSWR

SEQ ID NO: 93046 - protein, 173 aa, Glycine max
  Coding DNA Sequence Number=SeqID_1361
SQCFPSSCMRVELMTSLATERYKSRGAPGLSQLKISDVAMVFLKAKKASSQFSSYGVKVLLLGLAGLSSIGKSSIDGDDHGMQYYLKIEISDLDGYAPKYIHELSKGLVLCLSQIGQGNQGHARRPTSGVLCTESFNKGVKAVYRPSVRKVYKCLSGSVVSSYHLRLCGFHPQ

SEQ ID NO: 93047 - protein, 33 aa, Glycine max
  Coding DNA Sequence Number=SeqID_1362
MGIMASNEIPKAGRLSDGPTGPGMFCPAGCLGG

SEQ ID NO: 93048 - protein, 87 aa, Glycine max
  Coding DNA Sequence Number=SeqID_1363
  Gene Ontology: Mol. function=homoserine dehydrogenase activity; Cellular component=chloroplast; Biological process=aspartate family amino acid biosynthetic process
  Homolog annotation: Hit_ID=O63067; Match level="QueryCoverage=89%, HitCoverage=8%, E-value=3e-32, Identity=88%"; Hit description =Aspartokinase-homoserine dehydrogenase
RVLLYTKYHNVKPGVSLEEKKLPKGETWSVHKFGGTCVGTSQRIKNVADIILKDDSGRKLVVVSAMSKVKNMMYDLIHKAQSRDELI

SEQ ID NO: 93049 - protein, 691 aa, Glycine max
  Coding DNA Sequence Number=SeqID_1364
  Gene Ontology: Mol. function=receptor activity; Cellular component =cell septum surface; Biological process=cell separation during cytokinesis
  Homolog annotation: Hit_ID=A0EJF3; Match level="QueryCoverage=91%, HitCoverage=92%, E-value=0.0, Identity=78%"; Hit description=Beta -glucan-binding protein 4
  Pfam annotation: Domain name=Glyco_hydro_81; Domain location=67-690; Score=887.1; E_value=8.5e-264; Accession=PF03639.4; Description =Glycosyl hydrolase family 81
  Subcellular localization annotation: CTP_CleavageSite=56; ConfidenceScore=5.68e-01
MLKKLRRKVSTALTSGFKKGSKPDKNTTFKIKTPSPPRSPSTPLPPLLSPPRRLTMSHTRKHSPFLFPNVDSTVVPDPSNFFSPNLLSNPLPTNSFFQNFVLKNGDQPEYIHPYLIKSSNFSLSLSYPSRFFNSSFIYQVFNPDLTISSSQKSHLSHLNHTISSHNDLSVTLDIPSSNLRFFLVRGSPFLTLSVTQPTPLSITTIHAILSFSSSESLTKHTFHLNNGQTWFLYASSPIRLSHGLSEITSDVFSGIIRIALLPDSDWKHEAVLDRFSSCYPVSGEAVFARPFCVEYKWEKRGWGDLLMLAHPLHLQLLADSGCEDVSVLSDFKYGSIDGELIGVVGDSWLLKTDPVSVTWHSVRGVREESRDEVVSALVNDVEGLNSSAIATNSSYFFGKLIARAARLALIAEEVCFLDVIPKVRKYLKETIEPWLEGTFNGNGFLYDRKWGGIVTKQGSTDAGADFGFGIYNDHHYHLGYFLYGIAVLVKIDPVWGWKYKPQAYSLMADFMTLSRRSNSNYTRLRCFDLYKLHSWAGGLTEFGDGRNQESTSEAVNAYYAAALMGLAYGDTHLVAIGSTLTALEIHAAQMWWHVKEEDNQYDEEFGKENKVVGVLWANKRDSGLWFAPPEWRECRLGIQLLPILPISEVLFSNVDFVKELVEWTLPALHREGVGEGWKGFVYALLGIYDNE

SEQ ID NO: 93050 - protein, 246 aa, Glycine max
  Coding DNA Sequence Number=SeqID_1365
  Gene Ontology: Mol. function=receptor activity
  Homolog annotation: Hit_ID=Q9FVN5; Match level="QueryCoverage=99%, HitCoverage=41%, E-value=5e-77, Identity=58%"; Hit description=Beta -glucan binding protein
  Pfam annotation: Domain name=Glyco_hydro_81; Domain location=1-246; Score=-358.4; E_value=0.016; Accession=PF03639.4; Description =Glycosyl hydrolase family 81
MSGEAMFREPFCVEYKWQKKGSENLLLLAHPLHLMLLSNRDSGITVLGDFKYISIDGDLVGVIGSSWILKIDPVVVTWHSTKGVKENSCDEIVSALCKDVNGLNSSIITTTSSYFYGKLVGRAARLALIAKEMSYLDMIPKVSKFLKETVEPWLEQKFDENMDFYMIKNGEAILPKKVLTKLDPAWGRKYKPQVYSPVQDFMNIDTKSKPKYTWLGCFDLYVLQYSWAGGLTEFTNGRNQESTSEV

SEQ ID NO: 93051 - protein, 131 aa, Glycine max
  Coding DNA Sequence Number=SeqID_1366
EIVQAEDFYQHMEQRGHGMYYTPPTFAQYPSQMYQYPFEGHDTDMSASKHSFGGVAETQPHFSWPTMTPSQQHDAPMAISNAPLGQQWDVPGAIHAMGDLLGVDLRHEFSAEAEEQGRRQRARRNPDRQAR

SEQ ID NO: 93052 - protein, 105 aa, Glycine max
  Coding DNA Sequence Number=SeqID_1367
  Homolog annotation: Hit_ID=A5AV98; Match level="QueryCoverage=48%, HitCoverage=6%, E-value=3e-12, Identity=72%"; Hit description =Putative uncharacterized protein
MSVLIFNELNFSDWSEQVQFHLGVLDLDLALQVEKPAAIIGASSNEEKTHYKVWESMLVQEETRLKNQGNHSIHYVNNQGVGKKVNKKHGKDKGSLRIVESSTKI

SEQ ID NO: 93053 - protein, 64 aa, Glycine max
  Coding DNA Sequence Number=SeqID_1368
MGLGRLMVTLKSKIRSLKILKKPDYDKVEKSESMRMEIRSRKARKLIEETLKGMSQILCVIDKE

SEQ ID NO: 93054 - protein, 463 aa, Glycine max
  Coding DNA Sequence Number=SeqID_1369
  Gene Ontology: Mol. function=binding; Cellular component=anaphase -promoting complex; Biological process=cell division
  Homolog annotation: Hit_ID=A7PEI4; Match level="QueryCoverage=100%, HitCoverage=62%, E-value=1e-161, Identity=63%"; Hit description =Chromosome chr11 scaffold_13, whole genome shotgun sequence
  Pfam annotation: Domain name=TPR_1; Domain location=39-72; Score =24.9; E_value=0.00029; Accession=PF00515.19; Description =Tetratricopeptide repeat
  Pfam annotation: Domain name=TPR_1; Domain location=392-425; Score =1.5; E_value=3.5; Accession=PF00515.19; Description=Tetratricopeptide repeat
  Pfam annotation: Domain name=TPR_2; Domain location=39-72; Score =27.2; E_value=6e-05; Accession=PF07719.8; Description=Tetratricopepti de repeat
  Pfam annotation: Domain name=TPR_2; Domain location=392-425; Score =4.1; E_value=9.2; Accession=PF07719.8; Description=Tetratricopeptide repeat
  Pfam module annotation: Pfam domain module=TPR_1::TPR_1::TPR_2::TPR _2; Domain location=39-72::392-425::39-72::392-425
MAQSRYLFAISCFHMDLLSEAEAALRPADEPGAEVPNGAAGHYLLGLIYRCTDRRKNAIQHFKQALSMDPLMWAAYEELCILGAAEEATVVFGEAAAFCLQKQYLNCSTSPNSHMSPEHSNEVAARPCMSEEASPRQLKQMQSLKDIATYHHGASILGGAAGQPINSSSSNMSYYNTPSPMVAQLSSVAPPPLCRNVLPNGQNLTTLSTDSSPKSTVNSPIQAPRRKFVGEGKLRKISGRLFSDSGPRRSSRLSSDSSVNTNANSTVVSGNGTNNSYKGGSKLNHMAFRTMAIRKGQSWANENIDEDDSSLNRTSINSCSSPVIEAKSYEQEAATFHIGGQVTSGSKVITGTSEILTLLRVLGEGYRLACLYRCQDALDTYLKLPQKHYNTGWVLSQVGKAYFELVDYLEADCAFSRARQITPYSLEGMDIHSTVLYHLKEDMKLSYLAQELISTDRLAPQSW

SEQ ID NO: 93055 - protein, 55 aa, Glycine max
  Coding DNA Sequence Number=SeqID_1370
MWCLHQQDRGRRERVVVMVGDKPSDAVEWGPEMVVTGEGGRARRIYNKSAFLRLI

SEQ ID NO: 93056 - protein, 62 aa, Glycine max
  Coding DNA Sequence Number=SeqID_1371
  Homolog annotation: Hit_ID=Q9FKR1; Match level="QueryCoverage=98%, HitCoverage=95%, E-value=1e-08, Identity=54%"; Hit description =Pollen coat protein-like
MDSQNMSNNAGQAKGQAQEKANTVMDKASNAAQSAQESLQEPLKAKAQGAADAVKNATGMNK

SEQ ID NO: 93057 - protein, 96 aa, Glycine max
  Coding DNA Sequence Number=SeqID_1372
  Gene Ontology: Mol. function=metal ion binding; Cellular component =integral to membrane; Biological process=defense response
  Homolog annotation: Hit_ID=Q84KA9; Match level="QueryCoverage=98%, HitCoverage=28%, E-value=2e-13, Identity=40%"; Hit description =RING/C3HC4/PHD zinc finger-like protein
MLPMLLVIFLFALLFTAFCSIFIRYCSHEEQPQALPQATRVLATCPVTSYSAVKMRTPQNPAFQCAMCLAEFNDADDALHLLPKCGHVFHAHCIDA

SEQ ID NO: 93058 - protein, 329 aa, Glycine max
  Coding DNA Sequence Number=SeqID_1373
MVLEDKLKSCQRSKRSLTEQLRKTEENMLIIIDQYKEKVNLTTSHGQMLEDEQAKESLTEQLRKTKENMLIIIDQYKEKIEREAREGVIELLHKEAMKWMNRFALTLNESQELPRLLARAKAMTDTHCRHQKVIIVTKKNECALRHPYQTRDKARIMSKIKELQEQMKADMEVMKDQITTMMEAMMSMRKMMEVNAAAVATTSTAIEVREAKYWEVWAAPILRRSRASILPPHMACLPTRHHPMLYMCLMRTSTTPLLYPLRANNLSLGMHRSLNPWGRHMKYPETTLWPTSSLTPDMSLRGKHLVAYPSQTPWGGPQYRLQPQLQPFY

SEQ ID NO: 93059 - protein, 120 aa, Glycine max
  Coding DNA Sequence Number=SeqID_1374
  Gene Ontology: Mol. function=peptidase activity
  Homolog annotation: Hit_ID=A5AR53; Match level="QueryCoverage=79%, HitCoverage=27%, E-value=4e-46, Identity=90%"; Hit description =Putative uncharacterized protein
MSFQYFYAEYYGVVVDGSFRVALLLPTECNTYADIDAAYKCLKEQYGVKDEQLILYGQSVGSGPTLDLASRIPELRGVVLHSPILSGLRVLYPVKRTYWFDIYKNIDKVGAVKCPVLVIH

SEQ ID NO: 93060 - protein, 146 aa, Glycine max
  Coding DNA Sequence Number=SeqID_1375
MAESNPHPSAPLPFLHLLLLRIQSLRSSLIQTSCCRGINYANEAVQDSGTVNPAYTTREIQDQMLLTWLQSSLCRSILSRLLESVHAFQVWEKIHNHFQKLTKAKTCQLRTELRCTTLNNKSVSKFLLRIKALVDDVLASVEDEIT

SEQ ID NO: 93061 - protein, 36 aa, Glycine max
  Coding DNA Sequence Number=SeqID_1376
MKAPNDGKGNDAPEFELRNEDPLDRFGECKQYSRRI

SEQ ID NO: 93062 - protein, 301 aa, Glycine max
  Coding DNA Sequence Number=SeqID_1377
  Gene Ontology: Mol. function=DNA binding; Cellular component=nucleus; Biological process=regulation of transcription
  Homolog annotation: Hit_ID=Q70KC5; Match level="QueryCoverage=96%, HitCoverage=97%, E-value=3e-38, Identity=36%"; Hit description=MYB transcription factor
  Pfam annotation: Domain name=Myb_DNA-binding; Domain location=22-80; Score=31.2; E_value=3.9e-06; Accession=PF00249.22; Description=Myb -like DNA-binding domain
MRKPYMMEKDKMNNNIKSKLRKGLWSPEEDEKLLRYMITKGQGCWSDIARNAGLQRWSQIAARLPGRTDNEIKNFWNSTLKKRLKMNNNINATSSPNNSYSSSEPRDVNVMGGIMPMNEHDLMTMCMDSSSSTSSSCMQSMHTTNMVLTDQFDPFPLLSNNRYDMTGATDFLDNMAACLTQVGMVDHDHGVVHDGYGTLEPNKTGLESDFSLPPLESRSIDDNSSTPIDHVKSHNNNNHFKNSCFNNTDHHHHIQCSNNVVVEDLFGFGNHGHGESFRMEEWDFEGLIQDIPYFSSLDFQV

SEQ ID NO: 93063 - protein, 108 aa, Glycine max
  Coding DNA Sequence Number=SeqID_1378
  Gene Ontology: Mol. function=protein binding
  Homolog annotation: Hit_ID=A7PBD9; Match level="QueryCoverage=41%, HitCoverage=5%, E-value=1e-11, Identity=64%"; Hit description =Chromosome chr16 scaffold_10, whole genome shotgun sequence
  Pfam annotation: Domain name=LRRNT_2; Domain location=65-103; Score =42.6; E_value=1.4e-09; Accession=PF08263.3; Description=Leucine rich repeat N-terminal domain
MVKSSSRRLLRLMRYRRRLGSTVEKCNTLSNSKSQPNVRKLLDIIYVAIGTAKVVVSAQDQIMCIQREREALLEFKAALVDHHGMLSSRTTADCCQWEGIRCSNLTGH

SEQ ID NO: 93064 - protein, 123 aa, Glycine max
  Coding DNA Sequence Number=SeqID_1379
KYIALQICDDEDVEIMIQSFEQQQEMSVIELCVEVDVAGASAINLTNSLLSCGNNMSHNESSSATVGTNSEEDFDDDDYLISNSYVDDSLDEDEDIDEMSNTDDEAARLIEPFEMSDTYYVLQ

SEQ ID NO: 93065 - protein, 96 aa, Glycine max
  Coding DNA Sequence Number=SeqID_1380
MEMAIGSDFPNSRSKSGDLHPFNPEIDKTFHRQSRNNRSRSVVVLDSVVVHDNVVLDNSVMHTEFIVDSISDFVPELVFIASDSRKNSVGIMADNN

SEQ ID NO: 93066 - protein, 512 aa, Glycine max
  Coding DNA Sequence Number=SeqID_1381
  Gene Ontology: Mol. function=sulfate adenylyltransferase (ATP) activity; Cellular component=cytoplasm; Biological process=sulfate assimilation
  Homolog annotation: Hit_ID=A7NSX7; Match level="QueryCoverage=95%, HitCoverage=95%, E-value=0.0, Identity=75%"; Hit description =Chromosome chr18 scaffold_1, whole genome shotgun sequence
  Pfam annotation: Domain name=ATP-sulfurylase; Domain location=146 -503; Score=583.2; E_value=2.7e-172; Accession=PF01747.8; Description= ATP-sulfurylase
  Subcellular localization annotation: CTP_CleavageSite=38; ConfidenceScore=5.45e-01
MSLSLAIKLHLASSSPSFSLLTLNNHQHANKLTTSETCSNTKVRPKPIYSTNPLIIPTCKVRPRVQYCGTMIKSSLIEPDGGALVDLVVPEGERGAKITLAESLPKVQLTRIDLEWVHVVGEGWASPLKGFMREDEYLQSLHFNSLRVKDGSVVNMSLPIVLAIDDETKERIGSSSHVGLLGPDGDCVAILRSPAILVATLRFLNSVTAIRATLAAFVPCIEIYKHNKEERIARTWGTTAPGLPYVEEVITPAGNWLIGGDLEVLKPIKYNDGLDNYRLSPKQLREEFDKRQADAVFAFQLRNPVHNGHALLMNDTRKRLLEMGYKNPILLLHPLGGFVKADDVPLDVRMEQHSKVLEDGVLDPETTIVAIFPSPMHYAGPTEVQWHAKARINAGANFYIVGRDPAGMGHPTEKRDLYDPDHGKKVLSMAPGLEKLNILPFRVAAYDTKVNKMAFFDPTRAKDFLFISGTKMRAFAKSGENPPEGFMCPSGWKSVKNTFLGVPIFMPGLPAS

SEQ ID NO: 93067 - protein, 378 aa, Glycine max
  Coding DNA Sequence Number=SeqID_1382
  Gene Ontology: Mol. function=peptidase activity; Cellular component =integral to membrane; Biological process=proteolysis
  Homolog annotation: Hit_ID=A9NV43; Match level="QueryCoverage=95%, HitCoverage=94%, E-value=1e-126, Identity=62%"; Hit description =Putative uncharacterized protein
  Pfam annotation: Domain name=Abhydrolase_1; Domain location=96-307; Score=-11.9; E_value=0.048; Accession=PF00561.11; Description =alphabeta hydrolase fold
  Pfam annotation: Domain name=Abhydrolase_2; Domain location=52-260; Score=-78.9; E_value=0.067; Accession=PF02230.7; Description =PhospholipaseCarboxylesterase
  Pfam annotation: Domain name=Peptidase_S9; Domain location=90-263; Score=-66.1; E_value=0.011; Accession=PF00326.12; Description=Prolyl oligopeptidase family
  Pfam module annotation: Pfam domain module=Abhydrolase_1::Abhydrolase_ 2::Peptidase_S9; Domain location=96-307::52-260::90-263
MGAVTSSMAAKFAFFPPDPPSYTVAEEAEGRARMAEVALRENVDVLKVRTERGNIVVAMYIKNPTASLTLLYSHGNAADLGQMYELFSELSIHLRVNLMGYDYSGYGQSSGKPSEQNTYADIEAVYKCLQEKYGAKEEDIVLYGQSVGSGPTIDLASRLPNLRAVILHSPILSGLRVMYSVKRTYWFDIYKNIDKIPLVNCPVLVIHGTADDVVDCSHGKQLWENCKQKYEPLWIKGGNHCDLELYPQYIKHLKKFITVIEKSPHQKTGSDLIPDQLDKPRNSIDFREKSRLSMDQKENLKSIDQKEKPSASTDRKEKSRASVDRRDKSRNSIDHPEKSFNGSDIPEKARNSIDRFGEMVRSVGLCNIDCFRPTATHA

SEQ ID NO: 93068 - protein, 171 aa, Glycine max
  Coding DNA Sequence Number=SeqID_1383
  Gene Ontology: Mol. function=peptidase activity
  Homolog annotation: Hit_ID=A5AR53; Match level="QueryCoverage=79%, HitCoverage=38%, E-value=1e-43, Identity=66%"; Hit description =Putative uncharacterized protein
MGSNTLELEFWLNSILQNWLSVMLTLLISVKGLMLGTADEVVDVSHGKQLWELCKVKYEPLWVSGGGHCNLELYPEFIKHLKKFVQTIGKSKATANGSKKDTVESENQGKASKESESGTSGTSELSTEIPEVSRNSLDSRLEKSKKPGKPEKSRMSTDHVDRFRRRKGLVW

SEQ ID NO: 93069 - protein, 477 aa, Glycine max
  Coding DNA Sequence Number=SeqID_1384
  Homolog annotation: Hit_ID=A5B5V0; Match level="QueryCoverage=48%, HitCoverage=51%, E-value=1e-09, Identity=24%"; Hit description =Putative uncharacterized protein
MAKYDPEIVMDFYANAWPTEEGVRDKRSWDFAQSMAGKQVRIMRTSMTTLMQIWMTLLLNNILSRDHNFDLPLPKCQLVYAILTQVSVHVAQLISDAIYQFAGITPLRHPVDSEKSNRALGFPALITGLCQFYGVSVTPTKLIRPPISRAFIEKYCMLKKAQQQQEEGQQQPAASAPSSPLQEETFDCYQVFQNSALIDFMTLKLPYFPELVKVFYTNLKIQDGILYSEVHNILIVIDRSLFYSLTKLPSQGVPFEGTLVNDWKFDYSSHDARRMVYNDQADMTGKLLARSLTFDCRIMHYIIVRILLPRSSKLAQASKEDLIMMWAFQTGCQIDWGHLVRYQMHKALRANVPLSYPHLATLFLHHFNVPLDDEPFFKVKRSFSIGVGAITSFGYRKDVDGQWVRKQDLSLPIPDERTPSPPPQRTDSTSLLTEVLTELRDLRAFVDERFDAMDTRITRLEDDMSFIRRCFNPPVNS

SEQ ID NO: 93070 - protein, 156 aa, Glycine max
  Coding DNA Sequence Number=SeqID_1385
MLRDALGLITQKVKPSGSKEPTGGKSGGGLNGCNGLGTWGGRNGVGGRKGFGGRNGIGGRNGIGGNWIGGRNGIGGRNGIGGKGKKFGFLVGLNENNPAENMCSPCFIALRLTREEVASEATEQCGSLLLINLKVHPLILFACFHTLNGSFTLNSP

SEQ ID NO: 93071 - protein, 113 aa, Glycine max
  Coding DNA Sequence Number=SeqID_1386
MEKSPWPQQQMPSLYDRTTKLEETLAQFMQVLMSNQKSTESAIKNLELVAQPTSISRSRAKHEISALSATVVLSRLNARLALSSNPLTCAKAWVALSATSQIRSLFKAYFVQN

SEQ ID NO: 93072 - protein, 275 aa, Glycine max
  Coding DNA Sequence Number=SeqID_1387
  Homolog annotation: Hit_ID=A2Q4S5; Match level="QueryCoverage=76%, HitCoverage=29%, E-value=1e-19, Identity=33%"; Hit description=IMP dehydrogenase/GMP reductase, putative
  Pfam annotation: Domain name=DUF1723; Domain location=153-202; Score =58.2; E_value=2.7e-14; Accession=PF08330.1; Description=Protein of unknown function (DUF1723)
MEFVVDICRSWQRVVAPATEDDPVIAVDVHDPVGEDDPVGDADEPMVAASAGADVYAPGADTRAEAGADEPEGFPGGPSDPSVLTEYAEHVAASVWTKEVFIIFNLSYLLKHPELKLSSHGRKVQKLGRSVPTIEGLVVGTGLSPLIACSVDTGDRRLISSFVERWHGETSSFHLPVGEVTITLDDMAPLLHLPIIGNFHTFQPLHVDEAVLMLVYLLLVSADATRVETGHCHGPYMLYVIVQSPTNASDRASSIKWRIISNWAWIRNWAEPTWT

SEQ ID NO: 93073 - protein, 83 aa, Glycine max
  Coding DNA Sequence Number=SeqID_1388
  Subcellular localization annotation: CTP_CleavageSite=44; ConfidenceScore=5.27e-01
MATQLNQAQSQNSDKLSLQTVQNQKNVSAITLRSGKKIEVPPPVAAPAPEPVKLHSTPEKEDELAAQKRKLLDYEGANKKFHA

SEQ ID NO: 93074 - protein, 55 aa, Glycine max
  Coding DNA Sequence Number=SeqID_1389
MKVEQLFAYHHTSEERKVPLATLSFQGYALYWWTSLVRKRMILGIPPVEYWNDLK

SEQ ID NO: 93075 - protein, 129 aa, Glycine max
  Coding DNA Sequence Number=SeqID_1390
MAICPNLKKGNAGIIENLSAKRQNPSMRMVMKPLKLINESTEAQTHVLAKQTYMEFDLGVTSTNGPKVNGGQLAGGGQPPTTMPMIEGSQSYVAPTPDDPQPAKEPSSVDSHNEVDRRLVIFVEEVDDP

SEQ ID NO: 93076 - protein, 22 aa, Glycine max
  Coding DNA Sequence Number=SeqID_1391
MMQSSVAGEDWKEKGDNKTQTQ

SEQ ID NO: 93077 - protein, 89 aa, Glycine max
  Coding DNA Sequence Number=SeqID_1392
MEALKETETSVCIVGNRKDFAEGAKNIEYFDETTLLLSTILWRWPPSRSPVARKRIEDGEVFPQMFVQAMGKSDPHAVRIEVFRLAQCL

SEQ ID NO: 93078 - protein, 53 aa, Glycine max
  Coding DNA Sequence Number=SeqID_1393
MASNIWSKSIRRKHKELLAHLDIWGPEYEAGKVKNGFLQSGYVLVKSRMQRLL

SEQ ID NO: 93079 - protein, 114 aa, Glycine max
  Coding DNA Sequence Number=SeqID_1394
MVSLVACMNVVMWDMLLWSESAGLEAIRFRLLCVSKVSGKATVIAAIVVRYTKKYADGGYTISGHIYREDNICADKLARFASSLNDFCWLNSAPIFIAAELNGNRIGLPNYRFS

SEQ ID NO: 93080 - protein, 182 aa, Glycine max
  Coding DNA Sequence Number=SeqID_1395
  Gene Ontology: Mol. function=sequence-specific DNA binding; Cellular component=nucleus; Biological process=regulation of transcription, DNA-dependent
  Homolog annotation: Hit_ID=Q3Y4G8; Match level="QueryCoverage=100%, HitCoverage=75%, E-value=2e-90, Identity=91%"; Hit description=MADS -box protein
  Pfam annotation: Domain name=K-box; Domain location=13-111; Score =154.9; E_value=2.1e-43; Accession=PF01486.8; Description=K-box region
MLKTLERYQKCSYGAVEVSKPGKELESSYREYLKLKARFESLQRTQRNLLGEDLGPLNTKDLEQLERQLDSSLKQVRSTKTQFMLDQLADLQNKEHMLVEANRSLTMKLEEINSRNQYRQTWEAGEQSMSYGTQNAHSQGFFQPLECNPTLQIGYNPEASEQQLAATTQAQQVNGFIPGWML

SEQ ID NO: 93081 - protein, 124 aa, Glycine max
  Coding DNA Sequence Number=SeqID_1396
MFATTFNTPPLAYNLAPSSSCYRPSLPIQIRDMGHEDEDKDEDNNNNNDKDDDNSGDHVPQQQRTITREHPRIRGGRDHRPRGQQTQTNPVQQDERQIQTNSVQQDERPRCISKRTPCGTSSHH

SEQ ID NO: 93082 - protein, 352 aa, Glycine max
  Coding DNA Sequence Number=SeqID_1397
  Gene Ontology: Mol. function=sugar:hydrogen symporter activity; Cellular component=integral to membrane; Biological process =carbohydrate transport
  Homolog annotation: Hit_ID=A7PAT0; Match level="QueryCoverage=72%, HitCoverage=48%, E-value=1e-103, Identity=79%"; Hit description =Chromosome chr14 scaffold_9, whole genome shotgun sequence
  Pfam annotation: Domain name=Sugar_tr; Domain location=1-348; Score =23.7; E_value=6.5e-10; Accession=PF00083.15; Description=Sugar (and other) transporter
MAAGLVTGKFFITTQNIGATLAIEAQPKMVCHVPACAREVHCLTKSGAQKKLQRRTTAASGKGGKSPDRGAASRKQPEKSLEKEKGLSESAGISATNRKQGKISEAEKAIKTLYGQERVAAVMNDLTTASQGSSEPEAGWLDLFSSRYWKVVSVGAALFLFQQLAGINAVVYYSTSVFRSAGIASDVAASALVGASNVFGTCIASSLMDKQGRKSLLITSFSGMAASMLLLSLSFTWKVLAPYSGTLAVLGTVLYVLSFSLGAGPVPALLLPEIFASRIRAKAVSLSLGTHWISNFVIGLYFLSVVNKFGISSVYLGFSAVCVLAVLYIAGNVVETKGRSLEEIERALSAST

SEQ ID NO: 93083 - protein, 112 aa, Glycine max
  Coding DNA Sequence Number=SeqID_1398
  Subcellular localization annotation: CTP_CleavageSite=64; ConfidenceScore=5.26e-01
MFGFSSGCDSLHQDRGSFHVHAKTKVISNTPTTPTIKGRIIGKLSNIQALLSKRAFCTLPSQTKANPKEEVNVVSTKSGRPMAKFKKKKKKPLHHQKKKALTEESQEVLTPP

SEQ ID NO: 93084 - protein, 337 aa, Glycine max
  Coding DNA Sequence Number=SeqID_1399
  Gene Ontology: Mol. function=oxidoreductase activity; Cellular component=cytoplasm; Biological process=flavonoid biosynthetic process
  Homolog annotation: Hit_ID=A7QVT7; Match level="QueryCoverage=94%, HitCoverage=92%, E-value=2e-84, Identity=50%"; Hit description =Chromosome chr7 scaffold_192, whole genome shotgun sequence
  Pfam annotation: Domain name=2OG-FeII_Oxy; Domain location=192-292; Score=141.8; E_value=2e-39; Accession=PF03171.11; Description=2OG -Fe(II) oxygenase superfamily
METLDQMLVSSWYNVHSLVPPSYVQLPENRPSKVVSSLHKAIPVIDFGGHDRVDTTKQILEASEEYGFFQVINHGVSKDLMDETLNIFKEFHAMAPKEKVNECSKDPNGSCKLYTSSENYKKDAIHYWKDSLTHPCPPSGEYMEYWPQKPSKYREIVGKYTRELKKLALKILELLCEGLGLNLGYFCGGLSENPSVLVHHYPPCPDPSLTLGLAKHRDPTIITILLQDKEVQGLQVLKDGEWIGVEPIPNAFVVNIGLLLQIITNGRLVGAEHRAVTNSSSARTSVAYFVYPSFGSIIEPAQALINGSTPAIYKSMRFGEFRRNFFHKGPKIEEELQ

SEQ ID NO: 93085 - protein, 112 aa, Glycine max
  Coding DNA Sequence Number=SeqID_1400
  Pfam annotation: Domain name=Dimerisation; Domain location=34-72; Score=10.7; E_value=0.0084; Accession=PF08100.2; Description =Dimerisation domain
MSLATVLMSSWMMLMWNGGLFSTLGMMIRFLLRALVKCAIELGIADAIESHKSPMTLSDHQLLEDRVTFLLASHATAAINVEAMLFKIILMMPKNQESSKFQESRSRFKIQE

SEQ ID NO: 93086 - protein, 139 aa, Glycine max
  Coding DNA Sequence Number=SeqID_1401
  Homolog annotation: Hit_ID=Q1KUQ7; Match level="QueryCoverage=61%, HitCoverage=40%, E-value=6e-11, Identity=48%"; Hit description =Putative uncharacterized protein
MVDISEVEAEQKMLEEAIKNSRERERRSLLRAMNKDKSKSSNSAPTDTKGNKVGQLFPNASLEDYAKLNRVNVGHDDGEICDDSEGEVCEDEDDNSDNEDCDEDGNSDDEDGDSENEDCDENDDKNDENTPDHTSANHE

SEQ ID NO: 93087 - protein, 178 aa, Glycine max
  Coding DNA Sequence Number=SeqID_1402
  Gene Ontology: Cellular component=anchored to membrane
  Homolog annotation: Hit_ID=Q69F97; Match level="QueryCoverage=89%, HitCoverage=34%, E-value=8e-88, Identity=89%"; Hit description =Phytochelatin synthetase-like protein
MVGVHTPKKDNEPLLQCTHHMCPIRVHWHVKTNYKDYWRVKVAITNFNYRMNHSLWSLAVQHPNLNNLTQVFSFNYKPLLPYGSINDTGMFYGMKYFNDLLMEAGPTGNVQSELLLQKDKDTFTFKQGWAFPRKVYFNGDECMLPPPDAYPFLPNSAPASLLNFPAFIFLLLFLLSVW

SEQ ID NO: 93088 - protein, 282 aa, Glycine max
  Coding DNA Sequence Number=SeqID_1403
  Homolog annotation: Hit_ID=A7QHJ9; Match level="QueryCoverage=14%, HitCoverage=3%, E-value=4e-09, Identity=76%"; Hit description =Chromosome chr5 scaffold_98, whole genome shotgun sequence
MSGKQRWVQFVECSNDINGLIDATKFVDLELLIDGSYGFEMVVEKMYASTFAKQLFHIHLGYGVHTEPRGAVDEGPTGVAAGAEGEGNPNRATRGGALESTRDATIANREYLSDYIEVRPKRILRNLGLGGKDTRFEYSFKPMLIPCGWGILAKQSNPDWSPYDGVTSDEVVVGFAPRAQEADPRRVPVPPEHLSRPQGGIRLRFAGPSLLYGALQGDAFHIAYGVKEEDHFSLQAVGTLNEKLLCGCNDVQLSMHVSLDLHHKLAKRRKHSNKLLELFEAF

SEQ ID NO: 93089 - protein, 102 aa, Glycine max
  Coding DNA Sequence Number=SeqID_1404
MLSMMHEPDLNSQMQCGTIHQGNSLSMSTRHSHLGKLGRKCRGHPVVHRQLPPSHGDKPESQGNSKPSNIPPSTRGDLSPEPWLTDSKKIGPEMQEKALGFS

SEQ ID NO: 93090 - protein, 110 aa, Glycine max
  Coding DNA Sequence Number=SeqID_1405
MVNGELVPKEWEGMKDDEKRKVQDDQKAKNILNSSLSSDEFFHIARKITKKVPIVKKRQSVATYPSAGGRRETRGMRVPRKEYARSRHQRLFEENVGKTGKDEIYELFSE

SEQ ID NO: 93091 - protein, 120 aa, Glycine max
  Coding DNA Sequence Number=SeqID_1406
  Pfam annotation: Domain name=zf-CCHC; Domain location=31-48; Score =13.6; E_value=0.013; Accession=PF00098.14; Description=Zinc knuckle
MVNKFGKFLKKSKDKKFSKSTKKIESNNNTFTCSECGKQGHIKCECPIYLRKQVSEKKGKNDRKQKKAYIAWEDNASTSSNSSSDEEVANKFWKHLMKCMKKLKGLCWTSGLNNLRGEEG

SEQ ID NO: 93092 - protein, 89 aa, Glycine max
  Coding DNA Sequence Number=SeqID_1407
ASSRSFIKRRIAHSRYLLKDPNGQLMDNCLVKLKTKFREDPTVNEGWEAFLPRQLHVAFSRSFIKRLPLKASSKSFPVASLRSFLKRLL

SEQ ID NO: 93093 - protein, 94 aa, Glycine max
  Coding DNA Sequence Number=SeqID_1408
MVTSILQRRKDARSHYQRALLRGARRGSQVRFSKEERCAESPPTFICGKRRENRRKPVKMKILSSGVVFTLEEGRQKRGSCSYVPSIKEEIRPT

SEQ ID NO: 93094 - protein, 99 aa, Glycine max
  Coding DNA Sequence Number=SeqID_1409
MEKTNNKVLWIVLNRRIMLMVVNMLMEILAIIVTNPYTLSLLRDPPIDVVIDNNLGTISLEKDGAVNNNEFVSPIVQQDLRIVSRLWVNEVEEEDIGTS

SEQ ID NO: 93095 - protein, 65 aa, Glycine max
  Coding DNA Sequence Number=SeqID_1410
MDDEELPSPVNSDVVKRSRIVLGDGQIPGQIQRQRPIKVNGNAATVCRAMSFPAFRYLGMDPSRG

SEQ ID NO: 93096 - protein, 313 aa, Glycine max
  Coding DNA Sequence Number=SeqID_1411
  Gene Ontology: Mol. function=catalytic activity; Cellular component =type II protein secretion system complex; Biological process =metabolic process
  Homolog annotation: Hit_ID=A4TQ43; Match level="QueryCoverage=94%, HitCoverage=96%, E-value=1e-62, Identity=41%"; Hit description =Transketolase subunit B
  Pfam annotation: Domain name=Transket_pyr; Domain location=1-167; Score=86.2; E_value=1.1e-22; Accession=PF02779.15; Description =Transketolase, pyrimidine binding dom
  Pfam annotation: Domain name=Transketolase_C; Domain location=177 -295; Score=46.2; E_value=1.2e-10; Accession=PF02780.11; Description =Transketolase, C-terminal domain
  Pfam module annotation: Pfam domain module=Transket_pyr::Transketolase _C; Domain location=1-167::177-295
MQDLRDAVVTALIEEQLAGADLSVMVADSTSTSKIAPFEQAYPERVVNVGIAEQNMVGMAAGMALSGRTVFTANAAPFLFARSNEQMKNDVCYTETNVKMLGLNAGFGYGPLGATHHCMNDIAIARTLGNLSVYAPADARQAAEIVRYVIAQPGPAYIRMDSDKLPVLNASYHFRPGEPEVLHQGSDSLVFCLGTVAHESMKVLELGDNPTIVSLPSLWPLNEAAVVALMRSHRRVLTMEEHALSGGLGTIIGELLLRHQLPRPFTALGVPAYEFTHSSSRAALRRQYAIDAAGLHAQLTPYGECDGAERIRR

SEQ ID NO: 93097 - protein, 122 aa, Glycine max
  Coding DNA Sequence Number=SeqID_1412
MTWLLSNILPVTAMPISPCRRITPTRHPVDPEEPNRALGFRTLVTGLCQSYRVPVTPTRSCHHDIGIALAGHPVDPKKSNRVLELPALITGLYQFYGVPIVPSKVIRPPTNQAFIKKYCASR

SEQ ID NO: 93098 - protein, 60 aa, Glycine max
  Coding DNA Sequence Number=SeqID_1413
PFAKRKPRAKCIFGHALSRESQALSTQPLHLRLIWSAKLAKDELGQLQFDLNLAKLHPDR

SEQ ID NO: 93099 - protein, 244 aa, Glycine max
  Coding DNA Sequence Number=SeqID_1414
LTKFVSADNGTYDVINAYLHRASASFNELNHLHKELGSCDSHNKHKTHRIENGNDSGKVVGNSIQSVDINKELSLRHVNFDQFKRQQSESRNADGENFSQQEEEENVDGVADGKHVSSWLGPDLVIGGLVILSSEFVNETKKALNGGLGAEKGLNFGRISGYMMRFHWKPLFDNEITMAVNFLKDVERSVIQQNGRDAWVWMADPSGSYSVQSAYKVMRGPIVDGIKDMAFEELWQLKIPTKYA

SEQ ID NO: 93100 - protein, 47 aa, Glycine max
  Coding DNA Sequence Number=SeqID_1415
MRGIVHEPQYPGLQRTTRPHHQRAARPYLQRTTCPRLERATRPHLGY

SEQ ID NO: 93101 - protein, 62 aa, Glycine max
  Coding DNA Sequence Number=SeqID_1416
MKVLKGYTKNQYRLEASIVERETIFVDNSASKTLRLFAVGPNLNVPSLKGYDINNYSFYMKS

SEQ ID NO: 93102 - protein, 151 aa, Glycine max
  Coding DNA Sequence Number=SeqID_1417
MKEMKREKHASYSRHNSCKSLSEELRDHYEGRHRSHLRPHSYRRENERKPQEASINLPYFHGKDNVETYLDWEIRVKQKVKRKSTLKSYGSHSYPKKDQGLGILGATPSKPKDDKGKTIEKQPPKASMQEKTTLTVLKDDKLLLNAPPRKS

SEQ ID NO: 93103 - protein, 72 aa, Glycine max
  Coding DNA Sequence Number=SeqID_1418
MAQAPQPLARIEPPAQQVEPNPGVVLEQFDQTVGTIKFDRFDGYESDRGNFSHDQHDVGKFDHVSVCFCPME

SEQ ID NO: 93104 - protein, 71 aa, Glycine max
  Coding DNA Sequence Number=SeqID_1419
MAGLKDSKVSESGTTPLVMHRAVIKAGKPSREELDWAICEIYPEMMEPKSMSIFITNPYTNLALSMFISEV

SEQ ID NO: 93105 - protein, 72 aa, Glycine max
  Coding DNA Sequence Number=SeqID_1420
MEMNMLAYLFWPFRTPAERSGDRSVIIVATCPSRASEGEAHECAFQKRKDARSRHPRLFVGNVGKIEGNRSK

SEQ ID NO: 93106 - protein, 68 aa, Glycine max
  Coding DNA Sequence Number=SeqID_1421
MTHYNPYPRKQKRKEGKFPIKEKAKRKERKFPIKEWEKAKRKERKFPIKEWEKEKSKARKFPTQEWEK

SEQ ID NO: 93107 - protein, 121 aa, Glycine max
  Coding DNA Sequence Number=SeqID_1422
  Subcellular localization annotation: CTP_CleavageSite=63; ConfidenceScore=5.57e-01
MTTTPPVLLKNGITGASGTPSVFWRKQPSSPGRAGRQPPPPFSYKKAEGGCSKDPSAPWLCISAILGEKNCFREENPSRGASVTLPRCFRKQIREGFRPFFTVLRSSTEQNLTDRSHYNLG

SEQ ID NO: 93108 - protein, 104 aa, Glycine max
  Coding DNA Sequence Number=SeqID_1423
  Subcellular localization annotation: CTP_CleavageSite=32; ConfidenceScore=5.28e-01
SFYINSFYLSSPSNTSNSSSSGSFFSELQAILLNAVEPTSGPTPDHAKLVECGPPAAGVQPSPLGGGEAYAAQEPQQDQENDIPETAEPTPPKAFTLESDPVVV

SEQ ID NO: 93109 - protein, 178 aa, Glycine max
  Coding DNA Sequence Number=SeqID_1424
  Gene Ontology: Mol. function=transcription factor activity; Biological process=regulation of transcription, DNA-dependent
  Homolog annotation: Hit_ID=Q13WH3; Match level="QueryCoverage=97%, HitCoverage=92%, E-value=7e-24, Identity=40%"; Hit description=Sigma- 24
  Pfam annotation: Domain name=Sigma70_r2; Domain location=10-74; Score= 30.6; E_value=5.5e-06; Accession=PF04542.5; Description=Sigma-70 region 2
  Pfam annotation: Domain name=Sigma70_r4; Domain location=118-167; Score=9.1; E_value=0.037; Accession=PF04545.7; Description=Sigma-70, region 4
  Pfam annotation: Domain name=Sigma70_r4_2; Domain location=112-165; Score=38.2; E_value=3e-08; Accession=PF08281.3; Description=Sigma-70, region 4
  Pfam module annotation: Pfam domain module=Sigma70_r2::Sigma70 _r4::Sigma70_r4_2; Domain location=10-74::118-167::112-165
MVQDSRLLAALGACRTKLSAFIRGRSERHDEAEDILQEISWKLLQVEQPVENVSAWLFRAARNEITDRSRKKRELSLFNAAGDEDFPEDEIAETLFGVAQTPEDEYLKTLLWEELDDALAELPAAQREIFEKTELLGFSYQDLAAESGDSVQALLSRKHKAVLFLRTRLRSLYDELTA

SEQ ID NO: 93110 - protein, 78 aa, Glycine max
  Coding DNA Sequence Number=SeqID_1425
MATRGGERKAEKKMEEHKHQLADELALEPVDDLVEHEEIVEEVEGDEEGEIPIKDSQERIKKEEKEKEKEKETKKGRK

SEQ ID NO: 93111 - protein, 124 aa, Glycine max
  Coding DNA Sequence Number=SeqID_1426
MERRRMIIICLCVPSDTIASGWQKGLPLDGEKVCGMTIICLRMTSGPPPLDDKWRRMTIICLCVPLDTIVSEWQKGPPSLDDKRRRMTIICLCVPSDTIVSEWQKGERNDHNLSTHVIGPAASG

SEQ ID NO: 93112 - protein, 179 aa, Glycine max
  Coding DNA Sequence Number=SeqID_1427
MEASLCIPGKGFILNTEGQPWKLLRKDLTTLAQTWSIFSYSNLAPTSRTSDLNTDRARSVYGLITRMDMNIGGLISGQMTMMAQPNSSRLGFPALITTLCRSRGVGSDALTSYENQRLAIDLAYIIRNCWNANDQTVNFPEARKTKLRAYHVPSSFALIAGIPASSTSAPLPALVDLSA

SEQ ID NO: 93113 - protein, 152 aa, Glycine max
  Coding DNA Sequence Number=SeqID_1428
  Homolog annotation: Hit_ID=Q1RU80; Match level="QueryCoverage=32%, HitCoverage=40%, E-value=8e-08, Identity=48%"; Hit description =Putative uncharacterized protein
MAETGQCGGPYAFRDLTLVGWYAWGAAGLVHMYDQLNDASLSTNRQLAGYITLLQYWIYEHFSSVAECNVDSDYDEVSSRACRWIAMKKTVKKMSAGRHMRRTDLCRTFIRFRASRDSSAGACCQIQTGEGYAPVQLRPVHSCTPYPFMGVI

SEQ ID NO: 93114 - protein, 93 aa, Glycine max
  Coding DNA Sequence Number=SeqID_1429
  Subcellular localization annotation: CTP_CleavageSite=65; ConfidenceScore=5.64e-01
MVAAQLAQASQVASSRSNSLLEESSAGPKNSVASSADIPFLLKPSSSLSNLPTGTSSFGTRLALSLSSTPAFAFPFGSLDRTDGSGATKIHPL

SEQ ID NO: 93115 - protein, 71 aa, Glycine max
  Coding DNA Sequence Number=SeqID_1430
  Gene Ontology: Mol. function=RNA-directed DNA polymerase activity; Biological process=RNA-dependent DNA replication
  Homolog annotation: Hit_ID=A5B5G7; Match level="QueryCoverage=88%, HitCoverage=4%, E-value=4e-12, Identity=52%"; Hit description =Putative uncharacterized protein
MEDKEKFPVIISASLAAEQEEKLLRDLKKHKKVIGWTLANIPGISPSTYMHRILLEDGAKPLVGESSPSGS

SEQ ID NO: 93116 - protein, 28 aa, Glycine max
  Coding DNA Sequence Number=SeqID_1431
MERYERPKLKLSSHGRKMAKFGRLAPEI

SEQ ID NO: 93117 - protein, 78 aa, Glycine max
  Coding DNA Sequence Number=SeqID_1432
YGQNQRFESSFKQDYMKSLMEGTFARRQREVAPVAEDVQHVDHADDEERPKLNLSSHGRKVEKFGRPAPEIEGLVAGT

SEQ ID NO: 93118 - protein, 171 aa, Glycine max
  Coding DNA Sequence Number=SeqID_1433
METISKRFEELDVCGEVTLKSKLWEIAYPDQKSMCVPPSKVNTKDAPKKSMNKNQRSTNNSSVKRSASSSDQPNPRRIMSMLDQFQPFIHDFIDNIVDVKADSNFLYQSIATLLGMGEDSWSLVCNHLLKELAKWLEDYIKLFSGTDRFEELRRSLLVVGYPRLLWISGWI

SEQ ID NO: 93119 - protein, 179 aa, Glycine max
  Coding DNA Sequence Number=SeqID_1434
  Homolog annotation: Hit_ID=A2Q2H0; Match level="QueryCoverage=52%, HitCoverage=33%, E-value=6e-07, Identity=35%"; Hit description=F-box protein interaction domain
MSDPYFIKLHLSKSAAKDDLEHLQLMKNVCIGSIPEIHMESCDRNTRWIPCLFMEQGDKGDSRELPTLSFSPDIGRRTMFGFGYDPSSDKYKVVAIALTMLSLDVSEKTEMKVYGAGDSSWRNLKGFPVLWTLPKVGGVYLSGTLNWIVIKGKETIHSEILINSVDLEKETCTMANMFH

SEQ ID NO: 93120 - protein, 74 aa, Glycine max
  Coding DNA Sequence Number=SeqID_1435
MASLSYYHEGSGSPTGNLVLLDLEIEAMLKRNKAERRGKLLQDRTVASILEEEAHFFILHHLTHHHQGNPRHIY

SEQ ID NO: 93121 - protein, 139 aa, Glycine max
  Coding DNA Sequence Number=SeqID_1436
MASRKRVRTEDIPSSYNPFPSTELAHNRPIISMEQFLEKVAWPEAQLPLERSHEVVPPRPVASRTVVPPGPVPARTIIPPGPVPARTEPTSAEPQPPLVDPPAFLELEILSPPAPPMIIIPDDLADEAAAPPDSHHLAT

SEQ ID NO: 93122 - protein, 188 aa, Glycine max
  Coding DNA Sequence Number=SeqID_1437
LCKAKGVTSDSRSLESLRPTINLAYIKKNCWNLDDPTVTFRGTRKTRGKRSEAPTTSAAPETTAPSSSTPPAPSSSTPSTQIPLLAPSSFGPSDFLFTPEMLHSMLQSLHRGQVIIMQSLQSLGLPFIMSTNEFLAQVAWPGVQPSLSGGGEASVAQEPVPTEEQILVEEHDPTPPEPFEFVSDSVVA

SEQ ID NO: 93123 - protein, 20 aa, Glycine max
  Coding DNA Sequence Number=SeqID_1438
MWWNYDPVMILNFVFGGADD

SEQ ID NO: 93124 - protein, 91 aa, Glycine max
  Coding DNA Sequence Number=SeqID_1439
MDKSLKEGEDEWRERERRSTKFSAAKEKAVASGGSNLARLGELGGKLLPYFAINRGRSEGRRGSAFLALLILSKLLRKIISVKKIQVKALP

SEQ ID NO: 93125 - protein, 56 aa, Glycine max
  Coding DNA Sequence Number=SeqID_1440
MVGMHMLYLKLSSNLSVVVVVSRHVKVFASIIEGCTWVNRSKVKLHGVEFVFEVND

SEQ ID NO: 93126 - protein, 195 aa, Glycine max
  Coding DNA Sequence Number=SeqID_1441
MTLKIETLMRAKAQIPITTPPFPTCDKCGIVHGSGECTVDDKLSQGMYRSQSMQNQRPRQEDRQPTLQEIMLQYMTQNDQRMKLAPRKVEVPTNRNLVASKEGEEVFKVFDPAINSSSSPTCNFVQATNKMKTIVAKPHPSVGKDDLPRKKVIPKYPRWSKKKGDRITIQALDYGVDDYIGGSVQKGKITLFEGD

SEQ ID NO: 93127 - protein, 150 aa, Glycine max
  Coding DNA Sequence Number=SeqID_1442
GMMRIMKLAKYRLKAQVEKNEGPSGEGQSPRVEKDEGPEAETLSRLLIVAEGPSNPCGVYPDLSSFTGSGVYSDLSSFTGSGVYPDLSSFTGSGVIQIFVTCIKRSAPTQHKVPLSTSPSHLLPRTQGSRSSQDPNTNNKPGVSYHIPNY

SEQ ID NO: 93128 - protein, 214 aa, Glycine max
  Coding DNA Sequence Number=SeqID_1443
MRKREGVLCFFFLLLLHCWKLMSLEVYIGPFSHAYHHFLLLLKLECLSSLSFSIFMLGGTQGSLATHTQSFASSSRRRDLEAKCRAFSKSDQMRVELKDFDSKIEFLTSKNLKKHIWNYMRIIMHYEERTEDKVMCGTRCPCLWFQKGWSTYSLHQYFQVRMMSIRIDLCSWVSIFECRRIPPRVFHRILIGGFTFIWHAQLFHRAWIDDCSET

SEQ ID NO: 93129 - protein, 51 aa, Glycine max
  Coding DNA Sequence Number=SeqID_1444
MTRHDFYDKTTIGFCRNLPYDGRAGEKKAKENKRRHLLKKENEWELPPTFI

SEQ ID NO: 93130 - protein, 91 aa, Glycine max
  Coding DNA Sequence Number=SeqID_1445
MPYLESLKKSKILIIFNLGCLFSNDRPFIMVRTSQTGRPIGISGHNDESTLDICEMPVWTKDQAKCFDDAKVSHASQSFIQDKEIKDIQDG

SEQ ID NO: 93131 - protein, 40 aa, Glycine max
  Coding DNA Sequence Number=SeqID_1446
MWDTLALMYEGLSQVKCNKLSLLTRKYELFTMDDGEDIQA

SEQ ID NO: 93132 - protein, 150 aa, Glycine max
  Coding DNA Sequence Number=SeqID_1447
MSEVEEIQEKMKADMEAMKEQMATMMKAMMSMKKIMEANAVAIAATSVVAKANLMSPSGINQMNHPTSDMAHISQTMGETHEIPHHNLADFEPWLGYATEGQAVGGMGKLDHLEERLRAIEGGEDYAFANLEELFLIPKHGHSQVQGAGL

SEQ ID NO: 93133 - protein, 138 aa, Glycine max
  Coding DNA Sequence Number=SeqID_1448
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=71%, HitCoverage=75%, E-value=3e-25, Identity=66%"; Hit description=LacZ protein
  Subcellular localization annotation: CTP_CleavageSite=32; ConfidenceScore=5.09e-01
MTMITPSSKLTLSKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 93134 - protein, 94 aa, Glycine max
  Coding DNA Sequence Number=SeqID_1449
MPSLYDRTTKLEETLAQFMQVSMSNQKSIESAIENLEVQVGQLAKQLAERPSNSFTENTEKNPKEECKVVMTRSRMAIQEKESKANQKVEGFKQ

SEQ ID NO: 93135 - protein, 168 aa, Glycine max
  Coding DNA Sequence Number=SeqID_1450
PGPPPDIGGRPTVQAQPEREAITQLLCIPGQDFTRAAAKRRVRVMRTNMTTLAQICMTLLLSNIPPGDHNVDLPLRKDRARRHPVDPEKSNRVLGFPAMVTGLWIAPARHPVDPEKSNRVLGFPALITGLCQFYGVPVAPSKFIRPPINWAFIKKYCAPRQAQGETPQ

SEQ ID NO: 93136 - protein, 161 aa, Glycine max
  Coding DNA Sequence Number=SeqID_1451
DAGSRQARQGASAGVGGCRGWLNYAASEQIVLRVHHMRAIGAGLFAITPAGERGMCCKAIKLGNARVFPVTTLSTLEDPLLPGLVAPRCRKWCASMNYQEASLWTETLSSLVTFEEHYGDAHAKVEYVKKLHKQVKAQIAKKTESYDKQAKKNKKKVVLEP

SEQ ID NO: 93137 - protein, 97 aa, Glycine max
  Coding DNA Sequence Number=SeqID_1452
MASTSGDATPPSPKTARLMAQMIKLGNQMRRMSYDNEERIERMRKKNEESLGRIHRSSEALSVRIENIKRRREVRSSNSSHGEDEGYKKDEGGWRNE

SEQ ID NO: 93138 - protein, 335 aa, Glycine max
  Coding DNA Sequence Number=SeqID_1453
  Gene Ontology: Mol. function=NADH dehydrogenase (ubiquinone) activity; Cellular component=ferredoxin hydrogenase complex; Biological process=mitochondrial electron transport, NADH to ubiquinone
  Homolog annotation: Hit_ID=P69740; Match level="QueryCoverage=100%, HitCoverage=90%, E-value=1e-180, Identity=90%"; Hit description =Hydrogenase-1 small chain precursor
  Pfam annotation: Domain name=NiFe_dehyd_N; Domain location=1-52; Score=81.0; E_value=3.8e-21; Accession=PF08425.1; Description=Nickel- iron dehydrogenase small subunit,
  Pfam annotation: Domain name=Oxidored_q6; Domain location=69-172; Score=71.6; E_value=2.6e-18; Accession=PF01058.13; Description=NADH ubiquinone oxidoreductase, 20 Kd sub
  Pfam module annotation: Pfam domain module=NiFe_dehyd_N::Oxidored_q6; Domain location=1-52::69-172
MAPKIAWALENKPRIPVVWIHGLECTCCTESFIRSAHPLAKDVILSLISLDYDDTLMAAAGTQAEEVFEDIITQYNGKYILAVEGNPPLGEQGMFCISSGRPFIEKLKRAAAGASAIIAWGTCASWGCVQAARPNPTQATPIDKVITDKPIIKVPGCPPIPDVMSAIITYMVTFDRLPDVDRMGRPLMFYGQRIHDKCYRRAHFDAGEFVQSWDDDAARKGYCLYKMGCKGPTTYNACSSTRWNDGVSFPIQSGHGCLGCAENGFWDRGSFYSRVVDIPQMGTHSTADTVGLTALGVVAAAVGVHAVASAVDQRRRHNQQPTETEHQPGNEDKQA

SEQ ID NO: 93139 - protein, 69 aa, Glycine max
  Coding DNA Sequence Number=SeqID_1454
MSLRGHIVATYPSAGGRRVTRGMRVPRKEYARSRHQRLFEENVGKTGKDAIYELLSERFGSCIYARGRC

SEQ ID NO: 93140 - protein, 220 aa, Glycine max
  Coding DNA Sequence Number=SeqID_1455
VGPPPDIGERPTMRAQLEREAITQLLCIPGQDFTRAAAKRRGRIMLINMTTLTQIWMTMLLSNILPNDHNADLPLRKYQLDRAHKPPSGLGEVQQGPKVSSFGYGPLSVLQGITPTRHPLDPEMSNRVLGFPALITGICQFYGALIAPNKVIRAPTNRAFINKYCAPRQAQGETPQQPGDGRQRAIDTPPPPPELLNSSTKAGALPTTRGRPAGDQVQSQ

SEQ ID NO: 93141 - protein, 90 aa, Glycine max
  Coding DNA Sequence Number=SeqID_1456
MQRLLKRNNEELYRRIEGLEHQMNPNPGRPYGGNRRVNDGSNRIEGQDRIEGVKLNVSSFKGRSDPDAYLTWKMKISMHSPTMIIRKSRR

SEQ ID NO: 93142 - protein, 227 aa, Glycine max
  Coding DNA Sequence Number=SeqID_1457
  Subcellular localization annotation: CTP_CleavageSite=34; ConfidenceScore=5.06e-01
MAFLGETSSKTIVNSRLAFIFPNGSVIHNECGVYFQSSSSVPMRVLNMCDFSTLKSRIHNNLQLNDNQVVDVNTITPDGIINLLELTMIPTHDVVLYYNGRWNMPCQNNFVGYTFTGKNPQKFDIPKGCTINELKYLIKQVEPKGNPPHGIHESQLVRRLFFRQPAHLEYSNNVLKFEIIELKSDDDVLKVLVESNYWKQFVPIEILALFSKPVMENEDEVVTPLQD

SEQ ID NO: 93143 - protein, 217 aa, Glycine max
  Coding DNA Sequence Number=SeqID_1458
  Gene Ontology: Mol. function=phosphoprotein phosphatase activity
  Homolog annotation: Hit_ID=Q2HTA0; Match level="QueryCoverage=85%, HitCoverage=28%, E-value=2e-24, Identity=36%"; Hit description=IMP dehydrogenase/GMP reductase, related
  Pfam annotation: Domain name=DUF1723; Domain location=81-130; Score =61.0; E_value=4e-15; Accession=PF08330.1; Description=Protein of unknown function (DUF1723)
MIVKGSPATDEGFPSEPRDPSVLTGFAKHVAHSIWSGDERHELKLVSHGRKVDKFGRPALEIEGMIAATGLSPLIMCSIITTDLGLISAFVERWHRETSTFHLPVGELTITLDDVASLLHIPITGALQSFEPLVTSDAVVLLTELLEVIPEEARAETHQASGPHVRLSWLWEVYQSRCRARRWVVALFSLTRVQHMFTSCTWRLLGTWPSQGDSLGE

SEQ ID NO: 93144 - protein, 170 aa, Glycine max
  Coding DNA Sequence Number=SeqID_1459
  Homolog annotation: Hit_ID=A7UQU7; Match level="QueryCoverage=78%, HitCoverage=23%, E-value=5e-12, Identity=32%"; Hit description=IMP dehydrogenase/GMP reductase, putative
MVRTRRLGRASGTVHRQLVHFPHVTEDVTQTPEDVPQLNEDVPHVSNATPEMTGTVDAADAEGVATDGSEGSPATDEGFPSGPRDPSVLTGFAKHVAHSIWSGDERHELKLVSHGRKVDKFGRPALEIEGMIAATGLSPLIMCSIITTDLGLISAFVERWHRETSTFHLP

SEQ ID NO: 93145 - protein, 153 aa, Glycine max
  Coding DNA Sequence Number=SeqID_1460
  Gene Ontology: Mol. function=nucleotide binding; Biological process =defense response
  Homolog annotation: Hit_ID=Q2QVF2; Match level="QueryCoverage=63%, HitCoverage=10%, E-value=6e-11, Identity=35%"; Hit description =Transposon protein, putative, CACTA, En/Spm sub-class
  Subcellular localization annotation: CTP_CleavageSite=57; ConfidenceScore=5.70e-01
MASPPASPPPPLSAPLDASASPSAIKRTRKASRLRSLSTRPPSAERPVIHEEIKNISGIMARDKVDVTYENWNEVPTAQKDLIWEDIQVEFEIPEASDSRTKMKLLQTVGERWRQFKSDLTRKWALAADQDGVEDTVYEKYGISKEKWAQFCQ

SEQ ID NO: 93146 - protein, 88 aa, Glycine max
  Coding DNA Sequence Number=SeqID_1461
MSCTGSLSALLYLSKCTASVHPLSEKGTKPKIINRPELEAGAGLRASDEFVSDCEILEVKETSLPLVFLQSFILFFSLLLRRLPGMES

SEQ ID NO: 93147 - protein, 194 aa, Glycine max
  Coding DNA Sequence Number=SeqID_1462
MAGAGDNGGVYHQLDGSQRLLLDAMTTQMQRLLNRNKEELCRQIVKSSLFTLKPLSPREVCDDQIRMREKREQEKENSEATQRNRKKKSDAPEGKRDSSWTATFNPGASLLNRLTYKSNPQETQRKDAHAKVEYVKRLYDQVKVQIATKNESYAKQANKKRKEVVLEPGDDPGHLRANVFQEGGNDENPEIGQI

SEQ ID NO: 93148 - protein, 126 aa, Glycine max
  Coding DNA Sequence Number=SeqID_1463
  Subcellular localization annotation: CTP_CleavageSite=39; ConfidenceScore=5.16e-01
MNTSISLKKNFKKFFHSTIDSPRNLWVFSKTLPFIGGLVASYTFVEISVVFILMDYLTDSRGNDQRIAAVVTNLQDVLSSILFIFVSSISKEYTGCFTMITFCAAASIELCTSQSELDNTTKNAHC

SEQ ID NO: 93149 - protein, 62 aa, Glycine max
  Coding DNA Sequence Number=SeqID_1464
MGLRQFCPKFGGVGLMDNFKEKWARLVKYRIYELTEPHHALGEPSTKRTILRLSAQKNLEEG

SEQ ID NO: 93150 - protein, 107 aa, Glycine max
  Coding DNA Sequence Number=SeqID_1465
MEECPSTVFTFNCERSSSAGMHGRRFLCSCKINYKRTFFHAFLRKNFFRESAWKKVLPQLLISTAEEGSSAYDNTVSEEVDMDFEDEQHCGVNEGHVDCSDAFNTSQ

SEQ ID NO: 93151 - protein, 117 aa, Glycine max
  Coding DNA Sequence Number=SeqID_1466
  Subcellular localization annotation: CTP_CleavageSite=27; ConfidenceScore=5.69e-01
MAPLPSLQNGQVGPLGTSTYHLQRTVRPHLKRATRPRLQRATRPHRQRTTRPRLQRTSRPHLQRATRLHLHRTRRPQIQRTAVLTFKGLYALAFRGLHALALRGLHALAFRGLHVLA

SEQ ID NO: 93152 - protein, 282 aa, Glycine max
  Coding DNA Sequence Number=SeqID_1467
GAVNAVESDRPHRSKPLRDVATPRRFIFEALQKGGVIPHSGRKEDSCLLHSGELHDMETCLGVEELLQRMIDQGRLEVGSEGREEQHICMQSTDGSTVAKPKPLVIYFTKGTASQKPGHPLAAKPVPFPYQNRLALPVKGPVVSFYQFLGHPPILEEGQLCEHNQRRRLSRNYYAYRGKISPSRCKETSVDHAHHHNSDLPLSKITPARHPVDPEKSNRVLGFPALIRGLCAGRHTTVAWGWPAADNRRTAATSRAPQLIYKGWSVAYDPWSTSRRPSPKPK

SEQ ID NO: 93153 - protein, 61 aa, Glycine max
  Coding DNA Sequence Number=SeqID_1468
AVASRGSNPARLGELGGNHLPYFAINRGGSEKGKGSAPENFAKVSTVFDVFIRSSSFFDLQ

SEQ ID NO: 93154 - protein, 94 aa, Glycine max
  Coding DNA Sequence Number=SeqID_1469
  Subcellular localization annotation: CTP_CleavageSite=36; ConfidenceScore=5.24e-01
MGLNQFRFFNMVHDILVKVKLEVTKTSTVLNVFGSRQSSDVNRSIFCPNFCKMVTSIFQLDLMNLFVKAGAWFNPIIQGMRKMQGSCMSKHENK

SEQ ID NO: 93155 - protein, 61 aa, Glycine max
  Coding DNA Sequence Number=SeqID_1470
GFWAISCLRWKQPSSPGRARWQPPPPLKAAVLTVRDPPGEQIREGFPPLFTVLHPFFVLQQ

SEQ ID NO: 93156 - protein, 82 aa, Glycine max
  Coding DNA Sequence Number=SeqID_1471
MGFRDTRNASVKFPITLNNWIASGGSNPARLGELGGNLLPLFPINRLKGAVLRIPDAPGEVFQLFWVKKIVSVKKIQVEMLP

SEQ ID NO: 93157 - protein, 97 aa, Glycine max
  Coding DNA Sequence Number=SeqID_1472
  Subcellular localization annotation: CTP_CleavageSite=69; ConfidenceScore=5.86e-01
MGSPLASTTPPPPPPSPSPPRPSLTSDASASMSAVKRKRKASRLRSLSTRPPGVERPVVHVDPATGKADGSHRKKLRTYLGIVARDKVDITYENWKE

SEQ ID NO: 93158 - protein, 57 aa, Glycine max
  Coding DNA Sequence Number=SeqID_1473
  Homolog annotation: Hit_ID=Q6L477; Match level="QueryCoverage=100%, HitCoverage=9%, E-value=8e-07, Identity=38%"; Hit description =Putative uncharacterized protein OSJNBa0009L15.8
MTYETCKEVPATQKNLIWEDIQVEFEIPEASDSRTKKKVLQTVGEWWRQFKSDLTRK

SEQ ID NO: 93159 - protein, 64 aa, Glycine max
  Coding DNA Sequence Number=SeqID_1474
MDSPGTSLPQLGTFKEGAYTIMRDKREMLSISQKQIPPPPHAPTVRLPRNRKGGPGARASWVGV

SEQ ID NO: 93160 - protein, 55 aa, Glycine max
  Coding DNA Sequence Number=SeqID_1475
RIPRTLQQPVEWILPTPTPYRLVESVQLIEVSSSEEDLEEDPEELSPEPAMDASI

SEQ ID NO: 93161 - protein, 77 aa, Glycine max
  Coding DNA Sequence Number=SeqID_1476
MAAEWRKGERERRRHFKEKMSLEEAHHHRRPWIRAWRKKEMNEGRGREEHEILCSKRALKSEPTNPRSITRFSTKCA

SEQ ID NO: 93162 - protein, 264 aa, Glycine max
  Coding DNA Sequence Number=SeqID_1477
  Homolog annotation: Hit_ID=A9MY14; Match level="QueryCoverage=91%, HitCoverage=98%, E-value=8e-86, Identity=63%"; Hit description =Putative uncharacterized protein
  Pfam annotation: Domain name=DUF949; Domain location=57-249; Score =416.8; E_value=3.2e-122; Accession=PF06104.3; Description=Bacterial protein of unknown function (DUF949)
MQYSDALRQRSSSLQGTHRMGRIALLFAMILMPLLSWAMTPEPMQPLAPVSKELKKQLLGTPVFIQIFKEERTLELYGKIGNEYRLLDSYRICNFSGGLGPKRRQGDFKSPEGFYNVKMNQLKPDSRFYRAINTGFPNQYDRAKGYNGNYLMIHGDCVSVGCYAMTNASMDEIFTYVNAALRNGQQDVQVNIFPFRMTDSNMQRHRYSTYISFWRELQPGYAYFAKYHVPPTVNVTATGQYAVNNTPVMTTPEAASKSFLALTQ

SEQ ID NO: 93163 - protein, 200 aa, Glycine max
  Coding DNA Sequence Number=SeqID_1478
KDKAAEGTSSAPKYDSHRFRSAEHQQRYEAIKGWSFLRERRVQLRDNEYTDFQEEIVRRRWASLVTPMAKFDPDIVLEFYANAWPTEEGVRDMWSWVRGQWIPFDADAISQFLGYPLVLEEGQECEYGQRRSWSDGFDEEAIAHLLCIPGQDFARTAAGRRVRIMRTNMTTLTQIWMTLLLSNIQPSDHNSDLPLPKCQL

SEQ ID NO: 93164 - protein, 37 aa, Glycine max
  Coding DNA Sequence Number=SeqID_1479
SMLVGYCDADWAGQFTDTNNSGGCFYPEKLVPRRQQN

SEQ ID NO: 93165 - protein, 133 aa, Glycine max
  Coding DNA Sequence Number=SeqID_1480
MGKVEEVQEQMKADMEAMKEQMATMMEAMMSMKKIMEANAVAVVATSAVAKIWWAKIWEVGRPHDVQIQNKHAFLPYGLPPKEDVNNSAPILIESQQPQSDHAHVSQPMGETHEMPHHNLADFEPCLGYATEG

SEQ ID NO: 93166 - protein, 138 aa, Glycine max
  Coding DNA Sequence Number=SeqID_1481
MDRARLAYGLVTNMDMNIGALISGQISSIAQSNSSWLGFSALITALYRARGVTFDSLTYESLSPAINLAYIKKNYWNVDDLTVNFRGARKARVRSADVPSSSTPLAPSTSTTPLPAPLGLSAYDSRRFESMLQSLHQG

SEQ ID NO: 93167 - protein, 229 aa, Glycine max
  Coding DNA Sequence Number=SeqID_1482
MNTSSSNVSDAGPSNLRVPRIVHQFDASFHLEQNVIEVPFAYHRQWSENYPSYVLFDYEGDKHFIKLHKYGNRFFFGDGLKELRRTHGIHESVLMRFVGRDKNTTFSVDVVGPLHQRAATTIRHHVFTIDVSKDMIQHNYQLVLPLEASIYLTTSKKYMIVDRGSGRHHKWMITTNNGLSCVVDAWIHYLGDCHLKPGDEVIFFYNIDQHVWEVLYRKQVKWDDEEDEA

SEQ ID NO: 93168 - protein, 284 aa, Glycine max
  Coding DNA Sequence Number=SeqID_1483
MRHACPLEGHRSCTEKGGANWDQLLANKEGASVNCYNPVLAIRQLGYPMRGASLEEELAPVISRGFNKTNLEALQKVRKAWEVVQKKDKELKGSNNGTLGGYRKTAKREEVEATEEDEEVQALRAELEQAQTVKERFKSTTLKIQKENAELRDINIATTKALEQETKRAHSLILKDELKVCLRSKRSLSQHLCETETNMLAIISKYQEELNLATAHEHKVADEYAEKEARGRVIDSLHQEATMWMDRFALTLNGSQELPRLLAKAKAMGDTYSTPEEIHRLLSY

SEQ ID NO: 93169 - protein, 129 aa, Glycine max
  Coding DNA Sequence Number=SeqID_1484
MSDIEQVQEQMKVDMRAMKEQMTIMMEAMMSMRKMMEVNVSIAVAASTITKRDSIHPPGFNQSSFPPYGLPPNYTLPTIVYAPSENINNSTPVFIKNQQSQPDHTHAHVSQPMGETHEADAILPRKGIG

SEQ ID NO: 93170 - protein, 161 aa, Glycine max
  Coding DNA Sequence Number=SeqID_1485
  Subcellular localization annotation: CTP_CleavageSite=3; ConfidenceScore=5.31e-01
MTKMMTKSPKNDLNIESTKFKIKFNFKFHKKKSRRFKNQEKMNSRFKRRNQEDFTREGISFVVQVEGTSTWVVVTENKRGYDASSIGACRPRIFFINGFLCFLEDEWQRNGERKRERRRHFKEKMSLEEAHHHRRPWIRAWRKKEMNEGRGREEHEILCSK

SEQ ID NO: 93171 - protein, 129 aa, Glycine max
  Coding DNA Sequence Number=SeqID_1486
MGVAQAKGHPPIGKSAKGTVMGLTCQVLKHLINERQGKMIFFGYLVQPPIINADSPAVLHSCGDRLIPFILNHCEVCLLRNHLDWTHPLAVRNGVDGLIPGMSAKVHSMAFLCFLSTSNNFSSCSAAME

SEQ ID NO: 93172 - protein, 116 aa, Glycine max
  Coding DNA Sequence Number=SeqID_1487
MPNEAHIIFESSDPRIRPIKVSIHCIKSEEKWNHPVVVEEMGYFFRNRQGQVLFANPLTINVLSVTKGGNRTSTNRERPFYFDKWLIIQRNIEMIKKRVTRRGLGRGALARNALCI

SEQ ID NO: 93173 - protein, 350 aa, Glycine max
  Coding DNA Sequence Number=SeqID_1488
  Gene Ontology: Mol. function=endonuclease activity; Cellular component=cytoplasm
  Homolog annotation: Hit_ID=Q2HUP4; Match level="QueryCoverage=70%, HitCoverage=63%, E-value=4e-42, Identity=65%"; Hit description =Endonuclease/exonuclease/phosphatase
  Pfam annotation: Domain name=Exo_endo_phos; Domain location=75-319; Score=35.1; E_value=2.5e-07; Accession=PF03372.14; Description =EndonucleaseExonucleasephosphatase family
MTAYVERSRDHEDSANDLPWHFDKGKGYSGGSRRCYGEVDVVGRVVSLIFVDKSSTHVHVAYLLYLSNLDDCHEYAWGIAALVYYTTISSMSASTPASNIVRRKINFMCLQETKWTGEKAKELDNSGFKLWYTGKIRSRNGVGIIVDKEWKKDVVDVRRVGDRIIVLKLVVGQDTFNVISGYAPQVGLAEHFKVKFWEDLEGVLQDIPQGEKVFLGGDLNGHVGSVARGFEGVHGGFGLGEMNGEGKSILEFSEALDLSIANTWFKKREEHLITYKSGGTCSQIDFFLIRKSDRKYCLNCKVIPGESLTTQHRVLVMDVRIRDRAKRRSPLVAPRIKWWHLKGEKQGISN

SEQ ID NO: 93174 - protein, 139 aa, Glycine max
  Coding DNA Sequence Number=SeqID_1489
MAKYDPEIVMEFYANAWPIKEGGHRCEFRERRSQVSGFDEEAMGQLLCSMGQDFAQSVTGRQVSVHVAQLILDVIYQFVGIMPPRHPVDPEKSNRALGFSALITCLCQFYGVSVTPTKLIWPPINRSFIEKYCIPRQAQ

SEQ ID NO: 93175 - protein, 264 aa, Glycine max
  Coding DNA Sequence Number=SeqID_1490
  Gene Ontology: Mol. function=aspartic-type endopeptidase activity; Cellular component=small subunit processome; Biological process=DNA integration
  Homolog annotation: Hit_ID=A5CB76; Match level="QueryCoverage=73%, HitCoverage=70%, E-value=2e-39, Identity=42%"; Hit description =Putative uncharacterized protein
  Subcellular localization annotation: CTP_CleavageSite=68; ConfidenceScore=5.61e-01
MNIKSHVSEISSHLNSSWHQCGFRPSPSPPPPSVASGHRLPPPVATSGHRPPPPTTVRRNLAGIFFLVKMATSGPVFSFSGTPTIATAKLNWKNYLSWSASVELWFLGQGYHDHLEKNVNAVPNDKKLEWEKVDYQLCAVLWQSVESDVLEILRSFKTCHLFWKKAQEIFANDIQSLFDATVKVTALKQSKHDMIAHMGKARAAVEELRRFLVADSLEEVNRKLDKFYMVLILRSLHSDFDQVLAGDQVPSMDSLITRLLRVPH

SEQ ID NO: 93176 - protein, 24 aa, Glycine max
  Coding DNA Sequence Number=SeqID_1491
MALRKLSTKRSRKDAAAEGTSAIP

SEQ ID NO: 93177 - protein, 267 aa, Glycine max
  Coding DNA Sequence Number=SeqID_1492
MIPGDTLRLSAPPLPFRHSRVRWQAETKFGHSAHMIPGDTLRLSAPPLPFRHSRVRWQAETKFGHSAHMIRGDTLRLSAPPLPFRHSRVRWQAETKFGHSAHMIRGDTLRLSAPPLPFRHSRVRWPSRDQVWSFCTHDTRRYLTVIRPPFAIQTQSCSMASRDQVWSFCTHDTRRYLTVIRPPFAIQTQSCSMASRDQVWSFCTHDTRRYLTVIRPPLPFRHSRVRWQAETKFGHSAHMIRGDTLRLSAPPLPFRHSRVRWQAETKF

SEQ ID NO: 93178 - protein, 133 aa, Glycine max
  Coding DNA Sequence Number=SeqID_1493
  Homolog annotation: Hit_ID=A5AY05; Match level="QueryCoverage=61%, HitCoverage=20%, E-value=1e-08, Identity=40%"; Hit description =Putative uncharacterized protein
  Pfam annotation: Domain name=zf-CCHC; Domain location=39-56; Score =28.0; E_value=3.4e-05; Accession=PF00098.14; Description=Zinc knuckle
KDQAQGILGAAPLKPKEDKGKTIEKPTPKTSSQERTSNIKCFKCLGRGHIASQCPMKKTMIMRGQDIYSSQEDTISFPSSSGSKDEARGEESSKEVYPHEESDLLMVEATARLSELLFNLIPSFSINRREGDE

SEQ ID NO: 93179 - protein, 155 aa, Glycine max
  Coding DNA Sequence Number=SeqID_1494
  Homolog annotation: Hit_ID=Q6WAY4; Match level="QueryCoverage=85%, HitCoverage=24%, E-value=5e-14, Identity=36%"; Hit description =Putative uncharacterized protein
MGALYPGSWESMEWRWIYDHASLKELGRLMGPFQRQAFRKVYGKILDLTAVEVFTEAVVSLAQYYDQPLRCFTFGDFQIVPTVEEFEEILGCPPGGRKPYFFSGFLPSLRKIAAVVRDSTRELDRMKKTRNGVVGLPRKYLEGKARDMASQEEWV

SEQ ID NO: 93180 - protein, 72 aa, Glycine max
  Coding DNA Sequence Number=SeqID_1495
SSEATILESSDIGEEVEETQVRQVATATRERSLEATSEPSAPVMPEDPTTPVLAVDTSPPTTPVLQLTYEED

SEQ ID NO: 93181 - protein, 325 aa, Glycine max
  Coding DNA Sequence Number=SeqID_1496
  Gene Ontology: Mol. function=helicase activity; Biological process =viral genome replication
  Homolog annotation: Hit_ID=Q2A9E0; Match level="QueryCoverage=93%, HitCoverage=20%, E-value=5e-66, Identity=43%"; Hit description =Putative uncharacterized protein
MWYDERISKDKNFQNPSQYSGIQSHIVSGLSHMLDQHNSHAKSFRMARDRLAGDQTNNIKLQLIAARGKDGRVYNMPNVPKIVAFIVGDFHPGSKRDIIVETQNGELQRIHELHASYLPLQYPLLFPYGEDGYRADILHRSTSSSKKRKRNRLTMREWFAYRLQSRSNEAQTLLHSRKLFQQFIVEGYTMVESDKLSYIRNNQKKLRVGKYSSLQSSLDTGTAKGLTKGKRVILPSTFVGSPRYMDQLYFDGMAICSHVGFPNLFITLTCNPNWPEIHRLLSPLNLKPTDRPDIVSRIFRLKFEHMLSNLTKGQLLGRVVAYITG

SEQ ID NO: 93182 - protein, 71 aa, Glycine max
  Coding DNA Sequence Number=SeqID_1497
  Subcellular localization annotation: CTP_CleavageSite=41; ConfidenceScore=5.52e-01
MSKRNLPRKHAPSTQPARPASHLSLLALSAPGSLSQRSFTRAKRENGAKSAFKDKKPFLKPEVKEKRELGR

SEQ ID NO: 93183 - protein, 31 aa, Glycine max
  Coding DNA Sequence Number=SeqID_1498
MPRPDKPNWPTMHVLPFPKRLTPKTDACIES

SEQ ID NO: 93184 - protein, 349 aa, Glycine max
  Coding DNA Sequence Number=SeqID_1499
  Gene Ontology: Mol. function=solute:hydrogen antiporter activity; Cellular component=integral to membrane; Biological process =regulation of pH
  Homolog annotation: Hit_ID=Q7CRH4; Match level="QueryCoverage=99%, HitCoverage=66%, E-value=1e-128, Identity=70%"; Hit description =Na+/H+ antiporter
  Pfam annotation: Domain name=Na_H_Exchanger; Domain location=10-348; Score=63.5; E_value=7.3e-16; Accession=PF00999.12; Description =Sodiumhydrogen exchanger family
MDGTHLFELVIAMFLAIIVLHYIAHRMGLPPSVALVVGGGTLAFLPGLPTIAVIPELVLVIYLPPLLLDGAWSIAVDRLKRHVFGIASLAIGAVLFTTIVVAVVVHFLMPSLPWAACAALGAIVSPPDAVSARAVLERVKIPRRLHILLEGESLLNDASGLVLFRFAVAAAAGGTFSTTDALGEFIFLAAGGAAIGAVVGFAWVKLVRHLGDEYLMIAATAILSWAAYLLAERMHTSGVIATVTAGLIASWHQHTVLSAATRMRGTSFWNVLVFLMEAMVFILIGLSLRDVVERGGGFGSLVGSMALPAVTVLVTLVIARFVWIFVSDFVIGLFHGLKLARSTPLGAGG

SEQ ID NO: 93185 - protein, 242 aa, Glycine max
  Coding DNA Sequence Number=SeqID_1500
  Gene Ontology: Mol. function=xylulokinase activity; Cellular component=integral to membrane; Biological process=carbohydrate metabolic process
  Homolog annotation: Hit_ID=P09099; Match level="QueryCoverage=100%, HitCoverage=50%, E-value=1e-119, Identity=85%"; Hit description =Xylulose kinase
  Pfam annotation: Domain name=FGGY_C; Domain location=1-224; Score =339.5; E_value=6e-99; Accession=PF02782.7; Description=FGGY family of carbohydrate kinases, C-terminal domain
MADAGQAMLSLGTSGVYFAVSDGFLSKPESAVHSFCHALPGRWHLMSVMLSAASCLDWAAKLTGLGSVPALIAAAQSADDNADPVWFLPYLSGERTPHNNPQAKGVFFGLTHQHGPAELARAVLEGVGYALADGMDVVHSCGVKPDSVTLIGGGARSAYWRQMLADISGQQLDFRTGGDVGPALGAARLAQLGVHHDAAFSDLLPQLPLEQAHLPDAQRFARYAPRRETFRQIYQQLKPLMS

SEQ ID NO: 93186 - protein, 128 aa, Glycine max
  Coding DNA Sequence Number=SeqID_1501
MPKEKSRIRRHSPFRLRNCWEGRSVRASSLLRQLAKGGCAARRLSWVTPGFSQSRRCKTTASAKLACLQVDSRGSPISRRNPKLSRERKESHEDNTSEGFNLFYVSLTFENSIRAVGGITEGISGNHW

SEQ ID NO: 93187 - protein, 132 aa, Glycine max
  Coding DNA Sequence Number=SeqID_1502
MNSGIALLTQILTFDDAIAHRVTAYFADQIDGAVRQLLRTEIFRRQVRKPVQNAQHSSPESQRNLRRQRDVADALTVQLRPGTLNAHQRIGTGGCSKAFSPQRASAAWELSVSSWVVLKHRVANPFAFVTAH

SEQ ID NO: 93188 - protein, 335 aa, Glycine max
  Coding DNA Sequence Number=SeqID_1503
  Gene Ontology: Mol. function=2 iron, 2 sulfur cluster binding; Cellular component=cytoplasm; Biological process=regulation of transcription, DNA-dependent
  Homolog annotation: Hit_ID=Q1C5G9; Match level="QueryCoverage=49%, HitCoverage=100%, E-value=4e-68, Identity=81%"; Hit description=HTH -type transcriptional regulator iscR
  Pfam annotation: Domain name=HTH_11; Domain location=180-236; Score =3.1; E_value=0.091; Accession=PF08279.3; Description=HTH domain
  Pfam annotation: Domain name=Rrf2; Domain location=171-291; Score =175.6; E_value=1.3e-49; Accession=PF02082.11; Description =Transcriptional regulator
  Pfam annotation: Domain name=SpoU_methylase; Domain location=2-65; Score=-47.8; E_value=0.03; Accession=PF00588.10; Description=SpoU rRNA Methylase family
  Pfam module annotation: Pfam domain module=HTH_11::Rrf2::SpoU _methylase; Domain location=180-236::171-291::2-65
MLDSRECGIKSVEEGQQAPVALVFGRERVGLTNEELQKCHYHVAIQANPEYSSLNLAMAVQIIAYEVRMAWLDAQEKASPQPQYEASPYPLVDDLERFYQHIEQMMLNSGFIRQGTPSQVMSKLRRLYTRARPERDELNILRGMLSSFEKPKNDKDNPPTRWRTLTRLYAMRLTSKGRYAVTAMLDVALHSHEGPVPLADISERQGISLSYLEQLFSRLRKHGLVASVRGPGGGYLLGKDAGAIAVGAVITAVDESVDATKCQGKEGCQGGERCLTHVLWRDLSERISDFLNNITLAELVNNQEILDVADRQNSVDNRRFQQHRVQETINVNLRA

SEQ ID NO: 93189 - protein, 59 aa, Glycine max
  Coding DNA Sequence Number=SeqID_1504
  Subcellular localization annotation: CTP_CleavageSite=23; ConfidenceScore=5.07e-01
NWKGGLVPSVATYPSAGGRRVTRGMRVPQKKYARSRHQRLFEENVGKTGRDVIYELLSE

SEQ ID NO: 93190 - protein, 414 aa, Glycine max
  Coding DNA Sequence Number=SeqID_1505
  Homolog annotation: Hit_ID=Q6WAY6; Match level="QueryCoverage=78%, HitCoverage=54%, E-value=9e-37, Identity=30%"; Hit description =Putative uncharacterized protein
MAEVSTEAIASLTQYYDQPLRCFTFGDFQLTLTVEEFEEILGCSLGGRKPYLLLGFYPSLARISKIVKISAQELDRGKQVENGAVGVPRKGLEAKARTLASQDEWALFMDVLTLLIFEVVLFPNVDGLVDLAAIDVFLAFHDRKESLVVAILADLYDTFDQRCEKNSARIVCCTPVLYVWLVSHLFCQEVRHICPLEGHRSCTEKKEANWDRLLASKEGPSVSWFPRWKEGRTRILISCGGFPNVPLMGTRGCINYNLVIAIRQLGYPMRGAPLEEDLTPFIARGFNSSNAGVLQRVCKAWGMVQKKDEELMGSSNGPIGGYHKWLKAYAQGLDWLPNLRAIKEVEVEAPEEDEEVQALRTELEKARAIKEKFKSTAVRIRKENAELRDVNITTTMVVNSRFYVESWRFRKLDS

SEQ ID NO: 93191 - protein, 117 aa, Glycine max
  Coding DNA Sequence Number=SeqID_1506
MELGFRWEALNGNFSKVLLGITFKLEPLSMSTLATTLSMNLTDTCKALLCPLPSARISSSGKRNSLASVATYPSAGGRRETRGMCVPRKEYARSRHQRLFEDNVGKTGKDAIYELFS

SEQ ID NO: 93192 - protein, 73 aa, Glycine max
  Coding DNA Sequence Number=SeqID_1507
MESITGHTPVSTLGQEQGQRDQKLLIHIEPSNRPNQQPELCALYEQKANGLDHLIQQYEHDTKRWYPDYYSKL

SEQ ID NO: 93193 - protein, 256 aa, Glycine max
  Coding DNA Sequence Number=SeqID_1508
  Homolog annotation: Hit_ID=Q949K7; Match level="QueryCoverage=15%, HitCoverage=44%, E-value=4e-07, Identity=61%"; Hit description =Putative gag polyprotein
MGEAEEVQEKMKADMEAMKEQMATMMEAMMSMKKIMEANAVIVAATSAIAKVNPMLPSGLKQMNHPTSNMVGKDLGCTDDPMMCKFKTSTPSHHMACLPNYTPPNVAYIPNEDVDNSTPILIKSQQPQSDHAHVSRPMEETHGMPHHNLADFEPCLGYATEGQAVGGIPLQNTLEGPQCHPQPQPLHSSAVKNPHAMAEMGKRKGSRPLKEVLDFDKYKGTTCPKNHLKMYCQKMGEYAKDEELLIHSFPRKVLLG

SEQ ID NO: 93194 - protein, 63 aa, Glycine max
  Coding DNA Sequence Number=SeqID_1509
MTKDNNWYLKALHWAMRGIVHEPQVNIGKGCHEHYTTFHCLAIVSYEVSITKFHNKGCMRLHP

SEQ ID NO: 93195 - protein, 105 aa, Glycine max
  Coding DNA Sequence Number=SeqID_1510
MTHQSHPAPFLLLNEPQIPPITLEAHITNHIPFNWATHCDSSNSSLGMMLMGGPLDLPFAKTIKVYEDVGDFSNDEDLTPSMIAFYRGVCGEEISKGKVVSSDKE

SEQ ID NO: 93196 - protein, 52 aa, Glycine max
  Coding DNA Sequence Number=SeqID_1511
MRILKLAKYRLKAQVEKDKAPEWRRMKAQVEKDEGPEAEALPRLLIVAEDTL

SEQ ID NO: 93197 - protein, 160 aa, Glycine max
  Coding DNA Sequence Number=SeqID_1512
  Homolog annotation: Hit_ID=A5BEK1; Match level="QueryCoverage=83%, HitCoverage=10%, E-value=2e-09, Identity=30%"; Hit description =Putative uncharacterized protein
MVAKVNARMETRMEAMEKAIDLGNPFQELLALQQEETVQGSIGLEEPFLVEVFLKGLKEEISIEVRLHEPKNLMEAMVKAQRVEDKNKILGKLPVGNGTSGWKGRRTFHNLSPAEVNEKMMKGECFTCEEKYNPTHVCKNRQFRLMIMEEEEEGDPQSQQ

SEQ ID NO: 93198 - protein, 203 aa, Glycine max
  Coding DNA Sequence Number=SeqID_1513
  Gene Ontology: Mol. function=oxidoreductase activity, acting on the aldehyde or oxo group of donors, disulfide as acceptor; Cellular component=mitochondrial alpha-ketoglutarate dehydrogenase complex; Biological process=metabolic process
  Homolog annotation: Hit_ID=A7QSV3; Match level="QueryCoverage=93%, HitCoverage=53%, E-value=6e-70, Identity=66%"; Hit description =Chromosome chr4 scaffold_162, whole genome shotgun sequence
  Pfam annotation: Domain name=E1_dh; Domain location=1-202; Score =38.7; E_value=1.5e-11; Accession=PF00676.11; Description =Dehydrogenase E1 component
  Pfam annotation: Domain name=TPP_enzyme_C; Domain location=23-151; Score=-45.6; E_value=0.035; Accession=PF02775.12; Description =Thiamine pyrophosphate enzyme, C-termina
  Pfam module annotation: Pfam domain module=E1_dh::TPP_enzyme_C; Domain location=1-202::23-151
MWQWGVARKCSDANKYDNVKGRQMLTHYRPKKHNYFTVASTIATQISHVVGATYSLKMDKKDACVVTYFGDGGSRTFPCCLKFSAVLEAPVIFICWNNGWAISTPISDQFPRKAYGVRSIRDGNDALDIYSAIQAAHQMAITEERPILIEALTYRVGHHTASDDSTKYHPVNEIKWWRLTRDPMARFRKWIEKNGWWNDMAES

SEQ ID NO: 93199 - protein, 91 aa, Glycine max
  Coding DNA Sequence Number=SeqID_1514
MKDVEIQVVGMSPPPLRPHNHSQTHLKLSRRLPLQALILPRAHPRIVALSGWLAKPTGWHSERVKISTIQTHLIHLKLREKMIVKHTKWKY

SEQ ID NO: 93200 - protein, 109 aa, Glycine max
  Coding DNA Sequence Number=SeqID_1515
MPLFHLTIKVVACIHGEGRHDSRKCRSKDFAFDVLMMPYDHDVLMPYENVLLKFNSRQKSKNTRYNIKKISSALGREFQIEAAKGLAKKFKQKCFFQEIYSLVIDYQRM

SEQ ID NO: 93201 - protein, 109 aa, Glycine max
  Coding DNA Sequence Number=SeqID_1516
MVVVVQTYIVTFIRRGNPSDLQPFDPEIDRTFHRLVRHHLVPFEHPEHSVIGDFEHYSFEHSDFEHSENIAQPPPRERTLREMAAPDFTYEACASNTLMRMSRMFLKLV

SEQ ID NO: 93202 - protein, 153 aa, Glycine max
  Coding DNA Sequence Number=SeqID_1517
  Homolog annotation: Hit_ID=Q84VI1; Match level="QueryCoverage=100%, HitCoverage=22%, E-value=8e-34, Identity=54%"; Hit description =Envelope-like protein
MATSPKETSASGSPSVPSSPHQGQPELNIQPIQIIPGQAPVPEKLVPKRQQGVKTAENPSLATSPREVDPEMDKKIRSIVSNILKNASVPEADEDVPTSSTPNVSVPDVDQDVPTSSAPNAEALPSPSEEESTEEEDQASEETPGPRAPESAP

SEQ ID NO: 93203 - protein, 211 aa, Glycine max
  Coding DNA Sequence Number=SeqID_1518
RTAGAAIEAAQGVRFPVRINVVAFFARVAGIKGPVCLVELFLHAGIHLVTQVARIVPLLFALTRRLVAGRVVAIFNNQAIRLSDSQRRSQHHAGGQRGSEQGGKQETLYAGENRAAVFYHCDCRDHRLFSAVAVAEARHERLAIVTGRSQPGAVCLAADPASGSQRPGICGLWRRVCVNGADLAAAGRWRQTECVGLGGGMLIIVIGWGKA

SEQ ID NO: 93204 - protein, 40 aa, Glycine max
  Coding DNA Sequence Number=SeqID_1519
MEALENIQMVITFHTEVPIQAHHISRRSKLINGSSKEIQM

SEQ ID NO: 93205 - protein, 66 aa, Glycine max
  Coding DNA Sequence Number=SeqID_1520
  Subcellular localization annotation: CTP_CleavageSite=57; ConfidenceScore=5.30e-01
MTFATEGKGFSTLGAKALLLSTPKIKRSLKVQRLNVSLLPKIKRSLKVQRLNVSLLNQEIVKGPTP

SEQ ID NO: 93206 - protein, 276 aa, Glycine max
  Coding DNA Sequence Number=SeqID_1521
  Homolog annotation: Hit_ID=A7R1J8; Match level="QueryCoverage=27%, HitCoverage=20%, E-value=2e-14, Identity=57%"; Hit description =Chromosome undetermined scaffold_359, whole genome shotgun sequence
MSRFLQVSSFFEDEGESPVESDEIKVQTWSNQHYRNEPVVVVAAPRLQKYSSFHEQSGEPPLLLPIRSLKSRLSEEDIDVQSLNMLMSSKRFSSNSNRNAEVEADVVDTDVQSLNRSTISQGFSRNSNRKAEVIMLSSNTYVIMLSSNAEDSVRKKGFYKSCPPPPPPPPPTMFKKSVFMKPRFDGSSNEAPSFNKELKRSFTSERTTPVGKKSHEENKSKQGTLFRNNKFMGHASVPLVSQPAEKESLLVESNDDDDDDDTETEDQDVEGGRTVA

SEQ ID NO: 93207 - protein, 36 aa, Glycine max
  Coding DNA Sequence Number=SeqID_1522
MTARPGELLLHFEATLLAQTSQRLAWDSQGLETALK

SEQ ID NO: 93208 - protein, 80 aa, Glycine max
  Coding DNA Sequence Number=SeqID_1523
MAGSLDESISCFLIRVDPWVLVPIAFGRLHALAFRGLHVLALRGMHDLPFKGLHVLAFRGLHALTFRGLHVLAFRGLHAL

SEQ ID NO: 93209 - protein, 16 aa, Glycine max
  Coding DNA Sequence Number=SeqID_1524
MELTSFAQASCSSPMQ

SEQ ID NO: 93210 - protein, 134 aa, Glycine max
  Coding DNA Sequence Number=SeqID_1525
MEAMKGKMSTMMEAMMSMKKIMEAHAIVVAATGAVAKVNPMPPSDLNQMNHPTSDMVGKDLGSTDSPMMCKFKTSTPSRHMACLPTIHHPMWRTLPMRMSITPLLYSLRANNLNLIMHMSLDPWGRHMKCPTTI

SEQ ID NO: 93211 - protein, 135 aa, Glycine max
  Coding DNA Sequence Number=SeqID_1526
MSTTGRGRHSVLRIFKGRRGRTGHHATCEKITLSGAPADVSGLPNVAVSRHVPICTDDRSARARALGFAATAAPSYSSGLGPCPDGRVSAQLGTVTQLPVHPASPVLLTKKWAHLELSIPWGGLNRSSRHPSYLI

SEQ ID NO: 93212 - protein, 472 aa, Glycine max
  Coding DNA Sequence Number=SeqID_1527
  Gene Ontology: Mol. function=DNA ligase (ATP) activity; Biological process=DNA replication, synthesis of RNA primer
  Homolog annotation: Hit_ID=A0U6E2; Match level="QueryCoverage=57%, HitCoverage=52%, E-value=1e-31, Identity=37%"; Hit description=200 kDa antigen p200, putative precursor
MLQAARLVHVMLREIGLRSWLKTSGGKGLHVLVPLRRQYDWDTVKVFSQAIVQHLARTLPQVFVAKSGHEEPRRQDLRRLPAQRLRRHDGGSLVGARAAGHGRVGAAGLGRAGRGPGQRPVDHRQHPHPPGCGRRALGRLHAAGAGRSHEGDGLQAGFGRVGRLGAPIQPLTDAGAGQWAGAWGWRPTRLPPAPDRGVDHFVAVGAFDHHGDERCDNADDHRVRQPRKQPHPEFQPHAARLQALAHAQLREGDGQVDEQRDGARGLHQDVIDVHLRGGHHPDRGEGEQAGDEHAHIRRAGLAPGDLHDAMGVAAPGERIEHARGGVQRRIEAAAYRGQHDEVDDKLRVRDAQRVERDVVGALGRLREARRVVRHQADHDEDRSHVEQADAPHHRARGLDDLAARVGRFGGGHGDDLGADEGEHHAQQGHHHGLRAVGHEALAGQVAPSLGVAPRPQVRQRQAAHDQEQRGIL

SEQ ID NO: 93213 - protein, 82 aa, Glycine max
  Coding DNA Sequence Number=SeqID_1528
MVTSILQLDSMNLFVKARAWFNPITQRIAILIANTLTTFHRDERLENTHAMHGKCNYEIEMPEGTSFIRNGFMIPTWLAHGT

SEQ ID NO: 93214 - protein, 222 aa, Glycine max
  Coding DNA Sequence Number=SeqID_1529
  Homolog annotation: Hit_ID=A5AKA6; Match level="QueryCoverage=86%, HitCoverage=21%, E-value=4e-09, Identity=25%"; Hit description =Putative uncharacterized protein
MDTEFFSDEMFQCVQAFQNSGLILFMSLKIPVYPELVKVFYSNLEIQEGSLIFEVYGIKMVIDQSLFFELTQLSSDGVPFEGTLDDDWKFNFSVSDARRLVCINQADMTRRLFAGSLTFDCRILHYLIVRILLPRSSNLAQVSEEDLIIMWAFLIGRQIDWAHLVRYRMNKALRSNAPLPYPHLIYLFLHHFEVPLDFEPSVQIKKSFSIGAAVVASFGYRK

SEQ ID NO: 93215 - protein, 35 aa, Glycine max
  Coding DNA Sequence Number=SeqID_1530
GIGAEECCHPLKNTEVQQGANHLKSYWTKEALQIE

SEQ ID NO: 93216 - protein, 64 aa, Glycine max
  Coding DNA Sequence Number=SeqID_1531
MPTQTLTPSSPPPTTIGGHHEPPLVATEPPHQEEHFNRSKILRIHLKDSVDSNPSNPFFHSFFE

SEQ ID NO: 93217 - protein, 87 aa, Glycine max
  Coding DNA Sequence Number=SeqID_1532
MLVKGLMLWNNKWTCDLMQWSQGSQRIVIIKKGEIVEAMTSKVILMMPKNHELSKFHRFKNQVSRIKIQEFKIQEFKNQVSRIKIQE

SEQ ID NO: 93218 - protein, 108 aa, Glycine max
  Coding DNA Sequence Number=SeqID_1533
MASSTCFQQISSQITIMKQKPSKTTHHISQNPIPTKIKDVLHDSENALLSRFGAEMMTKGWSFVGASMVEEEEENGNLCHMSPFEWSKKGPLSLLIVTHTQPQKVRKF

SEQ ID NO: 93219 - protein, 198 aa, Glycine max
  Coding DNA Sequence Number=SeqID_1534
MTSPLDESISCFLIKVDPWVLVPITFRGLYVLAIRGLHILACRGLHTLAFRGLRVLIFSVIHIHTLREYKGSRPQDAQWTRRSPTGPWGFQLWLRASVSLTGCPSPQEESYPQRHPVDLEKSNRALGFPALVTDLCSPTGCPFPPARSRHHDIGIAPARHPLDPKKSSRVLELSSSNYGSLSVLRSACHLQQGHQAPY

SEQ ID NO: 93220 - protein, 105 aa, Glycine max
  Coding DNA Sequence Number=SeqID_1535
  Homolog annotation: Hit_ID=Q5CDC4; Match level="QueryCoverage=26%, HitCoverage=21%, E-value=1e-07, Identity=100%"; Hit description =LacOPZ-alpha peptide from pUC9
  Subcellular localization annotation: CTP_CleavageSite=55; ConfidenceScore=5.64e-01
MKFMSSASWSMWRSIASKRVLIPSMRSSTCAWNPRNSVRRSFRRTKESCHGGEAVCSSAGCGDASFFTQEPGTELEFVIMVIAVSCVKLLSAHNSTQHTSRKHKV

SEQ ID NO: 93221 - protein, 52 aa, Glycine max
  Coding DNA Sequence Number=SeqID_1536
MSKVMTKDNNRYLRALHWGNERHHAGASSDLGADQKFSPSRSKTRKGGLGKN

SEQ ID NO: 93222 - protein, 101 aa, Glycine max
  Coding DNA Sequence Number=SeqID_1537
MDEEQWMYDSMMSEEVDMNVENEEDAGIKVEHVDCYDAFNTSQLFASHDEVLQWARLLAHDIRLVVVIMRLDTDTGVRGRASFLLIACERSGEYRPKKHNL

SEQ ID NO: 93223 - protein, 113 aa, Glycine max
  Coding DNA Sequence Number=SeqID_1538
MEWFFRISHPFITRAEETAEPRHPPPPHDEEFVEPPIPEVLVASDLSTHSVVDCEGCQGMAKDLGAIAEDLERVINLQMVTEGTDLYDIMTRCLRRARGDAQMEVLGRDRDAA

SEQ ID NO: 93224 - protein, 134 aa, Glycine max
  Coding DNA Sequence Number=SeqID_1539
MGLQFFEMENESRGERKPVEEKKGTKMEKQMTKKACAEEERKKTKGGRLLGAQAKKKCGRRKVYEEPLKGQIAIQSSNIINHEQQVDPRLNSEHVNEKHLKGSWLLQSFNIPNFEWQVDHRMKSENTCSKTIKL

SEQ ID NO: 93225 - protein, 68 aa, Glycine max
  Coding DNA Sequence Number=SeqID_1540
MARLLMKKARGVATNFYSRKTFEKPKDEAKDGIGGHGSSPRRAGARPSKLLLQPEVTLLAQASRLLHP

SEQ ID NO: 93226 - protein, 193 aa, Glycine max
  Coding DNA Sequence Number=SeqID_1541
  Gene Ontology: Mol. function=long-chain-fatty-acid-CoA ligase activity; Cellular component=integral to membrane; Biological process=metabolic process
  Homolog annotation: Hit_ID=Q9SEW6; Match level="QueryCoverage=61%, HitCoverage=37%, E-value=2e-32, Identity=64%"; Hit description=Amino acid transporter b
MNSNMYMISFGIVEIIFSQISSFDQLWWLSIVAVVMSFTYSTIRLGLGIGKVIGMNSCYSHVHHDDICSSSITENRGVGGSLTRITVGTVTQTEKVWRTMQALGDIAFAHSYSLILGEPCKLLGVKCGIYGANSAEWIMSMQAYNAHGLYCVPLYDTLGAGAIVFIICHSEVSIAFAEEKKIPEVLLSKPYVL

SEQ ID NO: 93227 - protein, 376 aa, Glycine max
  Coding DNA Sequence Number=SeqID_1542
  Pfam annotation: Domain name=DUF247; Domain location=1-366; Score= -136.7; E_value=0.0005; Accession=PF03140.6; Description=Plant protein of unknown function
MMENQIPLIVLKRISGILFPEIFTDGGTDKLIQNLALSILGYNAPDSDFKASHLLEFVHQDLKSSISSGEVPNTRHGKQNLQRCATRLEAAGVTIGPPQAQSENANMEAGVTAEPAEAQSEVTTQPSEALSEAANMEDGVTDKPPKAQSEVTTQSPEALSKAANMEVVVNVRPRVAAETRFDLKVTFSDGKLEIPQLHITETTEAKWRNFIAWELNRTTLEKQRGVRNEDRISCQFISYALFFQSLTCSVHDVKLLRDRNVIVVHKLMSDEDLLNLFHNIIEGVPDAEIEMDSWFAQVIENLNSHPTTVDRVTTTSKIMWHIFICFLTWSWYQCRGTYRGLRRVYFPSGWKLIALLAAALGLGLTIAQTVFSALGQ

SEQ ID NO: 93228 - protein, 119 aa, Glycine max
  Coding DNA Sequence Number=SeqID_1543
MEKRLMIVLGIGRSGAWTRQACMWEILEKKEWSATSTMKAHLVDLTPSWGSKGGEMSPTKGGVVRLDGGRLARRGTKERTSRRRWGQRKGRWLEFSKASNESESQRDRIRRERGKDTYI

SEQ ID NO: 93229 - protein, 73 aa, Glycine max
  Coding DNA Sequence Number=SeqID_1544
MDCPVLIKPRSTFECGSIDLGITPNLQDVLMQGHEGWKASQLNDKEWWVITTSLFQWHCCSSMVRFHNSDVPM

SEQ ID NO: 93230 - protein, 64 aa, Glycine max
  Coding DNA Sequence Number=SeqID_1545
  Subcellular localization annotation: CTP_CleavageSite=58; ConfidenceScore=5.27e-01
MMRQTSDVKIALTGSLAHQWAKCASTAKRSFRVLSVTEEFGRASISRWRAKHEISALSAAVVFS

SEQ ID NO: 93231 - protein, 114 aa, Glycine max
  Coding DNA Sequence Number=SeqID_1546
MENCNKQSLHMSPNSWVEDALTKTQFMGLRKEGRMNENAIHGSPKQGREWRIALSNHYAWLQTCGWRMHERKCNSWGSEKRGREWRIALSNHYAWLQTRGWRTHKRKRNSWGSE

SEQ ID NO: 93232 - protein, 63 aa, Glycine max
  Coding DNA Sequence Number=SeqID_1547
MWMQAIGLFAQATCAPEFGLPRPFNQRLLVLRVGGVDGQPFLCVQESPTTRDPRSLNPFSEIR

SEQ ID NO: 93233 - protein, 86 aa, Glycine max
  Coding DNA Sequence Number=SeqID_1548
MSLSCIDFISSFMPLIHLYLRKNLIIFLFLNNIINNSLKVFYYWSCFLNNNRYEDLSTANNRTIPHSLRKSTKGPERCSPDPSYLP

SEQ ID NO: 93234 - protein, 155 aa, Glycine max
  Coding DNA Sequence Number=SeqID_1549
MAHQNPPYLAFCTPGQNETKNKIQGYQRKTNKNIYIFLNEHQGMKGMEAHEDQKACSKLQNKERETRLKRAIKGINSRKHQEESSQGNCASNQWGKTHQTIIMMDGSNSHKVISPNSIDSVPAYTTILVLEVFIKGLPRMMGTDPLENPSPIFKI

SEQ ID NO: 93235 - protein, 51 aa, Glycine max
  Coding DNA Sequence Number=SeqID_1550
MASFAMYLSTIDASGRYRFFVYPFKIFMYRSTGINDFATYGMEEKAQASYG

SEQ ID NO: 93236 - protein, 28 aa, Glycine max
  Coding DNA Sequence Number=SeqID_1551
MARKLQEDWAKDARECLRILMSLMGSIV

SEQ ID NO: 93237 - protein, 92 aa, Glycine max
  Coding DNA Sequence Number=SeqID_1552
MRIVGIGNAKFIENSEISGSEVPREVDIKEFRVQVLLACAFSCKNYQRVVRELVVSGSSRLNVTLMAVEAKLHDESTMIQKCFDDNNDDNKR

SEQ ID NO: 93238 - protein, 101 aa, Glycine max
  Coding DNA Sequence Number=SeqID_1553
MRRQNLVIPHPFAIQTQSCPMARRDKNLVILHPLSSRGGGPDDMRRQNLVIPHPFAIQTQSCPMARKDKIWSFCTLRQSRPISLLTRGDLHHLPHSQDLSY

SEQ ID NO: 93239 - protein, 86 aa, Glycine max
  Coding DNA Sequence Number=SeqID_1554
MTHTKNIGQMTSEATKEIAGKIMQSQGLALPLKPEVGPSAARVSTKESCVDPSGTIQTCVTRRKCWLYIEENPSCLVAIGDFMRGP

SEQ ID NO: 93240 - protein, 132 aa, Glycine max
  Coding DNA Sequence Number=SeqID_1555
MPVSAEAKHQLSSHEMMRIMKLAKYRLKAQVEKDEGPSGEGQSPRVEKDEGPSNPCGVYPDLSSFTGSGVYLDLSSFVGSGVYPDLSSFTGSGVYPNLSSFTGSGVIQTFVACIKRSAPTQVHIIWYQSFSS

SEQ ID NO: 93241 - protein, 81 aa, Glycine max
  Coding DNA Sequence Number=SeqID_1556
  Subcellular localization annotation: CTP_CleavageSite=56; ConfidenceScore=5.13e-01
MGGYLMVTRTFRQPRANEPVDARRLTSSSAPFVVLTRESGDMRCYLMVTRTFGQPVANKPVDARRLTSSAAPFVILTREVR

SEQ ID NO: 93242 - protein, 49 aa, Glycine max
  Coding DNA Sequence Number=SeqID_1557
MLYAKKVEKHIKVAIYLKNFMGSAKVEEDTEAAIFYSKKLPFLSDFYVK

SEQ ID NO: 93243 - protein, 62 aa, Glycine max
  Coding DNA Sequence Number=SeqID_1558
  Subcellular localization annotation: CTP_CleavageSite=16; ConfidenceScore=5.22e-01
MRTRSPLKARACSPLQARTYSPLKVIGTSTQGSTFMRKQEIDSSRRQTHATFVVKFGNADRT

SEQ ID NO: 93244 - protein, 58 aa, Glycine max
  Coding DNA Sequence Number=SeqID_1559
  Subcellular localization annotation: CTP_CleavageSite=35; ConfidenceScore=5.29e-01
MSQGNFQWGVFSPESAPGRQPKLQNPRSLVRMNIQASSADPSCKTTPDLDNPIRFRLT

SEQ ID NO: 93245 - protein, 82 aa, Glycine max
  Coding DNA Sequence Number=SeqID_1560
MEAKPSRCGCVMRSTHSLPCALKHSASSSEEPIQRWNIPMLDQFHPCIQDSIENIIGVKANGNCGYRAIAALLVWVKNHGHW

SEQ ID NO: 93246 - protein, 122 aa, Glycine max
  Coding DNA Sequence Number=SeqID_1561
  Homolog annotation: Hit_ID=Q3EAH8; Match level="QueryCoverage=68%, HitCoverage=14%, E-value=7e-28, Identity=71%"; Hit description =Uncharacterized protein At3g59040.2
  Pfam annotation: Domain name=PPR; Domain location=13-47; Score=19.7; E_value=0.011; Accession=PF01535.11; Description=PPR repeat
  Pfam annotation: Domain name=PPR; Domain location=48-82; Score=29.6; E_value=1.2e-05; Accession=PF01535.11; Description=PPR repeat
  Pfam module annotation: Pfam domain module=PPR::PPR; Domain location =13-47::48-82
MASDLELVGFGKMDFFMLITTYGKLGDFNGAEKVLGLMNKNGYAPNVVSQTALMEAYGKGGRYNNAEAIFRRMQKWGLEPSAFTYQIILKTFVHEVAERLWTGWEDERIEKNENSGTAVDID

SEQ ID NO: 93247 - protein, 119 aa, Glycine max
  Coding DNA Sequence Number=SeqID_1562
MLVATLVHFPLLEDAPLSLTRPPAEGSKLHDESILIQRSFDDNKGDNKKLKGSRKNKFKMFKIESRTLQGSRGNLISRNKNQVSRFKFQESRSRFKTQDSRIKRRINQDKYEKVFSKTE

SEQ ID NO: 93248 - protein, 290 aa, Glycine max
  Coding DNA Sequence Number=SeqID_1563
  Pfam annotation: Domain name=DUF1723; Domain location=95-139; Score =17.0; E_value=0.0051; Accession=PF08330.1; Description=Protein of unknown function (DUF1723)
MTNIFERARRVQDPASGATTIKCSRRITKQAAAPIIEDVEHVDHVDDEGFPGGPHVTSVFMDYVHHVVVTVWNGKERPVLKLSSHGSCPPIEKIGRPAPEIEGLVETSSFHLSVGEVTITLDDVALLLHLPIIGAFYSFEALHVDQVVDLLVDLLECWIYEHFPTIVSFIATEDYHERKPRVCRWKSGKTLPASMYHKRLDRLTFDITIPPHHAAQSLSIEDIDDRWIQFFEYLALVGQICVAPGQCTTDYIKWFYFISHPFMSLTQPGDPPRHPPVVHDDTFIEPDPPQ

SEQ ID NO: 93249 - protein, 110 aa, Glycine max
  Coding DNA Sequence Number=SeqID_1564
MTKHQRSIKYDLSYWDNSSVKRSASSSEQAKPRRTMPMLDQFHPCIHDSIENIVNVKADELAKWSDEYINLLGGIDRFEELKRSLLVDGLSMVTMNKWMNITDMGYVIAS

SEQ ID NO: 93250 - protein, 414 aa, Glycine max
  Coding DNA Sequence Number=SeqID_1565
  Gene Ontology: Mol. function=acetyl-CoA carboxylase activity; Cellular component=acetyl-CoA carboxylase complex; Biological process=fatty acid biosynthetic process
  Homolog annotation: Hit_ID=P0A9Q6; Match level="QueryCoverage=47%, HitCoverage=64%, E-value=1e-85, Identity=83%"; Hit description =Acetyl-coenzyme A carboxylase carboxyl transferase subunit beta
  Pfam annotation: Domain name=SNARE_assoc; Domain location=31-152; Score=14.9; E_value=0.0002; Accession=PF09335.2; Description=SNARE associated Golgi protein
  Subcellular localization annotation: CTP_CleavageSite=51; ConfidenceScore=5.34e-01
MASGFMPFCSSFCFVNRSGRYPLPAGRFTAVCRRGLSALPTNDLNVHLMVELMVIAAIVGDSVNYTIVRVFGERLFSNPDSKIFRRSYLDKTHAFYERHGGKTIILARFVPIVRTFAPFVAGMGHMSYRHFAAYNVVGALLWVLLFTYAGYLFGDLPVVQENLKLLIVAIIVLSVLPGVIEIIRHKRAAAKQAKQKWHYSPLIAKLAYDQVQAERLSMSWIERIKSNITPTRKASIPEGVWTKCDSCGQVLYRAELERNLEVCPKCDHHMRMSARNRLHSLLDEGSLVELGSELEPKDVLKFRDSKKYKDRLASAQKETGEKDALIVMKGTLHEMPVVAAAFEFSFMGGSMGSVVGARFVRAVEQALEDNCPLICFSASGGARMQEALMSLMQMAKTSAALAKMQERGLPYISC

SEQ ID NO: 93251 - protein, 145 aa, Glycine max
  Coding DNA Sequence Number=SeqID_1566
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=58%, HitCoverage=72%, E-value=3e-24, Identity=69%"; Hit description=LacZ protein
MALGEGTNARTDVRASGPHRLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 93252 - protein, 148 aa, Glycine max
  Coding DNA Sequence Number=SeqID_1567
MEADLQYTQERLRAAGRDLGTTVYPEATMTDRLLCTSDVNMYFARWASRDEKLLHIDRLGPRKNTITKRAARDPYRTRSKSRTMGDQEETQEQMKADMSALKEQMASMMEAMLGMKQLMEKTRPLPPLSVRLPKQTRLSWHYAPSPQT

SEQ ID NO: 93253 - protein, 204 aa, Glycine max
  Coding DNA Sequence Number=SeqID_1568
  Homolog annotation: Hit_ID=Q5NRP4; Match level="QueryCoverage=48%, HitCoverage=6%, E-value=4e-08, Identity=35%"; Hit description =Putative gag-pol polyprotein, identical
  Pfam annotation: Domain name=zf-CCHC; Domain location=161-178; Score =18.2; E_value=0.0027; Accession=PF00098.14; Description=Zinc knuckle
MSHHSSSVNGEGTSHKDPLSRLLDELSFLKLWKEKLERKEKGEERSLSEELCDYYEGRHRSHLRPHSHRRENERKPQEANINLPYFHGKDNVGAYLDWKIRVEQKLKRKSTLKSYGSHYYPKKDQGLGILGAAPSKPKDDKGKTIEKQPPKASMQEKTSSIKCFKCLGRGHNTSQCPTKKTMIIRGQDIYSSQDEATTSPSSSE

SEQ ID NO: 93254 - protein, 139 aa, Glycine max
  Coding DNA Sequence Number=SeqID_1569
  Homolog annotation: Hit_ID=O52175; Match level="QueryCoverage=58%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTERHAKHHWQQPLVIDLEELVLKSCAG

SEQ ID NO: 93255 - protein, 138 aa, Glycine max
  Coding DNA Sequence Number=SeqID_1570
MTKARQKGVRKGKRGRWLPPSSPRRARLLPPEGTAFCWKILEGPSGPDCYLYPLFTKYTPSALFCRFFFRNVTELYELRNDTCFLSVMSRNLTNYAIIPSLASGMLRNFTDCLTMGVKYLKVVKRGSHPNKQMVPRRN

SEQ ID NO: 93256 - protein, 35 aa, Glycine max
  Coding DNA Sequence Number=SeqID_1571
MVFGHWACGMAVIARVSPSFSSFSFAPVFAFIKAG

SEQ ID NO: 93257 - protein, 153 aa, Glycine max
  Coding DNA Sequence Number=SeqID_1572
MDKLKKRLPGDRTNLVDLGRNYRSDQFAFVNYTVIYKTKVERKDIELVDEEEAQIGVDRSSATSNKSEIYKEEARNAAQKHKPKRVESVNADAEAFAEALEHMRKRDAGHQSVSLENKTGDSTVLKIGDSAKVVIKQDVKGRKHKYGFNNNKR

SEQ ID NO: 93258 - protein, 103 aa, Glycine max
  Coding DNA Sequence Number=SeqID_1573
DNDEKKNKEGVEKENEKNDEVVASEIVEEKVVSEEQKQKSKKQATNKGKAIVNHPSIKHLPYPHAPSKKDKERAIIALPGDRPIFQEEDEDMTDLVDYFIGGD

SEQ ID NO: 93259 - protein, 107 aa, Glycine max
  Coding DNA Sequence Number=SeqID_1574
  Subcellular localization annotation: CTP_CleavageSite=12; ConfidenceScore=5.04e-01
MKLRLKSTRKVKLVRKKSLKRILRLLSFGTNVRGANTFLKCKYNSRIWNILHDRFPSVFPTFSTNKRWWRLRAFSSFGRYTHEPRLARPQKGRLRQLATPLGIVFVS

SEQ ID NO: 93260 - protein, 16 aa, Glycine max
  Coding DNA Sequence Number=SeqID_1575
MEHASHESRVALPPKG

SEQ ID NO: 93261 - protein, 40 aa, Glycine max
  Coding DNA Sequence Number=SeqID_1576
MVNESEIVIFLRQVRWPAGKREGFERKEKKRNCEAEEAED

SEQ ID NO: 93262 - protein, 108 aa, Glycine max
  Coding DNA Sequence Number=SeqID_1577
  Homolog annotation: Hit_ID=A5B258; Match level="QueryCoverage=39%, HitCoverage=7%, E-value=3e-07, Identity=65%"; Hit description =Putative uncharacterized protein
MHIEKNVCDSVIGTLLGIQGKTKDNFNTLQDLVEIVKQKTVAVPFIWGGMYLVKRYMKNLKGRRRERRHHLLENKPWKEKLQHQESALDKKLREEASIEEKNEIEEGA

SEQ ID NO: 93263 - protein, 146 aa, Glycine max
  Coding DNA Sequence Number=SeqID_1578
MWDATIFGVFNQNFPLYIKHEDLSEIAHGGQCLSISVIQLWILHLIETSVRAGNSDVYEFLEPQSNQRSRQSQFESESYIKSWIQSSKRDVYLGAYLNGSDNYLKGIINSALKGLDDAPQPKSKAAARWIVVKCIDKKESLNVATI

SEQ ID NO: 93264 - protein, 172 aa, Glycine max
  Coding DNA Sequence Number=SeqID_1579
  Homolog annotation: Hit_ID=Q6L477; Match level="QueryCoverage=58%, HitCoverage=16%, E-value=9e-09, Identity=29%"; Hit description =Putative uncharacterized protein OSJNBa0009L15.8
  Subcellular localization annotation: CTP_CleavageSite=50; ConfidenceScore=5.63e-01
MGSPPASPPPHAPSNISASPSAVKRTRKALRLRSLSTRPPGAERPVVHVDPATGKADGPHRKKLRTYLGIVACDKVDVTYENRKEVPTAQKDLIWEDIQAEFDIPEAFDSRTKRKLLQTMGERWRQFKSDLTRKWVLAADQDGMEDIVSEKYNISMEKWAQFCQTRRDPSWE

SEQ ID NO: 93265 - protein, 121 aa, Glycine max
  Coding DNA Sequence Number=SeqID_1580
MSYLAITTPISLYLSASWCMAPTRHPLDPDKSNKALGFPMLITGLCQSFEVPVTPSKVIRPPITRAFIEKYCTPRKAQGDALLRSSLGLRSHGPETSPRPKQGRSLQDPPVRQMNPIWMKR

SEQ ID NO: 93266 - protein, 31 aa, Glycine max
  Coding DNA Sequence Number=SeqID_1581
MEPLNNKFDGMTTSIEIPKTNSKEAHAKGVT

SEQ ID NO: 93267 - protein, 306 aa, Glycine max
  Coding DNA Sequence Number=SeqID_1582
  Homolog annotation: Hit_ID=A7P9D5; Match level="QueryCoverage=23%, HitCoverage=2%, E-value=6e-12, Identity=52%"; Hit description =Chromosome chr3 scaffold_8, whole genome shotgun sequence
MEITESLEDGILEMNSVFSQMNDSFKNLSSDLDDVTNERDQLQGQVICLKSRLEKDEAQAEANEAIAKEAQKTFTDQVDSYECCGSTWSVRVLRINLIHKTRMDQLDLYYPYFICNPTYYYGSSISYLIHLLNPYVDQLKHITNQKRSRNQNHGENRLTSTSTVEHSPIHVFNVVNAKLQSTTQRQTRMKKKTMTQEEAEWPKKRSRRRVASRGRVELALYQTDLAYGIKKVLKKTKRKKGGGSCDDDDLWNGHVMVTLHPFPYSTNSMYSKIKFMEIKLFQTFPYLMKMMHDDKDEDVKYLEREK

SEQ ID NO: 93268 - protein, 60 aa, Glycine max
  Coding DNA Sequence Number=SeqID_1583
MCLIYDLFKETKIWDDTKRTWLGISFFHFCEEGKRDSQDLKSKLPEKENFGFPVSDVGAL

SEQ ID NO: 93269 - protein, 79 aa, Glycine max
  Coding DNA Sequence Number=SeqID_1584
MWAIIDQYKEKLSLAATHEQRLEDEYAKVSVLQAEREARERVIDSLHREAMIWMHRFIFTLNGSQELPRLLAKAKAMAD

SEQ ID NO: 93270 - protein, 210 aa, Glycine max
  Coding DNA Sequence Number=SeqID_1585
  Gene Ontology: Mol. function=protein dimerization activity; Biological process=DNA integration
  Homolog annotation: Hit_ID=Q2R1C3; Match level="QueryCoverage=99%, HitCoverage=26%, E-value=3e-47, Identity=50%"; Hit description=HAT family dimerisation domain containing protein
MRAHLLKMTGKGVRGYQKVTVDKLIDLKKTVNEATLRVEKSKTKSMSLPPISTQYQMDTNTLGVDPKKRKTSTIESAFNLQARETLNHEIARMFYSLGMSFHLARNPHYRKAFTYAANNHIGGYQPPGYNKLRITLLQSERRHVENLLQPNKNAWSQKGVNIVSDGWSDQQRRSLINFMAVTESEPIFLKAIDCSNEIKDKNFIAKHMRE

SEQ ID NO: 93271 - protein, 42 aa, Glycine max
  Coding DNA Sequence Number=SeqID_1586
MDKSLKVEEDEWKEKERRSTKFYASKEPTNPRSSPIFSTKCA

SEQ ID NO: 93272 - protein, 115 aa, Glycine max
  Coding DNA Sequence Number=SeqID_1587
  Subcellular localization annotation: CTP_CleavageSite=68; ConfidenceScore=5.21e-01
MVQPKPSAGLKGKPHQHALTFMLSCVSTNKGLGPLGLSHVLAFILILASCPHPKMVQEFSPRRAQLAQASSARPSELTLYLYYFFGKTQDTRLPPSRASCLSGAGLGTTIHRSWA

SEQ ID NO: 93273 - protein, 213 aa, Glycine max
  Coding DNA Sequence Number=SeqID_1588
SASSWDYPLVLEEGQECEYGQRRNRSDEFDEEAIAHLLCIPGQDFARTAAGRQVRIMRTNMTTLTQIWMTLLLSNIQPSDHNSDLPLPKCMAPTRHPLDPDKSNRALGFPALITGLCQSFGVPVTPSKAANHRAHVQTYDCLYQMSLSLQGQGFTSFPCPTPDRFRAEVAWPEARAGEPPVEAPAEAPDKADEAREDEEMADLLDFLGGSGAT

SEQ ID NO: 93274 - protein, 42 aa, Glycine max
  Coding DNA Sequence Number=SeqID_1589
MCKLARLGELGSPGRAGLAWASWARLGEPPPAPNYKNDERGD

SEQ ID NO: 93275 - protein, 56 aa, Glycine max
  Coding DNA Sequence Number=SeqID_1590
QFRAEVAWPGDWPIEEGTGPAGSPGEAEEAHMDEDMTDLLGYLEEGGATRLRSPHL

SEQ ID NO: 93276 - protein, 183 aa, Glycine max
  Coding DNA Sequence Number=SeqID_1591
  Gene Ontology: Biological process=transposition, DNA-mediated
  Homolog annotation: Hit_ID=Q1J7G7; Match level="QueryCoverage=18%, HitCoverage=47%, E-value=2e-11, Identity=96%"; Hit description =Transposase
MVKVGTSYVPINVSFSPKVGPGLPGINRDTRIYLFCDVLQWLLFLSAVPPVQLLTGWCVTAKAPPDISAGKCSGHAARRVPFAIQAAQLLGRAIGAGLFAITPAGERGMCCKAIKLGNARVFPVTTFRETCRASCINESANARGEAVCVLGASGVYTGLTMLALMRVSVKCFMWQEKKGCTGA

SEQ ID NO: 93277 - protein, 170 aa, Glycine max
  Coding DNA Sequence Number=SeqID_1592
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
  Subcellular localization annotation: CTP_CleavageSite=10; ConfidenceScore=5.26e-01
MKHFTDTLISANIVSPVYTPLAPNTQTASPRALADSLMQLARQVSRLESGHPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 93278 - protein, 55 aa, Glycine max
  Coding DNA Sequence Number=SeqID_1593
  Homolog annotation: Hit_ID=A5B1P9; Match level="QueryCoverage=94%, HitCoverage=3%, E-value=1e-08, Identity=50%"; Hit description =Putative uncharacterized protein
MKDFLKKSWYIDSGCSKHMIGDASKFTHISPKKSGHVTYGDNNKVKMMILGYGIE

SEQ ID NO: 93279 - protein, 97 aa, Glycine max
  Coding DNA Sequence Number=SeqID_1594
EVMAVRLFPAADHPNAAVVFRPAPVWGAVLLDESSISRGPDALAGGDRYSVELTETRLIEARNQSWKPQGPVGLLQVHWVSLWGEIGIAVAGQNVAK

SEQ ID NO: 93280 - protein, 110 aa, Glycine max
  Coding DNA Sequence Number=SeqID_1595
  Homolog annotation: Hit_ID=Q2QRY8; Match level="QueryCoverage=93%, HitCoverage=16%, E-value=1e-13, Identity=32%"; Hit description =Retrotransposon protein, putative, Ty1-copia subclass, expressed
  Pfam annotation: Domain name=RVT_2; Domain location=2-101; Score= -193.2; E_value=0.068; Accession=PF07727.5; Description=Reverse transcriptase (RNA-dependent DNA pol
MGFSVEGNEHMVCILKKSIYSLKASFSPMENTCLSVYVSEANDLGLLHETKKFLSRNFEVKDMGEANWLRNFISGLGIVDSIARPLKMYCDNSATIFFVRTTSTLRVLSI

SEQ ID NO: 93281 - protein, 19 aa, Glycine max
  Coding DNA Sequence Number=SeqID_1596
MDQGISQSCDSACHRSLGT

SEQ ID NO: 93282 - protein, 226 aa, Glycine max
  Coding DNA Sequence Number=SeqID_1597
  Gene Ontology: Mol. function=oxidoreductase activity; Cellular component=cytoplasm; Biological process=auxin mediated signaling pathway
  Homolog annotation: Hit_ID=A6TDJ9; Match level="QueryCoverage=79%, HitCoverage=61%, E-value=3e-75, Identity=76%"; Hit description =Putative aldo/keto reductase
  Pfam annotation: Domain name=Aldo_ket_red; Domain location=1-211; Score=-12.7; E_value=9.9e-08; Accession=PF00248.12; Description =Aldoketo reductase family
MQLAGPGVFGPPKDEARALQVLRDAVAAGVNHIDTSDFYGPHITNQLIKKALYPYPDDLVLVTKVGARRDAKGGWLPASTPEELTQAVEDNLRNLGLDVLEVVNLRSMLSVHGPAEGSLEPQIEAMIKLQQRGLIRHIGLSNVTASQVAQAQQMTPIACVQNLYNLANRQDDALIDQLAAHRAFPTCRSFRSAVFRRCSRNSSARWPARSTPVRCRWRSPGCYSVR

SEQ ID NO: 93283 - protein, 82 aa, Glycine max
  Coding DNA Sequence Number=SeqID_1598
MHENEWHGACLLFAPIREPIGQYLGENRRKPVRMKILSSGVVFTIEEGISTSHVDKSGALAPTYPPSKRKSDLRSSSLCVNQ

SEQ ID NO: 93284 - protein, 87 aa, Glycine max
  Coding DNA Sequence Number=SeqID_1599
MEQYVRHWFASRQPTTEHMYGPMTSQGFAPFSCPTPDQFRAEVAWPGDWPEAQAGEASPEAPGDGEEAHEDEEMADLLDFLGGSGDT

SEQ ID NO: 93285 - protein, 154 aa, Glycine max
  Coding DNA Sequence Number=SeqID_1600
  Subcellular localization annotation: CTP_CleavageSite=21; ConfidenceScore=5.50e-01
VWMSSTLKMRTRSPLKVRACSASQGEDSPFKVRACSPLTVRACNPLMVRTCSPLKARTCSPLNGEGRVVLSRRGRVVLSTVRVTSTQVPKVRTYSPLKARTCSPLEVRACSPLMVRTCSPLKARTFSPLKVRTCNPLKARMCSPLKVRACSPTK

SEQ ID NO: 93286 - protein, 232 aa, Glycine max
  Coding DNA Sequence Number=SeqID_1601
AFSPDAEQLATLAATTSDFASSTDDAGTADGVAESVGGRHLLRAGRQRAAGRRDVDADSSGVARATHQRPARARRLGARLAAPAAAAVYLHPADPAWPDAVCGAGRADGDRLRTGAGDRLGRQERRVRFAQAEQQTGLRQCARDRAGDDAVAGGQTAGAVFGEPSVGADAERRQRGVDRVEQPGVCPAADLPVPPVYAAARLTPASAKIKGHASARPFFVYPITAASACSLL

SEQ ID NO: 93287 - protein, 205 aa, Glycine max
  Coding DNA Sequence Number=SeqID_1602
  Gene Ontology: Mol. function=protein heterodimerization activity; Cellular component=cytoplasm; Biological process=vitamin B6 biosynthetic process
  Homolog annotation: Hit_ID=A5BD59; Match level="QueryCoverage=91%, HitCoverage=79%, E-value=5e-68, Identity=66%"; Hit description =Putative uncharacterized protein
  Pfam annotation: Domain name=GATase_3; Domain location=30-147; Score=- 38.9; E_value=0.0018; Accession=PF07685.5; Description=CobBCobQ-like glutamine amidotransfe
  Pfam annotation: Domain name=SNO; Domain location=6-203; Score=75.8; E_value=1.4e-19; Accession=PF01174.10; Description=SNO glutamine amidotransferase family
  Pfam module annotation: Pfam domain module=GATase_3::SNO; Domain location=30-147::6-203
MAVVGVLALQGSFNEHIAGTLGVQGVEIRKPEQLNTISSLIIPGGESTTMAKLAEYHNLFPALREFVQMGKPVWGTCAGLIFLANKAIGQKTGGQYLVGGLDCTVHRNFFGSQARHGGAIRWNGVFIWRNFGLPPSAIDNIYYNFEAELSVPELVSKEGGPETFCGIFIRAPAILEAGPEVQVLADYPVPSSRLLSSDSSIEDQT

SEQ ID NO: 93288 - protein, 38 aa, Glycine max
  Coding DNA Sequence Number=SeqID_1603
  Homolog annotation: Hit_ID=Q2LFC2; Match level="QueryCoverage=94%, HitCoverage=3%, E-value=2e-08, Identity=77%"; Hit description=AGO4-1
MANVHTQSPKMEMIDNLFKKASDKEDEGIVRELLLEFI

SEQ ID NO: 93289 - protein, 100 aa, Glycine max
  Coding DNA Sequence Number=SeqID_1604
  Gene Ontology: Mol. function=phospholipase D activity; Cellular component=cytoplasm; Biological process=phosphatidylcholine metabolic process
  Homolog annotation: Hit_ID=A2Q468; Match level="QueryCoverage=97%, HitCoverage=12%, E-value=4e-29, Identity=67%"; Hit description =Phospholipase D/Transphosphatidylase; C2 calcium/lipid-binding region, CaLB
LTKCICANRNPAYVTIKIDNQKFAKTSQEINRVWNQTFQIHCANPADSCITITLKASCSLVLGKFDIQAQQLLKKGGFINGFFPILMDNGKPNPKLKLKF

SEQ ID NO: 93290 - protein, 176 aa, Glycine max
  Coding DNA Sequence Number=SeqID_1605
MDSVVGKETRLERLENVDDLMSYQMIFKKHDIRVCNYKHCNEIITNAYEKRDTLYICTSFNEKSPYPIVVLQTVMNLIWQKQNWMIVFASVLYQLFPSNVDEIGVWSLQGIRNHPEKNVVNLNLKMNLNPLSLKHQILQSIHLESLGMMGLKVSTLDPSDSVLFHLHIMRQNFSRF

SEQ ID NO: 93291 - protein, 291 aa, Glycine max
  Coding DNA Sequence Number=SeqID_1606
  Gene Ontology: Mol. function=hydrolase activity, acting on glycosyl bonds; Cellular component=beta-galactosidase complex; Biological process=carbohydrate metabolic process
  Homolog annotation: Hit_ID=Q5CCP8; Match level="QueryCoverage=59%, HitCoverage=20%, E-value=6e-69, Identity=72%"; Hit description=Beta -galactosidase
MATNKRCQNEIEIEEHPEWEIKNGSVFFQKAKESAPCKEIPSLQLINQTLSYAYTFGQPKYGHFKELHRAIKMSCLLILANSQHFEAHVYTTESGDCTAFLSNYDSKSSARVMFNNMQYSLPPWSVSILPDCINVVFNTAKVGVQTSQMQMLPTNTQLFSWESFDEDIYFVDESSAITAHGLLEQINVTKDASDYLWYITSVDIGLSESFLRGGEFPTLIVQSTGHAIHFLPLEQGSIGDSHILARMWENTLSREAQESLVQLHSMDLTRENGTCQGRNGVIRLHTHTLDT

SEQ ID NO: 93292 - protein, 77 aa, Glycine max
  Coding DNA Sequence Number=SeqID_1607
MVCTNSRKKLRNIPQFNPNPIFDTQLVPFKPLILKPINPPRCGRVAIAAEEGVVGIAVDGGCGVAQRDVVATGGVRR

SEQ ID NO: 93293 - protein, 48 aa, Glycine max
  Coding DNA Sequence Number=SeqID_1608
MWGIPYGYPHLSSTKENEVDGFYFCHPETFKPDDARDSSLLGGDDQVR

SEQ ID NO: 93294 - protein, 105 aa, Glycine max
  Coding DNA Sequence Number=SeqID_1609
  Subcellular localization annotation: CTP_CleavageSite=51; ConfidenceScore=5.54e-01
LASSSPGPPNAFKVKKPARLGKLMTLGLSLSSPGRAASAPSDPFPINKRARGAERGFHHRVVKEIERIKREEEERRGNEAEALPNHDCDQSLRCSLFSVLHANVS

SEQ ID NO: 93295 - protein, 161 aa, Glycine max
  Coding DNA Sequence Number=SeqID_1610
  Homolog annotation: Hit_ID=A5B2J2; Match level="QueryCoverage=65%, HitCoverage=30%, E-value=7e-10, Identity=34%"; Hit description =Putative uncharacterized protein
NPSDIQPFDPEIDRTFHRLVRHHFIPFDHPEHSITGESVHSVIGDFEHPDFEHYNFEHSDFEHSENMAQPPPRERTLRKMAAPDFTYESLCIQYPDEDVPYVLKTGLIHLLPKFHGLAGEDPHKHLKEFHIVCSTMKPPDVQEDHIILKAFPHSLEGVAKD

SEQ ID NO: 93296 - protein, 46 aa, Glycine max
  Coding DNA Sequence Number=SeqID_1611
MVINGRIGMYRKCGKRLRGTRISIRETIFMENDMSRYHYDYRGKIK

SEQ ID NO: 93297 - protein, 190 aa, Glycine max
  Coding DNA Sequence Number=SeqID_1612
  Homolog annotation: Hit_ID=A2Q3D2; Match level="QueryCoverage=92%, HitCoverage=39%, E-value=2e-11, Identity=24%"; Hit description =Putative non-LTR retroelement reverse transcriptase, related
MGNFVEERWEWKLTWRRNFFDHEIDMVADFIADIESGNVNHSNRDFLCWKSDPNGLYSTKSAYKVLQEGHASAIEDRVLNIMSSLKIPQRASAFSWRLFKNRLPTRDNLRRRQPMRWVNRVGPFPTDPKNHFLQFSQWNRPSYTVKRWEFLWIALSVSIWHHRNGMIFNNQPFNPEKVMDEALFHTWSWL

SEQ ID NO: 93298 - protein, 100 aa, Glycine max
  Coding DNA Sequence Number=SeqID_1613
MTPVNRKAGTGERTREPQGGNAWGAEPMEKRLCRGPLTSPVKYLPGIFPGKSPPRSKPVYTPASAQYANRLSPRVGRFINAAGTTGFPTGKRAVSATQLM

SEQ ID NO: 93299 - protein, 141 aa, Glycine max
  Coding DNA Sequence Number=SeqID_1614
MKNDVEIDHSRNLVAPRLRFFFFLLILSISFTTECSPYPQLPFTSIYSKKKHLGPRQLAQGSKDKDTNFVRAISLFDKATGENQVSQPTLLRVSEVRLTGASSIGGKCPESPPTFIERKTLEKPKETGHEEYSRFGSYLYV

SEQ ID NO: 93300 - protein, 128 aa, Glycine max
  Coding DNA Sequence Number=SeqID_1615
MRGYLMVTRTFHLPGENEPVDTQRLTSSPAPSVVLTREVSQVTCGVTLWLPAPFVNQGANEPVDVQRLTSSSAPFAIQGQRVRWQAEIPYGHPHLRQPRGTNSTVLLSLSLNIQAQRRTRFFYAGQGR

SEQ ID NO: 93301 - protein, 155 aa, Glycine max
  Coding DNA Sequence Number=SeqID_1616
MIMRSQDIYSSQDEATTSPSSSESEEAKGEESSEEIYPQEEGQPLMVKEECKEVNVSSKRLVKKESHFEIKTNIKETSPLRQPPHLLLCKKTLVSTATPLGLEVIPQVKELLDEGLVRKSLNPCALLVPKIGFVQCIYLLVFNEIVSYFWLNVYF

SEQ ID NO: 93302 - protein, 38 aa, Glycine max
  Coding DNA Sequence Number=SeqID_1617
MKTKLVFATRDDVLNWAQAVAYEIGFVAVIMRSDTNIV

SEQ ID NO: 93303 - protein, 278 aa, Glycine max
  Coding DNA Sequence Number=SeqID_1618
  Homolog annotation: Hit_ID=Q6UUU1; Match level="QueryCoverage=21%, HitCoverage=40%, E-value=4e-18, Identity=78%"; Hit description =Putative uncharacterized protein
  Subcellular localization annotation: CTP_CleavageSite=42; ConfidenceScore=5.13e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLNSMRYLLYLRLFVVLFRHVVGDPTHLLTVEFWFAGCHACLLLVTVDFELGPLIAEFGRAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 93304 - protein, 69 aa, Glycine max
  Coding DNA Sequence Number=SeqID_1619
MDVASKGRNFKDHRKEDRRMLSLSKNRESMSLSSSSNAYNVPWVEKYRPIKVADIVVNEDAISRKLFSN

SEQ ID NO: 93305 - protein, 172 aa, Glycine max
  Coding DNA Sequence Number=SeqID_1620
  Subcellular localization annotation: CTP_CleavageSite=22; ConfidenceScore=5.02e-01
MATRPLLQRNTCPRLQRTTHPRLQRAKRLHLQRTTRQHVLAFRGLHVLTFRGIHVLAFRGLHVLTVRGLHALAFRGLHILTCGGLHVLAFKGLHILAFRGLHVLALRGLHALVLPLEDYTPSPSEDYTSSPSEDYTSSPSEGYTPSPSEDYTSSPSEDYTSSPSEGYTSPPS

SEQ ID NO: 93306 - protein, 73 aa, Glycine max
  Coding DNA Sequence Number=SeqID_1621
MSKRLQEDWARAAEESPRVLMNLRLLEGSPPLASQGNFLPCFPRKLPSLLLKEASYCIFMYFSMGVSLAIGRV

SEQ ID NO: 93307 - protein, 138 aa, Glycine max
  Coding DNA Sequence Number=SeqID_1622
MEGRLLIGSLARRKEESGFYLHAKDECHQTKASRLSSHGVSMTTTRGYSKEFARHGMRHEERTESLGEATVRDDEVKASEESDEVQALKAELERARVVEEKFKSIAIKGSNSELKLRRVKGIITGQRHDLEGRAKGLP

SEQ ID NO: 93308 - protein, 162 aa, Glycine max
  Coding DNA Sequence Number=SeqID_1623
  Homolog annotation: Hit_ID=Q6UUU1; Match level="QueryCoverage=37%, HitCoverage=40%, E-value=1e-18, Identity=78%"; Hit description =Putative uncharacterized protein
ANWSSTAVAAALELVDPPGCRNSIVSVTAAPGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 93309 - protein, 80 aa, Glycine max
  Coding DNA Sequence Number=SeqID_1624
MDAHPRQDGVHQLTLRQGEVGIMIGGQDVAEQQSHPYLSQGGHVVTGRWPPRRTHQTGSSSGHTRTPNPLPALKGIPRAG

SEQ ID NO: 93310 - protein, 166 aa, Glycine max
  Coding DNA Sequence Number=SeqID_1625
MTGRLLVGSLTFDNRIMHYIIVRILLPQSSNLAQASEEDLILMWASLTGCQIDWAHLVRYQMHKALRANAPLPYPQLSKDQNGQWLKKDALPPQDKRTPSPPPQRDDSALMTEVLFELRGLRTYVGERFDSLDNCFAGMDICLTQLEEDVGYIRQTFDLPPPPPPS

SEQ ID NO: 93311 - protein, 91 aa, Glycine max
  Coding DNA Sequence Number=SeqID_1626
MHVNREETDLKTPQIDGSSSHITNPRMHALTITTDEESSSISETANREQTWCSIQGKRSHSWKSPSKLRLGNKNRSWDGGSGVPSFSVLEY

SEQ ID NO: 93312 - protein, 94 aa, Glycine max
  Coding DNA Sequence Number=SeqID_1627
MATGKQFGDVVTSQYHDKCNWGELHELHETKKENFNKLICQAIWGDSNVSWDSVPSVHTSGGLLCMWNNSVFEVDRRVKGRNFLMLVGRWTKDN

SEQ ID NO: 93313 - protein, 181 aa, Glycine max
  Coding DNA Sequence Number=SeqID_1628
  Homolog annotation: Hit_ID=A2Q1D6; Match level="QueryCoverage=50%, HitCoverage=14%, E-value=2e-08, Identity=36%"; Hit description =Ovarian tumour, otubain, related
MALTKIAVKQLMLNYLLGDARLGSVKVKVLMFIVVMVGSSAVANEMDENQWMYESIMSKEVDMNYQNEEECGANEPRVGCSIALNTSQVFDNREDVLRWARSVLHENGFVVVIIRSDTNTGSRGRTSFVLIDCERSDEYRCRKKEFVRRDTRTRKCGCPFKLHGKPIVGGQGWMVKLMWDS

SEQ ID NO: 93314 - protein, 562 aa, Glycine max
  Coding DNA Sequence Number=SeqID_1629
  Gene Ontology: Mol. function=phosphoprotein phosphatase activity
  Homolog annotation: Hit_ID=A7P7E6; Match level="QueryCoverage=44%, HitCoverage=47%, E-value=6e-23, Identity=32%"; Hit description =Chromosome chr9 scaffold_7, whole genome shotgun sequence
  Pfam annotation: Domain name=DUF1723; Domain location=141-190; Score =52.8; E_value=1.2e-12; Accession=PF08330.1; Description=Protein of unknown function (DUF1723)
MVGTRGSGLVLGRVIVRGLGRRDRDDSNDAPQRRRPTASARRQRGPVPVAKDEPVDTGADTGAEAAADEPEGFPGGPTDPSVLTEYAEHVAASVWTGEERPELKLSSHGRKVQKLGRPIPAIEGLVVGTGLIPLIACAIDTGDRGLISSFVERWHRETSSFHLPVGEVTIMLDDVASLLHLPIIGDFHTFQPLHVDEAMLMLVDLLLVSPEAAKAETGHCHGPYSATHVHVLFLDTLRDLSQTGRYAWGAATLVHMYDHLNDACISTSRQLARYITLLQCNVDPDYDEASPRACRWIATKKTVKSISIETYKQHLDRLRNPDVSFVGGPLLSDTDQRGWMHHSDHLAPAGEMCVRLPASAPNCTSSIKRLLNNKENNKMKDYKNTSGEDVSFTSWISQSFTNSSQALKPAPASSSGGLVRARALSARMDRLAHRTLAKPPYWLSEKVKTTLSKVVQHISHPFMTVAQTLYPLRDSPATQPRHIPQVLEPHIPQVPEPTATSTPGRSDVDEPKHAVEACYAIVERLECHLNLWVVTPGTSTHEVIEQCLRIVRGVTKDRIVYV

SEQ ID NO: 93315 - protein, 213 aa, Glycine max
  Coding DNA Sequence Number=SeqID_1630
  Gene Ontology: Mol. function=zinc ion binding
  Homolog annotation: Hit_ID=A7UQU7; Match level="QueryCoverage=75%, HitCoverage=28%, E-value=1e-20, Identity=39%"; Hit description=IMP dehydrogenase/GMP reductase, putative
  Pfam annotation: Domain name=DUF1723; Domain location=111-160; Score =46.3; E_value=1.1e-10; Accession=PF08330.1; Description=Protein of unknown function (DUF1723)
MTEDVFAPDAEDNYVDEGVAGDGTEGSAGDGAEGSVADNVERFPGGPHDPSVLTSFAEHVAHSIWNGEERRELKLVSHGRKVEKFGRPAPEIEELVTAIGLTPLIACSVDTGDRGVISAFIERWHKETSNFHLPVGELTITLDDVASLLHIPIIGAFHSFEPLHVDKAVIMWVELLEVLGEEARAETAYVMVHMYTCCGYEISIRGHARPDSG

SEQ ID NO: 93316 - protein, 140 aa, Glycine max
  Coding DNA Sequence Number=SeqID_1631
MHVCPNMQIIVKTKGLGHVLGRVIGRAVGREDHHHSDDVPQRRRPTASARRQREASLVAEDAPDVIDDVHAHAEDVVDDAEGFPGGPHDPSMLTEYGYHIAVIVWNGELSSYGRKVQKFGRPAPEIEVIKFRRKIITIES

SEQ ID NO: 93317 - protein, 256 aa, Glycine max
  Coding DNA Sequence Number=SeqID_1632
MGLNQEHAFKEGLIKSRSSMEVTSLQKLGQKMDQERTRARARVMGEIEEVQEWMKADIEAMKEQMDTMMEAMMNMKKIMEVNAAVVAATSAIADMDSTTPSGLNQISHPTSDMVEHACLPTIRLAPNYTPPNVVHTPDEDVNNSTPIPIESQQPQSIHAHEAPQDHNLADFEPYLGYATEGQAVVPPAVVKRGKFDHIEERLRGIEGGGDYAFANMAKLYLVPDVVIPPKFKVPDFDKYKGTTCPRKIGASQKMKS

SEQ ID NO: 93318 - protein, 115 aa, Glycine max
  Coding DNA Sequence Number=SeqID_1633
MVQLPQSTGIKVFYTCAHANLEGNLFSTVNGVDMIINVVVWKEVVNLDMGGVRKFDEMPDGNLRNHLGVSGLTAKDRMLVYLITYILTPRSSNHAQVTDDDLRIVYGMESGIKMN

SEQ ID NO: 93319 - protein, 81 aa, Glycine max
  Coding DNA Sequence Number=SeqID_1634
MMMKDNYQLKGTLLSFKVFWTGSMDSKPMLLKGLMLWNNKWTCDSMQWTQGSQRIVIIKKGEIVEAMPSKVILMMPKNQES

SEQ ID NO: 93320 - protein, 69 aa, Glycine max
  Coding DNA Sequence Number=SeqID_1635
  Subcellular localization annotation: CTP_CleavageSite=60; ConfidenceScore=5.42e-01
MGVQIATRPTRAFQDVPLEGGCFWRKQPSSPGKSKPRCFRNVSVSDFAKIFNRSSTFFVRSSSFFGLQP

SEQ ID NO: 93321 - protein, 53 aa, Glycine max
  Coding DNA Sequence Number=SeqID_1636
MDEDQWMYDSMMSEEVDMNVENEEDVSVKLFASRDGVYNGLDHWLMTLDLLPL

SEQ ID NO: 93322 - protein, 101 aa, Glycine max
  Coding DNA Sequence Number=SeqID_1637
  Subcellular localization annotation: CTP_CleavageSite=30; ConfidenceScore=5.48e-01
ISKLIWSTKFRALLSLSPHSSPSSSKLLSMASYGVASPLSLPFSIPLPFIFQEAKESIDEEDPRPTSSNGACISLIWEQQAMCAKIVVGSRNLDQSMMALL

SEQ ID NO: 93323 - protein, 172 aa, Glycine max
  Coding DNA Sequence Number=SeqID_1638
MTTLTQIWMTLLLSNIQPSDHNSDLPLPKCQLVYAILTRMSIHVAQLIVDAIYLFAGMAPTRHPLDPDKSNRALGFPALITGLCQSFGVPVAPSKVIRPPITRALIENLQSQGFTSFPCPTPDQFRAEVAWPGDWPEALAEAPAEAPDEADEAREDEEMTDLLDFLGGSGAT

SEQ ID NO: 93324 - protein, 28 aa, Glycine max
  Coding DNA Sequence Number=SeqID_1639
MEDAPVSPRVALPQKVRLRQLATPLGLF

SEQ ID NO: 93325 - protein, 420 aa, Glycine max
  Coding DNA Sequence Number=SeqID_1640
  Gene Ontology: Mol. function=catalase activity; Cellular component =periplasmic space; Biological process=response to oxidative stress
  Homolog annotation: Hit_ID=A0AWZ3; Match level="QueryCoverage=56%, HitCoverage=65%, E-value=1e-111, Identity=79%"; Hit description =Catalase domain protein
  Pfam annotation: Domain name=Catalase; Domain location=2-237; Score= -267.6; E_value=0.035; Accession=PF00199.10; Description=Catalase
  Pfam annotation: Domain name=Ni_hydr_CYTB; Domain location=239-410; Score=131.6; E_value=2.2e-36; Accession=PF01292.11; Description =Cytochrome b561 family
  Pfam module annotation: Pfam domain module=Catalase::Ni_hydr_CYTB; Domain location=2-237::239-410
MALLLKTDDKQQWRMAMNNEPYFATRNPEGFLALRQATAVDAATGKPDPQRLADFLKAYPEAEKYLKWAAQKPAPGSFAGATFYSINAFYLVNAQGERQPVRWMMRPHDPFFSLSDEQRKKADDNFLFESLRQRLAQKPLYWDYVLQLAQPGDPVDDPSRPWPDNRKQMVAGTLEVTRVEAQSVGACRDVNFDPSIVPAGVAVTDDPVLNARSAAYSHSFSRREREIGYGKATEAVQKQEHFNPLARYLHWLMAIMILAMLFIGAAMMTSLHHRIWLVDVHRPLGIAILLLALIRLANRFYSRQPPLPAELSRWQVRAAKASHWALYALMLAMPLLGWAQLSAAGVPIVVFEGLNLPAITPTSPLLFAWFHDAHRLLAKLLFAVVLLHLSAALVHAWIFRDGVFASMAKSTSRSSKPPVE

SEQ ID NO: 93326 - protein, 246 aa, Glycine max
  Coding DNA Sequence Number=SeqID_1641
MEFYANTCPIKEGVMDRRSRVRGQWIPYDRDAINQFLGHPLVLEERQRCEYAERRSQFSGFDEEVIGQLLCSLGHDFARSVVGRQVRIIRTSMTTLTQIRMLLLLSNILPNDHNFDLSLPKCQLIYSIMTQISVHVAQLISDAIHQFIGIAPPRHLVDPEKSNTTLGFLALFRGLCQFYRHFQDPNPYPWPTPEYFRATVTWPGGRPNFQEEVGPTDAQGVAQGSEGGAKDDGDMADLLDFFIGGD

SEQ ID NO: 93327 - protein, 78 aa, Glycine max
  Coding DNA Sequence Number=SeqID_1642
MEKIGGKQNNSRSMKEKDQRTFRPDKFSARLPFKVVLDWRYPTPPEQRGKDRNNQLPLQKKNTTLEKILLVRDRTFDL

SEQ ID NO: 93328 - protein, 73 aa, Glycine max
  Coding DNA Sequence Number=SeqID_1643
IPSGVANCHNVPFYGRARASLTGVLSKGGKMRGVATNEGISTSHVDKSEALAPTYPPSKRKSDLRSSFTCVNQ

SEQ ID NO: 93329 - protein, 109 aa, Glycine max
  Coding DNA Sequence Number=SeqID_1644
MAKRILIARPWLLFCLHLMRIMKLAKYRLKAQVEKDEGPSGEGQSPRVEKDEGPSNPCGVYLDLSSFTGSGVYPDLSSFTGSGVYPDLSSFTGSGVIQISVACIKRSAP

SEQ ID NO: 93330 - protein, 74 aa, Glycine max
  Coding DNA Sequence Number=SeqID_1645
ALKGLDDAPQHKSKVPARWIVVKRNRQKGSTECGYYVMHWMSTIILGSFRNNWEAYFNNPRPLELERLKVILIQ

SEQ ID NO: 93331 - protein, 51 aa, Glycine max
  Coding DNA Sequence Number=SeqID_1646
HSVELTKTRNQSWKPQDPVGLLWVHWVVGPCGLNNLKRDRLRMQKKQQQSI

SEQ ID NO: 93332 - protein, 111 aa, Glycine max
  Coding DNA Sequence Number=SeqID_1647
MYLLFFSFRRSYGNSRIAQQHLLLVSATLRNFTDRVTLLPFDFRRVSGLTYCATKGAKYLEAANQRLHVINQTNIYQTNMVNNKTYEWDQSSGKPNTTKSTPTLVKQEFTS

SEQ ID NO: 93333 - protein, 279 aa, Glycine max
  Coding DNA Sequence Number=SeqID_1648
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIVDPPRRPDRRPGPGHRAGVDGRESSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 93334 - protein, 306 aa, Glycine max
  Coding DNA Sequence Number=SeqID_1649
  Gene Ontology: Mol. function=oxidoreductase activity, acting on the aldehyde or oxo group of donors, NAD or NADP as acceptor; Cellular component=cytoplasm; Biological process=amino acid biosynthetic process
  Homolog annotation: Hit_ID=A9N475; Match level="QueryCoverage=100%, HitCoverage=90%, E-value=1e-124, Identity=75%"; Hit description =Putative uncharacterized protein
  Pfam annotation: Domain name=ADH_zinc_N; Domain location=3-146; Score= -23.4; E_value=0.068; Accession=PF00107.17; Description=Zinc-binding dehydrogenase
  Pfam annotation: Domain name=Semialdhyde_dh; Domain location=6-121; Score=132.8; E_value=1e-36; Accession=PF01118.15; Description =Semialdehyde dehydrogenase, NAD binding domain
  Pfam annotation: Domain name=Semialdhyde_dhC; Domain location=141 -306; Score=141.9; E_value=1.8e-39; Accession=PF02774.9; Description =Semialdehyde dehydrogenase, dimerisation domain
  Pfam module annotation: Pfam domain module=ADH_zinc_N::Semialdhyde _dh::Semialdhyde_dhC; Domain location=3-146::6-121::141-306
MSEGWNIAVLGATGAVGEALLETLAERQFPVGEIYALARNESAGEHLRYGGKSVIVQDAADFDWTQAQLAFFAAGVEASAAYVEEATNAGCLVIDLSGLFALEPDVPLVVPDVNPFVLADYRNRNIIAVPDSLTSQLLTALKPLIDDGGLSRIAVTSLLSVSANGKKAVDALAGQSAKLLNGIPIDEDDFFGRQLAFNMLPMLPDNQGSVREERRIVDEARKILQDDGLMISANVVQSPVFYGHAQMVSFEALRPLAAEEARDAFGRGEDIVLSEEREFPTQVGDATGSAHLSVGCVRNDYGMPEQ

SEQ ID NO: 93335 - protein, 129 aa, Glycine max
  Coding DNA Sequence Number=SeqID_1650
MRQFGYTQTIPAPLVDSWVSYDDIHDRWMHYSYHMVPAGEVCVVPGQCASDYMDWFFRISHLFMTPGQPSDPLLDGHAPQPRVATQAPETDIPHVPEAGAPLTSARPAVEEPRHAVKFAMGLLRGWSAI

SEQ ID NO: 93336 - protein, 106 aa, Glycine max
  Coding DNA Sequence Number=SeqID_1651
MESQMDQSNHLIKHEEYHVSNYIKASFSISMIQFLMVRNQFLYMLDKDHLAPFSWLLEPYADNKLLWRGEENVHAENNAGEEKLYGQERVQIKPKLMMHPLNLPLY

SEQ ID NO: 93337 - protein, 88 aa, Glycine max
  Coding DNA Sequence Number=SeqID_1652
MPRVLLKVEEETMFCECGDFGFHIPESMSVRCGSLTFVRGTKPARNTGFDMDEDDLLEMEQCHGVLVASFTCLIWHLANELYLLFRKF

SEQ ID NO: 93338 - protein, 491 aa, Glycine max
  Coding DNA Sequence Number=SeqID_1653
  Gene Ontology: Mol. function=aspartic-type endopeptidase activity; Cellular component=extracellular region; Biological process =proteolysis
  Homolog annotation: Hit_ID=A7R001; Match level="QueryCoverage=89%, HitCoverage=96%, E-value=1e-124, Identity=52%"; Hit description =Chromosome undetermined scaffold_293, whole genome shotgun sequence
  Pfam annotation: Domain name=Asp; Domain location=140-488; Score= -118.1; E_value=1.3e-06; Accession=PF00026.14; Description=Eukaryotic aspartyl protease
MGKVSVWLRVEAKCTIYLLKEEYETVPEQNVAEPAKWGVQDEPLLQTVQFADNDNPRQKQEGMQLNLYHVKGLDSSQTSTSPFSFSDMITKDEERVRFLHSRLTNKESVRNSATTDKLRGGPSLVSTTPLKSGLSIGSGNYYVKIGLGTPAKYFSMIVDTGSSLSWLQCQPCVIYCHVQVDPIFTPSTSKTYKALPCSSSQCSSLKSSTLNAPGCSNATGACVYKASYGDTSFSIGYLSQDVLTLTPSEAPSSGFVYGCGQDNQGLFGRSSGIIGLANDKISMLGQLSKKYGNAFSYCLPSSFSAPNSSSLSGFLSIGASSLTSSPYKFTPLVKNQKIPSLYFLDLTTITVAGKPLGVSASSYNVPTIIDSGTVITRLPVAVYNALKKSFVLIMSKKYAQAPGFSILDTCFKGSVKEMSTVPEIQIIFRGGAGLELKAHNSLVEIEKGTTCLAIAASSNPISIIGNYQQQTFKVAYDVANFKIGFAPGGCQ

SEQ ID NO: 93339 - protein, 501 aa, Glycine max
  Coding DNA Sequence Number=SeqID_1654
  Gene Ontology: Mol. function=calcium ion binding
  Homolog annotation: Hit_ID=A7R1A5; Match level="QueryCoverage=46%, HitCoverage=48%, E-value=1e-60, Identity=53%"; Hit description =Chromosome undetermined scaffold_342, whole genome shotgun sequence
MAVQYMRRVIEKKAKFDIMDLNCLLVAPKTFIPVLFGHGNDDQFIQPHHSDLISESYAGDKNIIKFDGDHNSSRPQFFYDSISIFFYNVLRPPHIPRVRKLEKYFDLGDLKIGSTVNESATTDAASSSSAPPSTSNSIKASVSELISKVAPVTAAESMIREEPKHGNDEHGHDEPADMKDEKNGLTEDYFSYCSSTRGNWGRCSSLVLSDEESYPDFRDDDNDSEDQLNGQALVEDMVFDVEKSQEEKKNLEQCLVIDSDSGNKTLNSPMMGDSDKKSIVVDNTQLMRREVEALKKELEWLMNLDDGDSVALFNSKKDKLAKLLVQEDQHWKQRAKAHWLKDGDQNTKGGHDQKGLCQVAKDYFINLFKQEVSCYEMVIEAVHSMVTKNEVEVLKNALHVYEVASDQAINLNKSEVLFCANIHDEKKFQLSSSLGHLEFPVVLDKLIWRIGDGSSINNGTKRLFMGSIHLMGFTLSEQFFQWFWNCNVDATSMDEEGKFGF

SEQ ID NO: 93340 - protein, 258 aa, Glycine max
  Coding DNA Sequence Number=SeqID_1655
  Gene Ontology: Mol. function=nucleic acid binding; Biological process= ubiquitin-dependent protein catabolic process
  Homolog annotation: Hit_ID=Q0P166; Match level="QueryCoverage=51%, HitCoverage=48%, E-value=4e-50, Identity=71%"; Hit description =Putative uncharacterized protein
  Pfam annotation: Domain name=PGAM; Domain location=101-229; Score =14.2; E_value=0.00012; Accession=PF00300.13; Description =Phosphoglycerate mutase family
MVAVGCTMMEVGGVTMWVVQWWLGVVLVWAKFMEVDGAPSFHFHHTTLVAGTLTDCAPNPLCSFRNRTPNSPTPTPTPSPSRAASFSFAMLRVPGIIALSAVTHSFSQFPLFNSPTFPKKLEFHDHDRPLSKSGKEDAVRVSRRLQQLGWIPELILSSDAARTKETLKIMQEQVQELVEAEVHFVSSFYSIAAMDGQTAEHLQKIICKYSRDEILTIMCMGHNRGWEEAASMFSGASVELKTCNAALLESAGKSWDEV

SEQ ID NO: 93341 - protein, 756 aa, Glycine max
  Coding DNA Sequence Number=SeqID_1656
  Gene Ontology: Mol. function=oxidoreductase activity; Cellular component=integral to membrane; Biological process=electron transport
  Homolog annotation: Hit_ID=Q2HST1; Match level="QueryCoverage=98%, HitCoverage=97%, E-value=0.0, Identity=60%"; Hit description=Ferric reductase-like transmembrane component
  Pfam annotation: Domain name=FAD_binding_6; Domain location=407-510; Score=-18.0; E_value=0.035; Accession=PF00970.15; Description =Oxidoreductase FAD-binding domain
  Pfam annotation: Domain name=FAD_binding_8; Domain location=404-508; Score=72.9; E_value=1.1e-18; Accession=PF08022.3; Description=FAD -binding domain
  Pfam annotation: Domain name=Ferric_reduct; Domain location=252-374; Score=117.9; E_value=3.1e-32; Accession=PF01794.10; Description =Ferric reductase like transmembrane component
  Pfam annotation: Domain name=NAD_binding_6; Domain location=514-734; Score=37.0; E_value=3.9e-08; Accession=PF08030.3; Description=Ferric reductase NAD binding domain
  Pfam module annotation: Pfam domain module=FAD_binding_6::FAD_binding_ 8::Ferric_reduct::NAD_binding_6; Domain location=407-510::404 -508::252-374::514-734
MEKNSLDYSPLLSPRGDENGSETTASPLVSATKWTLKTLILMIFVLWAAFIFFLPAKPVNELFSKWNDLNRDTPFGVTGSIFLVFTAPILIIAFLAIAHQILTGEDQLHEYVISSNLPFCAQHFIIIIARFSITVTVSTQSLILREIVVTDRFLKPGIIVYVEYFVFDLEFDGRKKTSKLPRFRLWTFPVFVKGPFGVVSATELIGIVLVLLYVIWALYAYTVRALDFISEFDVPSFRDKSIIMFKVMGLRTGAIGLMCLAFLFIPVSRGSVLLRYIDIPFEHATRYHVWLGHLTMVLFTVHGLLYVIAWAMEGHLVQELIQWKDIGVANLPGVISLLAGLLMWVTSLPGVRTWNFELFFYTHQLYVVFVVFLALHVGDFVFTMAAGGIFFFVLDRFLRFCQSRRTVNVISSRCLPCGTVELVLSKPQSLRYNALSFIFVQVRELSWLQWHPFSVSSSPLDGKNHLAVLIKVLGKWTEKLRQRITDVDAQKDSCVITTSVEGPYGHEVPYHLMYENLILVAGGIGLSPFLAILSDILHRVREGKPCQPRNILLVWAEEGYSYKPIKSSFCPMASDCGMSVLVGTGDNFWSGLYVISSTVGFVILLALLYVYYVTPFHIETWWYRGLLYVICMVASVVIFGGSVVAMWHIWEKQNSLKDKSNDTKVDKIHQNGSLATKDQSQDSSIAKSTVIHYGSRPNFKEIYDSISEKWGLVDVGVIVCGPSTLQTSVAEEIRSHSMTRQRHHSIFHFHSHSFDL

SEQ ID NO: 93342 - protein, 587 aa, Glycine max
  Coding DNA Sequence Number=SeqID_1657
  Gene Ontology: Mol. function=protein binding
  Homolog annotation: Hit_ID=A7QQK2; Match level="QueryCoverage=98%, HitCoverage=68%, E-value=1e-111, Identity=44%"; Hit description =Chromosome undetermined scaffold_143, whole genome shotgun sequence
  Pfam annotation: Domain name=DUF1296; Domain location=14-73; Score =140.6; E_value=4.3e-39; Accession=PF06972.2; Description=Protein of unknown function (DUF1296)
MSGKGGGKALSATIPASSRKMVQSLKEIVSNFPDHEIYATLKDCNMDPNEAVSRLLSQDPFHEVKSKREKKKEIKDPTESRSRGSGTNNTSSRGGGRAGTDRNGGRGGANQFGSSDYGLQGKPVYKKENGAPTYGGSTSSAPSVLGNNANMRPASYSDSVVTEKTYAFSIGDGPSSSSQRAGVQSAWAGNTGQVSMADIVKMGRPQARPSMHNSSIQSGNHQNVFMPPAASDNNLHSSQGYASKVSETNTNQGHAISDNVPQNDEWPCIENQHDVRVYADVDAHANSECYANSSSFAEADWQQKTHLDEHGAEDGSVENADNAESASISAKSTSEDNTGAEDDVSSVAANIEQLNIQRDDQGTAQEDDNPSVVIPNHLQLHTPECMNLSFGSFGSANPLSGSGSFTSRPLKSNLEDTSGAADASTIENSDTRNPDYYGDEHLTTTTSDGNLVQGTGVSAGTYEHTSISQEALKPEPPEIAQENQYSFPSHSHGFNYENAQQPEVTFPVSQTSSQNQNLAPFSGVMAHTNSLPSALLSSPVQTAREDIPYLPFPATQSMPTKYSDIASSIGGSTITMSEVHFCSNKLI

SEQ ID NO: 93343 - protein, 33 aa, Glycine max
  Coding DNA Sequence Number=SeqID_1658
MMKQDSDMGEGWHEDKKRRAKAGPEGQRATTTS

SEQ ID NO: 93344 - protein, 53 aa, Glycine max
  Coding DNA Sequence Number=SeqID_1659
MKEDGNEEGKGRENGEWSVVGKREVEHKKMVKRKRQNKMKVKQEDEAKNQGQV

SEQ ID NO: 93345 - protein, 54 aa, Glycine max
  Coding DNA Sequence Number=SeqID_1660
MCDLTSSLRTYPRERGVPVSSSMRFFIVIHLFICSPEHKVQDHHRIQTQTGNRE

SEQ ID NO: 93346 - protein, 472 aa, Glycine max
  Coding DNA Sequence Number=SeqID_1661
  Gene Ontology: Mol. function=nucleotide binding; Cellular component =intrinsic to membrane; Biological process=defense response
  Homolog annotation: Hit_ID=Q7XBQ9; Match level="QueryCoverage=72%, HitCoverage=36%, E-value=1e-29, Identity=31%"; Hit description =Disease resistance protein RGA2
  Pfam annotation: Domain name=LRR_1; Domain location=316-341; Score =1.6; E_value=1.6e+02; Accession=PF00560.24; Description=Leucine Rich Repeat
  Pfam annotation: Domain name=LRR_1; Domain location=357-377; Score =7.2; E_value=14; Accession=PF00560.24; Description=Leucine Rich Repeat
  Pfam annotation: Domain name=LRR_1; Domain location=379-401; Score =11.5; E_value=2.2; Accession=PF00560.24; Description=Leucine Rich Repeat
  Pfam annotation: Domain name=LRR_1; Domain location=403-425; Score =1.8; E_value=1.4e+02; Accession=PF00560.24; Description=Leucine Rich Repeat
  Pfam module annotation: Pfam domain module=LRR_1::LRR_1::LRR_1::LRR _1; Domain location=316-341::357-377::379-401::403-425
MAESTRSKVKSDRLVDAITKLTTHQLSLSETQHSMTLKLDELIHKLHTPDSPANFLRDIAEIKIQQQVSDNWEWSADPEGHYSTRSAYDLIGEEVRDSSQEECFEKLWRIKVPARFLNPTRGCIPSFLSLQQTSTHMVGNHVMAARFRLEELGPLKLKGDLDIKHLGNVKSVKDAEKANMSSKQLNNLLLSWDKNEESESQENVEEILEVLHPDTQQLWRLDVEGYKGFHFPQWISSSPLKHLMLKDCENCLQLSPIAKLPSLKTLRILNMIHVEYLYEESYDGEVVFRALEDLSLCRLPKLKRLSREDGENMFPCLSILEIDGCDRFLGEEVFLHRLHSLTLINCGKINVSAGFNCLEKLWISECRVESLQALQDMTSLKELRLRNLPKLETLPDCFGNLPLLHTLSIFFCSKLTCLPMSLSFSGLHQLTIFGCHSELEKRYEKETGEDWPNIAHIPHISVGSNLYDHISD

SEQ ID NO: 93347 - protein, 196 aa, Glycine max
  Coding DNA Sequence Number=SeqID_1662
  Gene Ontology: Mol. function=hydrolase activity, acting on glycosyl bonds; Cellular component=extracellular region; Biological process =cell wall organization and biogenesis
  Homolog annotation: Hit_ID=A0MET3; Match level="QueryCoverage=67%, HitCoverage=34%, E-value=4e-34, Identity=53%"; Hit description =Putative uncharacterized protein
  Subcellular localization annotation: CTP_CleavageSite=33; ConfidenceScore=5.32e-01
MPNPTTTTKPSLLSLFSLHTLHLLVLCSWFTTSSAKATSYNVVDFGAKPDGTTDATSAFLGAWNKACSSPKPAGIHVPQGRFLIGRAVTFSGQCSNRAISITIRGTLLAPSQYTFLGNSLYWFTFDQVTGLSIHGGVLDARGSFLWDCKYKAMPNCPIGAAGLDAENGLWRIGRIKRLFNVYLPNHLFDMVEIVRK

SEQ ID NO: 93348 - protein, 250 aa, Glycine max
  Coding DNA Sequence Number=SeqID_1663
  Gene Ontology: Mol. function=protein binding; Cellular component =cytoskeleton; Biological process=microtubule cytoskeleton organization and biogenesis
  Homolog annotation: Hit_ID=Q8L405; Match level="QueryCoverage=95%, HitCoverage=45%, E-value=3e-84, Identity=62%"; Hit description =Tubulin folding cofactor E
  Pfam annotation: Domain name=CAP_GLY; Domain location=13-81; Score =115.4; E_value=1.7e-31; Accession=PF01302.16; Description=CAP-Gly domain
MQESPEPRHEFWVGQRVHASGDSQRIGTVKYVGPVEGYSDTWVGVDWDNGEGKHDGSINGVRYFHAKSERSGSFVRAHNLNQGISLLESLESRYKSESTKDEDDDMFVLSTSNQRVSVQLLGKDKIHDKLSRLEELTSVSLSYMGISSPGIASHINNTVPNIKELDLTGNLLSEWKDVGTICEQLPALRTINLSNNLMSPYKSKLLLLKNIQVVVLNNTGVDWEQVELLRQSLTTIEELHVMGNSISRIL

SEQ ID NO: 93349 - protein, 913 aa, Glycine max
  Coding DNA Sequence Number=SeqID_1664
  Gene Ontology: Mol. function=nucleotide binding; Cellular component =endoplasmic reticulum; Biological process=membrane organization and biogenesis
  Homolog annotation: Hit_ID=Q9FKE9; Match level="QueryCoverage=94%, HitCoverage=93%, E-value=0.0, Identity=71%"; Hit description=GTP -binding protein-like; root hair defective 3 protein-like
  Pfam annotation: Domain name=GBP; Domain location=13-248; Score= -80.4; E_value=0.044; Accession=PF02263.10; Description=Guanylate -binding protein, N-terminal domain
  Pfam annotation: Domain name=MMR_HSR1; Domain location=40-133; Score=- 20.5; E_value=0.08; Accession=PF01926.14; Description=GTPase of unknown function
  Pfam annotation: Domain name=RHD3; Domain location=45-874; Score =1216.2; E_value=0; Accession=PF05879.3; Description=Root hair defective 3 GTP-binding protein (RHD3)
  Pfam module annotation: Pfam domain module=GBP::MMR_HSR1::RHD3; Domain location=13-248::40-133::45-874
MANDDCCATQLIDGHAEFNVAGLDSFIRTVNLASCGLSYAVVAIMGPQSSGKSTLMNHLFHTSFREMDAFRGRSQTTKGIWIAKCVGIEPSTIAMDLEGTDGRERGEDDTAFEKQSALFALAISDIVLINMWCHDIGREQAANKPLLKTVFQVMMRLFSPRKTTLLFVIRDKTKTPLENLEPILREDIQKIWDGIRKPEAHQHTPLCEFFNVEVTALSSYEDKEDKFKEEVAQLRQRFFHSIAPGGLAGDRRGVVPASAFSISAQQIWKVIRENKDLDLPAHKVMVATVRCEEIANEKLNQLRSDKGWLELEEAIELGPVRGFGEKLSSIIDACLSQYDEEAIFFDEAVRNAKQKQLESKALDLVYPAYTTLLGHIRSKALDDFKTKLEQSLNNGEGFASSVRTWTQSTMLEFDKASADAAIRQANWGASKVRDKLHRDIDSHTSSVCSAKLLEITTNFEKKLAKALAEPVESLFEAGGKDSWLSIRELLKRETETAVSEFSASVAGFELDEETVGRMQQSLRDYARKVVENKARDEAGKILIRMKDRKCSLIRHAERQKFCIHLIKSSERHKKALGETIKTRPCFQWLYWDFGFDSCNLSHQLCKAWLLLLLLAVSLGFKWDVIFEIGTKRFSTVFNHDNDSLPRVWTGKEDIRAITRDARSASLKLLSDMAAIRLDEKPDRIESALYSSLIDKTSAATSSQYLTREASVDPLASSTWEEVSPEDVLITPVQCKALWRQFQGETEYTVTQAISAQEAYKRSNNWLPPPWAIMAMVILGFNEFMMLLKNPLYLMFIFVAYLLGKAIWVQMDIAGEFRHGTLPGLLSISSKFLPTVMNLIKRLAEEAQGNQTPQESQGSTSQTQIFRNHVHKPDSVSNSISNVSSVGSSVDDNEYSTANLSHRRRTNAPEAEFS

SEQ ID NO: 93350 - protein, 199 aa, Glycine max
  Coding DNA Sequence Number=SeqID_1665
  Gene Ontology: Mol. function=metalloendopeptidase activity; Cellular component=proteinaceous extracellular matrix; Biological process =metabolic process
  Homolog annotation: Hit_ID=A9PHU7; Match level="QueryCoverage=57%, HitCoverage=44%, E-value=4e-20, Identity=41%"; Hit description =Putative uncharacterized protein
  Pfam annotation: Domain name=Peptidase_M10; Domain location=69-190; Score=67.6; E_value=4.2e-17; Accession=PF00413.15; Description =Matrixin
MFKTFFIIFLLSFSVFTPEPLLISATPSLQNPENIQKGVTLESVEITRILQPKRVGKTGFRDHETNIVTKMRHLRYVFESGTEGAPLGFLRRVFREAFRQWSFFSGDQGDEFSFDKFGPVLAHAFQPPDGRLHVDADKPWSVEVPIEREYYDFVWVAMHEIGHLLGLGHSSHRRAVMYASVHAGVNRIGGNLMWMMLQV

SEQ ID NO: 93351 - protein, 434 aa, Glycine max
  Coding DNA Sequence Number=SeqID_1666
  Gene Ontology: Mol. function=hydrolase activity; Cellular component =vacuole; Biological process=lipid catabolic process
  Homolog annotation: Hit_ID=A7QC06; Match level="QueryCoverage=94%, HitCoverage=95%, E-value=1e-134, Identity=62%"; Hit description =Chromosome chr10 scaffold_76, whole genome shotgun sequence
  Pfam annotation: Domain name=Patatin; Domain location=69-260; Score =100.8; E_value=4.4e-27; Accession=PF01734.13; Description=Patatin -like phospholipase
MATMSASSMNLNMIDSNFEVDKLTYEIFSILENNFLFGYGHTENRTNLVNFPLKDAKPVKHAAGKVRILCIDGAGATDGILAAKSLAHLEACLRRKSGEANARVADFFDAAAGSGIGGVLAALLFTRGKDGRPLCTAEEALRFLTDNRRRISRRSGILRRVLRPAEKLFRKTFGECTLKDTVKPVLIPCYDLVTRAPFVFSRADALEVDGFDFKMRDVCAATSADPSSAGPTEMLSVDGRTRIVAVDGGVAMNNPTAAAITHVLNNKHEFPFCNGVSDLLVLSLGNGESDFNAVKSPSGFVRIAGEGASDMVDQAVSMAFGECRMSNYVRIQSNGIMANKGTQAKSCKTASDLLSISEEMLAQKNVESLLFKGKKVAENTNMDKLELFGGELIKEQERRKTSILPTVVLKNNNASPSPSRTSSATTLSTLSSTS

SEQ ID NO: 93352 - protein, 381 aa, Glycine max
  Coding DNA Sequence Number=SeqID_1667
  Gene Ontology: Mol. function=nucleic acid binding
  Homolog annotation: Hit_ID=A7Q1D4; Match level="QueryCoverage=60%, HitCoverage=40%, E-value=5e-87, Identity=69%"; Hit description =Chromosome chr10 scaffold_43, whole genome shotgun sequence
  Pfam annotation: Domain name=YTH; Domain location=7-97; Score=132.6; E_value=1.1e-36; Accession=PF04146.6; Description=YT521-B-like family
MAKPLNLKLSMFWQGCAKMTSKIGGSVAGGNWKYAHGTAHYGRNFSVKWLKLCELSFHKTRHLRNPYNENLPVKISRDCQELEPSIGEQLASLLYLEPDSELMAISVAAESKREEEKAKGVNPDNGGENPDIVPFEDNEEEEEEESDEEEESFGHGVGPAGQGRGRGRGMMWPPHMPLGRGARPMPGMQGFNPVMMGDGLSYGPVGPDGFGMPDLFGVGPRGFAPYGPRFSGDFGGPPAAMMFRGRPSQPGMFPGGGFGMMLNPGRGPFMGGIGVGGANPPRGGRPVNMPPMFPPPPPLPQNANRAAKRDQRTADRNDRFGSGSEQGKSQDMLSQSGGPDDDPQYQQGYKGNQDDHPDDSESEDEAPRRSRHGEGKKKHKI

SEQ ID NO: 93353 - protein, 350 aa, Glycine max
  Coding DNA Sequence Number=SeqID_1668
  Gene Ontology: Mol. function=oxidoreductase activity; Cellular component=extracellular region; Biological process=response to oxidative stress
  Homolog annotation: Hit_ID=O24081; Match level="QueryCoverage=94%, HitCoverage=93%, E-value=1e-130, Identity=72%"; Hit description =Peroxidase1A precursor
  Pfam annotation: Domain name=peroxidase; Domain location=42-291; Score=465.5; E_value=7e-137; Accession=PF00141.14; Description =Peroxidase
MSSLRLALCCVVVVLGALPHFSYAQLDPSFYDSTCSNVTSIVREVLSNVSQSDPRILASLIRLHFHDCFVQGCDASILLNDTDTIVSEQSAVPNNNSIRGLDVVNQIKTAVENACPGIVSCADILALAAQISSDLANGPVWQVPLGRRDSLTANQTLANQNLPAPTFTIDQLIESFGNQSLNITDLVALSGAHTIGRAQCRFFVDRLYNFSNTGNPDPTLNTTLLQSLQGICPNGGPGTNLTNLDLTTPDTFDSNYYSNLQLQNGLLQSDQELLSANNTDIVAIVNNFISNQTLFFENFKASMIKMGNIGVLTGSQGEIRSQCNSVNGNSSGLTTTATKESSQDSMVSSL

SEQ ID NO: 93354 - protein, 496 aa, Glycine max
  Coding DNA Sequence Number=SeqID_1669
  Gene Ontology: Mol. function=nucleic acid binding; Cellular component= ribonucleoprotein complex; Biological process=rRNA processing
  Homolog annotation: Hit_ID=A7Q1D6; Match level="QueryCoverage=80%, HitCoverage=77%, E-value=1e-172, Identity=74%"; Hit description =Chromosome chr10 scaffold_43, whole genome shotgun sequence
  Pfam annotation: Domain name=WD40; Domain location=132-170; Score =28.5; E_value=2.5e-05; Accession=PF00400.23; Description=WD domain, G-beta repeat
  Pfam annotation: Domain name=WD40; Domain location=193-231; Score =27.6; E_value=4.7e-05; Accession=PF00400.23; Description=WD domain, G-beta repeat
  Pfam annotation: Domain name=WD40; Domain location=235-273; Score =45.2; E_value=2.4e-10; Accession=PF00400.23; Description=WD domain, G-beta repeat
  Pfam annotation: Domain name=WD40; Domain location=277-314; Score =20.2; E_value=0.0075; Accession=PF00400.23; Description=WD domain, G- beta repeat
  Pfam annotation: Domain name=WD40; Domain location=317-354; Score =23.1; E_value=0.001; Accession=PF00400.23; Description=WD domain, G -beta repeat
  Pfam annotation: Domain name=WD40; Domain location=397-434; Score =13.3; E_value=0.72; Accession=PF00400.23; Description=WD domain, G -beta repeat
  Pfam module annotation: Pfam domain module=WD40::WD40::WD40::WD40::WD4 0::WD40; Domain location=132-170::193-231::235-273::277-314::317 -354::397-434
MPRKKKAHDPFFTNDSRKRQKQNKKLDEDEEEDAEIESDFDEDGFFAGGGGGGEEQEEEETGAEVRKRLAQDLLQRVRKSAQKGEEEEDDEEEEDEEGARDSLVAQKLLKEQNEESGRVRRSLASRVKVSGDEGFRVLAKHRHSVTAVALSEDDSKGFSASKDGTIMQWDVNSGQCERYKWPSDSVLKSHGLKDPQGSATRQSKQVLALAASSDGRYLATGGLDRHIHIWDTRTREHLQSFPGHRGPVSCLTFRQGTSELFSGSFDRTIKIWNVEDRTYMSTLFGHQSEVLSIDCLRKERVLTAGRDRSMQLFKVHEESRLVFRAPASSLECCCFVGNDELFSGSDDGSIELWTVMRKKPIYILRNAHALPVDSMKSDQKDSEKLPNGNLENGYNHPKDHHCLSVFSWVSAVSVCRNSDLAASGAGNGSVRLWEIESDTKDIKSLCNVPLAGFVNSLAFAKSGEFLVAGVGQEPRLGRWGRNPEARNGVSILPLKL

SEQ ID NO: 93355 - protein, 680 aa, Glycine max
  Coding DNA Sequence Number=SeqID_1670
  Gene Ontology: Mol. function=hydrolase activity, hydrolyzing O -glycosyl compounds; Cellular component=integral to membrane; Biological process=carbohydrate metabolic process
  Homolog annotation: Hit_ID=A7QNR6; Match level="QueryCoverage=98%, HitCoverage=99%, E-value=0.0, Identity=71%"; Hit description =Chromosome undetermined scaffold_134, whole genome shotgun sequence
  Pfam annotation: Domain name=Glyco_hydro_3; Domain location=106-376; Score=255.0; E_value=1.7e-73; Accession=PF00933.12; Description =Glycosyl hydrolase family 3 N terminal domain
  Pfam annotation: Domain name=Glyco_hydro_3_C; Domain location=448 -660; Score=206.8; E_value=5.2e-59; Accession=PF01915.13; Description= Glycosyl hydrolase family 3 C terminal domain
  Pfam module annotation: Pfam domain module=Glyco_hydro_3::Glyco_hydro_ 3_C; Domain location=106-376::448-660
MSRALFHLLGVLWLCWCLTSIGEAQIEYLRYKDPKQSVQTRVRDLMSRMTLDEKIGQMVQIDRSVANANVMKTSFIGSVLSGGGSEPLPRATAEDWVNMINDFQKGALESRLGIPMIYGIDAVHGHNNVYNATIFPHNVGLGFAFIHLFGSNNLWIGAATALEVRATGIPYVFAPCIAVCRDPRWGRCYESYSEDPKIVQEMTEIIPGLQGSIPANSRKGFPYVGGKTKVAACAKHFVGDGGTTKGINENNTVIDWHGLLSIHMPAYSDSIIKGVSTVMVSYSSWNGVRMHANRDLVTGFLKNTLKFKPFFLPLSDPDLSNMVHIVDANNKFCSLIYQGFVISDWQGIDRLTSPPSSNYTYSVQASIEAGVDMVMVPFEYDKFIQDLTLLVKSNIIPMERIDDAVERILLVKFTMGLFENPLADTSLVNELGSQEHRDLAREAVRKSLVLLKNGKNESAPLLPLPKKVPKILVAGSHADNLGYQCGGWTIKWQGFSGNSDTRGTTILSAIKSAVDTSTEVVFRDNPDNEFVRSNNFEYAIVVVGEPPYAETAGDSTTLAMMESGPNVINNVCGTVKCVVVIISGRPIVIEPYVSSIDALVAAWLPGTEGQGVTDVLFGDYGFTGKLARTWFKSVDQLPMNFGDPHYDPLFPFGFGLTTESVKDLVARLSTIYGSFIGAGG

SEQ ID NO: 93356 - protein, 181 aa, Glycine max
  Coding DNA Sequence Number=SeqID_1671
  Gene Ontology: Mol. function=transcription factor activity; Cellular component=nucleus; Biological process=regulation of transcription, DNA-dependent
  Homolog annotation: Hit_ID=A5BV07; Match level="QueryCoverage=76%, HitCoverage=8%, E-value=6e-52, Identity=73%"; Hit description =Putative uncharacterized protein
  Pfam annotation: Domain name=CBFB_NFYA; Domain location=86-142; Score= 130.8; E_value=4e-36; Accession=PF02045.6; Description=CCAAT-binding transcription factor (CBF-BNF-YA) subunit B
MANPEVIQLIGIATQNVQYATPSQLGTGHAVVPPTYPYPDPYYRSIFAPYDAQTYPPQPYGGNPMVHLQLMGIQQAGVPLPTDTVEEPVFVNAKQYHGILRRRQSRAKAESEKKAARNRKPYLHESRHLHALRRARGCGGRFLNSKKDENQQDEVASTDESQSTINLNSDKNELAPSDRTS

SEQ ID NO: 93357 - protein, 133 aa, Glycine max
  Coding DNA Sequence Number=SeqID_1672
  Gene Ontology: Mol. function=GTP binding; Cellular component =intracellular; Biological process=ATP catabolic process
  Homolog annotation: Hit_ID=A7Q4M8; Match level="QueryCoverage=84%, HitCoverage=28%, E-value=2e-55, Identity=92%"; Hit description =Chromosome chr10 scaffold_50, whole genome shotgun sequence
  Pfam annotation: Domain name=DUF933; Domain location=70-133; Score =96.0; E_value=1.2e-25; Accession=PF06071.4; Description=Protein of unknown function (DUF933)
MWKKKFNYHWIPVIFRVQEHGGETIIPFSCALERNLADMPPDEAAKYCEENKTQSALTKIIKTGFSAINLIYFFTAGPDEVKCWQIRRQTKAPQAAGAIHTDFERGFICAEVMKFEDLKELGSESAVKHQIDN

SEQ ID NO: 93358 - protein, 682 aa, Glycine max
  Coding DNA Sequence Number=SeqID_1673
  Gene Ontology: Mol. function=protein binding; Biological process =hermaphrodite genitalia development
  Homolog annotation: Hit_ID=Q9LIQ0; Match level="QueryCoverage=98%, HitCoverage=99%, E-value=6e-89, Identity=34%"; Hit description =Genomic DNA, chromosome 3, BAC clone:F14O13
  Pfam annotation: Domain name=Krr1; Domain location=382-617; Score =202.2; E_value=1.2e-57; Accession=PF05178.3; Description=Krr1 family
MPLQLFDGSDSENEDISKIKIDKEYARRFEHNKKREDLQRFEELKKKGVIDSPSHSHSEGEEESESESLDDDDDDYETLVNSRRRDKEFFDALIKVKKQDPILKQKDVRLFGSDDSSDDESDEKEKVKSKDKKGEKPMYLKDVVAKHLIEEGADFGDEEEEIDEKEKRKGKKVMPLKDKDFVIKDGKKTYGDEQEELKKAFLQAVEREGLEDGEEEFFSVKEKVGEEDKVDSDDKELEEKLDEYFGGDVESNENSKFLRSYFMNKLWIDKSGKNLNVGEDELDEISEDEVELERQEEYEYRFQENPGDRVLGHARKVEGSVRKKMNARKEQRKSKEERMAIEQKEREEELKRLKNLKKQEIQEKVKKIMKTAGIHGDDIIPLSMAEIEEEFDPEEYDRMMKKAFDEKYYNAEDADLDFCSDIDDIEKPDFEKEDELLGLPKGWDACGSNGGFLAAREKALKEKIENTSDDDLPEAEDENERFENTSDDDLPEGEDEKEEKIPEEGSRKRKRKTALLEKARQAMMDEYYKLDYEDTIGDLKTRFKYAKTKSSRFGLSASEILLMDDKELNQYISLKKLAPYQEEEWKLSKQKRYMLKMRAKELLRMSSLDKKKRKNSKVDSGKITSSKSVENEKPSTEESNINTDNLSRKAKRRRQVANLKLSQSRLKAYGKIPSKSKHGGKH

SEQ ID NO: 93359 - protein, 142 aa, Glycine max
  Coding DNA Sequence Number=SeqID_1674
  Gene Ontology: Mol. function=binding
  Homolog annotation: Hit_ID=A7Q4Q6; Match level="QueryCoverage=95%, HitCoverage=21%, E-value=2e-49, Identity=71%"; Hit description =Chromosome chr10 scaffold_50, whole genome shotgun sequence
  Subcellular localization annotation: CTP_CleavageSite=43; ConfidenceScore=5.29e-01
MLFERGSPARCYMTPPPQRTSPWKPPHSRSSSVPFSERKMSPNSVNKSDIFHIIHKVPAGDSPYVKAKQVQLVDKDPGRAVSLFWAAINAGDRVESALKDMALVMKQLNRSDEAIEAIRSFRHLCPSDSQDSLDNILVELYK

SEQ ID NO: 93360 - protein, 1217 aa, Glycine max
  Coding DNA Sequence Number=SeqID_1675
  Gene Ontology: Mol. function=double-stranded RNA binding; Cellular component=intracellular; Biological process=RNA processing
  Homolog annotation: Hit_ID=A7PV34; Match level="QueryCoverage=97%, HitCoverage=87%, E-value=0.0, Identity=55%"; Hit description =Chromosome chr4 scaffold_32, whole genome shotgun sequence
  Pfam annotation: Domain name=Helicase_C; Domain location=194-275; Score=55.1; E_value=2.4e-13; Accession=PF00271.22; Description =Helicase conserved C-terminal domain
  Pfam annotation: Domain name=PAZ; Domain location=593-733; Score =10.6; E_value=0.00017; Accession=PF02170.13; Description=PAZ domain
  Pfam annotation: Domain name=Ribonuclease_3; Domain location=772-912; Score=105.0; E_value=2.3e-28; Accession=PF00636.17; Description =RNase3 domain
  Pfam annotation: Domain name=Ribonuclease_3; Domain location=984 -1095; Score=127.8; E_value=3.1e-35; Accession=PF00636.17; Description=RNase3 domain
  Pfam annotation: Domain name=dsRNA_bind; Domain location=343-425; Score=47.9; E_value=3.6e-11; Accession=PF03368.5; Description=Double stranded RNA binding domain
  Pfam annotation: Domain name=dsrm; Domain location=1122-1187; Score =22.4; E_value=0.0017; Accession=PF00035.16; Description=Double -stranded RNA binding motif
  Pfam module annotation: Pfam domain module=Helicase_C::PAZ::Ribonuclea se_3::Ribonuclease_3::dsRNA_bind::dsrm; Domain location=194-275::593 -733::772-912::984-1095::343-425::1122-1187
MKVYTCVSEAVLTEFIPTSTPKFKFYQGNEVQSVLFEDLAFKLKMLKEQHESNLKSSDFTKSAAEFARRRTKKIFSALIFCLDELGVWLALKAAESLSSNDIQLFSWGHSGDTVVKNFISAGVQTLKTYLPCGPQWSIGDNIKYDVEMELLSSKVCCLIDSILEYRGLTDMRCIIFVERVITAVVLRDLLNTLLPKYNSWKTKFIAGQNFGLQNQSRKKQNEIVEEFRMGLVNIIVATSILEEGLDVESCNLVIRFDPCHTVCSFIQSRGRARMQNSDYILMVKSGDSVTCSRLAKYLASGDIMRKESLRHSSLPCDPLEEDRFDKETYRVASTEAFANLSSSISLIHLYCSRLPADGYFKPTLRWDKETGTLYLPKSCPLQPIRVEGDKKILKNIACLEACKQLHKIGALSDNLVPDIVMEEAEVEELGNEPYDENQPTFVPFGLVNSVSNNSQTVYHCYFMEFNNKFSYDVSVQDIFLLMRIELDPEIGCMQFDMGFDRGSLSVNFRYKGTINLSPDQVLLCKKFQVTILRILIDHDMNKLTAGLDRCYLEDDLEIDYLLLPAMGKGKYTAINWLAVNSVNPSEVSCKYHEPHIRTKSGLVCSCKLQNALVCTSHPIGKISFYIATGTMELDGNSPMELRGGGVTTYKKYYEQHHGIQLQFEHQRLLKARHIFQVKNHCHGRKQGKEGEVSKAFVELPPELCSIVMMPISDSLIYSYSFIPSIMHRFESLLGAFNLKKMHLDHCARNEIQTIKVLEAITTKRCKEAFHYESLETLGDSFLKYAASQQLFKTYHNHHEGLLSLKREKIISNAALCKLGCSSGLPEETSMECRQKIVECVQIARLWAGGFIRNEPFDPNTWIIPGDKPRSFKLKELVAKGKTIYVSGKRKLRQKIVADVVEALIGAFLSTGGEKAALLFMDWVGIKVSFNKIPYDRHFDIQPEKLVNVSFLESQLNYSFHDRSLLVEAVTHGSYMLPEVPRCYQRLEFLGDSVLDYLITWHLYNKYPGMTPGQLTDMRSASVNNDCYAWSAIKHGLHKHVLHASQELHMHVSATLNKFDKLSSLSTFGYEAETSLPKVLGDIVESLAGAILVDSGYNKEVVWQSIRPLLEPLVTPETLKLHPIRELNELCQKRSYKIILEDVSRKDGLTYYRMEVEADGIIHKYEYKGDALRDTAKKIVCKEILNSLKDGGAHKDTAKKIVCEEKLNSLKEGESNGA

SEQ ID NO: 93361 - protein, 243 aa, Glycine max
  Coding DNA Sequence Number=SeqID_1676
  Gene Ontology: Mol. function=histidinol dehydrogenase activity; Cellular component=chloroplast; Biological process=amino acid biosynthetic process
  Homolog annotation: Hit_ID=A7QMZ3; Match level="QueryCoverage=72%, HitCoverage=40%, E-value=2e-85, Identity=89%"; Hit description =Histidinol dehydrogenase
  Pfam annotation: Domain name=Histidinol_dh; Domain location=1-170; Score=-4.8; E_value=1.7e-18; Accession=PF00815.11; Description =Histidinol dehydrogenase
AEHGPDSQVVLVIAGDGVDLNAIQEELSKQCDSLPRGEFASKALSHSFFVYACDMLEAINFSNLYAPEHLIINVKDAEKWESFIENAGSVFLGPWTPESVGDYASGTNHVLPTYGYARMYGGVSLDSFLKYITVQSLSEEGLRRLGPYVATMAEVEGLEAHKRAVTLRLQYIEARQNLREKRFVTERNDTPVDWTPKWKVPNPNAGKLEFVPNKHGSLPILEHALATALEAAHLVATKFIRWP

SEQ ID NO: 93362 - protein, 37 aa, Glycine max
  Coding DNA Sequence Number=SeqID_1677
MEVSPCMRRQETSSGPFCCPGVTCADGHNVSLWGRKK

SEQ ID NO: 93363 - protein, 175 aa, Glycine max
  Coding DNA Sequence Number=SeqID_1678
  Gene Ontology: Mol. function=ATPase activity, coupled to transmembrane movement of substances; Cellular component=integral to membrane; Biological process=transport
  Homolog annotation: Hit_ID=A7PPC5; Match level="QueryCoverage=98%, HitCoverage=47%, E-value=2e-20, Identity=48%"; Hit description =Chromosome chr8 scaffold_23, whole genome shotgun sequence
MVLVVAFLGQELRKVLPAILFVKANNEESCKNTRFKRLALVDYTARQKKKKMKALIPQIIQAIYFGVLSILKSQSRITQDVGKAYNECWQGEPAAERLLAMSRFKNKQLRSFLIASMNSLHLLTLFSGTVAANIGYRDLTTKIDMDRVKHASETAHADEFVKKLPEGYKINIGYL

SEQ ID NO: 93364 - protein, 548 aa, Glycine max
  Coding DNA Sequence Number=SeqID_1679
  Gene Ontology: Mol. function=oxidoreductase activity; Cellular component=anchored to membrane; Biological process=electron transport
  Homolog annotation: Hit_ID=Q9SVG3; Match level="QueryCoverage=94%, HitCoverage=94%, E-value=0.0, Identity=62%"; Hit description =Reticuline oxidase-like protein
  Pfam annotation: Domain name=BBE; Domain location=485-542; Score =103.0; E_value=9.2e-28; Accession=PF08031.3; Description=Berberine and berberine like
  Pfam annotation: Domain name=FAD_binding_4; Domain location=88-227; Score=100.1; E_value=6.8e-27; Accession=PF01565.14; Description=FAD binding domain
  Pfam module annotation: Pfam domain module=BBE::FAD_binding_4; Domain location=485-542::88-227
  Subcellular localization annotation: CTP_CleavageSite=25; ConfidenceScore=5.24e-01
MATKPRLAYLPAIFVLLLVVFTSVTAQSPGPESSSLHDTFLQCLTKYTKNSSSQLSNIVFANTNPKFPTVLQNYIRNARFNTSSTPKPSLIVTPQKESHVQATVICAKSVNIQLKIRSGGHDYEGISYISDEPFIILDMFNFRRITVDIKNEVAVVQAGATLGEVYYRIWKKSKVHGFPAGVCPTVGVGGHFSGGGYGNMLRKYGLSVDNVIDAQIVDVKGNLLNRKTMGEDLFWAIRGGGGASFGVILSYTIKLVPVPETVTVFRVEKTLETNVTATDLVVQWQKVAPNTDDRLFMRLLLQPVSSKVVKGTITVRASVVALFLGGANEVVSILAKQFSLLGLKKENCTEVSWINSVLWWNDNNSLKNGVKPEALLDRNLNSAGFLKRKSDYVQNAISRDGLEWLFKRMIELGKTGLVFNPYGGKMSEIPSDATPFPHRKGNLYKIQYSVNWDDRSPGAALNFTNQAKRLFSYMTPFVSKNPRSAFLNYRDLDIGVNSFGENSFQEGVVYGTKYFNDNFQRLVKIKTIVDPENFFRNEQSIPVLRGKA

SEQ ID NO: 93365 - protein, 533 aa, Glycine max
  Coding DNA Sequence Number=SeqID_1680
  Gene Ontology: Mol. function=oxidoreductase activity; Cellular component=anchored to membrane; Biological process=embryonic development ending in seed dormancy
  Homolog annotation: Hit_ID=Q9SVG3; Match level="QueryCoverage=95%, HitCoverage=94%, E-value=1e-169, Identity=58%"; Hit description =Reticuline oxidase-like protein
  Pfam annotation: Domain name=BBE; Domain location=470-527; Score =103.7; E_value=5.8e-28; Accession=PF08031.3; Description=Berberine and berberine like
  Pfam annotation: Domain name=FAD_binding_4; Domain location=82-221; Score=111.0; E_value=3.5e-30; Accession=PF01565.14; Description=FAD binding domain
  Pfam module annotation: Pfam domain module=BBE::FAD_binding_4; Domain location=470-527::82-221
  Subcellular localization annotation: CTP_CleavageSite=49; ConfidenceScore=5.36e-01
MAKPSLFYLSAAFVFLSVSSSLSARPPNPPIHDTFLQCLTQHANSTTPLADIVFDNTNPKFPIVLANYIRNAGFNTSSTTKPLLIVTPMVESHVQAAVLCAKSANVQLRIRSGGHDYEGLSYISPKPFILLDMSNLRTITVDVKNELAVVQAGAILGELYYRIWEKSKVHGFSAAVCPTVGVGGHISGGGYGTMLRKYGLSVDNVIDAQIVDVKGNLLNRKTMGEDLFWAIRGGGGASFGVIVSFTIKIVPVPETVTFFRVDRTLEQNATDLVLQWQQVAPTTDDRLFMRLLLSPSGKTATASVVALFLGGANELLPILDKQFPLLGLKKENCTEGRWIDSVIWFDDEEAFEKGAKPEVLLERNPNWALFLKRKSDYVQNAIPREGLELLWKTIIEMGKTGLAFNPYGGKMSQILPDATPFPHRKGNLFKIQYSVTWSDPSPAAAQNFLNQTRVLYSVMTPYVSKNPRSAFLNYRDIDIGTNSFGKNSFEEGEVYGAKYFNANFQRLVKVKTAVDPENFFAYEQSIPVSPTKA

SEQ ID NO: 93366 - protein, 304 aa, Glycine max
  Coding DNA Sequence Number=SeqID_1681
  Gene Ontology: Mol. function=protein serine/threonine kinase activity; Cellular component=integral to membrane; Biological process=protein amino acid phosphorylation
  Homolog annotation: Hit_ID=A5BIK9; Match level="QueryCoverage=95%, HitCoverage=38%, E-value=1e-35, Identity=32%"; Hit description =Putative uncharacterized protein
EVCAQEDSTTWPIAKPGCDSGCGDVPIPYPFGMNRSDCYAGKWFEIECRNSTRPYLKSIGLGVEVLSFDVNRGTVDINNPIYRSNNCGTKTTKHPAVNNISLEGSPFVYSQRNNKFVAAGCNNIAFLKGKGSAVSGCVSICDNDDDVGNTNLGTIECNGESCCENSLPMYLSEYTPEIKGLNENKKGNHCSYAMIVQNQPNPDPYQYQCRNGYRYPYPYQYQYGYSNLLGVGKLKDIDFVPAVLEWEIVNATLKLPTSPYVDCKGTNITSSRYNYSGRRCSCRYEAYYYITPSPRNPYIADGCP

SEQ ID NO: 93367 - protein, 78 aa, Glycine max
  Coding DNA Sequence Number=SeqID_1682
MTGGSEIPYRALHGETAKRRKGFVEGCWEKGHSERKPCREGREDRQGLKTLNRRTKISKKSNKLLGKRRGYHENEIII

SEQ ID NO: 93368 - protein, 940 aa, Glycine max
  Coding DNA Sequence Number=SeqID_1683
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=A7QC19; Match level="QueryCoverage=98%, HitCoverage=98%, E-value=0.0, Identity=62%"; Hit description =Chromosome chr10 scaffold_76, whole genome shotgun sequence
  Pfam annotation: Domain name=Glyco_hydro_31; Domain location=284-794; Score=811.4; E_value=5e-241; Accession=PF01055.17; Description =Glycosyl hydrolases family 31
MDTTTTIAPLLFCTCACLIFFSASLSEATVVGYGYTISTVNNYPIKNSLTANLNLIKSSSVSGPDIPHLSLTASFENKDRLRVRITDSNHQRWEIPQEVIPRDSSSQHYPLGFLNTKQGSHQPKDSLSLTHSDSDLVFSLHNTTPFGFTVSRKSSNDVLFHAAPDPSNPETFLVFKDQYLQLSSSLPSQRASLYGFGEHTKSSFKLRPNQTLTLWNADIASANLDLNLYGSHPFYLDVRSHSSDGKVKAGTTHGVLLLNSNGMDIVYGGDRITYKVIGGVFDLYFFAGSSPELVLEQYTQLIGRPAPMPYWSFVFGIAGKWHKCTTPKQLAMPLIELCSVATQIHTRTADSSRQRISFHQCRWGYKNVSDLEDVVANYAKAGIPLEVMWTDIDYMDAFKDFTLDPINFPLDKMRSFVDTLHKNGQKYVLILDPGISVNETYATYDRGLKADVYIKRNGNNYLGQVWPGPVYYPDFLNPRSQAFWGGEIKLFRDLLPIDGIWLDMNELSNFITSPPIPSSNLDNPPYKVNNVGDQRPINDKTVPATSLHFGNITEYNVHNLYGLLESKVTNKALKDITGKRPFILSRSTFVSSGKYAAHWTGDNAATWNDLAYSIPAILNSGIFGIPMVGADICGFEGNTTEELCGRWIQLGAFYPFARDHSVINSIRQELYVWDSVASSARKVLGLRYRLLPYFYTLMYEAHTKGTPIARPLFFSFPEDVTTYEINSQFLLGRGVLVSPVLQSGATTVDAYFPKGTWFDLFNVSNSVNAESGKYVTLDAPYDHINVHVGEGNILALQGEAMTTDAARKTAFQLVVVISSSRSSYGQLYLDDGEALDMAGAKDQWTLVSFYGALHNNSVSVTSKVTNGRFALDQRWILDKVTFLRIPKLAGNELSIVNGTSSMKKAIVKSQFDSSSQFVNVQVSKLSLLIGEEFQLEIEIK

SEQ ID NO: 93369 - protein, 103 aa, Glycine max
  Coding DNA Sequence Number=SeqID_1684
  Gene Ontology: Mol. function=oxidoreductase activity; Cellular component=endoplasmic reticulum membrane; Biological process =electron transport
  Homolog annotation: Hit_ID=Q84ZW1; Match level="QueryCoverage=55%, HitCoverage=11%, E-value=1e-26, Identity=96%"; Hit description=Ent -kaurenoic acid oxidase
MMMMMCSMWMWVVLVAIAGALLVLRSILKNVNWWLYESKLGVKQYSLPPGDMGWPFIGNMWSFLSAFKSKDPDSFISSFVSSRNPNTPQRVNGSRDPPLTSGH

SEQ ID NO: 93370 - protein, 449 aa, Glycine max
  Coding DNA Sequence Number=SeqID_1685
  Gene Ontology: Mol. function=5-formyltetrahydrofolate transporter activity; Cellular component=membrane
  Homolog annotation: Hit_ID=A7PAZ5; Match level="QueryCoverage=91%, HitCoverage=95%, E-value=1e-162, Identity=68%"; Hit description =Chromosome chr16 scaffold_10, whole genome shotgun sequence
  Pfam annotation: Domain name=BT1; Domain location=24-430; Score =270.2; E_value=4.2e-78; Accession=PF03092.7; Description=BT1 family
  Pfam annotation: Domain name=MFS_1; Domain location=16-376; Score= -14.1; E_value=0.055; Accession=PF07690.7; Description=Major Facilitator Superfamily
  Pfam module annotation: Pfam domain module=BT1::MFS_1; Domain location=24-430::16-376
MVASDGGGGGRLMKKVLGLGFWVQGFRCFPWLVVSFYLKDGLNVDPSTLQILQSSANLPMVGKPLYGLLSDSVYISGQHRVPYIALGAKLHTFATFLQFVVGSVMWGFWNRGLALSWLVIAISPTNMSIFAISIYLLLSNLGASIAEVANDAIVAEMAKQTPSSTKHPQPSSSGNLQSFVWIASSAGGVLGNLLGGIFIGRLPKSPSGGIRKQLSQLLVALRKPEIAYSISWFTASYAIIPALTGTMFFYQTQYLKIDSSVLGISKVFGQATMLLWGIIYNQYFKSVSSRKLISAIQVMMAFLMVSDFLFVRGFYRQMGMPDSLYVVIFSGFLEVLFFFKILPFSVLIAQMCPPGCEGSVMAFLMSCVALAFIVSGYLGVALASCIKVTGNDFSGLPFGLLIQAACTLVPTFWSSCIPDKWYDAEVIDSVSFLCLHASAGRYKLYQFVF

SEQ ID NO: 93371 - protein, 265 aa, Glycine max
  Coding DNA Sequence Number=SeqID_1686
  Gene Ontology: Mol. function=sequence-specific DNA binding; Cellular component=nucleus; Biological process=regulation of transcription, DNA-dependent
  Homolog annotation: Hit_ID=A7Q4V5; Match level="QueryCoverage=92%, HitCoverage=56%, E-value=4e-77, Identity=63%"; Hit description =Chromosome chr10 scaffold_50, whole genome shotgun sequence
  Pfam annotation: Domain name=WRKY; Domain location=26-86; Score =139.3; E_value=1.1e-38; Accession=PF03106.6; Description=WRKY DNA -binding domain
KNQAKKVVCIPAPAAANSRQTGEVVPSDLWAWRKYGQKPIKGSPYPRGYYRCSSSKGCSARKQVERSRNDPNMLVITYTSEHNHPWPKQRNALAGSTRSQPSKNNNNAAASNSKNSEGSNSQKGTATKAKDDEESNNYNNSSEGNVSPVVAGNSSNSVKEENMEDIEKHQIEMDEGEFSDGIPYKPSLMDHQSTNNQQSEDFFAELGEIEADPLDLLFTQGFGGADDQRESKALDPFHLFDWSGNNNNNNNTSSSFEEPNNKRRL

SEQ ID NO: 93372 - protein, 245 aa, Glycine max
  Coding DNA Sequence Number=SeqID_1687
  Gene Ontology: Mol. function=catalytic activity; Cellular component =nucleus; Biological process=metabolic process
  Homolog annotation: Hit_ID=A7Q8M5; Match level="QueryCoverage=74%, HitCoverage=31%, E-value=9e-79, Identity=77%"; Hit description =Chromosome chr5 scaffold_64, whole genome shotgun sequence
LEVMNTETMKPVPADGASVGEIVMRGNAVMKGYLKNRKANMEAFADGWFHSGDLAVKHPDGYIEIKDRSKDIIISGGENISSVEVENVLFSHPAVLEASVVARPDEKWGESPCAFVTLKPAGMDGAASTNEKILAEDIVKFCRSKMPAYWVPKSVVFGPLPKTATGKTQKQLLRTKAKEMGPALLMMDHVKQELPLEHALGTSRTWPILAKSVDDGEVAPMPSLQPQDAELESQSSLSLPPSLPP

SEQ ID NO: 93373 - protein, 86 aa, Glycine max
  Coding DNA Sequence Number=SeqID_1688
MVKRTYQREKLTTVPPERIGDNDDDDNNNNSDDGESGGNDGGFCDDGGGTSGGRTMAIVARSDIDDDGNNDGYYDGDDDNSNLVAF

SEQ ID NO: 93374 - protein, 173 aa, Glycine max
  Coding DNA Sequence Number=SeqID_1689
  Gene Ontology: Mol. function=ribose-5-phosphate isomerase activity; Biological process=pentose-phosphate shunt, non-oxidative branch
  Homolog annotation: Hit_ID=A9PIX0; Match level="QueryCoverage=45%, HitCoverage=28%, E-value=2e-17, Identity=55%"; Hit description =Putative uncharacterized protein
MYWNKQEGPKNHILLSRKVWRRPSIGQAGPLGGDFPVVTSEGHNIPDVIFTSPIENLAEVAKCLDKVDGVVDHGVVSKVPCTVVIASQTGLKILDKLTADIFPCASIITMNKGWDWGLREKKATKVGDLVGREGGGEMEGVKIAIQRENSNSQIAIVIKLEPKPNNSPETLQG

SEQ ID NO: 93375 - protein, 66 aa, Glycine max
  Coding DNA Sequence Number=SeqID_1690
MAEEYYAIVSPYFRRAKICSKYALDVVSRFKEVFAKYKARIRKRAFESLGDSNWCMIESKSRQQEF

SEQ ID NO: 93376 - protein, 66 aa, Glycine max
  Coding DNA Sequence Number=SeqID_1691
MTMWVKSGERKVVRHCKRASIVMGKGKGNRNMPGKGKAKKTAKITWWVFGGRGYLVAGNAMYDEYD

SEQ ID NO: 93377 - protein, 184 aa, Glycine max
  Coding DNA Sequence Number=SeqID_1692
  Homolog annotation: Hit_ID=A2Q5X8; Match level="QueryCoverage=29%, HitCoverage=8%, E-value=7e-09, Identity=53%"; Hit description =Protein kinase
  Pfam annotation: Domain name=LRRNT_2; Domain location=29-70; Score =23.5; E_value=0.00079; Accession=PF08263.3; Description=Leucine rich repeat N-terminal domain
MKPMPTTRNLNVLLIFWSLFSLFMAGYGAESDIYCLQTIKKLDRFNNLPSWDFESNTEGDICKFNGVECWNQHDVEDRVISLLLSTTTVLLAFMYYYEPWTEFKKRSNAIHPLRKKQNHQKETRQKAELLPLALQDQGSKELARLLERLIPRMSFMDLCKATDYFSTGTTGIMTSARGNFYLKP

SEQ ID NO: 93378 - protein, 358 aa, Glycine max
  Coding DNA Sequence Number=SeqID_1693
  Gene Ontology: Mol. function=dimethylallyltranstransferase activity; Cellular component=cytoplasm; Biological process=cholesterol biosynthetic process
  Homolog annotation: Hit_ID=P49351; Match level="QueryCoverage=100%, HitCoverage=100%, E-value=1e-178, Identity=86%"; Hit description =Farnesyl pyrophosphate synthetase 1 (FPP synthetase 1) (FPS 1) (Farnesyl diphosphate ...
  Homolog annotation: Hit description=synthetase 1) [Includes: Dimethylallyltranstransferase (EC 2.5.1.1); Geranyltranstransferase (EC 2.5.1.10)]
  Pfam annotation: Domain name=polyprenyl_synt; Domain location=34-321; Score=365.1; E_value=1.2e-106; Accession=PF00348.8; Description =Polyprenyl synthetase
MADLKSTFLNVYSVLKSELLHDPAFEFSDDARHWVDRMLDYNVPGGKLNRGLSVIDSYRLLKEGQALNDDEIFLASALGWCIEWLQAYFLVLDDIMDNSHTRRGQPCWFRVPKVGMIAANDGVLLRNHIPRILRKHFRGKPYYIDLLDLFNEVVLAQMPKFKLCGVHLVEFQTASGQMIDLITTLEGEKDLSKYTLTLHRRIVQYKTAYYSFYLPVACALLMAGEDLDKNVDVKNILVEMGTYFQVQDDYLDCFGDPQTIGKIGTDIEDFKCSWLIVKALELSNEQQKKVLQENYGKPDPENVAKVKALYNELNLQGVFEEYESGSYAKLVSSIEAHPIKAVQAVLKSFLAKIYKRQK

SEQ ID NO: 93379 - protein, 76 aa, Glycine max
  Coding DNA Sequence Number=SeqID_1694
MEAEWRRKRERRRHFKEKMSLEEAHHHRRPWIRAWRKKEMNEGRGREEHEILCSKRALKSEPTNPRSIPRFSTKCA

SEQ ID NO: 93380 - protein, 80 aa, Glycine max
  Coding DNA Sequence Number=SeqID_1695
MKIHADKLVARGIIGHALTHTKEHGWSDSNKRHVVAHQRSSGRTISQTSKSGHARVDSNGDEVIACADNGEGRGGKERGN

SEQ ID NO: 93381 - protein, 127 aa, Glycine max
  Coding DNA Sequence Number=SeqID_1696
MENWRRGTYVLEPLMIAGRRLELEKKRRTGKQGGPSLLCPFWSRRIDYGGSLELGVHQHVDCSDTFNTSQEFATHDDVLHWTLSVAYDIGFVAVIMRSYTDTRIKGRTSFVLIGCERSVKYRVRKKD

SEQ ID NO: 93382 - protein, 221 aa, Glycine max
  Coding DNA Sequence Number=SeqID_1697
MYLKGWVVARAKMMGLKMKSVGDLLTFCRVSVHLQRVPRHELPKYSCDQPGNLFDETVNETSIRGEIRGVFVDVFEELEQKRHLRVKNGVVELRDIERCVVFEGRLSMGEKVVEGGYKRGFSIRKVEMGGRRRRRVAERRGEREREREKRNRRREKARRKRKRAIQELDRWLFFPMCNLTCNLTRATNTCDTTRRMPTCLVNGHLKFGELRRTRRKYILQV

SEQ ID NO: 93383 - protein, 169 aa, Glycine max
  Coding DNA Sequence Number=SeqID_1698
MQWRFQRQKRCKDKMKLTRNKHRTMVTSKENESWKIPLRLKGSSRCGFSMENNDGLWWLMVVVGDGESYWNFRNGFGRKKEEEMTFFLSYTKAKAEISFIKRLLAHSRHFLKDPNGQIMDKYLVKLQTKFREDQTVNEGWAAFLPRQLHVAFSRSFIKRLPPEASSWLL

SEQ ID NO: 93384 - protein, 165 aa, Glycine max
  Coding DNA Sequence Number=SeqID_1699
MEDILKRWSEHVESIQLGVIHPPLVLMMPKEQDFFKPKVKKRLSHEVLKVIVELSSSVGLSVHPSLSAASVTLALGNVLLPQNLIEAGVKLSLKRSTAGDSIPIDLEINATCRRRNSERIRNFLQDLEAVTTPKEEPRSSEASSSFPIAGHSHIEPVEDPIMAEE

SEQ ID NO: 93385 - protein, 174 aa, Glycine max
  Coding DNA Sequence Number=SeqID_1700
MKSPLSNKRSLYTPPTSTIQKDVPQINYIARGAIIEGNIQELLNQAGEFKGYTSSGLENTCKAKSSSGWMNTLLCTNDQPMWLHLDQVNAHDHTSSTQHEFGRGPFASRVLEICQSEEGMVVNDSLEERIDDNWAWKSYPCLQLLGHINASIGSFPVGPMLVTLGFLGAEGAGG

SEQ ID NO: 93386 - protein, 304 aa, Glycine max
  Coding DNA Sequence Number=SeqID_1701
MEDLFRRWTEHLDNIHSRVNQPPLITCDFCGGEHANSHCHLYFTNNSGWGQESSPYDQYEERGTLTLESVFEEFMAYNTSSKENQNVMNNQEIDVAKSYSIEKSQGTPELELYNQGESERGANLDNLLMQFEETTESTQLTFTSVEIQASKLAKDVTQCVARIEEDIVEIEAQEEIPTKEHELREKDEMKGEEKTQQWEEYLQQDIQQESMLQINTLPHQLIFKKQRQGEQKSALSVFLFGITNPSSAMSWHTLPEYMKFMEFLAKRWNCKEDIAYPLSANLALSAISSRAKPSLLTLSAKTHD

SEQ ID NO: 93387 - protein, 117 aa, Glycine max
  Coding DNA Sequence Number=SeqID_1702
MVVILPKEHLVVWFCSLHNRPVNYLKGIINSAIKGLDDAPQPKSKAPAGWIVVKCNRQKGTTELGYYVMHWMSTIILGSFRNNWEAYFNDPRPLEPERSFSSNAEYSMRGTQYMFAK

SEQ ID NO: 93388 - protein, 50 aa, Glycine max
  Coding DNA Sequence Number=SeqID_1703
MKCCRKTHPEEGLPEVTETYSGRSASGRHFRNHFFRNRPQKLPEDGLPEV

SEQ ID NO: 93389 - protein, 71 aa, Glycine max
  Coding DNA Sequence Number=SeqID_1704
MKLQMLSLFMMRLNIRSEIGFKASCRCSQVAHALLVHDETKHKNTCNDIEYLQNFILKESKKLKRGRKRFV

SEQ ID NO: 93390 - protein, 115 aa, Glycine max
  Coding DNA Sequence Number=SeqID_1705
MSSKYWRSKLPFLGLWGLAKLMLLRKGSSSQFEVWKKKHDLRHPYRTRARVRVMGEVEEVQEQMKADTEALKKQMATMMGAMMSIKEIMEVNVAAIAVISTIVEVDLTSHMASTK

SEQ ID NO: 93391 - protein, 192 aa, Glycine max
  Coding DNA Sequence Number=SeqID_1706
MASTICSVRRYRSSAPRIRCAAQQCECAGYSLLSGQQAAGGQQHVADCFPRHTRSRRGAGTAAGRDAGGWGVHRQRGAAAGISVRRGDESGSNAGTGMAAGVTGTGDRDAAARHAGGGTLFSGAGSAAAGAQLWRYRCEIAVSESAHAGASADVELVFNGLADAEQPDLLALAGDAGAKGVAIGLSDADGTL

SEQ ID NO: 93392 - protein, 70 aa, Glycine max
  Coding DNA Sequence Number=SeqID_1707
MGEVEEVQEQMEADMKAMKEKMAAMMEAMMSMKKIMEANAVAVAATSAVAKVNPTSPSGINQKNQSDVSL

SEQ ID NO: 93393 - protein, 150 aa, Glycine max
  Coding DNA Sequence Number=SeqID_1708
  Homolog annotation: Hit_ID=Q6L477; Match level="QueryCoverage=46%, HitCoverage=11%, E-value=5e-10, Identity=35%"; Hit description =Putative uncharacterized protein OSJNBa0009L15.8
  Subcellular localization annotation: CTP_CleavageSite=33; ConfidenceScore=5.87e-01
MGFPPASTTPPLPPPPPPSPPSPPPPPPTSDASASTFTVKRTRKASRLRSLSTRPPGVERLVVHVDPATGKADGPHKKKLRTYLGIVARDKVDITYENWKEVPTAQKDLIWEDIQAEFDIPEASDSTTKRKLLPTVGERWRPFTSDLTRK

SEQ ID NO: 93394 - protein, 200 aa, Glycine max
  Coding DNA Sequence Number=SeqID_1709
IGLAKLKVVSEESFEAPEEDEEVQALKSELGKAKLAKEKFKLAATHIRKECAGLREENATTARALEQEAKRARKEEYGRNKFRGALWGSNNELKLRREERDQSRAHSMTNMLAIIAKYQEELGLATAHEHRVADEYAQVYAEKEARGRVIDSLHQEATVWMDRFALTLNGSQELPRLLAKAKAMADTYSAPEEIHGLLGY

SEQ ID NO: 93395 - protein, 151 aa, Glycine max
  Coding DNA Sequence Number=SeqID_1710
MDNKCSELGVAGPGRTGAGAEDARADVDGADVEGAEEDGTSDPLPLDLWVPQKVTEGSSGFQQFILTYAKLMAGLKLSKVKESELILAHYWAKRASTAKRNFSTLSVIEEFGRASISRPRAKCEISALSTTVVFSQAQRTPDDKLKSTYSR

SEQ ID NO: 93396 - protein, 141 aa, Glycine max
  Coding DNA Sequence Number=SeqID_1711
MPTSAIIFFDQFLMRIVKLAKYRLKAQVEKDEDPSGEGQSPRVEKDEGPEAETLARLIITYQGNPCGVYPDLSSFTGSGVYPDLSSFTGSGVYPDLSSFTGSGVYPDLSSFTGSGVYPDLSSFTGSGVNQKLYSVYQVIRS

SEQ ID NO: 93397 - protein, 87 aa, Glycine max
  Coding DNA Sequence Number=SeqID_1712
  Homolog annotation: Hit_ID=A6FJQ2; Match level="QueryCoverage=43%, HitCoverage=84%, E-value=3e-11, Identity=92%"; Hit description=50S ribosomal protein L5
MQLPGDGHSLSVIGCREQTSPSGRVSGCWRMRKEKIPHQAPFAIQAAQLLGRAIGAGLFAITPAGERGMCCKAIKLGNARVFPVTTL

SEQ ID NO: 93398 - protein, 179 aa, Glycine max
  Coding DNA Sequence Number=SeqID_1713
MVVTVRPERVLRQFGYIQSIPPPPVSTLLSYDDIDDRWMHFSDHVAAVGDICVVPGQVSVDYMEWFFQISHPFMISTQEGDHPRHPPATDHEDCIQSDIPEVPVAFDPPRHAVDDYEGYETIVERLERVLNLRMAIAGTELHDIMQDCLRIARGVPAPMEVLGLDKDVTQSIDDVFYVL

SEQ ID NO: 93399 - protein, 91 aa, Glycine max
  Coding DNA Sequence Number=SeqID_1714
MDRFDGLQTFVGERFDTLELQVDMCFNEMESRITKVEEYMITKDDDKGDDKKLKGQSKNEFKIFKIDSRTLQDSRGNLNSRIQNQDSRDQD

SEQ ID NO: 93400 - protein, 70 aa, Glycine max
  Coding DNA Sequence Number=SeqID_1715
MIMKGQDMDSRRDEVATSPSSSESEEAKGEESSEEIDSQEERDLLMVRRLLGGQSCHLSNHLNDVRIDRD

SEQ ID NO: 93401 - protein, 112 aa, Glycine max
  Coding DNA Sequence Number=SeqID_1716
  Homolog annotation: Hit_ID=UPI00006A2D9E; Match level="QueryCoverage =95%, HitCoverage=77%, E-value=2e-09, Identity=20%"; Hit description =UPI00006A2D9E related cluster
MDLLNVKWLHCRHSKMVNTPTFRGLHVLAFRGLHALTFRGLHVLTIRGLHVLAIRGLHALTISGPHALTFRGLHALTFRGLHVLAFKGLHTLSFSGLHALTFRGLDALAFKR

SEQ ID NO: 93402 - protein, 89 aa, Glycine max
  Coding DNA Sequence Number=SeqID_1717
  Subcellular localization annotation: CTP_CleavageSite=84; ConfidenceScore=5.13e-01
CYTKFRAPFLPLPPFIFSHLQALIMAFYGGELLLNSSSPRSGVSSQLFFFSIPLPLKFKKQRTPLMKKIQGLQAPNGATSCGIRASSSR

SEQ ID NO: 93403 - protein, 19 aa, Glycine max
  Coding DNA Sequence Number=SeqID_1718
MATVLFLMHFPFSDSNNNS

SEQ ID NO: 93404 - protein, 209 aa, Glycine max
  Coding DNA Sequence Number=SeqID_1719
  Subcellular localization annotation: CTP_CleavageSite=6; ConfidenceScore=5.29e-01
MELASQASLTSNSCTCPLSTPNNSCSCLGTQQTHNPPSCQGYYPNIKQVSLNTRQTPSILDNLFLPVQQIYVARHLALRYMRQPSMSSLTQEHICPTLSSQALNEQVMSNLLCLARVCGDDRGTTVSIETEFEDKPTTVEAMSSKVILMMPKNQESSKIQRFKNQVSKIKIQDSTIKFQESRFKNNQDQDSRLKTQDLRIKRKLNQDKY

SEQ ID NO: 93405 - protein, 86 aa, Glycine max
  Coding DNA Sequence Number=SeqID_1720
MRSKCVVFQVKNLKEVGLLELEVVELLLAVNLDDERNNKDEEGGAGDPRGLANAAEEFLGDECGIIGSFLVAGDDGGARDLREDGA

SEQ ID NO: 93406 - protein, 76 aa, Glycine max
  Coding DNA Sequence Number=SeqID_1721
MKTKARNINTNNIVSETKQRAPYQDDELVELQEVLEVNPDVINESLADVDGGGEEIDASLLKQLDLVELDEDECLS

SEQ ID NO: 93407 - protein, 94 aa, Glycine max
  Coding DNA Sequence Number=SeqID_1722
MDRRITLLWLGVRWIECALSCLVLGYEMEFILDVAPCGASEWRRRRGERRHHPLGNKPWKEELHHQESVFDKKLREEASMEEKNERERERWKEH

SEQ ID NO: 93408 - protein, 101 aa, Glycine max
  Coding DNA Sequence Number=SeqID_1723
  Gene Ontology: Mol. function=structural constituent of ribosome; Cellular component=ribonucleoprotein complex; Biological process =translation
  Homolog annotation: Hit_ID=Q9ZAE4; Match level="QueryCoverage=95%, HitCoverage=52%, E-value=1e-45, Identity=94%"; Hit description=50S ribosomal protein L6
  Pfam annotation: Domain name=Ribosomal_L6; Domain location=11-86; Score=113.3; E_value=7.4e-31; Accession=PF00347.14; Description =Ribosomal protein L6
MRGYKKELEIVGIGYRAQLRGNTVVMNLGYAHPVVYEIPSDVKIEVPAPNRIVVSGIDKQRVGQVAAEIRAFRPLNVYTGKGIRYVGEVVRQKESKKAYRG

SEQ ID NO: 93409 - protein, 113 aa, Glycine max
  Coding DNA Sequence Number=SeqID_1724
MVKKDSRVEEKNTSVVEVEGEGGRIMKHGPHMLSKKHNICLTRSSNTQTTFRTQSGNNIPINPMIGRETPNKLPGNSVNGITNPLGQPKVLHEPKWSSEQISQGSHCQLYLTA

SEQ ID NO: 93410 - protein, 92 aa, Glycine max
  Coding DNA Sequence Number=SeqID_1725
MNFPFKNLGANNDKHITYAPYHLVTMNFPLKNLGGRIQRTSLGDIAISNDVLCTPSTRSCSHYCIANKEMTSNIEAHHSIQKRQQNIHSKYS

SEQ ID NO: 93411 - protein, 68 aa, Glycine max
  Coding DNA Sequence Number=SeqID_1726
MKMLLIPHDASSIGASEWRRKRERRRHFKEKMSLEEAHHHRRPWIRAWRKKEMNEGRGREEHEILCSK

SEQ ID NO: 93412 - protein, 75 aa, Glycine max
  Coding DNA Sequence Number=SeqID_1727
MSLHSSSSVNGRHRAHLRPHSHWREKERKPQEANINLPYFHGKDNLDANLDWEIRVEQCHTLILSGDYYLMTCNK

SEQ ID NO: 93413 - protein, 100 aa, Glycine max
  Coding DNA Sequence Number=SeqID_1728
MSLPSAVHATYPPAGGRRETRGMRVPRKEYARSRHQRLFEENVGKTGKDAIYELLSERFGSCIYARGSGRQGCFPLLLRIPQFAMRKSDLRSSFGTKCLV

SEQ ID NO: 93414 - protein, 137 aa, Glycine max
  Coding DNA Sequence Number=SeqID_1729
IEEIQVVGMSPSPLEPHNHSQTHLMLSGWLPLHAPFSASGLVGACVRSATLARLACISEFQLSAYLLAQRMDSSGALSGADIKEEELIDLRSNPLQGGGDDAILPRKGLVTRAMSKMLQEDWARAAEESPRVLMNLR

SEQ ID NO: 93415 - protein, 50 aa, Glycine max
  Coding DNA Sequence Number=SeqID_1730
MGCNSYLAHGSDIYPKAHENPKAFSCIFGLIFLESSIQCPCGIGLHQLNI

SEQ ID NO: 93416 - protein, 95 aa, Glycine max
  Coding DNA Sequence Number=SeqID_1731
MLEPSKKRKGSSSRSQWHSETQDTPIPSSISSSSLFSTEEQHTRYINLFSSRSIIDAKFIDMDFFSDESFECIQAFHNSNLIPFMSLKLPVYSEL

SEQ ID NO: 93417 - protein, 55 aa, Glycine max
  Coding DNA Sequence Number=SeqID_1732
MAGSTTTSSIEYNRANDGIAMNIGMILGNMWKCHKARTKIRDTKTKIRMRKKKIS

SEQ ID NO: 93418 - protein, 142 aa, Glycine max
  Coding DNA Sequence Number=SeqID_1733
NTLNEIVGKVERLRYLDNNPSSCGCVMRSTFGLPCAYQGLCEVEDSIKEEIETISERFEELDVNTKGAPKKPMKRSQRSTKPDPSYLEYVDAFHSVQSSNSSVKHSASSSEPPKPTRIIPMLDQFAPFRQDFIHNIVDVKAD

SEQ ID NO: 93419 - protein, 140 aa, Glycine max
  Coding DNA Sequence Number=SeqID_1734
GELICAITRSPPSTTYDGVVPGDMSQGSGDLGDVRRAPSSQPIKEQRPQNKEACVGFKNGDRKLKWPLVIDYQGALVIDYQLGVIDYTVIHDVGYNVQDILPENTGVAAQCTRQDKRIEAAGSTMSDTMSRTSCPKILDT

SEQ ID NO: 93420 - protein, 214 aa, Glycine max
  Coding DNA Sequence Number=SeqID_1735
  Subcellular localization annotation: CTP_CleavageSite=41; ConfidenceScore=5.27e-01
MAESSKKRKGSSSTTVATAHCRHEPSKAPTAPIHPSLSSPRSSNLFSSDDQRLRYLSQFYSRIILDPKYLDIDFFNDETFDCYQVFQNSGLIDFMSLKLSYYPELVKVFYINLKILDGIISSEVHGAPFEGTIVDDWKFDYSSHDARRMALRANAPLPYPQLVTFFLRHFQIPLDDEPFVQVKRSFAIGAGAVTSFGYRKDHNGQWLKKDALPP

SEQ ID NO: 93421 - protein, 102 aa, Glycine max
  Coding DNA Sequence Number=SeqID_1736
MRLSWLLVMSLKWNVDDVGNALTSACCVCSWGGGGCIGLVGCPLCGKIEWLKNLSIFEGMLRSFNSSMVIVLDGAHVHKSVYFVLGCVSPGRELLDKWPQMS

SEQ ID NO: 93422 - protein, 69 aa, Glycine max
  Coding DNA Sequence Number=SeqID_1737
MGEESWSLVRNHLHKELTSWSEEYINLVGGIERFEELKRSLLVDDLSKVIMDKWMNITDMGYVIASRYN

SEQ ID NO: 93423 - protein, 140 aa, Glycine max
  Coding DNA Sequence Number=SeqID_1738
MHKALRLNAPLPYPHLVTLFFQHFNIPLDSEPYVPIKRSFLIGASVIASFGYQKEHDGSWVKKGARHVGEGHDGEDSSLLSKILDRFDCLQTFVGERFDTLELQVDMRFNEMESRITKVEEDVSYIRSSFDLTPPPPPSS

SEQ ID NO: 93424 - protein, 2186 aa, Glycine max
  Coding DNA Sequence Number=SeqID_1739
  Gene Ontology: Mol. function=histone-lysine N-methyltransferase activity; Cellular component=nucleus; Biological process=chromatin modification
  Homolog annotation: Hit_ID=A7PXL8; Match level="QueryCoverage=96%, HitCoverage=87%, E-value=0.0, Identity=55%"; Hit description =Chromosome chr12 scaffold_36, whole genome shotgun sequence
  Pfam annotation: Domain name=RCSD; Domain location=337-454; Score =1.1; E_value=0.018; Accession=PF05177.3; Description=RCSD region
  Pfam annotation: Domain name=SET; Domain location=1811-1964; Score =91.7; E_value=2.3e-24; Accession=PF00856.19; Description=SET domain
  Pfam module annotation: Pfam domain module=RCSD::SET; Domain location= 337-454::1811-1964
MGDGGVACIPLQQQQHVIERLPNAAAEKALSGNGFGSGLLKAAGKRKKKKVKVKKKVAPAAKKVVNSELAVEGVGSRGGNDVESGGVCGEMDEVEEGELGTLGCELENGEFVPPEKPVMLTRRSEIENGEIASERWKKGEVERGVFVSGKWRKEEDVEKGEIVPEKGRKGETEKWEYGSWRGGMKNDIEKGEFIQDRWHRGDMGRDDYGCARICRYPPGRDKGWKNERERTPPSGRYYIGDEYFRKKELNRSGSQHAKSAPRWDSGQERNIRISSKIVDEEKNEHSNSRTHMRDYSSGNRLKRHGNESEGCEWNYGDYAGLKSRRLSDDSPRHAYSEHYSRPSVERSYRNSSSKSSADKYSSRHHESLPTRSVYDKHGRSPGHSERSPHDRARYYDHKDRTPVRPSPYSRDRSPYSREKSPHGRERSPYNRNWDRSRHHDHKMRSPTHAERSPQDRGRHQDRRDLTPNLMEQSPHDRTKSNIHREVSSKTLSSGKHNSQHSCKDSEDKHIQQEANLSDVESHGERNVHNGNKSIEKDVCSEPEKEQQSSSPTVSCKDSPCLEPSPEELPSMEEDMDICDTPPHVPVVMDSSSGKWFYLDYNGVEHGPSKLSDIKVLVDDGVLMSDHFIKHIDSDRWLTVEKAVSPVAAPSFPPVVSDTITQLVNPPEAPGNLLADTGDILQSGPENYPGIPAPILQPMLCSKDSGIASELLEDLHIDERVGVLLEGYDVIPGREFEAIKESLQMDFEYAKWEGLEECEGFPGHDSLRMEHDSRIDSSREHESQVSIPSGKDNGFTVGVPGDWSSAQWSCKGGDWKRNDDAQDRFCNKKLVLNDGFSLCQMPKSGCEDPRWTRKDDLYYPSHSRRLDLPLWAFCTDERVDCSTVSKPVQTKLASVRGVKGNILSVVRINACVVKDQGSLVSEACHKTQGKDRYHSRSTRSFSSTSDSKRSSTEEDSQSKASNDQGSLGSCRSMEFINIPKDHNCTVHDLQLHLGDWYYLDGSGRERGPSSFSELQHLVDQGIVKNYSSVFRKCDKLWVPVTSSAETYDEDVNLRSYQESSTVSGECSGLPSKQIHGASFGEHDSKSNLFNSLFPQFVGYTRGKLHELVMRSYKSREFAAVINEVLDPWINARQPKKEIEKQIYWKSEGDGHASKRARMLVDYSEEDSDFEDGSLTNGKDESTFEALCGDATFSGEGSGITDPKVGSWGLLDGRMLARVFHCLRSDLKSLAFASMTCKHWRATVRFYKKVSRHANLSSLGHSCTDSIMWNILNAYEKDKIESIVLIGCTNITAGMLEKILLSFPGLSTVDIRGCSQFGELTPKFTNVKWIKSQSSHITKIAAESHKIRSLKQTAEQTSSISKVSSFSIRDDFGELKDYFDSVDKRDSAKQLFRQNLYKRSKLYDARKSSSILSRDARTRRWSIKKSESGYKRMEQFLASSLREIMKANSCDFFMPKVAEIEAKMKNGYYSGHGLSYVKEDISRMCRDAIKTKNRGDAGNMNHVITLFIQLATWLEENSKYVNSRDALVKLWGNNPPSSLCSTSSKYKKNRLVSERKHRSNETHGGLDNGEYASDREIRRRLSKLNKKSFDSESETSDDFDRSSEDGKSDSDTTTTDIESDQDVHSESRIGDSRGDVYFTPDDGLDFITDEREWGARMTKASLVPPVTRKYDVIDQYIIVADEEDVRRKMRVSLPDGYAEKLSVQKNGIDESDMELPEVKDYKPRKQLENEVVEQEVYGIDPYTHNLLLDSMPKELDWSLQEKHLFVEDKLLRMLNKQVNHFTGTGNTPMSYPLQPAIEEIERYAEEQCDVRTVRMCQGILKAIASRPDDKYVAYRKGLGVVCNKEEGFGEDDFVVEFLGEVYPVWKWFEKQDGIRSLQKNSNDPAPEFYNIYLERPKGDAYGYDLVVVDAMHKANYASRICHSCRPNCEAKVTAVDGHYQIGIYSVREIQHGEEITFDYNSVTESKEEYEASVCLCGSQVCRGSYLNLTGEGAFEKEWHGILDRHYLMLEACELNSVSEEDYNDLGRAGLGSCLLGGLPDWLVSYAARLVRFINFERTKLPEEILKHNLEEKRKYFSDICLEVERSDAEVQAEGVYNQRLQNLAVTLDKKNGKGQFFGKDRCSQELMGQHCFKIESWLAWQFIVGQEFWISYSVKDLRASPGAAVKLCLGDLLVMGSNPETASLHMQG

SEQ ID NO: 93425 - protein, 83 aa, Glycine max
  Coding DNA Sequence Number=SeqID_1740
  Subcellular localization annotation: CTP_CleavageSite=66; ConfidenceScore=5.31e-01
MTCGVTLWLPTPFVNQGQTSPMTPESNIVFCTFCRPDSVKSGDLRGYLRVSRTFGQLGGNEPVDTRGQTSSSAPFVVLTREVR

SEQ ID NO: 93426 - protein, 38 aa, Glycine max
  Coding DNA Sequence Number=SeqID_1741
  Homolog annotation: Hit_ID=A7PP46; Match level="QueryCoverage=94%, HitCoverage=14%, E-value=9e-07, Identity=72%"; Hit description =Chromosome chr8 scaffold_23, whole genome shotgun sequence
RKMLGTSRPQFVLFGSSIVQYSYYEGWGATLSHLYARK

SEQ ID NO: 93427 - protein, 33 aa, Glycine max
  Coding DNA Sequence Number=SeqID_1742
MEVGSWKWKLLEVGNESYWKLKVENGGWKLEGE

SEQ ID NO: 93428 - protein, 83 aa, Glycine max
  Coding DNA Sequence Number=SeqID_1743
TFVSIATPLRLEFIPQVKELLDEGLVRKSLNPCALLVPKIGLGSSSSMDSFASWKMNDSGMEKEEREEMPLHGKDESRRSSPP

SEQ ID NO: 93429 - protein, 129 aa, Glycine max
  Coding DNA Sequence Number=SeqID_1744
  Homolog annotation: Hit_ID=A0ST23; Match level="QueryCoverage=20%, HitCoverage=55%, E-value=2e-08, Identity=100%"; Hit description =Putative reverse transcriptase
LTFSPWVKVYGELGFWLKACRMIKLIDTVDLEGGPVGKPVVPAALMNRPTRGERRFAYWALAECILAYYVGTDEGEKKGCTGASAEYVIQDIFPLPRSLTRYARSFDCGEREMAYERGRRFPGRCQEDT

SEQ ID NO: 93430 - protein, 303 aa, Glycine max
  Coding DNA Sequence Number=SeqID_1745
  Gene Ontology: Mol. function=translation elongation factor activity; Cellular component=intracellular; Biological process=translational elongation
  Homolog annotation: Hit_ID=A4SHU2; Match level="QueryCoverage=99%, HitCoverage=76%, E-value=1e-139, Identity=81%"; Hit description =Elongation factor Tu
  Pfam annotation: Domain name=GTP_EFTU; Domain location=1-111; Score =84.9; E_value=2.6e-22; Accession=PF00009.18; Description=Elongation factor Tu GTP binding domain
  Pfam annotation: Domain name=GTP_EFTU_D2; Domain location=134-203; Score=98.1; E_value=2.8e-26; Accession=PF03144.16; Description =Elongation factor Tu domain 2
  Pfam annotation: Domain name=GTP_EFTU_D3; Domain location=208-302; Score=210.1; E_value=5.5e-60; Accession=PF03143.8; Description =Elongation factor Tu C-terminal domain
  Pfam module annotation: Pfam domain module=GTP_EFTU::GTP_EFTU_D2::GTP_ EFTU_D3; Domain location=1-111::134-203::208-302
MITGAAQMDGAILVVAATDGPMPQTREHILLGRQVGVPYIIVFLNKCDMVDDEELLELVEMEVRDLLSAYDFPGDDTPIVRGSALKALEGEAEWEAKIVELAEHLDSYIPDPVRAIDLPFLLPIEDVFSISGRGTVVTGRVERGIVKVGDEVEIVGIKATAKSTCTGVEMFRKLLDQGQAGENCGVLLRGIKREEIQRGQVLAKPGTIKPHTQFESEVYVLSKDEGGRHTPFFKGYRPQFYFRTTDVTGTIELPEGVEMVMPGDNIKMVVTLIHPIAMDDGLRFAIREGGRTVGAGVVAKVLG

SEQ ID NO: 93431 - protein, 459 aa, Glycine max
  Coding DNA Sequence Number=SeqID_1746
  Gene Ontology: Mol. function=DNA-directed RNA polymerase activity; Cellular component=intracellular; Biological process=transcription, DNA-dependent
  Homolog annotation: Hit_ID=Q5PK93; Match level="QueryCoverage=98%, HitCoverage=33%, E-value=0.0, Identity=94%"; Hit description=DNA -directed RNA polymerase subunit beta
  Pfam annotation: Domain name=RNA_pol_Rpb2_1; Domain location=27-366; Score=50.4; E_value=6.5e-12; Accession=PF04563.6; Description=RNA polymerase beta subunit
  Pfam annotation: Domain name=RNA_pol_Rpb2_2; Domain location=155-458; Score=-26.0; E_value=0.0019; Accession=PF04561.5; Description=RNA polymerase Rpb2, domain 2
  Pfam module annotation: Pfam domain module=RNA_pol_Rpb2_1::RNA_pol _Rpb2_2; Domain location=27-366::155-458
MVYSYTEKKRIRKDFGKRPQVLDVPYLLSIQLDSFQKFIEQDPEGQYFLEFSFRSVFPIFVCGGSYSGNSELQYVSYRLGEPVFDVTECQIRGVTYSAPLRVKLRLVIYEREAPEGTVKDIKEQEVYMGEIPLMTDNGTFVINGTERVIVSQLHRSPGVFFDSDKGKTHSSGKVLYNARIIPYRGSWLDFEFDPKDNLFVRIDRRRKLPASIILRALDYTTEQILDLFFEKVVFEIRDNKLQMELVPERLRGETASFDIEANGTVYVEKGRRITARHIRQLEKDNIQHIEVPVEYIAGKVVAKDYIDTNTGELICAANMELSLDLLAKLSQSGHKRIETLFTNDLDHGAYISETLRVDPTTDRLSSLVEIYRMMRPGEPPTREAAESLFENLFFSEDRYDLSAVGRMKFNRSLLRDEIEGSGILSKDDIIEVMKKLIDIRNGKGEVDDIDHSATVVSVP

SEQ ID NO: 93432 - protein, 50 aa, Glycine max
  Coding DNA Sequence Number=SeqID_1747
YLNEVRPLEAERFKALRIQCLAPFVAQYVKSRDVPKIKRKQAYAIRENSV

SEQ ID NO: 93433 - protein, 83 aa, Glycine max
  Coding DNA Sequence Number=SeqID_1748
MHVIVAADVLVIGRADIHRCQHHAFACQALRQWIAVGVDDHRAADPRNAALHFATIAHRDEQTIDGSVGLRLRQFRRPIALGA

SEQ ID NO: 93434 - protein, 56 aa, Glycine max
  Coding DNA Sequence Number=SeqID_1749
MEEIPPNLSQKNDDLGLINCWIVVTFEHHVRNPIPRISTIGNFDIMSELREIPLTL

SEQ ID NO: 93435 - protein, 123 aa, Glycine max
  Coding DNA Sequence Number=SeqID_1750
MTTFGRRSSRSNEGQFRKKCFRKLLSEDLLPELDLVTSGRRYNGIILNDLGVVNFWMWLYDNLNVLVYDAYVLKMDEDQWMYDFAISQEVHMDYDYDNEEECGVNEPHVDCSNAFNTSQVFAT

SEQ ID NO: 93436 - protein, 16 aa, Glycine max
  Coding DNA Sequence Number=SeqID_1751
MAVHLLPAAGHPQATM

SEQ ID NO: 93437 - protein, 145 aa, Glycine max
  Coding DNA Sequence Number=SeqID_1752
EMAPRKLASKRSRKDKAAEGTSSAPEYDSHRFRSAGHQQRFEAIKGWSFLRERRVQLRDDEYTDFQEEIIHRRWASLVTPMAKFDPDIVLEFYANAWPTEEVLEEGQECEYGQRRNRADGFDEDAIAQLLCIPGQDFARTAVGRR

SEQ ID NO: 93438 - protein, 144 aa, Glycine max
  Coding DNA Sequence Number=SeqID_1753
MALRKLASKRSRKDKAAEGTSSTPEYDSHRFRSAEHHQRFEAIKGWSFLRERRGQLRDDEYTDIQEEIVRRRWASLVTPMAKFDPDIVLEFYANAWPTEEGVRDMRSWVRGQWIPFDADAIGQLLGYPLVLEEGQECEYGQRRN

SEQ ID NO: 93439 - protein, 80 aa, Glycine max
  Coding DNA Sequence Number=SeqID_1754
YHYWKTHMQIFIEAIDLNIWEAIEISPYIPKNDKKKKGIALKASSSIQEESDKEDFNEIEEDDDFSFFINVEASLMMNQD

SEQ ID NO: 93440 - protein, 51 aa, Glycine max
  Coding DNA Sequence Number=SeqID_1755
RKVSVFPESQNVVDSDSKNPFASLMVKKWVRYGRRENWGRGFLKKREDADF

SEQ ID NO: 93441 - protein, 176 aa, Glycine max
  Coding DNA Sequence Number=SeqID_1756
  Homolog annotation: Hit_ID=Q6WAY3; Match level="QueryCoverage=88%, HitCoverage=5%, E-value=7e-08, Identity=28%"; Hit description =Gag/pol polyprotein
  Pfam annotation: Domain name=G-patch; Domain location=1-37; Score =21.7; E_value=0.00045; Accession=PF01585.14; Description=G-patch domain
  Subcellular localization annotation: CTP_CleavageSite=77; ConfidenceScore=5.09e-01
MLGYGYEPGMGLGKNNGGRTSLVSTKGNRGKFGLGYKPTQANIRKSISKRKNKGQSPRLGQQAGGAPPCHINRSFISAGLRHEGQVATICEDDSPRRSDLVRPCPPGFRLGNWRVEENPDVYTTSIISDDESLEGTNTRDPAVNFELEAGRMESEEDEDVGLPPELERIIAQRTER

SEQ ID NO: 93442 - protein, 90 aa, Glycine max
  Coding DNA Sequence Number=SeqID_1757
DRARKTPSGPGEVQQGLRVSSSDYGPLSVLESAHRPQQGHQAPINRAFIKKYYAPRQAQGETPQQPRDGQQRAISAPPPPLEFTSAHPQK

SEQ ID NO: 93443 - protein, 107 aa, Glycine max
  Coding DNA Sequence Number=SeqID_1758
MVVILPKEYLVVWFCSLHNRPDNYLKGIINSALKGLDDAPQPKSKAPARWIVVKCNRQKGSTECDYYVMHWMSTIILGTFRNNWEATIGARELKGVADRVGTVLSPS

SEQ ID NO: 93444 - protein, 429 aa, Glycine max
  Coding DNA Sequence Number=SeqID_1759
  Gene Ontology: Mol. function=isomerase activity; Cellular component =fatty acid beta-oxidation multienzyme complex; Biological process =metabolic process
  Homolog annotation: Hit_ID=A8GL46; Match level="QueryCoverage=44%, HitCoverage=65%, E-value=5e-99, Identity=95%"; Hit description=Enoyl- CoA hydratase/isomerase
  Pfam annotation: Domain name=ECH; Domain location=6-122; Score=-17.7; E_value=9.7e-06; Accession=PF00378.11; Description=Enoyl-CoA hydrataseisomerase family
FFADAIKNRKRVWIMAYARACIDCVHAAARGFDTGAVSIAMVEGSALGGGFEAALAHHFVLAQNNARMGFPEIACNLFPGMGGYSLVARKAGMRLAEELIWGGESHTAEWFESRGLVDQLFQPGDAYMATRTFIDTIRPKLNGMRAMLRARQRVLQLTRSELMDITEDWVHSAFTIEEKDRAYIERLPMLQLFREHWPRKQKALFFVHADLVEEVVFALGLHPFGDYPEGQRLRRRDDRAHQRLRYRVEIHPAHEAFIQLDGVQRNARQLRQRRIAGAEVVEMHLRAQFAQPGDQRARAVLVFNQATFGQLEVQQTGGHAVIAQHPEQVVDDAVIGQLTGREVDRHPQIQALFLPLRRLPGGGLQHPLAERADQAGLLGVGNELQRRDQAALRRIPAHQRFHAVHFTAARVDFRLVIQHQLILLQPFAQ

SEQ ID NO: 93445 - protein, 313 aa, Glycine max
  Coding DNA Sequence Number=SeqID_1760
  Gene Ontology: Mol. function=protein kinase activity; Cellular component=chromatin; Biological process=protein amino acid phosphorylation
  Homolog annotation: Hit_ID=Q2A9E0; Match level="QueryCoverage=64%, HitCoverage=13%, E-value=8e-57, Identity=55%"; Hit description =Putative uncharacterized protein
  Pfam annotation: Domain name=DUF889; Domain location=256-313; Score= -141.6; E_value=0.072; Accession=PF05970.5; Description=Eukaryotic protein of unknown function (DUF889)
MMAHQLHIGDSNLMNLVLLEVEQLLQANQRSLKDYPSMPYLENANLLTHADNGLILSELNFNNEELRSEFLNLFFSQMTSLFIVLTCLAYFPPLCFALEFQVVIKTRTIFMPTDQQTQIYNQIIQVVNKNEGGMFFLYGYGGTGKTFFWKTLVASLRADNKIVIMVASSNIASLLLSRGRTTHSKLKIPIPIFEDSTCNIHQGTQLAKLLNEASLIIWDEAPMAHKFYFEALDQSQRDVIKAKSSSDKIFDGKVMVFGGDFRQILSIIPRGSRSDIVNATINSSYLWNYCHVLTLSKNMRLEVNIDATDKEEL

SEQ ID NO: 93446 - protein, 46 aa, Glycine max
  Coding DNA Sequence Number=SeqID_1761
VWNVQDGRPRRRKHNQKECLAHHHVPVKGAIWRIKERGRGSASDAR

SEQ ID NO: 93447 - protein, 179 aa, Glycine max
  Coding DNA Sequence Number=SeqID_1762
MERCKKIEGRGTLRYSGHRGSKNLGELASGDYSAFGALIWHEELTGLTLLLLIGSETIHFGFGSSRIDIRCTWHRECCFPRKTICHGYNNSRVQDKNQEEFKTQEESLESRIKIQGSRSQESRSRFKTQDSRIKRRLNQDKYEKFFSKIEWHMIFLKTCLPKSFYSLVIDYQIVVIDYQ

SEQ ID NO: 93448 - protein, 100 aa, Glycine max
  Coding DNA Sequence Number=SeqID_1763
  Homolog annotation: Hit_ID=A2Q6E1; Match level="QueryCoverage=97%, HitCoverage=61%, E-value=1e-08, Identity=36%"; Hit description =Putative uncharacterized protein
MCPPPSKVNTKGAPKKLMKRSQRSTKRDPSYWEYADAYHSVQNSNTSIRHTATSSEPLKPARMIPMLDQFAPFIQGFIEDVVEVKADGNCGYRSVAVLLG

SEQ ID NO: 93449 - protein, 142 aa, Glycine max
  Coding DNA Sequence Number=SeqID_1764
MDVNTMLMCNDRFSCVGPIELCTAGRTPDGILNLLERTMTPTHDAVLYYNGRWSMPRQNNFVGYAFTGKNPQKFDIPKRCTIDELKDLIKQVTPKGNPPHGIHESQLVLVESNYWKQFVPIEILALFSKSVMENEDEVVTSL

SEQ ID NO: 93450 - protein, 172 aa, Glycine max
  Coding DNA Sequence Number=SeqID_1765
MNGISKYLSYGVIREQTSNDFQDYFDDVKESRVKQVPKNPASRIKSQRIKIQEQLSFKIQDSRFKNNQDQDSRLKIQDSRKVDFKIQEKKSRSNNQDFTSEVITLPMVFLIRHEESIKRGYISYGSVQVEGTSTWLFKENKGGYIPCGSLACKGFYKVERNLKNCWLLGDWM

SEQ ID NO: 93451 - protein, 115 aa, Glycine max
  Coding DNA Sequence Number=SeqID_1766
MARIDDKIKTIDGSKENLKLAIRITELWFVGMSGRSEQAEMVIIDSDPLVRYFYDSQGDQIHVVCKQEQLKTWKMDLKECCTYVMHNFRVSQNDGQYKVCDHPYKLTFIGVTVVR

SEQ ID NO: 93452 - protein, 83 aa, Glycine max
  Coding DNA Sequence Number=SeqID_1767
MEVDEPWLGLWLPLNYQVDMGARMAFVDNWAVGKEKVGYWLSNDIVGLVGNLAVLEWQSQHGLLLHPHPLHLPQFSHSSKQDD

SEQ ID NO: 93453 - protein, 87 aa, Glycine max
  Coding DNA Sequence Number=SeqID_1768
MNVLSGAILFCKITRAPNIFMICVHRDLLGSDQGVPMNPKRIKVIPEWPTPPSVEEKSPEFQQPRDLKSNPFQGRGIDAISPRKDIG

SEQ ID NO: 93454 - protein, 275 aa, Glycine max
  Coding DNA Sequence Number=SeqID_1769
  Gene Ontology: Mol. function=acetyl-CoA carboxylase activity; Cellular component=acetyl-CoA carboxylase complex; Biological process=fatty acid biosynthetic process
  Homolog annotation: Hit_ID=Q8D0U1; Match level="QueryCoverage=100%, HitCoverage=77%, E-value=1e-144, Identity=94%"; Hit description =Acetyl CoA carboxylase, carboxytransferase component, beta subunit
MSWIERILNKSNITQTRKASIPEGVWTKCDSCGQVLYRAELERNLEVCPKCDHHMRMGARARLHTLLDEGSEVELGSDLEPKDVLKFKDSKRYKDRLVAAQKATGEKDALVVMKGTLYGMPIVAASFEFAFIGGSMSSVVGARFVRAVEQALEDNCPLVCFSASGGARMQEALMSLMQMAKTSAALAKMQERGLPYISVLTDPTMGGVSASLAMLGDINIAEPKALIGFAGPRVIEQTVREKLPPGFQRSEFLIEKGAIDMIVRRPEMRQTLASI

SEQ ID NO: 93455 - protein, 305 aa, Glycine max
  Coding DNA Sequence Number=SeqID_1770
  Gene Ontology: Mol. function=motor activity; Cellular component=cell projection
  Homolog annotation: Hit_ID=UPI00016621D1; Match level="QueryCoverage =99%, HitCoverage=42%, E-value=8e-20, Identity=32%"; Hit description =UPI00016621D1 related cluster
GLHVLTFRGLHALAIRGLHVLPFVGLHDLTFRGLHDLTFRGLHVLAIRGLHVLPFVGLHALTFRGLHVLALRGLPVLAFRGLHILPFRGLHAFAFRGLYILAIRGPYVLTFRGLHVLAFRGLLVFTIIGLHTLAFRGLHVLTFRGLHALVIRGLHVLPFVGLHAFTFRGLHVLALRGLPVLAFRGLPVLAFRGLHILALRGLHALAFRGLHALAVKGLYVLTFRGLFVLTFRGLYILTFRGLRILTFKALYVLTFSGLHVLAIRGLHVLAFRGIHVLPFRKLHTFTFVRLHILTVRELHSLAFKR

SEQ ID NO: 93456 - protein, 144 aa, Glycine max
  Coding DNA Sequence Number=SeqID_1771
  Homolog annotation: Hit_ID=A5BEV8; Match level="QueryCoverage=95%, HitCoverage=23%, E-value=6e-19, Identity=35%"; Hit description =Putative uncharacterized protein
MVKPRNILLTLKEHNANDYTTIRQIYNARHAYCSSIRESNTEMQKLMMLLDRDKYIHWHRRKDYNVVRDLFWSHLDAFWGLFMRVDALPRVIVTDKDLSLMNVVKTVFLDATNLLCQFHIDKNVKAKCKNLIAQKNAWDYVMEG

SEQ ID NO: 93457 - protein, 230 aa, Glycine max
  Coding DNA Sequence Number=SeqID_1772
  Gene Ontology: Mol. function=motor activity; Cellular component=cell projection
  Homolog annotation: Hit_ID=UPI00016621D1; Match level="QueryCoverage =91%, HitCoverage=42%, E-value=2e-23, Identity=36%"; Hit description =UPI00016621D1 related cluster
GLHVLAFKGLHILTFRGLYILAFKGLHILAFRGLHALTFRGLHVLTFRGLHAFTFLGLHVLTFRGLHVLAFRGLHVLAFRGLHALTFRGLQVLTFRGLHAFTFLGLHVLTFRGLHVLAFRGLHVLAFRGLHALAFRGLHIRTFRGLHVLTVRELHVLTVKGLHVLTFRGLHVLTFRGLHALTFKGLHALALPSEDYTSSPSEGYTPSEDCTSSPLEGYASSLSVGSISTP

SEQ ID NO: 93458 - protein, 276 aa, Glycine max
  Coding DNA Sequence Number=SeqID_1773
DDEYTDFQEEIAHRHWTSLVTPMAKFDPDIVLELYANAWPTGEGVRDMRSWEGKECEFSQRRNRADGFDEDAIAQLLCTLGQDFARTAARRRVRIMRTSMTTLTQMWMTLLLSNVLPSDHNSNLPLPKCQLVYAILTQMSIHVAQLIVDAIYLFAGMPLTRHPLDPDKSNRALGFPTLIMGLFQSFGVPVTPSKGDAPQAADAPPPPHQDDPAGSLGMECYRQPLGSPAGAQPPGADWPEAQAREAPAGSPDDAEEARMDEEMTNLLGFLGGSGAT

SEQ ID NO: 93459 - protein, 52 aa, Glycine max
  Coding DNA Sequence Number=SeqID_1774
MDSIKHRMMHAPDLNSQMQCEFVETTQSCTVTSPLGDQSGATRSSLPGDAPP

SEQ ID NO: 93460 - protein, 68 aa, Glycine max
  Coding DNA Sequence Number=SeqID_1775
MAPRKLASKRSRKDKATKGTSSAPEYDSHRFRSVEHQQRFEAIKGWSFLQERRVQLMDDEYTYFQEEI

SEQ ID NO: 93461 - protein, 71 aa, Glycine max
  Coding DNA Sequence Number=SeqID_1776
MGEVEEAQEQMKADMDAMKEKMATMMEAMMIAATRAVAKVNPMPPSDINQMNHPTSDMVGKDLGSTDDPMM

SEQ ID NO: 93462 - protein, 168 aa, Glycine max
  Coding DNA Sequence Number=SeqID_1777
METCLEVEELLQRMIDQGRLEVGIEGKEEQHICMQSTEGSGVAKPKPLVIYFTKSAASQKPGHPLMAKPVPFPYQNSHAVPWRYTPPGKKEEEVTDVSFLSAKVTDITGLSGVTRSGRVFAPPDLPVQPADVKGKGKVVEEQDGEAPHASNKDIPAKGPPEKKDGRKE

SEQ ID NO: 93463 - protein, 93 aa, Glycine max
  Coding DNA Sequence Number=SeqID_1778
MGSSQAPSLKKRFYRVKVKNLGITNQKELGQLMGRGEWAPFIDILALLIFKGVLFPNVDGLVDLVAIDTFLAYHDRKESSVIAILADLYDTFD

SEQ ID NO: 93464 - protein, 140 aa, Glycine max
  Coding DNA Sequence Number=SeqID_1779
  Pfam annotation: Domain name=G-patch; Domain location=46-90; Score =16.5; E_value=0.0019; Accession=PF01585.14; Description=G-patch domain
ATCLTPSSTPYVEAAEESLETSFQALEIVNNAYVEAPPVQSCLSNASLMVSCVMLRDGYEPEMGLGWSSNGTTSLVRFVENRGRFGLGYEPTHADKRRVTLEWKERSLAHLQGWGPQMERVLVCHISKSFVSVGWMHENQ

SEQ ID NO: 93465 - protein, 66 aa, Glycine max
  Coding DNA Sequence Number=SeqID_1780
MAIIPAKIPQSPFFRGYNLNATCAYHGGVLGHSIEHSTCTPEFDFLVCSIRNCSFYTFGEGAVNNE

SEQ ID NO: 93466 - protein, 187 aa, Glycine max
  Coding DNA Sequence Number=SeqID_1781
  Pfam annotation: Domain name=Transposase_23; Domain location=103-173; Score=-9.7; E_value=0.014; Accession=PF03017.5; Description=TNP1ENSPM transposase
MAHHAHGHQDVLTTAIGPPEHLGRVHAAGAAITIKQYFGSAPTTSRTSSSMGLEDLDQMQSQFQSHMQSHGLALPPEPEVGPSGARVSTKESCFYLSGNDPDTGDSDKCGLYIEENPPRLVALGRLYEGSTTVHNIPLLHDQIKVGAEEVRYADAPIPIPTEEVKLVWQALNTFLAWMTHLVKRLSE

SEQ ID NO: 93467 - protein, 51 aa, Glycine max
  Coding DNA Sequence Number=SeqID_1782
MSRNFMDRATMPSLTSGMSRNFTNCLTMGAKYFEVVNEGRIPTTDGPLDEI

SEQ ID NO: 93468 - protein, 519 aa, Glycine max
  Coding DNA Sequence Number=SeqID_1783
  Homolog annotation: Hit_ID=A4WEW2; Match level="QueryCoverage=100%, HitCoverage=74%, E-value=0.0, Identity=73%"; Hit description=LppC family lipoprotein
  Pfam annotation: Domain name=LppC; Domain location=1-519; Score=11.3; E_value=2.7e-12; Accession=PF04348.4; Description=LppC putative lipoprotein
MSQSSNDTKTNWQLLAIRALLKEGKTQRAAELFNQLPKDLNDAQRREQSLLSAELKVALKDYAAAKKILGDIDVSALDKNQQARFWQAGITAEQGRPSLTLLRALVAQEPLLGGADKQKNIDATWQALASMTQEQAQALVINADENVLQGWLDLQQMWFNNRSDPKMLKAGITDWQTRYPQNPGAKMLPTQLVNVQNFKPASTSKIALLLPLNGQAAVFGRTIQQGFEAAKNGTTSVAGSAVPAQAAQAANVNNDVVSPSAAETSDLTTAQAPAQGTMQNPVTAPTTPAPVPATPAPAETQAPPASVPAPATTAEQPQPQPAQPTAQPAAQPQSVATTSASPSAELKIYDTSSQPLDQVLAQVQQDGASIVVGPLLKNNVEELMKSNTTLNVLALNQPEQVQNRANICYFALSPEDEARDAARHIHEQGKQAPLLLIPRSALGDRVANAFADEWQKLGGGVVLQQKFGSVSELRAGVNGGAGIALNGSPVTASLPQQQGVTIGGLTIPAPPTDAQISGG

SEQ ID NO: 93469 - protein, 52 aa, Glycine max
  Coding DNA Sequence Number=SeqID_1784
MSFSRDFLSANRLPNALSPCVIDYTQLVIDYQCPITLCNRLHTLGNRLPEAI

SEQ ID NO: 93470 - protein, 27 aa, Glycine max
  Coding DNA Sequence Number=SeqID_1785
MEEYRELLRQLEPTSEEESDDSSEDTS

SEQ ID NO: 93471 - protein, 79 aa, Glycine max
  Coding DNA Sequence Number=SeqID_1786
PFVVKRAFSGGDLVLTNMDGEELPSPGQDHLELPSGVGTKHEQQKPIKGRMRVGVGSRPTDRCPFSALNKQRTSLQGSP

SEQ ID NO: 93472 - protein, 71 aa, Glycine max
  Coding DNA Sequence Number=SeqID_1787
MLGFTSNSPQISASPHQLDLAPYALGLYNAPGLLYDKHTLCSSRILEKWRLRKPSKGMATIAVSVDMEQLA

SEQ ID NO: 93473 - protein, 116 aa, Glycine max
  Coding DNA Sequence Number=SeqID_1788
VPLPLPLPLPWWFAFFWVVQSSIALFKFEASQGSFVSHRRQDVLIAAIGQPEHPSRVRAAKADATIKQYFGSAPRTSHSSSFMPPEDLQHLTQQIKDQLEESIMEKVTPQLMASFS

SEQ ID NO: 93474 - protein, 254 aa, Glycine max
  Coding DNA Sequence Number=SeqID_1789
  Gene Ontology: Mol. function=nucleoside-triphosphatase activity; Cellular component=chloroplast
  Homolog annotation: Hit_ID=Q2PMM5; Match level="QueryCoverage=100%, HitCoverage=15%, E-value=4e-59, Identity=83%"; Hit description =Protein ycf2
MIELRKLLDRYPTSELNSFWLKNLFLVALEQLGDSLEEIRSFAFGGNMLWGGGPTYGVKSIRSKKKYLNLIDLISIIPNPINRIAFSRNTRHLSHPKRRIFLANYQTITYSQTLRGANSFHFPSHGKPFSLRLALPPPSRGILVIGSIGTGRSYLVKYLATNSYVPFITVFLNKFLDNKPKGFLIDDSDDIDDSYDSDDIDRYLDMEPELLTMMNTLTMDMMPEIARFYITFQFELAKAMSPCIIWIPNIHDLD

SEQ ID NO: 93475 - protein, 149 aa, Glycine max
  Coding DNA Sequence Number=SeqID_1790
MTTLTQIWMTLLLSNILPTDHNSDLPLPKCQLVYAILTRMSIHVAQLIADAIYIFAGMAPTRHPLDPDKFNRALGFPALITGLCQSFGVPVTPSKAIRPPITRAFIEKYCTQRLVRPDHLTRSSICGIWFTSRRPTTGHMYRLMIVFIR

SEQ ID NO: 93476 - protein, 170 aa, Glycine max
  Coding DNA Sequence Number=SeqID_1791
  Gene Ontology: Mol. function=protein binding
  Homolog annotation: Hit_ID=A8G8X8; Match level="QueryCoverage=100%, HitCoverage=13%, E-value=6e-79, Identity=90%"; Hit description =Putative uncharacterized protein
  Pfam annotation: Domain name=DUF490; Domain location=1-170; Score =20.1; E_value=2.9e-09; Accession=PF04357.4; Description=Family of unknown function (DUF490)
MFSGPPDQPLLNIEAIRNPESTEDDVTAGVRVTGLADAPKLEVFSDPAKSQQEALSYLLRGQGLSSSGADGNAMTSMLIGMGVAQSGQLVGKIGEAFGVSNLALDTQGVGDSSQVVVSGYVLPGLQVKYGVGIFDSLATLTLRYRLMPKLYLEAVSGLDQALDLLYQFEF

SEQ ID NO: 93477 - protein, 128 aa, Glycine max
  Coding DNA Sequence Number=SeqID_1792
MGEVEEVQEQIKANVEVMKEKMATMMEAMMSIKKIIEVNAAAVAATNVVAEVDLIPPFVLNQINPPTSDMVRQGGKELGGTGSPRFVQVQNIHHPTWRTLPMRMSITPLPYSLKANNLNLIMHMSLNP

SEQ ID NO: 93478 - protein, 98 aa, Glycine max
  Coding DNA Sequence Number=SeqID_1793
  Subcellular localization annotation: CTP_CleavageSite=58; ConfidenceScore=5.28e-01
MGMSPPPLETSQSLKISSNALQHSFLFKLAPVMFTQLGGSSGALSELILAERIIDNSSASRIFYALSHELLRSANGSLSQRIGLSRGSKSALPPNLPN

SEQ ID NO: 93479 - protein, 29 aa, Glycine max
  Coding DNA Sequence Number=SeqID_1794
MEQHHEDELRNLKANHDQLEARVTCPKAT

SEQ ID NO: 93480 - protein, 73 aa, Glycine max
  Coding DNA Sequence Number=SeqID_1795
MFLIFNTSALKGLDDTPQPKSKAAARQKGIPECGYYVMHWMSTIILGSFRNNCETYFNEVRPLEAERFKAYRI

SEQ ID NO: 93481 - protein, 133 aa, Glycine max
  Coding DNA Sequence Number=SeqID_1796
  Gene Ontology: Mol. function=receptor activity
  Homolog annotation: Hit_ID=Q5WAN8; Match level="QueryCoverage=93%, HitCoverage=37%, E-value=2e-32, Identity=57%"; Hit description=TRAP -type transport system substrate-binding protein
MYASGVPARILEVTDVQLASINAIANSWFRFDIKAETYPRQPKAVATIAQPNILVALSRLDEKLVYDLTKTMFVNLPEVHQVHSSAKYISLENALKGVSVPLHLGAYRYYREAGVEIPDYLIPPEAAALAANP

SEQ ID NO: 93482 - protein, 357 aa, Glycine max
  Coding DNA Sequence Number=SeqID_1797
  Gene Ontology: Mol. function=phosphoglycolate phosphatase activity; Biological process=metabolic process
  Homolog annotation: Hit_ID=A7H5I1; Match level="QueryCoverage=46%, HitCoverage=77%, E-value=4e-53, Identity=62%"; Hit description =Hydrolase, HAD-superfamily, subfamily IA, variant 3
  Pfam annotation: Domain name=Hydrolase; Domain location=1-182; Score =40.9; E_value=4.4e-09; Accession=PF00702.17; Description=haloacid dehalogenase-like hydrolase
MDGVLIDAREWHYRALNQALACFGRASTREEHEGGFDGLPTRDKLHRLSERYGLPVSLHSFINELKQQYTLREIWQHCWPVFAHQYALARLKREGYRTAVASNSIRQSIETMLGQAKLLELIEFYLSNEDVSRGKPDPEIYQKAIQRLALQPKECVIVEDNPHAIVRRSPPPGAVIPAGAGQRHTLFSGYPDIPAVRKTGYPGSQSGKRRAGTRGSLASVSVTGRRTALTPAAIISILDENHYFATGLQHILLAWFQRNGRTVQFLAPGDNTESAHLVFFTLQSLSRHPSLLLRPPSREQQRICTISRRDFCGHTCPGLPEITVLHRESSRNGVITSLLSLNAAGKTQLPVPVNGRY

SEQ ID NO: 93483 - protein, 215 aa, Glycine max
  Coding DNA Sequence Number=SeqID_1798
  Pfam annotation: Domain name=Transposase_23; Domain location=96-163; Score=-15.2; E_value=0.055; Accession=PF03017.5; Description =TNP1ENSPM transposase
PHGREDVLTAAIGRPEHPGHVRVAGVGVTIKQYFGSATWTSHTSSSMTPEELKQLTQQIRDQLEESITKKPKVGPSAARVSTKGSCVDPSPTDHDTGDSDKCGLYIEENPSRLVALGRIYEGSIAVHNIPLLHGQVKVGVEEVKDAEALVPVPTDEIVVSLAKPIDGPNPQVMWDATVFEVFNEHFPLYIRHKDLSEIAHGSQCLSIFVKQLWIL

SEQ ID NO: 93484 - protein, 52 aa, Glycine max
  Coding DNA Sequence Number=SeqID_1799
MASYGVASPFIFLLLHSVAIRPQEAKESIDEEDPRPTSSNGATSCGVKSLFI

SEQ ID NO: 93485 - protein, 77 aa, Glycine max
  Coding DNA Sequence Number=SeqID_1800
  Gene Ontology: Mol. function=aspartic-type endopeptidase activity; Biological process=DNA integration
  Homolog annotation: Hit_ID=A5B7I7; Match level="QueryCoverage=81%, HitCoverage=7%, E-value=4e-20, Identity=77%"; Hit description =Putative uncharacterized protein
MDHWKATKRVMRSSTKSKNIDIKFLVVKERVRSGQISIEHLGKNFMIAYTLTKELPPKVFHEHVDHMGVLQFEESLV

SEQ ID NO: 93486 - protein, 15 aa, Glycine max
  Coding DNA Sequence Number=SeqID_1801
VNAVKIFPDAQNGLG

SEQ ID NO: 93487 - protein, 118 aa, Glycine max
  Coding DNA Sequence Number=SeqID_1802
  Subcellular localization annotation: CTP_CleavageSite=64; ConfidenceScore=5.10e-01
MVKVGTSYVPINVSFSPKVGPGLPAVPHVQLLKGRCVTAKAPPDISAGKCSGHPARNHHARRAYCAATGRVPFAIQAAQLLGRAIGAGLFANTPAGERGMCCKAIKLGNARVFPVTTL

SEQ ID NO: 93488 - protein, 73 aa, Glycine max
  Coding DNA Sequence Number=SeqID_1803
  Homolog annotation: Hit_ID=Q949K7; Match level="QueryCoverage=49%, HitCoverage=40%, E-value=1e-08, Identity=72%"; Hit description =Putative gag polyprotein
MVINPGLKGVPNRVTCPQVQIFLLIRNYKDIQQGHCLVPNVVIPTKFKVSDFDKYKGTTCPTNHLKMYRRKNS

SEQ ID NO: 93489 - protein, 71 aa, Glycine max
  Coding DNA Sequence Number=SeqID_1804
MLSSVGAPPHGDSFFSFLPSGEPTDHSTSYPGQELVPIYSPLFSTRAMAQERTWMSCVLLEQVRNQPNTEG

SEQ ID NO: 93490 - protein, 78 aa, Glycine max
  Coding DNA Sequence Number=SeqID_1805
  Subcellular localization annotation: CTP_CleavageSite=47; ConfidenceScore=5.11e-01
MRVHCNQASRRPSMIIDSPPLLMFPRTRSHQLSQPTLRREGDARLTGASSKEGKRAESPPTLFEENVGKTGKGVVYEL

SEQ ID NO: 93491 - protein, 283 aa, Glycine max
  Coding DNA Sequence Number=SeqID_1806
  Homolog annotation: Hit_ID=Q6WAY6; Match level="QueryCoverage=81%, HitCoverage=38%, E-value=7e-12, Identity=25%"; Hit description =Putative uncharacterized protein
QRPWKIKANWDQLLASKEGASVNWFPRWKEGRTRVLISCGGFPNVPLMVTRGCISYNTILAIRQLGYPMRGAPLEDGLAPVRKAWGVVQKKDKELVGKLRTAKREEVEAPEEDEEVQALRTKLEQAQTVKERFKSVALRIQKENAELRDVNVATTKALEQKTKRAPIVSSSSEEVKGIITGQRHDLEGRAKGNMWAIIDKCKEKLNLAATHEQRLEDEYAKISAEREARERVIDSLHQEATMWTDRFALTLNRSQELPPLLAKAKAVADTYSAPEEIHGLLSY

SEQ ID NO: 93492 - protein, 80 aa, Glycine max
  Coding DNA Sequence Number=SeqID_1807
MEISNMWTNPFDVSLKHGAAATTGRIRKMTHVKEKPSGKYVCGGHHHNMEFVMAPASCGFTHLYILKDTNGTTTSLPNAL

SEQ ID NO: 93493 - protein, 158 aa, Glycine max
  Coding DNA Sequence Number=SeqID_1808
MAESSKKRKGSSFITTAKELLETHPHQVILDPKYLDIEFFYGETFDCYQIDWAHLVRHRMHKALRANAPLPYPHLVTLFLHHFNIPLDDEPYVKVKWSFSIGAGAVTSFHYRKDVDGQWVRKQDLPPPIPDERTPSPPPQRNDSTSLLTEVLTELCIL

SEQ ID NO: 93494 - protein, 161 aa, Glycine max
  Coding DNA Sequence Number=SeqID_1809
  Gene Ontology: Mol. function=RNA-directed DNA polymerase activity; Biological process=regulation of transcription, DNA-dependent
  Homolog annotation: Hit_ID=A5B388; Match level="QueryCoverage=96%, HitCoverage=8%, E-value=3e-36, Identity=51%"; Hit description =Putative uncharacterized protein
MCFDLPHAFWNRKKHIVDLPYEKDFREKQIPTKAKPIQMNEELLQYCQKEIKDLLDKDLIRKSKSPWYCATFYVNKQAELERGEVVPYLNKIVKPLHDRLKKNPPSWSDFHTQPVKDIKLKVQSIKCLYLPIPQAFKIVETDAFDIGFGGILKKTWADIAS

SEQ ID NO: 93495 - protein, 48 aa, Glycine max
  Coding DNA Sequence Number=SeqID_1810
MVWGLLSTLLLHSTAIKIQEAKDSIDKEDPRPTSSNEATSCGIKSIFI

SEQ ID NO: 93496 - protein, 123 aa, Glycine max
  Coding DNA Sequence Number=SeqID_1811
MSSLPLPYLPESFKLHLVFSGATIMIGLSFRSVHPETLITNNYVMHIGAATPRKSSSHQQGDYIWNGQRVMLTADPGVRLEDIKHCFGGTIIVVLESENKTYTRNPSWTYKVRPRDLGKMFSI

SEQ ID NO: 93497 - protein, 225 aa, Glycine max
  Coding DNA Sequence Number=SeqID_1812
MESLGLALPPEPEVGPSAACVSTKESYVDPSGNDPGRHEKSSCLVAIERLYEGSKPVHNIPLHHDQVKVGVEKLTDADAHILVPTEKGVMGPVKPTDRLDHDVDDPLYLMTLIIPQLFLKPLQVMWDATVFGVFNDNFPLYIKHEDLFEIAHGGQCLSISVIQLWILPNNYLKGIINSTLKRLDDTPQSKSKAATRWIIVKYFNDCRSLEPERLKALRIQLKWVY

SEQ ID NO: 93498 - protein, 73 aa, Glycine max
  Coding DNA Sequence Number=SeqID_1813
MFCENAPTIWDQHKLKGALKPGDPQGLHSEESLKRDIEIPNGENARNWVANVVLKFHDDPTVNESKIVVFLRQ

SEQ ID NO: 93499 - protein, 105 aa, Glycine max
  Coding DNA Sequence Number=SeqID_1814
MKLAKYRLKAQVEKNEGPSGEGQSPRVEKDEGPNLSSFTGSGVYPDLSSFTGSGVYPDLSSLTGSGVYPDLSSFTGSGVIQIFVACIKRSAPTQVHIIWYQSFGS

SEQ ID NO: 93500 - protein, 78 aa, Glycine max
  Coding DNA Sequence Number=SeqID_1815
MNVEEQLKSSRNYPRKRYGSASAWIFFTGNNFPQQFQENTNKIGEELATQLAQAKPGLVPSRSNRLLEEESGKAQGGP

SEQ ID NO: 93501 - protein, 90 aa, Glycine max
  Coding DNA Sequence Number=SeqID_1816
MASSTCFPQIPSQIIIINEKPSKTTHHISQNPIPTKIKGERNTHFTTPKMPSFRDLEQKWAPKVEALFGASMENEGEKKSNVREREKRAV

SEQ ID NO: 93502 - protein, 89 aa, Glycine max
  Coding DNA Sequence Number=SeqID_1817
MHTGSGFCPDRCREAGMPPTRHPLDPDKSNRALGFPALITGLCQSSGVPVTPSKVIRPPITRAFIEKYCTPRQAQGDAPQAADAPPPPH

SEQ ID NO: 93503 - protein, 77 aa, Glycine max
  Coding DNA Sequence Number=SeqID_1818
MNETSMRAGNADVYGFLKPQSIQRSRQSALKELDDTPQPKSKAGARWIVVKVAMLLLIFYCNRQKGSTECGYSGCQL

SEQ ID NO: 93504 - protein, 151 aa, Glycine max
  Coding DNA Sequence Number=SeqID_1819
  Homolog annotation: Hit_ID=A2Q533; Match level="QueryCoverage=88%, HitCoverage=46%, E-value=8e-10, Identity=34%"; Hit description =Putative uncharacterized protein
GLEHGPRKQYFSTWWADLRAIFQHQNVINADNQIRWKLGRGDKFLFWEDPWGDEGVPLKDQFPELFSISSQRDLTVAEVGSWTENGAESTGVLTSKSGYQVIKADRDDEGQYLGFKTLWEIKLPPKALSFGWRLLWDRLPTKDNLIKRQIQ

SEQ ID NO: 93505 - protein, 90 aa, Glycine max
  Coding DNA Sequence Number=SeqID_1820
MRGYRMVIRTVATCPSAGGRRVTRGMRVPRKEYARSRHQRLFEENVGKTGKDVIYELLSERFGSCIYARGRVFPFAPTYSPICDEEIRPT

SEQ ID NO: 93506 - protein, 157 aa, Glycine max
  Coding DNA Sequence Number=SeqID_1821
MAVQLQYPMKRFSTFCRVGLPRSLSRIGHVRSLKEVDAGLASVCPQVLEYSNGSLGNHPPTIGCPRVKRCILLKPEVTQNSYTASRRGYSLTKTGILVEGRAPQLLYPEVGTNMTSTDADSLAASNPTTNIIFGLSHCFRHTTQTQGLAHVRSQPSK

SEQ ID NO: 93507 - protein, 71 aa, Glycine max
  Coding DNA Sequence Number=SeqID_1822
MTPSQQHDAPMATPNAPLGQQWDVPGAIPARPRNKGGDNAQEEIRIVKPEGGIDHVAHLRAIMDTMMTDFD

SEQ ID NO: 93508 - protein, 65 aa, Glycine max
  Coding DNA Sequence Number=SeqID_1823
MTEWYLEICRGGQETLRTSGGVLFPKSKLDQSRPNPGIVRLKNEDSKLRWPLVIDYQGCVIDYKA

SEQ ID NO: 93509 - protein, 64 aa, Glycine max
  Coding DNA Sequence Number=SeqID_1824
  Subcellular localization annotation: CTP_CleavageSite=26; ConfidenceScore=5.02e-01
MTDVNAKFENSYQGHTGFRLTNPRFSQARKSKRRQSRTGSHLYPLDDLKYVYVKGCLTMKMRTP

SEQ ID NO: 93510 - protein, 73 aa, Glycine max
  Coding DNA Sequence Number=SeqID_1825
MTSFSQMQSQLQSQMQSQGLALPPEPEVKVGVEEVKDAEVPVPIPTNEVQLMGQALNTFLAWSTHLVKRVSEQ

SEQ ID NO: 93511 - protein, 82 aa, Glycine max
  Coding DNA Sequence Number=SeqID_1826
VEGHKLYRLKVQSNNHTFSSNWVQRINHSYTSKDEIIIKLFKKYGNKNPDPVNDPMHAHSGPVLVQMMDPKKEAGPTLVQMA

SEQ ID NO: 93512 - protein, 274 aa, Glycine max
  Coding DNA Sequence Number=SeqID_1827
  Gene Ontology: Mol. function=asparagine synthase (glutamine -hydrolyzing) activity; Cellular component=phagocytic vesicle; Biological process=amino acid biosynthetic process
  Homolog annotation: Hit_ID=P22106; Match level="QueryCoverage=100%, HitCoverage=49%, E-value=1e-148, Identity=93%"; Hit description =Asparagine synthetase B [glutamine-hydrolyzing]
  Pfam annotation: Domain name=Asn_synthase; Domain location=64-274; Score=306.6; E_value=4.7e-89; Accession=PF00733.12; Description =Asparagine synthase
MGHDEHGNLYVASEMKALVPVCRTIKEFPAGSYLWSQDGEIREYYRRDWFDYDSVKDNVTDATALRTALEESVKSHLMSDVPYGVLLSGGLDSSVISAITKKYAARRVEDQERSEAWWPQLHSFAVGLEGSPDLRAAQEVANHLGTVHHEIHFTVQEGLDAIRDVIYHIETYDVTTIRASTPMYLMSRKIKAMGIKMVLSGEGADEVFGGYLYFHKAPDAREFHEETVRKLLALHMFDCARANKAMSAWGVEARVPFLDKKFLDVAMRINPKDK

SEQ ID NO: 93513 - protein, 236 aa, Glycine max
  Coding DNA Sequence Number=SeqID_1828
  Pfam annotation: Domain name=G-patch; Domain location=46-90; Score =22.4; E_value=0.00038; Accession=PF01585.14; Description=G-patch domain
MLVSCPSSAPYVESAEESLETTFQSFEVVSCASVEPSPLLPSLSNAAMMVACVMLRNGFEPGMGLGKDGLGNADVVDIKGNPYKYGLGYEPGMPGRRNVPSRLRANREWPGRISECFTSAGTVSEEEVAAVEEEFPQDPPSFVQPCHPDSQVGNWRVISQSEVYTADSIYEGRFFEDPNNEGLTIDFDQDISQTVNEEEEEDVLSPELERDHGGKERSKGRNRYDRAYPPRLDNPS

SEQ ID NO: 93514 - protein, 482 aa, Glycine max
  Coding DNA Sequence Number=SeqID_1829
  Homolog annotation: Hit_ID=UPI00016621D1; Match level="QueryCoverage =26%, HitCoverage=38%, E-value=4e-09, Identity=31%"; Hit description =UPI00016621D1 related cluster
MSSPLEDYISSPLEDYTSSPSECCTPSPLEGCTPSPLRTTRPRHQWTIRPRCQRVARPRLHRATRLYLQRTIRLRLQRATRPHLQRATCLRLQRATRPRFQRTISPHLQRTTCPHLQRTTRPRHQRTTHPRHQRAIRLRVQRTPRPRLQRTACPRLQRATRLRLQRTTRPPLLRTTRPRNQRTTWLHALALKDLHAIAFRGLHAFAFRGLYILAFRGLHVLAFRGLHVHPFRGLHVLAVRGLHALALEDYTSSPSVGYTPSPSEDSTSSPSEDCMSYPSKGYTPSPSEDYTSSSSEGYTPLPSEDYMSSPLQDYPSSPSDDCTGLPVLTFRGLNVLLLGGLHALAFRGLYVLLFRGLHVLPFRGLHILTIKGPHVLAFRGIHVLTFIGLHVLPFRGLHALAFRGLHVLTIRGIHSLTFRRIHILLFRGLHVHAFRGLHALAFIGLHVIAFRGLHALAFVGLHPLAFIGLHICAFRELEVLRP

SEQ ID NO: 93515 - protein, 117 aa, Glycine max
  Coding DNA Sequence Number=SeqID_1830
GRYIHLVVQREQAKIHKGGYISYGSVQVDGTSTWLFKENKGGYIPCGSLLVKVFTRLKEIPRTAGCLGTGCRHGPLDPTQGIHLINLGFDSTFFNRCLNDRGGSHRTLKAIKSLFAP

SEQ ID NO: 93516 - protein, 61 aa, Glycine max
  Coding DNA Sequence Number=SeqID_1831
MELKKSLQEQLWTAAIAYESMMRQESRVKWIREGDTNSAYFHRLINHRRRLRRDEWSDEKS

SEQ ID NO: 93517 - protein, 172 aa, Glycine max
  Coding DNA Sequence Number=SeqID_1832
MEVEEPWLGWCLALVVWKVGFVVDLGMAFVDNWVVGKEKGCYWLSNDVCWVGGKLGRIGMAVTTCVSPSSSPSSLAQGPSKNGLRKVLTLVYQVTVVPVSKGIIFTSFNGPKPFLSMIQLSHFSHSMRVFTRCGMQGVWLWVILRALQSVLQGYITNCLPFSGISEARLEVG

SEQ ID NO: 93518 - protein, 45 aa, Glycine max
  Coding DNA Sequence Number=SeqID_1833
MTTLVSARRWAFLPLVDERLACPWLTKGADDDVSLYTSTGLFAPG

SEQ ID NO: 93519 - protein, 281 aa, Glycine max
  Coding DNA Sequence Number=SeqID_1834
  Homolog annotation: Hit_ID=Q84VH5; Match level="QueryCoverage=85%, HitCoverage=39%, E-value=1e-112, Identity=80%"; Hit description =Envelope-like protein
MDLIKAAGLLKTVTKLGDCYESLVREFIVNIPSDITNRKSDEYQKVFVRGKCVRFSPTVINKYLGRPTEGVVDIAVSEHQIAKEIIAKQVQHWPKKGKLSAGKLSVKYAILHRIGTANWVPTNHTSTVATESFAVKLPIAFPTVLCGIMLSQHPNILNNIDSVKKRESALSLHYKLFEGTHVPDIVSTSGKAAASGAVSKDALIAELKDTCKVLEATIKATTEKKMELERLIKRLSDSGIDDGEAAEEEEEAAEEEEEAAEEEEDAAEDTESDDDDSDATP

SEQ ID NO: 93520 - protein, 89 aa, Glycine max
  Coding DNA Sequence Number=SeqID_1835
  Gene Ontology: Mol. function=protein serine/threonine kinase activity; Cellular component=integral to membrane; Biological process=protein amino acid phosphorylation
  Homolog annotation: Hit_ID=Q0VJB8; Match level="QueryCoverage=62%, HitCoverage=29%, E-value=1e-17, Identity=78%"; Hit description =Putative serine/threonine kinase
MEGSLAQKGILKSPALLKPQINSTCPTNLGRAVLVWCTRDSKLRIIHRDLKESNILLDEVLNPKIPDFGMARIFGGTEDQANTNRVVGT

SEQ ID NO: 93521 - protein, 267 aa, Glycine max
  Coding DNA Sequence Number=SeqID_1836
  Homolog annotation: Hit_ID=Q2HW90; Match level="QueryCoverage=79%, HitCoverage=51%, E-value=2e-11, Identity=28%"; Hit description =Putative uncharacterized protein
MRLNQAPLLKKRFYHIKIKSLEVASMQELGQLMGQLQRQAFCKTYKKIWDLAMIEVSIEAIVALTQYYDQPLRCFKFGDFQLVPTVEEFEEILGCPLGGRKPYLFSRIPRKHLEEKAKALADQGKWALFIDILELLVFQVVLFPNVDGLVDLVAIDAFLAYHHSKESLIIAILADAMTHLTEDAKRAVQESSVAHLLFMDDWSLTSFIMKVDPSVPCKVTTHAPRKGRPIGSNSWLVWWGHPLIGSPDGRKEEPEFRPHARGSQTSP

SEQ ID NO: 93522 - protein, 233 aa, Glycine max
  Coding DNA Sequence Number=SeqID_1837
  Subcellular localization annotation: CTP_CleavageSite=41; ConfidenceScore=5.23e-01
MEGANTFLKRKYNSQIWNIFHDRFPSVFLKISTNKRWWRLRAFSSFGRRTREPRLACPQKGRLRQLVLEEGQQCEFSQGRSQASGFDKEAISQLLCISGQDFARTVVGRRVSVHVALLISNAIYQFVGITPPRHPVDPEKSNRALGFPAMTIGLCQFYGVPVTPNKLIQPPINRAFIEKYCMPRQVQGQVPQQQPAADAPPSPLEEVPSLRSISDHLWRIELQMHRYMQHMTS

SEQ ID NO: 93523 - protein, 73 aa, Glycine max
  Coding DNA Sequence Number=SeqID_1838
MALQIAEALGYGGFVRMLVDALGHVAEGEHVEEMKKMGFGSEARSLATVVLVVATEDPAKRTMISTITCVSWF

SEQ ID NO: 93524 - protein, 28 aa, Glycine max
  Coding DNA Sequence Number=SeqID_1839
MKGRKEQRRSHDSVYHAARAAPGGTELS

SEQ ID NO: 93525 - protein, 90 aa, Glycine max
  Coding DNA Sequence Number=SeqID_1840
  Subcellular localization annotation: CTP_CleavageSite=53; ConfidenceScore=5.06e-01
MYPPLFSLNNLVDAPSTRTDPQEMYPLLFLVTTTPVDVPSTYTTKDVPSNVLRQSSQAGKGRHKRIQAVSPSFFWKREKKDTKRIQAVSP

SEQ ID NO: 93526 - protein, 156 aa, Glycine max
  Coding DNA Sequence Number=SeqID_1841
MQVLCIPGQDFTRAAANGRVWIMRTNMTTLTQIWMTLLLSNIPSSDRNTDLPLQKYQLGSCPQGTQWTRRSPTGSWGFQLWLRASVSPIGCPSPQQGITPVRHPVNPEKSNRVLGFPALITSLYQFYGVPVTPSKVIKPSINQTFIKKCCTPRDGR

SEQ ID NO: 93527 - protein, 34 aa, Glycine max
  Coding DNA Sequence Number=SeqID_1842
MSVRHRPTDTSAGGDRHYGHWAERCKVATSSISM

SEQ ID NO: 93528 - protein, 138 aa, Glycine max
  Coding DNA Sequence Number=SeqID_1843
MTTLTQIWMTLLLSNISSYDHNADLPLRKHQLDRAHKTPSGLGGVQLGPRVSSSGYGPLSFLPGIAPTRHPVDPEESNRALGYPALVMGLCQFYREPVAPNKVIRPLLIGISSRSTAPPGRRRARHHSSGQQHTRHHL

SEQ ID NO: 93529 - protein, 176 aa, Glycine max
  Coding DNA Sequence Number=SeqID_1844
MTVKTSDTCSSRRRSQLSVSGCREQTSPSGRVSGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSRNRVLAFYLLSLEEIPLSFASGERMRILFYRPRFKKV

SEQ ID NO: 93530 - protein, 136 aa, Glycine max
  Coding DNA Sequence Number=SeqID_1845
MTRGNPSDLQPFDPEIDRTFHRLVRHSVHPTFPEHFIPFEHSVTGESVHSIIGDFEHPDFEHYNFEHFENMAQSPSRERTLREMVAPDFTCESLCIQYPNEDVPYVLKTGLIHLLPKFHGLTGEDPHKHLKEFHIV

SEQ ID NO: 93531 - protein, 164 aa, Glycine max
  Coding DNA Sequence Number=SeqID_1846
WLLPVAISRVLPGWTQDDSYRIKAQRATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTQALSIKPTGKTVT

SEQ ID NO: 93532 - protein, 68 aa, Glycine max
  Coding DNA Sequence Number=SeqID_1847
FLRFFRRFPQINVSGDSVRIPFVEHASRESRVARPQKGTLRHPLITKLTSLRNFLEKLELSYTHPSKS

SEQ ID NO: 93533 - protein, 291 aa, Glycine max
  Coding DNA Sequence Number=SeqID_1848
  Homolog annotation: Hit_ID=A7UQU7; Match level="QueryCoverage=39%, HitCoverage=20%, E-value=4e-08, Identity=34%"; Hit description=IMP dehydrogenase/GMP reductase, putative
MVSTRGLGRDLSHVTGRGVGRGDRDDFDDALQHRWPTASTRRQRVPVTTVHNEPVVPVAEADGASIEANVYADEPMAGGDVQDTGADISADTGAQAAEDEPKGFSGGPSDPSVLIGYADHIAGNIWMGEEHPELKLSSHGRKVHSLGRFVPTIEGLVAGTGLSPLIACLIDTDDRGLFSSFVERWHRETCSFHLPVGSRCTGAYVDCYEEYREEHTYTDIQGAPGLTLNSGCLLDPIWGAPTGSGLPYDFMLFWSVALGARCCVLPTREGLAIVWIHPDHFCSACRFMGVV

SEQ ID NO: 93534 - protein, 215 aa, Glycine max
  Coding DNA Sequence Number=SeqID_1849
  Gene Ontology: Biological process=intein-mediated protein splicing
  Homolog annotation: Hit_ID=A8GCR3; Match level="QueryCoverage=100%, HitCoverage=36%, E-value=1e-110, Identity=88%"; Hit description =Putative uncharacterized protein
  Pfam annotation: Domain name=DUF879; Domain location=3-215; Score= -357.4; E_value=0.0019; Accession=PF05947.3; Description=Bacterial protein of unknown function (DUF879)
MDDLTLRYYDAEMRYLLEAGEEFARAHPEQAAMLNLDKAGARDPYVERLFEGFAFLMGRLREKLDDDLPELTEGLVSLLWPHYLRTIPSMSVVEFTPDWREMKEPMRIVKGFEVNSRPIGEKGTRCRYTTTKEMTLQPLSLEHARLSTDPDGRSVITLRFHCSGLADWTRIDLSCIPLYFNADTPLACAMHEAFTMNVARLWLRLPGDMDRKPLD

SEQ ID NO: 93535 - protein, 104 aa, Glycine max
  Coding DNA Sequence Number=SeqID_1850
MGAKYLEVVERGSHPNNGWSPDEIRTLNDHNLSLHFVGHNRTWVARHRMTIICLCVPLDTIASGWRKGARNDHNLSPPTSRLILNNKGRRICLCAFITRLAKSV

SEQ ID NO: 93536 - protein, 88 aa, Glycine max
  Coding DNA Sequence Number=SeqID_1851
MVKDECKECILQETLVSTATPLGLDIIPQVNESLDEGLVRKSLNSCALLVPKIGAEERTPEFQEPLDLRSNPFQGGWNDAILPPKGIG

SEQ ID NO: 93537 - protein, 75 aa, Glycine max
  Coding DNA Sequence Number=SeqID_1852
  Subcellular localization annotation: CTP_CleavageSite=61; ConfidenceScore=5.05e-01
MGIAPTKTPSGPQEVQQGPGFPALITGLCQFYRVPVPPARASGPLLIELSSRSTAPPDGRRARHHSSIGMAGSGQ

SEQ ID NO: 93538 - protein, 329 aa, Glycine max
  Coding DNA Sequence Number=SeqID_1853
  Gene Ontology: Mol. function=oxidoreductase activity; Cellular component=cytoplasm; Biological process=metabolic process
  Homolog annotation: Hit_ID=A9F1I8; Match level="QueryCoverage=31%, HitCoverage=44%, E-value=1e-23, Identity=49%"; Hit description =Putative uncharacterized protein
  Pfam annotation: Domain name=ADH_N; Domain location=167-253; Score =56.1; E_value=1.2e-13; Accession=PF08240.3; Description=Alcohol dehydrogenase GroES-like domai
  Pfam annotation: Domain name=SnoaL; Domain location=15-136; Score =34.3; E_value=4.4e-07; Accession=PF07366.3; Description=SnoaL-like polyketide cyclase
  Pfam module annotation: Pfam domain module=ADH_N::SnoaL; Domain location=167-253::15-136
MNPAAEYVQRLKIERQAVETLYQAFSDNNPDLVDSVLAPSWEDIPLAPGQAPGPEGIKPIIRMLAQAFPDVQIVVHDMIQEPGRIAARAEISGTHLGEIFGIAPTGRPSDHHLAHGGLVWPVPPAWPVSATSLNQTGELIMKAALIDTFGTADVLTIGERQLRAASPDEVTVQVEAASVNPLDVKIISGHMQQVFPVDMPYVPGMDFCGVITAVGDHVSHLNAGDRVFGRTPPGAGGAFAQSLVIAADDVCLVPAAMSAEQAAALPTAFGLRAAGAVRCGPAAARRARADSRRSGGRRQHGRPAGASAALMSSLRRRRKTTRCDQSGRR

SEQ ID NO: 93539 - protein, 92 aa, Glycine max
  Coding DNA Sequence Number=SeqID_1854
MTKASQKGVRKENEGGACHPACPSELGCFLQKAPPSGGTSWKAEVGQIVQQYFLLTSSMSRNFTDCLTMGAKYLEVVKRGLHPNKRMVLGRN

SEQ ID NO: 93540 - protein, 183 aa, Glycine max
  Coding DNA Sequence Number=SeqID_1855
  Homolog annotation: Hit_ID=A5AIB7; Match level="QueryCoverage=96%, HitCoverage=16%, E-value=4e-10, Identity=27%"; Hit description =Putative uncharacterized protein
  Pfam annotation: Domain name=G-patch; Domain location=139-178; Score =16.4; E_value=0.002; Accession=PF01585.14; Description=G-patch domain
  Subcellular localization annotation: CTP_CleavageSite=37; ConfidenceScore=5.33e-01
MDHIVAKVLIDNGSSLNVMPKSTLEKLPFNASHLKPSSMVVRAFDGTRRELSVGAPVDPLSRSCSLNTPPKVEIRSGRASGHRIRRGRHLGELPILYAYVEAVEESLETAFQYFEVVSISSVDSFSGQACLSDAAVMMARVMLGNGYEPRMGLGKDNGGITSLINAKGNRGKYGLGYNPLRRT

SEQ ID NO: 93541 - protein, 109 aa, Glycine max
  Coding DNA Sequence Number=SeqID_1856
RRRVTHIRTLAHRHHLGRPIRLGHWAWNGIYTIWFASRRPTTIDKCRYMSVSTGSASVSRGRVPPLLYALPRSSLGLRSHGLETGPMPRQGRSLQNPPVRRMNPVWMRI

SEQ ID NO: 93542 - protein, 141 aa, Glycine max
  Coding DNA Sequence Number=SeqID_1857
MGGKCAESPPMFIRGKSRKKPERCGLRTLIVKGSGVVFTHGEDSISGTYRLKTEEQTKNGEESSRNRSQKRFISVTEAPQLGFFSRKQFSSLILRESSNTSDAILPRKGPVTRAMSKRIEEDWARAAEEGPRVLMNLRVDF

SEQ ID NO: 93543 - protein, 289 aa, Glycine max
  Coding DNA Sequence Number=SeqID_1858
  Gene Ontology: Mol. function=metal ion binding; Cellular component =cytosol; Biological process=metabolic process
  Homolog annotation: Hit_ID=A7QCT0; Match level="QueryCoverage=43%, HitCoverage=37%, E-value=8e-35, Identity=46%"; Hit description =Chromosome undetermined scaffold_79, whole genome shotgun sequence
  Pfam annotation: Domain name=zf-UBP; Domain location=8-63; Score =32.1; E_value=2e-06; Accession=PF02148.10; Description=Zn-finger in ubiquitin-hydrolases and other protein
MWSPVFLNGRRLSSLEGGHAIIHWKETQHCYSLEVETKRAWDYVGDNYVHRLIQSKTDGKLVELNTQCAHADNGCGSCSSEDNAMNEAILNSKLEAAISLKHQKIQSKIDRCKKDKKFLDDLNKNLVKNEDIWKTKILRIEERNAFFRHEAYYSDICVGAIACRLEKKEGGGQVRVYIMTLGVLAPYRGLGIALNFGKAASEEIQVLQEQMKQAHASKMDSIKQLSFETETARSEEEEMTSKTQELKQEAEKSKAMEKELEKKLELYLKQAEGAKASKQRAIEKMKMNT

SEQ ID NO: 93544 - protein, 302 aa, Glycine max
  Coding DNA Sequence Number=SeqID_1859
LGRIDGDPALRGTRIRATWEYVSSVGGEQQEMGETSCFYSLTTEWYLEICRRGQETLGMPASSWQSTDKKNKDHKARGLVWWLASNESGVRFGIWPLVIDYQGLRKETGMLKGPLVIDYQCCVIDYTEEQATGHFCRFHVLRLCNSSLASEMKSLEIPLLLIMMAAQLIHDRVEMECLEGAWGTLEGNTRCQFRGTIRFTVTSLVHPEEPARTLQRTVEWILPTPTPYRLVEPVQVIEVTSSEEDPEELPPEPAVDALDFLEGDEDPLPEVDSPEDIMSASEADSTEESGPGEMATSGCSSS

SEQ ID NO: 93545 - protein, 167 aa, Glycine max
  Coding DNA Sequence Number=SeqID_1860
  Homolog annotation: Hit_ID=A7QLT1; Match level="QueryCoverage=77%, HitCoverage=45%, E-value=2e-12, Identity=36%"; Hit description =Chromosome chr18 scaffold_121, whole genome shotgun sequence
  Pfam annotation: Domain name=WD40; Domain location=102-140; Score =6.7; E_value=4.8; Accession=PF00400.23; Description=WD domain, G -beta repeat
  Pfam annotation: Domain name=WD40; Domain location=51-89; Score=36.6; E_value=8.6e-08; Accession=PF00400.23; Description=WD domain, G-beta repeat
  Pfam module annotation: Pfam domain module=WD40::WD40; Domain location=102-140::51-89
MATTGCDRFQNPFNHNLCLLHLECFLKQSCLIILWHHQKPIFIHSQIGEKGDWAFELQGHKDFVSSLDFNYDGQFLASGCFHGIVQVWDASRNLKNVFEGLGGGIEGHGYQTKGLTCLAISSNSTLALTSSEDGSSYIVKIDGGKITSTKKNGAQLLTLERRLLESN

SEQ ID NO: 93546 - protein, 58 aa, Glycine max
  Coding DNA Sequence Number=SeqID_1861
MESPTIAIYPSAGGRCETNGCVFHGRKMRGVTTNVYSRKTSEKTGKGVSLAPTYPQLR

SEQ ID NO: 93547 - protein, 38 aa, Glycine max
  Coding DNA Sequence Number=SeqID_1862
MVARVMLGHGYEPGNGFGQEQRRQDQPGKNQRKLREVW

SEQ ID NO: 93548 - protein, 122 aa, Glycine max
  Coding DNA Sequence Number=SeqID_1863
MAPKKLFTKRSRKDATGEGSSAASEFDSHRFQSAEHQQRFEAIKGWSFHRERRVQLREDEYPDFQGEIARRHWARLVTPMAKFDPEIVIEFYANAWPTKEGVRDMRSWVRGHWIPFDADAIS

SEQ ID NO: 93549 - protein, 123 aa, Glycine max
  Coding DNA Sequence Number=SeqID_1864
QAQGDAHQAAGAPPPPRQADPAGPLGVERYLEHLVCQQAANHRGQVQIHECLYRFSLSQHEQGSARFVCPTPEQFGAEVAWPGDWPDAQAGEEPTGSPGEAHESCMDEDMTDLLGFLGGSGAA

SEQ ID NO: 93550 - protein, 29 aa, Glycine max
  Coding DNA Sequence Number=SeqID_1865
SKSLGSRRTVAKFGNAVRLMMKGITSIWK

SEQ ID NO: 93551 - protein, 189 aa, Glycine max
  Coding DNA Sequence Number=SeqID_1866
PSVRYKVTARALRKERQIGTNSLLAWRGRPLIGSLTGRKEEPIFCSHNLPLIAWGFGDPNARILQGVHKAWDAVQRKDKELRGSSNGIIGGYRQWLRVRTQGLDWLPKLRAAREEEAEAPKESEEVQALMAELEKAQAVKEKFKSTTIKVRREYDELKDINMDTAEALERETKRALKEEDGRTKFRGAL

SEQ ID NO: 93552 - protein, 56 aa, Glycine max
  Coding DNA Sequence Number=SeqID_1867
MLHPYEIQHRLKGATSNPVTPKAYTSKSSSGPLPPDSAFQIWVIKVNSLYFYIIFK

SEQ ID NO: 93553 - protein, 130 aa, Glycine max
  Coding DNA Sequence Number=SeqID_1868
MPISPADVSVGLCRHDIGIAPTRHPVDPKKSSRALGFPALVTGLFQSYRVPIPPARSCHRDIGITPTKTLSGPGEVQQGPGVSSSGIAPARHPVDPKKSNRVLELSSSNYGSLSVLRSACHLRQGHQAPY

SEQ ID NO: 93554 - protein, 258 aa, Glycine max
  Coding DNA Sequence Number=SeqID_1869
  Homolog annotation: Hit_ID=UPI00016621D1; Match level="QueryCoverage =89%, HitCoverage=40%, E-value=1e-16, Identity=30%"; Hit description =UPI00016621D1 related cluster
MGTSKPYTGAMRGIVHEPQGGPLGTSTLAFRGLLVLAIKGLHVLAIKGLHVLTFRGLHALAFRGLHVLAIRGLHALAIRGLFVLSFRGLPALAFRELHVLAFRGQHALAFRGLHILPFRGLLALAFSGLLVLAFRGLHVLAFRELHALAFRGLLVLSIRGLHVPTLRGLHALAFRRLHVLTFRGLHVLAFRGLHILTFTGLRALTFGGLQVLGFRGLHALTFRRLQALTFRGLHALTFRGLHVLAFRGLHALAFRGLQ

SEQ ID NO: 93555 - protein, 61 aa, Glycine max
  Coding DNA Sequence Number=SeqID_1870
MGHLSDQWVPTDPKRIKVIPDWPTPPSVEGRSPEFEEPLDLRSNPFQDGGDDAILSPKGIG

SEQ ID NO: 93556 - protein, 143 aa, Glycine max
  Coding DNA Sequence Number=SeqID_1871
  Gene Ontology: Mol. function=helicase activity; Biological process =viral genome replication
  Homolog annotation: Hit_ID=Q9LTU4; Match level="QueryCoverage=91%, HitCoverage=9%, E-value=1e-33, Identity=50%"; Hit description =Helicase-like protein
MVESKRLNYIRNNQKKLRVDKYCSLQNSLDAGTNQGLNKGKRVIFPSTFVGNPHYMDQLYFDGMAICSHAGFPNLFITLTCNPNWPEIHRLVAPLNLKPADRLDIISRVFKLKYEEMLSDLTKNHLLGKAVAYNKYPTSNEID

SEQ ID NO: 93557 - protein, 130 aa, Glycine max
  Coding DNA Sequence Number=SeqID_1872
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=65%, HitCoverage=71%, E-value=3e-24, Identity=68%"; Hit description=LacZ protein
MLVGVQLVLEVAAGVPRSYSSNSCSPGDPLVLERPPPRGSSNSPYSESYYNSLAVVLQRRDWENPGVTQLNRLAAHPPFASWRNSEEARTDRPSQQLRSLNGEWDAPCSGALSAAGVVVTRSGDRYTCQR

SEQ ID NO: 93558 - protein, 145 aa, Glycine max
  Coding DNA Sequence Number=SeqID_1873
MTTEDVHCAIMGHRQHTEWRQGRRRCGDISVSGGVIEEMKTQYTGTHIDWWLLTTSAFSPTSLSLLRLLCAPFARARPVTQTHAASAFAASSSLCISPVVECSLASDNIVWCMSALLIPPRRLTSNLSTAFSLHCKLACAGVVRV

SEQ ID NO: 93559 - protein, 151 aa, Glycine max
  Coding DNA Sequence Number=SeqID_1874
  Gene Ontology: Mol. function=2-oxoglutarate decarboxylase activity; Biological process=menaquinone biosynthetic process
  Homolog annotation: Hit_ID=Q15KJ0; Match level="QueryCoverage=73%, HitCoverage=51%, E-value=2e-10, Identity=32%"; Hit description =Truncated PHYLLO protein
MSFDGFLLYIGSESLVLYPLALEEALEKLKEALQILNSPSPSSPAGFLRFQVALPPSPKTFTLFCSQPHSSSVFPLIYVSKNDADSKSLYVNLDDNVSHQKESRSQIELDELESVSILSMTLAWDEFSFSTFQEAHYSLQDSLDQVPDMPF

SEQ ID NO: 93560 - protein, 70 aa, Glycine max
  Coding DNA Sequence Number=SeqID_1875
MRKILLVEVLDTVFPTSMTRPSKVGMIPPPEIVPVAGEHKLQVVQLLQIAAQKGKGLCGGRQRSINHRVW

SEQ ID NO: 93561 - protein, 112 aa, Glycine max
  Coding DNA Sequence Number=SeqID_1876
  Homolog annotation: Hit_ID=A5AZG1; Match level="QueryCoverage=41%, HitCoverage=14%, E-value=4e-07, Identity=51%"; Hit description =Putative uncharacterized protein
DLIEAQRSSFHRRFSSKLPSRSIRAQELQGELSYCEEISDYYGGRHRSHPRPHSHRREKERKPQEVNTNLPYFHGKDNAEAYLDWEMNVEQLFACHHTSEERKVSLATLSFQ

SEQ ID NO: 93562 - protein, 119 aa, Glycine max
  Coding DNA Sequence Number=SeqID_1877
  Gene Ontology: Mol. function=pantoate-beta-alanine ligase activity; Cellular component=cytoplasm; Biological process=pantothenate biosynthetic process
  Homolog annotation: Hit_ID=A8GIZ7; Match level="QueryCoverage=100%, HitCoverage=41%, E-value=4e-54, Identity=89%"; Hit description =Pantoate--beta-alanine ligase
  Pfam annotation: Domain name=Pantoate_ligase; Domain location=1-115; Score=-106.7; E_value=6.4e-07; Accession=PF02569.6; Description =Pantoate-beta-alanine ligase
MGYDIDIVGVPTVRAKDGLALSSRNGYLTAEERKVAPQLSKIMNGLAQQLANGERHIETLLEQTAEQLRAAGFTPDELFIRDADSLQPLTVDSQRAVVLMAAWLGKARLIDNQQVDLTL

SEQ ID NO: 93563 - protein, 769 aa, Glycine max
  Coding DNA Sequence Number=SeqID_1878
  Homolog annotation: Hit_ID=Q5GV63; Match level="QueryCoverage=25%, HitCoverage=79%, E-value=3e-30, Identity=36%"; Hit description =Putative uncharacterized protein
  Pfam annotation: Domain name=UPF0231; Domain location=1-51; Score= -17.0; E_value=0.00012; Accession=PF06062.2; Description =Uncharacterised protein family (UPF0231)
MDGEEVMIRANQLEFEGDEMEEGMNYYDEESLSFCGVEDFLLIGDLLAFGGAQRLWFRVEQVVLQIEIFQQHLGMEDIFLVNVHVHHVIQRLDVFRHKVLDRIDLMIDVMFHAVHVAGKTAHAIVHGDDVGFQLPAFRMAFRVGVYADMALVQVRNDRVRQRAGMLRRIDVFRIDRLFADQDGDAGALRLVVLTRDVQNIGADDRAGFAQDLGQPVGVILFVNVGDIAVAVVRGLGVTNIVNTKTQALGQGIEQILRQGKTADVNCRSRQIALAQRRVLARPGKGHDAAVIGWDRRLIEADVGKVAAQFGVAVDRLVLLQEADAVLRDENAALIQAAGAAFIKRRSEQAFAGADRIGAVGDDHIEGFVGLVHEVDAVVDHQLEARIVIGAGAVVGQVLAAELDDTGVDLDHGDLLHARVPADFAQHAAVAAADDQHFLRRAVRQQRHVGQHFVIDELVTLGGLHHAVERHHAPQHRVLEDHQILVIGLLAVQHLLYREILAEARMQRFVPNFFLGHGKELVGVGQQAQRVARQRFALLGRWNGDAAQIAIAVFAQRLHIEAVVVAQIPAVLLREIDDGAFDLRACLSFADVTTLACKGTKFYCCRAGVAFASHILLIVRHSLKYRQERLDLPPGGRFRLAALSYVTEKRESAMLRRDFIKLTAALGAASTLPLWSRAAWAAWAADRPALPVPPRGKPAGLPGAATKTWGFNGALLGAGGAAAAWPAGDGRYQKRPWRRPAPVHWHGLEIPRRRRMAAPQAIDPSRRGRA

SEQ ID NO: 93564 - protein, 121 aa, Glycine max
  Coding DNA Sequence Number=SeqID_1879
  Homolog annotation: Hit_ID=A7P0R1; Match level="QueryCoverage=38%, HitCoverage=59%, E-value=1e-07, Identity=68%"; Hit description =Chromosome chr19 scaffold_4, whole genome shotgun sequence
MGNCLKNQSPTKYDGGSDDDNDDWDFLTGEEGSFVTTKAATAAKTVTEVKIKITKKQLEELLSKVDVRELRVEQVLSQLMNHSSGGFQSFQRPWRPALQSIPECMMELMMMKKRIGLLGQS

SEQ ID NO: 93565 - protein, 192 aa, Glycine max
  Coding DNA Sequence Number=SeqID_1880
  Gene Ontology: Mol. function=endonuclease activity
  Homolog annotation: Hit_ID=Q2HUP4; Match level="QueryCoverage=96%, HitCoverage=63%, E-value=2e-65, Identity=67%"; Hit description =Endonuclease/exonuclease/phosphatase
MDQLRNNVNARSLPGSNALYGSSTVSKEQGSLHRRPDVVKSKQGFPHFRERVWVKKLVHDRRIRFGTWNIGTLTGKSMEIVDVMVRRKINFMCLQETKWTGEKAKELDNSGFKLWYTGKIRSRNGVGIIVDKEWKKDVVDVRRVGDRIIALKLVVGQDTFNVISGYAPQVGLAEHFKVAWLEVLRGCMGVLA

SEQ ID NO: 93566 - protein, 74 aa, Glycine max
  Coding DNA Sequence Number=SeqID_1881
MSSKVILMMPKNQELSKFQRFKNEVSRIKIQDSRIKFQESRFKNNQDQDSRLKIQESREDSIKISIKFFFKNIE

SEQ ID NO: 93567 - protein, 35 aa, Glycine max
  Coding DNA Sequence Number=SeqID_1882
MAEINQGTDTSGARVTTDRSLPLPGAKQAENVAAG

SEQ ID NO: 93568 - protein, 181 aa, Glycine max
  Coding DNA Sequence Number=SeqID_1883
MVCTNQADMTGRLLAGSLALESRILHYLIVRILLPRSSNLAQALRLNAPLPYPHLVTLFLQHFNIPLDSEPYVPIKRSFLIGAVVVASFGYRKERDDSWVKKGVQPNDDEGHLPVERDSSLLQSILDKFNGLQTYVGERFDSLEHQVDTRFEEMNSRIAKVEEDVTIIRDCLDLPPPPPLV

SEQ ID NO: 93569 - protein, 120 aa, Glycine max
  Coding DNA Sequence Number=SeqID_1884
MEQKTASFGLLLLRGHKTKMVFMSGGRRRKDSVYPEAQWLCSAPPQLVLTISLRCIMELTSIYMKCFQTMLYMCPQTLIGPRVAHVIRRGVPPGLSPDLVMTCRPLETSQYLMRRTLEMN

SEQ ID NO: 93570 - protein, 25 aa, Glycine max
  Coding DNA Sequence Number=SeqID_1885
MKLGSLDDGVLGVEPMVRKREVGEK

SEQ ID NO: 93571 - protein, 181 aa, Glycine max
  Coding DNA Sequence Number=SeqID_1886
MGELICAIARSPPSTTYDGVVPGDMSRGSGDLGDVRWGAIAQNQAWLIPTQPGHSQSYDRALVIDYQLCVIDYIVLPATVHPEEPAHTLQQPVEWILPTPTPYRLVEPVQVIEVSSSEEDREEDPEELPPEPAMDALDLPEDDEDPLPDVDSPEDIMSAFEADSTEENGPRGTANSDNSSS

SEQ ID NO: 93572 - protein, 54 aa, Glycine max
  Coding DNA Sequence Number=SeqID_1887
MARKPRQDFSVSKLSLSLTLPFFLPHSPLKLHTKLQPLAIIFAPNRERRAFSGS

SEQ ID NO: 93573 - protein, 157 aa, Glycine max
  Coding DNA Sequence Number=SeqID_1888
MEIIISIPQINCDFFRREHYKDNFYLYSTNNSRWRHEFNPYNHYEEERAPDLESVSEEFMAYHASSKANQNSIQNHEIHFGKSYSLEDYQRELELQTYFQKEAERGFNLDNLLMQFKDTIESIQRAFKSIEIQVGKLVEEVTQAVGRREEEFVKVEA

SEQ ID NO: 93574 - protein, 51 aa, Glycine max
  Coding DNA Sequence Number=SeqID_1889
MYIDGMKFPFQMQEMALRKLSSKRSRKDAAAEGTSAAPEFDSHRFRSAEHQ

SEQ ID NO: 93575 - protein, 81 aa, Glycine max
  Coding DNA Sequence Number=SeqID_1890
  Subcellular localization annotation: CTP_CleavageSite=33; ConfidenceScore=5.15e-01
MRDTMHEPQPNLGGGTNPGVATYPSAGGRRGTRGMRVPRKEYARSRHQRLFEENVGKTGKDAIYELLSERFGSCIYARGRY

SEQ ID NO: 93576 - protein, 89 aa, Glycine max
  Coding DNA Sequence Number=SeqID_1891
MKVMPSKPTRKGMKWYLNPTYQGNPCGVYPDLSSFTESGVYPDLSSFTGSGVYRDLSSFTGSSVYPDLSSFIGSGDIQTFVVCIKRSAP

SEQ ID NO: 93577 - protein, 424 aa, Glycine max
  Coding DNA Sequence Number=SeqID_1892
  Gene Ontology: Mol. function=RNA-directed DNA polymerase activity; Biological process=regulation of transcription, DNA-dependent
  Homolog annotation: Hit_ID=A7QRX9; Match level="QueryCoverage=88%, HitCoverage=43%, E-value=3e-60, Identity=33%"; Hit description =Chromosome undetermined scaffold_154, whole genome shotgun sequence
  Pfam annotation: Domain name=DUF755; Domain location=106-206; Score= -39.8; E_value=0.051; Accession=PF05501.2; Description=Domain of unknown function (DUF755)
  Pfam annotation: Domain name=zf-CCHC; Domain location=213-230; Score =30.0; E_value=8.9e-06; Accession=PF00098.14; Description=Zinc knuckle
  Pfam module annotation: Pfam domain module=DUF755::zf-CCHC; Domain location=106-206::213-230
AVKTDLNGKVITNDDDKEIPGAVNTLIFTIAQHFIGDPSLWKDRSAELLSNLKCRTLADFRWYRDTFPTRVYTREDSQQPLWKEKFIAGLPRSLGDKVRDKIRSQSANGDIPYENLSYGQLISYVQKVALKFCQDDKIQRQLAKEKAQTKRDLGSFCEQFGLPACPKQKKKQTSRKETQDHKPANRRRFSKRRYSHKPSTSREMENPKKTKKITCYNCGKQGHISKYCRLKKKLRNLNLEPAIEEQINNLLKETSEEETETSSSVLSDENLNLIQQDDQLSSTDNDDGQINTLTREQDLLFEAINSIPDPQEKKVFLEKLKKTLEVKPRQKDFITNNKFDVSNILKRLENSSTKPTTIQDLQTEIKNLKREVKELRQQQEIHHIILSQLEEDSDSESTNNSEENQPENLEDDIFRNNGPIEHRG

SEQ ID NO: 93578 - protein, 89 aa, Glycine max
  Coding DNA Sequence Number=SeqID_1893
MHETSGFFSPGDNIEHKNADIPMICFYNLTIGILEIITFGLPLSKKGALSAIPTERNCAERPKATLSPFPTERKCTEHPEGPLSESCRL

SEQ ID NO: 93579 - protein, 102 aa, Glycine max
  Coding DNA Sequence Number=SeqID_1894
MEKSEKKNHSEKKLKKAYITWDENDLESSDDSENEEINLCLMAKSYESDEEVSLRKKWYIDSGCSKHMTGDASNFTHISPKKSGHALSTACLALVNYVTKAI

SEQ ID NO: 93580 - protein, 327 aa, Glycine max
  Coding DNA Sequence Number=SeqID_1895
  Homolog annotation: Hit_ID=A0TV72; Match level="QueryCoverage=46%, HitCoverage=8%, E-value=2e-10, Identity=36%"; Hit description =Putative uncharacterized protein
MQIVTSATPDTVAICLIVNERLTRKPALREIGLKQKSGADSHPPPRTGLIILDHRLFLSGYAAGKTKKIAGFSLFLKRTNATRTQVGVRRQRLRRQIEIPLPAGQGIAQINQRVARRIVLRLLNVDTGAERPVRTETAFDDRPQRITDAARGAAVLDGELIGQRIRDQPLQRIAALAVGFRMGQRNRTAQLPRPVLGALAIVDRQRQRQILLRAVIAALPQRIAAQILLVVPQHGIEPDAQTAIVFVDQLVVVAGHQPLPLVIRHVLAGNLVRAEIGPHAVRLAAIVAGAQADAGSAHAAPGDAGVRIVGAAERQQRAGDRPPRGRQ

SEQ ID NO: 93581 - protein, 27 aa, Glycine max
  Coding DNA Sequence Number=SeqID_1896
MSAGIKMNWVLSAAKVAKKMKLKFTKE

SEQ ID NO: 93582 - protein, 163 aa, Glycine max
  Coding DNA Sequence Number=SeqID_1897
DRVKFLNRDVAADGNVRESGDVGGGPGKSYLFCLTACPPWKRLSRRTECLPRPVVLITASGLQGEQPLVDGTIPEPVGCRWTARAASAARAGRRVPVGGRIGNGPFGASSPGVEQSTQNCALNVKVKKFNQARVNGGSNYDSLKRNHSQGNGLGGISGERRPC

SEQ ID NO: 93583 - protein, 123 aa, Glycine max
  Coding DNA Sequence Number=SeqID_1898
VQKTVSAPACYQAFCLTDSKRMGANNHKVSPRIMGISAYHGCRMTKLGLCLSSGPPPLDDKRGADNRKVSPRIMGISAYHGCRMTKLGLCLSSGPPPLDDKRGANNHKGANNHKVSPRIMGAE

SEQ ID NO: 93584 - protein, 88 aa, Glycine max
  Coding DNA Sequence Number=SeqID_1899
  Subcellular localization annotation: CTP_CleavageSite=36; ConfidenceScore=5.05e-01
MLLSSNVIYICVRVVMLVRMIRTRLFAAARIWGPLRARTRSPLKARACSPLKFRTCRLLKARECSPMIARTCNPLKVRACPPLKMGNM

SEQ ID NO: 93585 - protein, 54 aa, Glycine max
  Coding DNA Sequence Number=SeqID_1900
MVPKTCSQPASVPDRTSSIKRTLESHQFPLLNDPNKACIYVIRVKAHWNEKQIA

SEQ ID NO: 93586 - protein, 422 aa, Glycine max
  Coding DNA Sequence Number=SeqID_1901
  Homolog annotation: Hit_ID=A7CDN1; Match level="QueryCoverage=98%, HitCoverage=74%, E-value=5e-83, Identity=44%"; Hit description =Putative uncharacterized protein
MQRHPGGAAGGVQERIEQRPVGHRIGTVAHGLRLAVGAGHRAGIQVIAADHHGRRQFAAAHHLVERQAEAGALAQANPANPRRQALETDALARHVEPAMQVRVVGNQFLDLGIGLVDVLRIARQRGPAERAHAAAEQRADVGRHEPRKIEGIGHALVLGHLADVVAVVEGRDALLLERQHGPDVHGHGLLGGLHHRGRFAAGALAIFGPGPAGGQIAIERVMGAGLVGDHVRTHPAAHQLGQHFGGVAAQRDRYRAAFPGVAGDARQGVIQVGGLLVHIAGAQAKVDAGLLALDVQRAGAGQRRGQRLRAAHAAQAGGEHPAGAEIAAVVLAAGFRRRSHPAAGGHLAIHGQALPIQLVEVVPVGPSRYQVVIGNHHSLCICMGAEHAYRLARLHQQGLVIVQALERFDYGIQALPFTHDSS

SEQ ID NO: 93587 - protein, 123 aa, Glycine max
  Coding DNA Sequence Number=SeqID_1902
  Homolog annotation: Hit_ID=UPI00016621D1; Match level="QueryCoverage =95%, HitCoverage=22%, E-value=5e-07, Identity=33%"; Hit description =UPI00016621D1 related cluster
MRGIMHEPQVNIGDGPLGTSTLTFRGLYVLVIRGLHALTFRGLHVLAFRGLHALTFRGLHVLAIRGLRVLAIKGLRVLAIRGLHVLAFRGLNVLAFRGLHVLAIRGLHALTFRGLHVLTFRGS

SEQ ID NO: 93588 - protein, 139 aa, Glycine max
  Coding DNA Sequence Number=SeqID_1903
  Gene Ontology: Mol. function=hydrolase activity, hydrolyzing O -glycosyl compounds; Cellular component=extracellular region; Biological process=cell wall organization and biogenesis
  Homolog annotation: Hit_ID=A7P4U6; Match level="QueryCoverage=94%, HitCoverage=33%, E-value=5e-12, Identity=36%"; Hit description =Chromosome chr4 scaffold_6, whole genome shotgun sequence
MLVKGDFNYKEALTKSLIFLEAQRSMRHNVQGNTVLIQGSSLQIIGCLGEETQHSMMANSLMGQCEIWAPHGFHCYYASMGSHFLQLVLDTKDDHHCWAPPENMKTKKSVKMITSDTPGTEIAAETAAAMRSQLQVKEA

SEQ ID NO: 93589 - protein, 57 aa, Glycine max
  Coding DNA Sequence Number=SeqID_1904
MASVEEALPHIPRLGTCLRLFKGFIVIKQVDNTRELLTQFGATSPTSGGYQAREEIH

SEQ ID NO: 93590 - protein, 388 aa, Glycine max
  Coding DNA Sequence Number=SeqID_1905
RRPRLFRFFRRFPQINVGGDSARIPFLEDAPASLASPSRRRKGLTKGKPWVFQALEWGRVCPRYFPDCGVVRITKCGAWDSPRVDLGFCEPFGVSTRKFLTWVLGVVLMNACQSPWVALIGDIARALACMSLVVGGMYWRRSNVLMRTCHSLWVDLPRVDLGFFDPFGVSTRKLSDLGFRHRVLVCMPLIVGGTSIEVELQAGCGPEWTFPVKVKLSHSGFFYGLTLDSPYEVLDAYPCQELFISLSFELSVVVHNNGVWEAVAADESMTTSRYLASLGAFGSGPVCPFPHGKGLRGAQTMKIVRRSTCHVSKLLASSAPPDEVEGICLEGWLVVADSYYFGGYGASFDGVIQFRSSSLSQRALLRASEARLTGALSKGGKDARSRHQ

SEQ ID NO: 93591 - protein, 105 aa, Glycine max
  Coding DNA Sequence Number=SeqID_1906
MYKKHKELDLNRDLPLEPKIRPCNAYFILLVLDLVIGPPMPCKGSLDRLIAPLSFPPSLKGFVLEFELLPTSNEDRSTTLKVALMFSQRNGEEEELRGDTTSRRR

SEQ ID NO: 93592 - protein, 66 aa, Glycine max
  Coding DNA Sequence Number=SeqID_1907
MSVKNLVGRLGVHDKTNHTLSRRPVRVTVFSENAPTIWDQHRLKGALKQGDPQGLNSEESVRTSPS

SEQ ID NO: 93593 - protein, 183 aa, Glycine max
  Coding DNA Sequence Number=SeqID_1908
MGETHEVPYHNLANFEPCLRYATEGVPSAMAQREKLDHLEERLRVVEGGEDYAFANLEELFLVPNVVILPKFKVSYFDKYKRTTCPKTHYQCSAMKKMVGYTPSSFVDLVFTGERIEVGQKRGKFDHPALTNEKIGANEEDENEGETHVVAVIPTQPNFPPAQQCHYSANINPSHYPPPNHPQ

SEQ ID NO: 93594 - protein, 285 aa, Glycine max
  Coding DNA Sequence Number=SeqID_1909
MQTLSAPAKHACAPKPQCLSVEAELSASIWLIGKERHHLHPPKLDLTDQDSLPKRLGKDTDIIVPRKLLPERNMAVYYIEFDEFKEELERSHWDEELTDFGDGNIDVAIDTLNTFLKTPVIVEEGESLCAYSRFALLRPDPQELAAKLCIPGKGFELNADGQPLKILRKNLTTLAQTWSVLSLSNLIPTSHTSDVTLDRARLIYGIIMKMDMNVGYLISLTAQHDTSRLGFPALITALSKARGVQSDSRSLESLSPAINLAYIKKDYWNLDDPTITFRGPRKARG

SEQ ID NO: 93595 - protein, 202 aa, Glycine max
  Coding DNA Sequence Number=SeqID_1910
MASRKRKVATSRPQPHYDTHKLTSKDAWNCYTDNVLGWNILPERNVKLFVTKFDEFRTKLVRRNWHRTLTNLIEGSIDVALVKEFYANLYVLRGKPLKQVRVRGHLIKFDVDSLNTFLETPVVLELGVTLPAYSQFCSLRPNPQELAARLCIPGRGFVLNVEVLPWKLLRKDLTTLAQTWSILSYFNLAPTSHTSDLNLDRA

SEQ ID NO: 93596 - protein, 64 aa, Glycine max
  Coding DNA Sequence Number=SeqID_1911
MDRKASGEVSKGEVPKPKENVGSGSEDKVMKAPGGDGSYISRKEFEKNPQGYFDGGVNCGEGEH

SEQ ID NO: 93597 - protein, 32 aa, Glycine max
  Coding DNA Sequence Number=SeqID_1912
MESRKGKKQKGTGQTNTNKEDEHKQRDSTRAL

SEQ ID NO: 93598 - protein, 77 aa, Glycine max
  Coding DNA Sequence Number=SeqID_1913
MEYKYWKDIELVDEEEAQIGVDRSSATSNKSKIYKEEARNATQKHKPKRVESVNADAEALGDDWKIQIALCILKLNH

SEQ ID NO: 93599 - protein, 33 aa, Glycine max
  Coding DNA Sequence Number=SeqID_1914
MEKEERYLETSLQGEDESKTSSTLLEAMDKSLK

SEQ ID NO: 93600 - protein, 104 aa, Glycine max
  Coding DNA Sequence Number=SeqID_1915
IRYTNLFSSRSVIDPKFNGMVMQSYPAWALGRRLQVDWARDPREGPRVLMSLRVDFEPMGYDASSIGACRPRIFFINGFLCFLEDEWQRNGEGREGGDATSRRR

SEQ ID NO: 93601 - protein, 85 aa, Glycine max
  Coding DNA Sequence Number=SeqID_1916
MLQFEGVSSNLRYDFSIPNGENVWNWVANVVLKFHNDTTVNGSEIVIFLRQVWWAAGKRKDFERRRGKTKMRPKGGSWLNITIYT

SEQ ID NO: 93602 - protein, 54 aa, Glycine max
  Coding DNA Sequence Number=SeqID_1917
MHKEAQRLDVLNKKMRSDLKMHITKLASTQSVPKSKGLTMVYLDSGCSRHMTGG

SEQ ID NO: 93603 - protein, 66 aa, Glycine max
  Coding DNA Sequence Number=SeqID_1918
MEVEEPWLGLWLPLNYQVDMRASQRRTPEWGFVLKVVFLIGSAVDRLCVDLGMAFVDNWVVGNEKS

SEQ ID NO: 93604 - protein, 46 aa, Glycine max
  Coding DNA Sequence Number=SeqID_1919
MAENLHGFAHENVSEALWKHLDLDFLHGNTQNGEVLAAERLLEEDF

SEQ ID NO: 93605 - protein, 147 aa, Glycine max
  Coding DNA Sequence Number=SeqID_1920
MRRPGYAAKLQHVQTVIKGAHNLHLAVGVDKPALVRDVKSNFGARFKTLNVQPIAVKQLDPVMHVQQADFISGHLVRLYALNDFWINAVAGIAHRNTHAVAAFGDADGDDPFAFTGLNAVNNRVFDQGLDKQARDHAVDLFINIVND

SEQ ID NO: 93606 - protein, 143 aa, Glycine max
  Coding DNA Sequence Number=SeqID_1921
MSNHKSTELALKNLEVQMGQLTNQIADKSSNNFGANTENNSKEECKAVMTRSKRFVEAEDEENVVDKEQLSEKTGAEVKKNDVKGKENQEKGKKIMVQNKEMEDQEREKEIENEKNENEKNKVAEKSRSGKVVEESVEVPYPV

SEQ ID NO: 93607 - protein, 66 aa, Glycine max
  Coding DNA Sequence Number=SeqID_1922
MGVNLSKMGGANSNFEILQLGLPEYFRCWIASGGSNPARRNHVGNQKETNVRGANTFLKRKYNSRT

SEQ ID NO: 93608 - protein, 24 aa, Glycine max
  Coding DNA Sequence Number=SeqID_1923
MGGGAWPFLVGGAICLLLRGTMAA

SEQ ID NO: 93609 - protein, 901 aa, Glycine max
  Coding DNA Sequence Number=SeqID_1924
  Gene Ontology: Mol. function=metalloendopeptidase activity; Cellular component=proteinaceous extracellular matrix; Biological process =pathogenesis
  Homolog annotation: Hit_ID=P23694; Match level="QueryCoverage=53%, HitCoverage=98%, E-value=0.0, Identity=91%"; Hit description =Serralysin precursor
  Pfam annotation: Domain name=HemolysinCabind; Domain location=354 -371; Score=23.4; E_value=0.00082; Accession=PF00353.10; Description =Hemolysin-type calcium-binding repeat
  Pfam annotation: Domain name=HemolysinCabind; Domain location=372 -389; Score=26.3; E_value=0.00011; Accession=PF00353.10; Description =Hemolysin-type calcium-binding repeat
  Pfam annotation: Domain name=Inh; Domain location=510-610; Score =192.8; E_value=8.8e-55; Accession=PF02974.5; Description=Protease inhibitor Inh
  Pfam annotation: Domain name=Peptidase_M10; Domain location=88-269; Score=-24.1; E_value=1.9e-05; Accession=PF00413.15; Description =Matrixin
  Pfam annotation: Domain name=Peptidase_M10_C; Domain location=270 -493; Score=301.7; E_value=1.4e-87; Accession=PF08548.2; Description =Peptidase M10 serralysin C terminal
  Pfam module annotation: Pfam domain module=HemolysinCabind::HemolysinC abind::Inh::Peptidase_M10::Peptidase_M10_C; Domain location=354 -371::372-389::510-610::88-269::270-493
MSGIEPMQSTKKAIEITESSLAAATTGYDAVDDLLHYHERGNGIQINGKDSFSNEQAGLFITRENQTWNGYKVFGQPVKLTFSFPDYKFSSTNVAGDTGLSKFSAEQQQQAKLSLQSWADVANITFTEVAAGQKANITFGNYSQDRPGHYDYGTQAYAFLPNTIWQGQDLGGQTWYNVNQSNVKHPATEDYGRQTFTHEIGHALGLSHPGDYNAGEGNPTYRDVTYAEDTRQFSLMSYWSETNTGGDNGGHYAAAPLLDDIAAIQHLYGANLSTRTGDTVYGFNSNTGRDFLSTTSNSQKVIFAAWDAGGNDTFDFSGYTANQRINLNEKSFSDVGGLKGNVSIAAGVTIENAIGGSGNDVIVGNAANNVLKGGAGNDVLFGGGGADELWGGAGKDIFVFSAAGDSAPGASDWIRDFQKGIDKIDLSFFNKEAQSSDFIHFVDHFSGTAGEALLSYNASNNVTDLSVNIGGHQAPDFLVKIVGQPGMKGTLTRTALAAGGMMVTSAVMAGSLALPTAQSLAGQWQVADSERQCQIEFLANEQSETNGYQLVDRQRCLQSVFAAEVVGWRPAPDGIALLRADGSTLAFFSRDGDLYRNQLGADDALTELQVERTHDQEVAGEVTESHDGVRRAEGETVAVEQPNHVGQQQQRGAGQQREAEIGAAQEILLARQPDHQQRHRHVGDDRPAHLFQPGPKGGQQQRADRQQRQRQRPEQAERHLAGEAQGIQQMGQEKGADGVQHPLARQQEQRVADQRRQQAEHDQITCCAEHRRLPGQQQQQQQRDGFEHPALPARATGAATTGSKLSPMKWETDEQATVIFCRRDCADRRAGHATLLQTAPAGGGKRSRADAQPAGDGERQAQLPGRQDPRAAARTAGQQLEHAKDKDLGFLPVADWLILRL

SEQ ID NO: 93610 - protein, 150 aa, Glycine max
  Coding DNA Sequence Number=SeqID_1925
  Homolog annotation: Hit_ID=A2YED3; Match level="QueryCoverage=42%, HitCoverage=4%, E-value=2e-24, Identity=89%"; Hit description =Putative uncharacterized protein
MAKDKKRGFFSWLGFGQKEKEEEQQQPEQPVEQAEPQAAETPAEPATAKLDDKLPAQESEPAASVDTPGEWDSGQAGEPIAENLPAAAEHPTAQALAEEIVSVTEQVVAQQQPVVEPEPVVEPEPVVESEPVVEPEPVVEPEPVVEPEPV

SEQ ID NO: 93611 - protein, 114 aa, Glycine max
  Coding DNA Sequence Number=SeqID_1926
MVSKLIYKAVIDYHEHVIEYQCFKTVDFKVQKSQLVIKHGYILGGTSRGYIYLGCYTENKREYICCRSIQVKGTSTWLFKENKGGYIPCGSLACKGFYKVERNIKNRWLLGDWM

SEQ ID NO: 93612 - protein, 98 aa, Glycine max
  Coding DNA Sequence Number=SeqID_1927
MYNTIITYIGIHCSAHWQMVIILPKENLFVWFCLLHNRPDNYLKGIINSALKGLDDTPQPKSKAGTRWIVVKVTMLLLIFYCNRQKGSTECGYSGCQL

SEQ ID NO: 93613 - protein, 263 aa, Glycine max
  Coding DNA Sequence Number=SeqID_1928
  Gene Ontology: Mol. function=hydrolase activity, acting on glycosyl bonds; Cellular component=cell outer membrane; Biological process =cell wall organization and biogenesis
  Homolog annotation: Hit_ID=Q0P6Q0; Match level="QueryCoverage=84%, HitCoverage=62%, E-value=6e-98, Identity=81%"; Hit description =Putative uncharacterized protein mltC
MMKKLLALALVAPLLVSCSSKKGDEYNEAWIKDTNGFDILMGQFAHNIENIWGFNEVLIAGPKDYVKYTDAYLTRSHINFDEGTITIETIAGTDPAARLRQAIIKTLLMGDDPGSIDLYSDADDITISKEPFLYGQVVDQTGQPIRWEGRATKFADYLLQTRLKSRSNGLKIIYSVTINLVPNHLDKRAHKYLGMVRQASRKYGVDESLILAIMQTESSFNPLYSTAPVKTSSARRGNPGRRAAAICSIRRATLIPAPPIWRC

SEQ ID NO: 93614 - protein, 61 aa, Glycine max
  Coding DNA Sequence Number=SeqID_1929
MCLSGKERQGLTFSPWVKVYDKLGFWLKACRMAGHNICQGLASGSGIKGMPYIISMIHMQQ

SEQ ID NO: 93615 - protein, 90 aa, Glycine max
  Coding DNA Sequence Number=SeqID_1930
MEAAPEGEKIKKGISWKVERGDKFKVWEDEWIQGEVSLITKYPRLFVISQQQSNSIQQMGGFKDNEWEWNLSWRRPLFDNEQQQNNSILV

SEQ ID NO: 93616 - protein, 109 aa, Glycine max
  Coding DNA Sequence Number=SeqID_1931
MEITMRSSSLIGLMPLKPLLMNVMEGRLLGDSHVRCSSIQPDDLDDSSRLAVNLNQGVALREDEGFVHGKTLVIDKFIVTNRCYIVDLAAKGFGGSSFMLLELTMLKIL

SEQ ID NO: 93617 - protein, 88 aa, Glycine max
  Coding DNA Sequence Number=SeqID_1932
MLEGVLVCSGIYGVFGFSETIDVEKTIELIKMTSWMWLTAKDKTFSSSWIAWATDPVLENEALGRANYVGNGDHGVLSFCNLESLKSG

SEQ ID NO: 93618 - protein, 251 aa, Glycine max
  Coding DNA Sequence Number=SeqID_1933
MGSKIYPKVHENPRAFFSSSSPSFLESSIQYPWGMDEDQWMHNSIMFEEVDINEENEEESGMNEENGEKAGVHQHVDCFDAFNTSQVFATHDDVLHWARSVAYDISFVAVIMRSDTDTDQGLSEPEVSITEEMETISKRFEELDVYGKVTLKSKLWEIAYPDLNFMCAPLEKVKTKGYILCGTSRGYIYLGCYTENKRGYISCGSVQVEGTSTWLFKENKGGYIPCGSLACKGFYKVERNLKNRWLLRDWM

SEQ ID NO: 93619 - protein, 110 aa, Glycine max
  Coding DNA Sequence Number=SeqID_1934
  Subcellular localization annotation: CTP_CleavageSite=67; ConfidenceScore=5.02e-01
MGVQIVLFKSGPFWRLFFGAGLLPSGRAGWQPPPPFSYKKAKWGCSKGPRFTVDLLPLFPKQEICFREENSSQGASVTLPRGFRKQICEGFPPFFTVLRPFFISSSFFSG

SEQ ID NO: 93620 - protein, 212 aa, Glycine max
  Coding DNA Sequence Number=SeqID_1935
  Gene Ontology: Mol. function=protein dimerization activity
  Homolog annotation: Hit_ID=A5C1A1; Match level="QueryCoverage=75%, HitCoverage=38%, E-value=1e-30, Identity=38%"; Hit description =Putative uncharacterized protein
MDRTKEAIQRTFNDNKEKYKDTLKRWGCQLHHPLHAEIYYLNPRFYYTNPNNDKDDEVEDELSKCIDKISKDDEFVVEVHKELLMYKRSGERCESNRSAFEHIQSKKRRRLEHQKLQDLVYVKYNQDFVNHFNSRDVIDLVVLNDIDESNDWLLGELEEEKNAKDEASEPLKYTKRQTQMKKVNDANERGKKGRESSFLMLVGMKKNYKKMS

SEQ ID NO: 93621 - protein, 37 aa, Glycine max
  Coding DNA Sequence Number=SeqID_1936
MEKEGDACHPARPGELKRKQPPSGASGPGCYLNPHFY

SEQ ID NO: 93622 - protein, 89 aa, Glycine max
  Coding DNA Sequence Number=SeqID_1937
MMALAIACEEATSFKKPIIQYSYNLPQPKPLLLLPPPNTTASTATYAISLHRNLPGRTPSPLSSTSLPHQNPILQPHLRSQTTPKATLR

SEQ ID NO: 93623 - protein, 89 aa, Glycine max
  Coding DNA Sequence Number=SeqID_1938
  Homolog annotation: Hit_ID=Q4A3R5; Match level="QueryCoverage=88%, HitCoverage=84%, E-value=6e-07, Identity=41%"; Hit description =Capsule O-acetyl transferase
MTKVMTKSSKVNQRMSSRCSRRNQEQFKTQEEKLKNTSRFKKKDEFKNQDSRIKLQDSRIKLQESRSRFKIQDSRIKRRLNQDKYEKYF

SEQ ID NO: 93624 - protein, 176 aa, Glycine max
  Coding DNA Sequence Number=SeqID_1939
MKEDLRKLRDKNKDGAKSQANVVKSVEDDVFLATNDELRNGGKMKVEGIGSVSQTQVDVPSTCTTKDVPSNVLRQRSQAVKPLILCEWGYKRILRREKGDTKEFRRLVLCSFGKGRRETQKEFRRLVLGEFFLTKGEENEKMNSISFQSLENQKTLESFWYKEEEEVQGDLGLVKD

SEQ ID NO: 93625 - protein, 165 aa, Glycine max
  Coding DNA Sequence Number=SeqID_1940
  Gene Ontology: Cellular component=plastid chromosome; Biological process=positive regulation of transcription, DNA-dependent
  Homolog annotation: Hit_ID=A7NVI7; Match level="QueryCoverage=45%, HitCoverage=42%, E-value=3e-12, Identity=42%"; Hit description =Chromosome chr18 scaffold_1, whole genome shotgun sequence
MDEYKMEELDNKKDFDIEYNPFMTVVLDDENITIIKSKSFVSTLGWDSNPNNDVYDFREMYVTPSDIDAYSIPKVLAPMPQKVVRLTDGKLAIKMSDYYFLCFEVPLPRTLFTTSHSHINIEIGNILPMIYQFLSELKHPTVYSLSPRTNVTPAMTKDVNGLFNV

SEQ ID NO: 93626 - protein, 220 aa, Glycine max
  Coding DNA Sequence Number=SeqID_1941
  Gene Ontology: Mol. function=phosphoprotein phosphatase activity
  Homolog annotation: Hit_ID=A7R8Y3; Match level="QueryCoverage=78%, HitCoverage=62%, E-value=3e-16, Identity=27%"; Hit description =Chromosome undetermined scaffold_3090, whole genome shotgun sequence
EMCSATDYKVKSIGGMCILIQMWAWERCTTLAPKRTPPVIENKPLRHRWLQRGNQHIGNDELRVFRRKLDLMKRHEFFWEPYTATVMVALPPICVVGSVAWFAVNLHGITLKGKQDENWFHLLAPMISQWNNRAEFRVDVYPRQEGLLGFNSDYLVWYRRKTKMFVDPNNANTAALGEVVETLQYMVSPQGRNTWTIDDLVPYVDKLAIISEEQERITEP

SEQ ID NO: 93627 - protein, 142 aa, Glycine max
  Coding DNA Sequence Number=SeqID_1942
  Homolog annotation: Hit_ID=Q2A9I2; Match level="QueryCoverage=67%, HitCoverage=61%, E-value=9e-09, Identity=36%"; Hit description=GRF zinc finger containing protein
  Pfam annotation: Domain name=zf-GRF; Domain location=57-97; Score =30.6; E_value=5.5e-06; Accession=PF06839.3; Description=GRF zinc finger
  Subcellular localization annotation: CTP_CleavageSite=39; ConfidenceScore=5.67e-01
MVFCCIVFVCSRTSASLWVSSFSKGTFFAGVKVLLSSVNGAMEKSSSSYTIEARSRVFCLCNVEAPLVTSWTEDNPGRRFYGCGRKGCNYFKWHNLVANIHQKKIIVALMKKVDELKLREKDLQSRISEDEGKIIRIVLVVS

SEQ ID NO: 93628 - protein, 200 aa, Glycine max
  Coding DNA Sequence Number=SeqID_1943
  Homolog annotation: Hit_ID=Q7F099; Match level="QueryCoverage=17%, HitCoverage=4%, E-value=2e-07, Identity=79%"; Hit description =Plectin-like protein
MLKDDLRNMERSKKREGVDMTYFKNVIFNLLETGINFNRAVGKETRLVRLENVDDLMSYQMIFKKHNIRHMKNGIHCTSAHASMRSLPIQLLCFKQLFPSNVDEIGVWSLQGIRNHPEKNVVNLNVKMNPNPLSLKHQILQSIHLESLGMMCLKVSTLDPSDSVLFQLHINHEAKLYQILTLIDKVLYHWGKYVLLFCIF

SEQ ID NO: 93629 - protein, 108 aa, Glycine max
  Coding DNA Sequence Number=SeqID_1944
MPESMKKRKGSTAAGHRRHGTSGAVTSFGYRKDIDGQWIRKQDLPSLIPYELLFELRGLQVFVGDRFDAMDSRLDAMDARFEGMDSQITQLEDVIGFIHRCFDPPTTL

SEQ ID NO: 93630 - protein, 255 aa, Glycine max
  Coding DNA Sequence Number=SeqID_1945
MAFIISKSCIHSVFRDSYKNRYLMLVVPSQFKIHTFHRVTTIGYLHYLLVKQANIFTHAPNFHVLSLIDIAYLFEVYDLASQVTQFVQSIQFKPISNKHHYHKGHHAHNRPLLSQIVNALHHQAKAVVKALQHRHYNITTLHGWPDGAEGAGAGTSASVGAGAEVEAYEGALALALRDPRNAKLLAGLKDSKVSESDTTPPAMRNAVISVGNPSLEELDWAIWEIWLEMIGPASISIFITSPYTNLTLSMLRSEV

SEQ ID NO: 93631 - protein, 1519 aa, Glycine max
  Coding DNA Sequence Number=SeqID_1946
  Gene Ontology: Mol. function=ATPase activity, coupled to transmembrane movement of substances; Cellular component=integral to membrane; Biological process=response to nematode
  Homolog annotation: Hit_ID=A7PK05; Match level="QueryCoverage=92%, HitCoverage=99%, E-value=0.0, Identity=71%"; Hit description =Chromosome chr15 scaffold_19, whole genome shotgun sequence
  Pfam annotation: Domain name=ABC_membrane; Domain location=315-585; Score=102.3; E_value=1.4e-27; Accession=PF00664.14; Description=ABC transporter transmembrane region
  Pfam annotation: Domain name=ABC_membrane; Domain location=940-1217; Score=79.4; E_value=1.2e-20; Accession=PF00664.14; Description=ABC transporter transmembrane region
  Pfam annotation: Domain name=ABC_tran; Domain location=1289-1472; Score=144.0; E_value=4.1e-40; Accession=PF00005.18; Description=ABC transporter
  Pfam annotation: Domain name=ABC_tran; Domain location=659-830; Score= 127.2; E_value=4.7e-35; Accession=PF00005.18; Description=ABC transporter
  Pfam annotation: Domain name=MMR_HSR1; Domain location=1290-1389; Score=-11.3; E_value=0.012; Accession=PF01926.14; Description=GTPase of unknown function
  Pfam annotation: Domain name=SMC_N; Domain location=648-833; Score= -129.7; E_value=0.043; Accession=PF02463.10; Description=RecFRecNSMC N terminal domain
  Pfam module annotation: Pfam domain module=ABC_membrane::ABC _membrane::ABC_tran::ABC_tran::MMR_HSR1::SMC_N; Domain location=315 -585::940-1217::1289-1472::659-830::1290-1389::648-833
MYLYDIDINDRLTLTEFKSLFWTSWQPLESTCLLEHIILPVELGFLVILLFQLLRKYVSQFSKQTKVPDGATKMMHPTAIKFGFAYKLTFVCTTLLLVVHSSQLLLMLNNETQCTSKLQAFTSEIVQVLSWSISLIAIWKISKSHTYFPWILRAWWLCSFILCIITTALHAHFSVINNGQIGLRECADFLGLLASTCLLVISTRGKTGTVLLATNGASEPLLGEKAERHSECLKESPYGKATLLQLINFSWLNPLFAVGYKKPLEQNDIPDVDINDSAEFLTCSFDESLRQVKEKDGTANPSIYKSIYLFARKKAAINALFAVVNASASYVGPYLITDFVDFLGEKGSRGLKSGYLLSLAFLCAKMVETIAQRQWIFGARQLGLRLRAALISHIYQKGLHLSSRSRQSHTGGEIMNYMSVDVQRITDFVWYVNVIWMLPIQISLAVFILHTNLGLGSLAALAATLAVMTLNIPLTKIQKRYQAKIMDAKDNRMKATSEILRNMRTLKLQAWDRQFSQRIEALRQIEYNWLMKSLRQAAFSAFIFWGSPTFISVITFWACMFMGIELTAGRVLSAFATFRMLQDPIFSLPDLLNAIAQGKVSVDRIASFLREEEIQHDVIENVAKDKTEFDIVIEKGRFSWDPESKTPTIDEIELKVKRGMKVAVCGSVGSGKSSLLSGLLGEIYKQSGTVKISGTKAYVPQSAWILTGNIKDNITFGKEYNGDKYEKTIEACALKKDFELFSCGDMTEIGERGINMSGGQKQRIQIARAVYQDADIYLFDDPFSAVDAHTGTHLFKECLMGILKEKTIIFVTHQVEFLPAADLILVMQNGRIAQAGKFEDLLKQNIGFEVLVGAHSKALESIIVAENSSRTNLNSIAEEGESNFSSKPSHQHVQTQHDSVQDNPPEGKGNDGKLVQEEERETGSIAKEVYWEYLTTVKGGILVPLILLAQSSFQILQIASNYWMAWVCPTSSDAKPIFDMNFILLIYMALSVAGSFCVLLRAMMVLNAGLWTAQTLFTKMLHSVLRAPMAFFDSTPTGRILNRASTDQSVLDLEMANRIGWCAFSIIQILGTIAVMCQVAWQVFVIFIPVTAVCIWYQRYYTPTARELARLAQIQITPILHHFSESLAGAASIRAFDQEGRFIYTNLLLVDGFSRPWFHNVSAMEWLSFRLNLLSNFVFAFSLVMLVSLPEGIINPSIAGLAVTYGINLNVLQASVIWNICNAENKMISVERILQYTNITSEAPLVIEDSRPPSNWPETGTICFKNLQIRYAEHLPSVLKNITCTFPGRKKVGVVGRTGSGKSTLIQAIFRIVEPREGSIIIDNVDICKIGLHDLRSRLSIIPQDPALFEGTVRGNLDPLQQYSDIEVWEALDKCQLGHLVRAKEEKLEFPVVENGDNWSVGQRQLFCLGRALLKRSSILVLDEATASVDSATDGVIQNIISQEFKDRTVVTIAHRIHTVIDSDLVLVLSDGRVAEYDEPSKLLEKEDSFFFKLIKEYSGRSHNFSNLATQHVQSREQL

SEQ ID NO: 93632 - protein, 154 aa, Glycine max
  Coding DNA Sequence Number=SeqID_1947
  Pfam annotation: Domain name=XYPPX; Domain location=102-106; Score =2.2; E_value=75; Accession=PF02162.8; Description=XYPPX repeat
  Pfam annotation: Domain name=XYPPX; Domain location=34-38; Score=1.9; E_value=90; Accession=PF02162.8; Description=XYPPX repeat
  Pfam annotation: Domain name=XYPPX; Domain location=39-43; Score=1.6; E_value=1.1e+02; Accession=PF02162.8; Description=XYPPX repeat
  Pfam annotation: Domain name=XYPPX; Domain location=45-49; Score=1.9; E_value=92; Accession=PF02162.8; Description=XYPPX repeat
  Pfam annotation: Domain name=XYPPX; Domain location=50-54; Score=1.2; E_value=1.5e+02; Accession=PF02162.8; Description=XYPPX repeat
  Pfam annotation: Domain name=XYPPX; Domain location=55-59; Score=1.2; E_value=1.5e+02; Accession=PF02162.8; Description=XYPPX repeat
  Pfam annotation: Domain name=XYPPX; Domain location=75-79; Score=1.2; E_value=1.5e+02; Accession=PF02162.8; Description=XYPPX repeat
  Pfam annotation: Domain name=XYPPX; Domain location=81-85; Score=1.9; E_value=92; Accession=PF02162.8; Description=XYPPX repeat
  Pfam module annotation: Pfam domain module=XYPPX::XYPPX::XYPPX::XYPPX: :XYPPX::XYPPX::XYPPX::XYPPX; Domain location=102-106::34-38::39 -43::45-49::50-54::55-59::75-79::81-85
MSNRKDNTDDESSERGIFSHLGYPSAPPYPPPHGYPPSGYPPPGGYPPTAYPPPAYPPPGVYPHSGYYPSEYPPAYPPPGGYPPTTYPHSGYHPPAYPAPHGYPPAAPPYPAGATQTQVPSSSNYDVGSVTWADLRAAPLQSAMEVTALGHKPS

SEQ ID NO: 93633 - protein, 75 aa, Glycine max
  Coding DNA Sequence Number=SeqID_1948
MGSIGDQEGQWPRTVTSIALWRGAALSPSDRRLRAKATRGVGAVHEGAAGSARDVGTSASALGLSTTGDAPAAGA

SEQ ID NO: 93634 - protein, 69 aa, Glycine max
  Coding DNA Sequence Number=SeqID_1949
MGIGRMRGGVGEGVTEKEKLNRNEGCGSGSVGLCAVEKTLSSENGRRKESRNFGVLKKKERIRKEFGAN

SEQ ID NO: 93635 - protein, 74 aa, Glycine max
  Coding DNA Sequence Number=SeqID_1950
MGIWKRRVRFEVATLHTCPSRMGATPLRSAAIAATIDNYAFCTLLRSIGCGQLWIGGKASVASYVCSLNSPQET

SEQ ID NO: 93636 - protein, 76 aa, Glycine max
  Coding DNA Sequence Number=SeqID_1951
MGVAARVVVVVSMTMMTVMGSNNGGDDGGDGGGGGMMIVTLVVVEWPIIDLIFKTMGGGMVEEVAITGVVVVVVKE

SEQ ID NO: 93637 - protein, 142 aa, Glycine max
  Coding DNA Sequence Number=SeqID_1952
  Homolog annotation: Hit_ID=A5AYQ8; Match level="QueryCoverage=56%, HitCoverage=10%, E-value=8e-07, Identity=36%"; Hit description =Putative uncharacterized protein
  Pfam annotation: Domain name=zf-C2HC_plant; Domain location=18-73; Score=42.0; E_value=2.2e-09; Accession=PF07567.3; Description =Protein of unknown function, DUF1544
MLNSEGSSLFKPIGDRVDAFWKWNSLKDKNNRKSVTCDFCHKTTTRGISRAKRHQLQIKGDVGSCKKVPEDVKLEMIAAYEKKIAETAAYMEAMQEEDEEEEDGILEIARLKSGKKRPTTSNEASLTASNKRITTKKGPIDF

SEQ ID NO: 93638 - protein, 174 aa, Glycine max
  Coding DNA Sequence Number=SeqID_1953
  Gene Ontology: Mol. function=oxidoreductase activity; Cellular component=cytosol; Biological process=metabolic process
  Homolog annotation: Hit_ID=A5BKL3; Match level="QueryCoverage=88%, HitCoverage=44%, E-value=4e-65, Identity=75%"; Hit description =Putative uncharacterized protein
  Pfam annotation: Domain name=ADH_zinc_N; Domain location=15-131; Score=-11.7; E_value=0.0073; Accession=PF00107.17; Description=Zinc -binding dehydrogenase
MTDKARNPFSLDLETSKKLFRVDLLKNKFGFDEAFNYKEELDVNATLKGYFPEGIDIYFENVGGKTLDAVLLNMRVHGRIPVCGMISQYNLTQLDGVTNLANLIFKRVKMEGLLVNDFYHLYPKFLDFVLPHIREGKVLYVEDIAEGLENGPAALVGLFSGRNVGKQVLVVARE

SEQ ID NO: 93639 - protein, 268 aa, Glycine max
  Coding DNA Sequence Number=SeqID_1954
  Homolog annotation: Hit_ID=A4PP05; Match level="QueryCoverage=69%, HitCoverage=52%, E-value=5e-18, Identity=32%"; Hit description=IMP dehydrogenase/GMP reductase, putative
MGHTNYCGCEAYIGTNVTQDSGLESYKWGAAALAHMYENLNDASKSTTRQLVGYITLLQCWIYEHFSFVSSASATKDYDERKPCVCRWKSGKALRVSMYHKHLDRLTSDALCWISYGDYHAFREFEFGYLQTIPPHPVVASLCIKDIDDRWIHFSKYIALVGQICVALGQCSPYYMEWFYMISHPFMSQAQPGDPPRHPPATAMDEAPEDAHADEACQAIVERLERLLNQSIVTKGTEAYIVIEKCVRIAKVSVSNEMSTFDQDEGDV

SEQ ID NO: 93640 - protein, 98 aa, Glycine max
  Coding DNA Sequence Number=SeqID_1955
MAQLSQGPYISSTRPLGLQSLTVGDIIDHQRKESRVSLAQNFLFEWLSVRKKNHTNTLPPQVAATYVWNPPHTGSLKCNLDADHFINQTQVWYRVLHS

SEQ ID NO: 93641 - protein, 132 aa, Glycine max
  Coding DNA Sequence Number=SeqID_1956
MNEELRREIRKYPLTCQRLVPSYGHQPTETSIMTRSPDKIKSIDGSKETLKLSVRISDLWFIGTPNKSEQAEMVFVDSDGTSLLENTGLLDVVAGQFEPGLLVDVIGVVEEVVFRQVSGKGRRVVFKLKDFT

SEQ ID NO: 93642 - protein, 103 aa, Glycine max
  Coding DNA Sequence Number=SeqID_1957
  Subcellular localization annotation: CTP_CleavageSite=50; ConfidenceScore=5.02e-01
MENEVHCEQQAFIQKLSVLVKLHFKQLVAPHRAHRTYSLPVIASSRSPTLASLRQAQGETPQQPGDGQQQATNAPPPPPEPLSSSTKWRPAQDVKEALLGGNL

SEQ ID NO: 93643 - protein, 143 aa, Glycine max
  Coding DNA Sequence Number=SeqID_1958
MASSAITQDFNSVSQNHYTSHYNYNVSTSDESIELEFDSLEDCDLDISDQNIDFTNNHVSIQVLSKGYLDIGNPIMQCKQCQAMMWDKLKDEVVLDVKLKLISNKENDGRIYNIPIVSEVAALITGDSDIGLTRDIILETQTE

SEQ ID NO: 93644 - protein, 58 aa, Glycine max
  Coding DNA Sequence Number=SeqID_1959
MGNSPADNKLKGRENEISGALGMLAGGCWDPTSTRDMINVVLIRLKHSSPYKLVLWMS

SEQ ID NO: 93645 - protein, 171 aa, Glycine max
  Coding DNA Sequence Number=SeqID_1960
  Homolog annotation: Hit_ID=A2Q6E1; Match level="QueryCoverage=48%, HitCoverage=42%, E-value=7e-09, Identity=40%"; Hit description =Putative uncharacterized protein
MWLNMFLKNPYTRGFLERFQDQGLCEAQVTIKEEIETISKRFEELDVCGKVTLKSKLREIAYPDQNSMCPSPSKGFIDNIVDVKADDNCGYQSISALLGMGEDSWSLVRNQLIKELDKWSDDYINLFGGTKRFEELRWSLLVDGLSKVTMDKWMEYNEDGICHCIKVHEDR

SEQ ID NO: 93646 - protein, 587 aa, Glycine max
  Coding DNA Sequence Number=SeqID_1961
  Gene Ontology: Mol. function=glutamate-tRNA ligase activity; Cellular component=cytoplasm; Biological process=tRNA aminoacylation for protein translation
  Homolog annotation: Hit_ID=A7P8T4; Match level="QueryCoverage=76%, HitCoverage=71%, E-value=1e-174, Identity=70%"; Hit description =Chromosome chr3 scaffold_8, whole genome shotgun sequence
  Pfam annotation: Domain name=tRNA-synt_1c; Domain location=65-390; Score=120.4; E_value=5.1e-33; Accession=PF00749.12; Description=tRNA synthetases class I (E and Q), catalytic domain
MGAVWFVKERAHETPDGEAVARNMQIGNRPDEGGGRKRRKKRWIRYNENKCPPEEGRKDHQKAEGGRFSLFPQLGSRYHGIMVLIGSLIGILYTSNLRITYTNPVMFIAASVLMRYFWNLLQVNVLLWTGPCLHVFGKELEKMKEDAKLKQLPPVYTGKWASATNEEVEEELAKGTPYTYRFRVPKGSLKINDQIRGEPYPCICKEAVSGFEPMTNKSPRHNFTAAPGLRWKIDLGGLGIVLKVSWNLDTLGDFVIMRSNGQPVYNFCVTVDDATMAISHVIRAEEHLPNTLRQALIYKALGFPMPYFAHVSLILAPDRSKLSKRHGATSVGQFREMGYLPEAMVNYLALLGWGDGTENEFFTLDQLVEKFTIERVNKSGAIFDSTKLRWMNGQHLRARPSEELTKLIGEYWKTSGLLTVSDGSFIDEAVQLLKDGIDLINDADKALANLLSYPVYSTLQSDEAESVLQDNLSEFAASLLAAYDSGDLVAALEEGHAGWQKWVKGFGKLLKRKGKSLFMPLRLLLTGKIHGPDMGASVVLLYKAGTSNAVAPDAGFVTLDERFKILGQINWETLSKDQTVKETADPV

SEQ ID NO: 93647 - protein, 87 aa, Glycine max
  Coding DNA Sequence Number=SeqID_1962
  Gene Ontology: Mol. function=hydrolase activity, acting on glycosyl bonds; Cellular component=extracellular region; Biological process =cell wall organization and biogenesis
  Homolog annotation: Hit_ID=O81798; Match level="QueryCoverage=71%, HitCoverage=17%, E-value=3e-12, Identity=51%"; Hit description =Putative polygalacturonase
MVATTFRTSFSSSVGTNTIYNVINYGAKGDGRSDDSQAFLRAWQSTCGAQGAATLLIPPNRVFLVSSLILKGPCSAAIQIQTGMPIE

SEQ ID NO: 93648 - protein, 220 aa, Glycine max
  Coding DNA Sequence Number=SeqID_1963
  Gene Ontology: Mol. function=oxidoreductase activity, acting on sulfur group of donors, disulfide as acceptor; Cellular component =endoplasmic reticulum membrane; Biological process=protein thiol -disulfide exchange
  Homolog annotation: Hit_ID=Q9C7S7; Match level="QueryCoverage=64%, HitCoverage=39%, E-value=1e-41, Identity=52%"; Hit description =Endoplasmic oxidoreductin-1 precursor
  Pfam annotation: Domain name=ERO1; Domain location=1-198; Score= -98.6; E_value=7e-09; Accession=PF04137.6; Description=Endoplasmic Reticulum Oxidoreductin 1 (ERO1)
MVRDPLDLRRYAKTEDGDDLTQALVEEIIEKCLGFEVEQRSLVLIFKPPAFFFGILAHPCYSNTFHYELEKNWGQNLTLMYDRVLRYPDHVRNLYFTFLFVLRAVTKLLYNPKLQAACPIPFDEANLWKGQSGPELKQKIQQQFRNIRALLWLSLLECERVRSELPVDEDNRHQLQRNEVIALTNLLNRLSESFKFVHEVGPTVERIMEGGHFSAHTRTD

SEQ ID NO: 93649 - protein, 242 aa, Glycine max
  Coding DNA Sequence Number=SeqID_1964
  Homolog annotation: Hit_ID=A7UQU7; Match level="QueryCoverage=47%, HitCoverage=21%, E-value=3e-14, Identity=34%"; Hit description=IMP dehydrogenase/GMP reductase, putative
MDCRSSSLSPPPSQLHSFTNKSATHVHVLDEASRTTTRQIGGYLTLLQCWIYEHFPSVHQCVTDNAYEETSPHVCQGLMMKAHMKGITGASYRARCDTLTVTDVCWLPYTDHREVRGFELISSFQERVVRQFGYIQTIPLSPISASLSYDDIDDRWMHFSDHVAATGEICVVPGQVMSLNIHLPQSMTNDYEGYKAITESLERVLNLRMITEGTELYDIMEDCIKIARGGASADGTVRARQR

SEQ ID NO: 93650 - protein, 100 aa, Glycine max
  Coding DNA Sequence Number=SeqID_1965
MARTRDLGRAIGRLVGRDRPDDQDAADVPERRRLTASARRLQVHQMTAEGRDMAEDVADMTNHVPELAAEAPEMRADVQGADGGEGSDGDDAAEGFPGGP

SEQ ID NO: 93651 - protein, 713 aa, Glycine max
  Coding DNA Sequence Number=SeqID_1966
  Gene Ontology: Mol. function=transferase activity; Cellular component= mitochondrial outer membrane; Biological process=glycolysis
  Homolog annotation: Hit_ID=Q9FVD3; Match level="QueryCoverage=95%, HitCoverage=96%, E-value=0.0, Identity=74%"; Hit description =Hexokinase
  Pfam annotation: Domain name=Hexokinase_1; Domain location=37-241; Score=222.1; E_value=1.3e-63; Accession=PF00349.12; Description =Hexokinase
  Pfam annotation: Domain name=Hexokinase_1; Domain location=535-707; Score=45.8; E_value=1.1e-14; Accession=PF00349.12; Description =Hexokinase
  Pfam annotation: Domain name=Hexokinase_2; Domain location=244-491; Score=273.7; E_value=3.9e-79; Accession=PF03727.7; Description =Hexokinase
  Pfam module annotation: Pfam domain module=Hexokinase_1::Hexokinase _1::Hexokinase_2; Domain location=37-241::535-707::244-491
MGKVAVGTAVVCAAAACVAAALVVRHRTRSSGKWGRATAIAKELEEQCWTPISKLRQVADALDVEMHAGLASEGGCKLKMLITYVDNLPSGDEKGLFYALDLGGTNFRTLRVHLGGKEKGVVKIESEEVSIPPHLMTGSSQELFDFIASKLAKFVSSEPEELHPPPGRQRELGFTFSFPVKQTSIASGTLIKWTKGFNIEDAVGEDVVGGLTKSLEKIGLDMRVAALVNDTVGTVARARFSNQDVIAGVILGTGTNAAYVECAHAIPKWQGLLPKSGEMVINMEWGNFCSSHLPLTEYDQALDAESLNPGEQIFEKIVSGMYLGDIVRRVLLKMAEEVDFFGDTVPPKLRIPFVLRTPDMSAMHHDTSSDLKVVGNKLKDILEINNTSLKTRKIVVELCDIVATRGARLSAAGIFSILKKIGRDTVKDGKKQKSVVALDGGLFEHYAKFRSSLESTLKELLGDEADETVGIEHSNDGSGIGAALLAASNSQWTKSTVKLFLGLCSSCCKCNIAASPPITVALVARHHMRSSGKWGRVVAIMKEFEEQCGTSIAKLRHVADAMNVEMHVGLASEGDNKLEMLITYVDNLPSGEFLLGFSYYLCESEKVSIPPHLMTGSSHELVDFKAAKLAKFVSSEPEELHPPPGRQRELGFTFSFPVRQTSIASGNLIKWTKSFNIEDMVGEDVVGELTKSFEKIGLDKPVAALGSVTSLSF

SEQ ID NO: 93652 - protein, 69 aa, Glycine max
  Coding DNA Sequence Number=SeqID_1967
  Subcellular localization annotation: CTP_CleavageSite=42; ConfidenceScore=5.46e-01
MRPCSAPRKALPWSTRYVAQRGARQQQGSAPDAGTSGSALPLSATGSAQRVARLVVPLTRTRLRRLCIF

SEQ ID NO: 93653 - protein, 280 aa, Glycine max
  Coding DNA Sequence Number=SeqID_1968
  Gene Ontology: Mol. function=DNA binding; Cellular component=integral to membrane; Biological process=regulation of transcription
  Homolog annotation: Hit_ID=A7PEE6; Match level="QueryCoverage=25%, HitCoverage=17%, E-value=2e-25, Identity=77%"; Hit description =Chromosome chr11 scaffold_13, whole genome shotgun sequence
  Pfam annotation: Domain name=NAM; Domain location=178-272; Score= -56.9; E_value=0.036; Accession=PF02365.6; Description=No apical meristem (NAM) protein
  Pfam annotation: Domain name=PB1; Domain location=26-116; Score=42.5; E_value=1.5e-09; Accession=PF00564.15; Description=PB1 domain
  Pfam module annotation: Pfam domain module=NAM::PB1; Domain location =178-272::26-116
MKTSVGLMFKDSIKLLGVDSFYREQKHDNQLSYVGDDTKILAVDHSVKFPAFLFKVVTLYDSLPQDLTLKYQPSDKDLNALIYVTNDNDLKHMMHEYVRLYHPNLKPKTRAFVAALNAEVRRTKGRLMDELPKLQKRMHKKVLVLTLPERIQVIPNGIYGAIVQTAGWTATSSQSHIKFDSSVHLSLPNFDFGLGGYSYMHLTGLTRDGLSKNFFHRPSKAYTTGIRKRRKIQNEYDLQGAETRWHKTGKTRLVMVNGKQKGCKLSANCKLQVAICQLCT

SEQ ID NO: 93654 - protein, 465 aa, Glycine max
  Coding DNA Sequence Number=SeqID_1969
  Gene Ontology: Mol. function=drug transporter activity; Cellular component=membrane; Biological process=multidrug transport
  Homolog annotation: Hit_ID=A7PEG4; Match level="QueryCoverage=93%, HitCoverage=90%, E-value=1e-142, Identity=57%"; Hit description =Chromosome chr11 scaffold_13, whole genome shotgun sequence
  Pfam annotation: Domain name=MatE; Domain location=222-396; Score =71.1; E_value=3.7e-18; Accession=PF01554.9; Description=MatE
  Pfam annotation: Domain name=MatE; Domain location=47-207; Score =141.4; E_value=2.5e-39; Accession=PF01554.9; Description=MatE
  Pfam module annotation: Pfam domain module=MatE::MatE; Domain location=222-396::47-207
MCESKSEQRHDDKEKQTEELGGVLTRRSTIMWDVIGEAKSLWELAFPTALTGLIFYARSMVSMLFLGHLGDTELAAGSLAIAFANITGYSVLSGLSLGMEPLCSQAFGAKRPKLLSLTLQRCVIFLLFSSIPISLLWLNMSKVFILLHQHTHITQMAQTYLVFLLPDLVTNSFLHPIRVYLRAQNITHPVTLASLAGTLLHVPFNLLLVQRGLPGVAAASAASSFSILSLLVLYVWITWGPPGHVDRAEPGCGVMVDPTASVAAMGILLQTTSLIYVFPSSLGFAVSTRVGNQLGANRGPRARMSAVVAVFFAAVMGFSAVVFATAMRRRWGRMFTGDEGILRLTAAALPILGLCELGNCPQTVGCGVVRGTARPNVAANVNLGAFYLVGMPVAVGLAFWLEVGFCGLWLGLLSAQVCCAGLMLYMIGTTDWEYQACRAQLLTALDQGSDGHKQPLLAAVDNNNS

SEQ ID NO: 93655 - protein, 83 aa, Glycine max
  Coding DNA Sequence Number=SeqID_1970
MTISDSFTVVKFEHYVCSPITSILTVGNLDIMFELREIPFALKKKESNEDSTSGDFNLFSVSLTFGNSIGAVGGITGGMSGNR

SEQ ID NO: 93656 - protein, 58 aa, Glycine max
  Coding DNA Sequence Number=SeqID_1971
MNWRNDKLERKGEGLGVVKEEGESEKGREKVGGVGKREEQIATGIPSPNNASKSTCHS

SEQ ID NO: 93657 - protein, 109 aa, Glycine max
  Coding DNA Sequence Number=SeqID_1972
  Homolog annotation: Hit_ID=A5AYU6; Match level="QueryCoverage=67%, HitCoverage=13%, E-value=8e-13, Identity=44%"; Hit description =Putative uncharacterized protein
MEKSDKKNFKDKKAKKAYITWEDNNIDSSGDSENEVVNLSLMAKNYDSEEEDFLKKSWYIDSGCSKHMTKDASKFTHISPKKSGHVTYGDNNKDLKKIDYVMHVKKENK

SEQ ID NO: 93658 - protein, 35 aa, Glycine max
  Coding DNA Sequence Number=SeqID_1973
MNRNTRCSGMTVAIKMKSRVEIERMKKMSMKTEEK

SEQ ID NO: 93659 - protein, 54 aa, Glycine max
  Coding DNA Sequence Number=SeqID_1974
MSIAQAPLELVGLGSSSSMDSFASWKMNGIGMEKEEREEMPLQGEYESRRSSPP

SEQ ID NO: 93660 - protein, 641 aa, Glycine max
  Coding DNA Sequence Number=SeqID_1975
MDECFSVSSVITSISVTIEGACNTRAIPLHTCHSWSEHVLESWCMEVISIGGSSSEDTHHGASYNESSSLYRVKASRHTGEGTSCPRRRARPFAASGELVPITMILPLSASGGVRRGSGGGHVRVSPYVRCSHNPGSPLCIPVVAGYEWVRDAILKYKSSLTFAASVATLQCQVKLASPEDSYKYLFEVLGLIIPLNSFLCALLKHLNMAPSQLHPNSLAMVRAFEILCPFFNIQPSVSVFFFSFQMKLTDKIGWVSLNNVSKKLFEFDSNVFFRFKDHFFKVLATDVVADGFPLMFNRHGEPRFPFYRQSDPTRFKSFDKDLWTLVERVDKAILEQLSTSLDLRAILSLPLTSYPLAALDDKVRPVGRTVPPFVVAPAEGGQPTGPYKPSCPKVGCKVDAWCGSPYDYADVPSAPPVVEAPIADITTPDPSPHPSVPILEVSSIVVVVNVPTTSAGPVVVSSSPVNSYLLSVGLATASAPLMSPPPSSAPLIPTFGVLVMLIYCGAQVTGEWTTTPRGFAQGGILGSGGQTTKCLPRLVVSLSSCYAQGWTVMNCLRDKVESIMVERDELAKAARERETNKEHEEEFLVYKKEVVEQHGKGFNKAELDLGLFDPFKDIKDGVLLDEVETIAEEEVVVEEQ

SEQ ID NO: 93661 - protein, 291 aa, Glycine max
  Coding DNA Sequence Number=SeqID_1976
MKVQIQITGAKQVSEAHSATLHHQIIYRLQNHAINMSMPTSHENALFVLANNQEETPSIATFRRSVDGLVTSTFKGLDGASSNNSPEVFHSLMIKPKVKEDSRMSIFAVKADGRVIHTDKVDGHFIWDIAPEMCDSNCSSDEQDRGTYDETNDEDEGFWKPEPRPYSRAESDDFKEQTEESSIEAEKSYSDEDEEAGYMDISNILMAYSTEEPFYDSPKEEEPLIKDLDRHFQRMNQRFYLLNGLNDPSLKNTYVASLPEEIKLELNKMVAAAQMDFSTMSMGQIHQFTLE

SEQ ID NO: 93662 - protein, 143 aa, Glycine max
  Coding DNA Sequence Number=SeqID_1977
MAVQLIHDRVVMECLEGDWETLEGNERCRFCGTIRLTATSLVHPEEPAHTLQQPVEWILPTPTPYQLVEPVQVIEVSSSEEDLEEDPEELPPEPAVDALDFPEDDEDPLPDVDSPEDVMSASDADSTEESGLGGTTNNDDSSS

SEQ ID NO: 93663 - protein, 82 aa, Glycine max
  Coding DNA Sequence Number=SeqID_1978
  Homolog annotation: Hit_ID=Q2HTR6; Match level="QueryCoverage=62%, HitCoverage=12%, E-value=8e-08, Identity=51%"; Hit description=RNA -directed DNA polymerase , putative
EIKKTVWDCDGDKCPGLDGYDFNFKKFWHVVKGNFVRMGQEFHANGVFPRGGKLVAKLLSKRMNDVNLTRSGSLDTGHRVLG

SEQ ID NO: 93664 - protein, 67 aa, Glycine max
  Coding DNA Sequence Number=SeqID_1979
MTSFPVLPTFSSNKRWWRLRAYSFLGTRTRESRIALPPKDKRAPEHNVCLKVMEGGQEVLKEYTSQS

SEQ ID NO: 93665 - protein, 30 aa, Glycine max
  Coding DNA Sequence Number=SeqID_1980
MANTSCPIQLEPKTLNQVQFTQARVIIYYC

SEQ ID NO: 93666 - protein, 308 aa, Glycine max
  Coding DNA Sequence Number=SeqID_1981
  Gene Ontology: Mol. function=transcription regulator activity; Cellular component=nucleus; Biological process=regulation of transcription
  Homolog annotation: Hit_ID=A7R4Y3; Match level="QueryCoverage=56%, HitCoverage=67%, E-value=5e-32, Identity=46%"; Hit description =Chromosome undetermined scaffold_813, whole genome shotgun sequence
  Pfam annotation: Domain name=HLH; Domain location=132-198; Score =32.6; E_value=1.4e-06; Accession=PF00010.17; Description=Helix-loop -helix DNA-binding domain
MDEPWLKWVSILDTNDYHLSTECDMNSVEEPLEGENSVDPGELSWENHSPNSYLTKERTTLLSNSSSLEEINTSFDMTSLKQHASPQKPKSCILSFEDSTSVPITSKKTCQLYHGEHSKETQEELPNRKPLKRDTSFDHIMAERKRRENISRLFIALSALIPGLKKKCLFFRNNPIRNTMMDKASVLYNAIEHVKYLQQRVKDLEKDNKKRKTESVGCFKINKTNVADNVWACDDKPIKICPKVEARVSGKDVVIRVTCEKQKNILPKLLAKLEAHNLSIVCSNVLPFGNSALSITSIAKEKDNTSLK

SEQ ID NO: 93667 - protein, 62 aa, Glycine max
  Coding DNA Sequence Number=SeqID_1982
MITFSVLQATWTQGRSHAIGECRRMIGSETARSANTEVHVSVRHILREAKAPADALSKMGMR

SEQ ID NO: 93668 - protein, 178 aa, Glycine max
  Coding DNA Sequence Number=SeqID_1983
MKAFKDCVAKVGDINTKMDRGYVNCPTNEEWDKAKLKIVKHKLYTLYNEYVKLYSQKETTCNVASSQSSSQGTSSVNTFASGKSSTSQWLIMNEFIQYENETLSDVDKSHLDTYLEDQKLSSQYHPNLDLLQYWKENKARFLELALMAFVGKEDESVQIEKDSEATSNMESNVVIGNA

SEQ ID NO: 93669 - protein, 120 aa, Glycine max
  Coding DNA Sequence Number=SeqID_1984
  Subcellular localization annotation: CTP_CleavageSite=33; ConfidenceScore=5.10e-01
MPCAKLRTSKLTSAMSLPASLDRRAVACLVVVACVAVGCFALCRARPAMPCYPSKIYIGYSLCEKSYFDAFVAFQAKLPCGVYSQPSTDNKSTTNNKVNFTAIENGTRVVEAPSSLFMHK

SEQ ID NO: 93670 - protein, 87 aa, Glycine max
  Coding DNA Sequence Number=SeqID_1985
MTIITSTAMTIIVIVVAATITVNANDGGCENDNDDYGATATKVMVVEVVAVDDNNSDDDDDHGGSCNSDHGSDNDSHSDGDMLIEIF

SEQ ID NO: 93671 - protein, 56 aa, Glycine max
  Coding DNA Sequence Number=SeqID_1986
MEMQWKTNEKSSKDQRTTQVNQEQVKSSRMKKNSRLKKKVYNQESRFKNEEKTQSR

SEQ ID NO: 93672 - protein, 95 aa, Glycine max
  Coding DNA Sequence Number=SeqID_1987
MPILELYIKKDVVGGSAFHYTNSVRSCGHNLSNNETESPRNVNNLHEDEDDDDYLVSNSYVEDSLDEDDSVDGISNIDDEVAHMVQPVTIVQPRE

SEQ ID NO: 93673 - protein, 120 aa, Glycine max
  Coding DNA Sequence Number=SeqID_1988
MVIRKKKNKQGQFWHLIALLGAPAIMLGAPSNTQSLNHHGGFGLLPFLDKPISRNHLELWCGRGGASGMPVTVLLGTRLKGEAGWHDLDLDGGGGSLKERGESVGIWLVSKRKKGNCITW

SEQ ID NO: 93674 - protein, 62 aa, Glycine max
  Coding DNA Sequence Number=SeqID_1989
MEMEDHALKEVLVDTKEHEDVMVYWELDLTDDVAVVAKEELEMKMTEDKGEEDEEKKIYDNF

SEQ ID NO: 93675 - protein, 147 aa, Glycine max
  Coding DNA Sequence Number=SeqID_1990
MAGDIDSRKSTLGYLIKFVEGCDLAVQAAKVTLMGSSLFLSESHDEKDLTKYINREVDWVGEWIKILGSCYGVYMYMDEETKDKTRLDMARILIPEDASFPENFVDNEVSKEDGDVALFGACRPCIFFINGFFCFIKINVSGMEKEE

SEQ ID NO: 93676 - protein, 95 aa, Glycine max
  Coding DNA Sequence Number=SeqID_1991
MARSVSASCPYSRDLYGRELKWLLVIIPKVVISLLMVSRVPSGVANCRNLPFSGRATRDSQVRVPRKEYARSRHQHLFEENVGKTGKDVIYELFK

SEQ ID NO: 93677 - protein, 80 aa, Glycine max
  Coding DNA Sequence Number=SeqID_1992
MQCGTVSLKNLVGRLGVHNKSNHTLRPVGVTLFCKNAPTMWDWHKLRGSLKLGVFASKAYTPKSPLGPLPPDSGPTQKTF

SEQ ID NO: 93678 - protein, 44 aa, Glycine max
  Coding DNA Sequence Number=SeqID_1993
MVAGNATIEKPREQWDEEEKKMAWMNILEYQTARMQRRYGIPYK

SEQ ID NO: 93679 - protein, 97 aa, Glycine max
  Coding DNA Sequence Number=SeqID_1994
  Gene Ontology: Mol. function=protein binding
  Homolog annotation: Hit_ID=A7PGQ2; Match level="QueryCoverage=80%, HitCoverage=18%, E-value=3e-36, Identity=89%"; Hit description =Chromosome chr17 scaffold_16, whole genome shotgun sequence
MTVDLEFPNTTESYKLFSQRVIASDIKECVCRAPDTPYDESAYSNIPMTSYELPDGQTVEIGADRFKIPDVLFNPSLVQKYTKASCKSKRKKVPLMY

SEQ ID NO: 93680 - protein, 182 aa, Glycine max
  Coding DNA Sequence Number=SeqID_1995
NDEGFCVFVGIVISYIMMVEETKSMERLEAGRVPIHTSTMTLDGRIFGISILEEIPKEIANFCCSSIHDEEDEHSSEDIVEGDFLVVSKVANVRYDMGKGSVGALSGPKCGPPKRDDVYGMSSKIKVEGGLYQQNEGVCGPSIVKDKPILVTNIPQSQEEVDDVWCDKPLRIKSVAVKYFRD

SEQ ID NO: 93681 - protein, 77 aa, Glycine max
  Coding DNA Sequence Number=SeqID_1996
MSNYTEANLEGTQHMDLGLKFIVETLDDILHLHPKMRDSGVLLHTVKVITTQSKTVELEMGKCIYTKMRNNFLHDML

SEQ ID NO: 93682 - protein, 880 aa, Glycine max
  Coding DNA Sequence Number=SeqID_1997
  Gene Ontology: Mol. function=nucleic acid binding; Cellular component= ribonucleoprotein complex; Biological process=mRNA processing
  Homolog annotation: Hit_ID=A7PK71; Match level="QueryCoverage=55%, HitCoverage=67%, E-value=0.0, Identity=69%"; Hit description =Chromosome chr15 scaffold_19, whole genome shotgun sequence
  Pfam annotation: Domain name=RRM_1; Domain location=297-368; Score =94.0; E_value=4.6e-25; Accession=PF00076.13; Description=RNA recognition motif. (a.k.a. RRM, RB
  Pfam annotation: Domain name=RRM_1; Domain location=377-451; Score =21.5; E_value=0.0015; Accession=PF00076.13; Description=RNA recognition motif. (a.k.a. RRM, RB
  Pfam annotation: Domain name=RRM_1; Domain location=474-547; Score =40.9; E_value=4.6e-09; Accession=PF00076.13; Description=RNA recognition motif. (a.k.a. RRM, RB
  Pfam module annotation: Pfam domain module=RRM_1::RRM_1::RRM_1; Domain location=297-368::377-451::474-547
MPPKTAKRGSASSFSKRGGRGGRGTLKASQNQQQHEPAEETVKVEEKQQPVVVVVAEEEQHTVVVEEENPAVEEKRLVVEEKESVVVVEDKAIDMNQMAPEAVEEASHAANGLSVAKRFWLCLHLVVIKVLNGNCGFGFIVILYIAGNWNKCGQGGHLRLQFRHGNVVANSRKAIAQYDEEEVKESIDEYEKDERLDLEDNDPEYEPEEYGGVDYDEKELEQDEGHEVGNEVEEEVAEDNVGEEGDTGEEEVEDVHDELEGEEEHEHEHEHPDFADVEEEEHREVVKERRKRKEFEVFVGGLDKDATESDLRKVFGEVGVVTEVRLMMNPQTKKNKGFAFLRFETVEQAKRAVAELKNPVINGKQCGVTPSQDSDTLYLGNICKTWTKEALKEKLKHYGVTNVEDLTLVEDTNDEGKNRGFAFLEFPSRSEAMDAFKRLQRRDVVFGVDKLAKVSFADSFIDPGDEIMAQVKTVFIDALPPSWDEDYVRDLLRKYGEIEKIELARNMPAARRKDYGFVTFGTHDAAVKCADSITGTELGEGHKKAKVRARLSRPLQRGRGKHSSRGDYRSSRGSGMMTRPSWGRPAPHSFPSRSVRGVGSRTPPVRSVSVRDRRPMMSIPARSRPVPPPSRSYDRRPVAPAYPKSSMKRDYGRREDIPPPRSRVAVDYGSRVASVRRPSYRDYPARGPGYTELPRSTSRAAPRRGYVDDGYGQRFERAPPPPPPPHLSYREGRPRDYDALSGSKRPYAAIDDLPPRYADTGARQSRARLDYDYGDSASQYGDAYGDRLGRSSVGYGGGSRSSISSQDSHGMYSSRQGMSYGGGGSFGSGDVGGMYSSSYGGDYISRGSDVGGSSYSSVYSGRGVGGGSSYMGGGGSGSYY

SEQ ID NO: 93683 - protein, 127 aa, Glycine max
  Coding DNA Sequence Number=SeqID_1998
  Gene Ontology: Mol. function=metal ion binding
  Homolog annotation: Hit_ID=A7PT26; Match level="QueryCoverage=67%, HitCoverage=30%, E-value=7e-19, Identity=60%"; Hit description =Chromosome chr8 scaffold_29, whole genome shotgun sequence
MNHRPKSVANKPQYLQDYVKEVLQTNLSICKNMQGLGQKFKQPAGTSIDFSTFEESELLKVGDMDVYPIAIKADGSSSDHGDSKSNETPSSGSSNSQITQVVFEKEKGELQVKVVKQILVAYVIMLE

SEQ ID NO: 93684 - protein, 47 aa, Glycine max
  Coding DNA Sequence Number=SeqID_1999
MVFLGVFRSKLVVLGFMKRLNSYDDRWVRADVLGGDGGALNDGGGAV

SEQ ID NO: 93685 - protein, 148 aa, Glycine max
  Coding DNA Sequence Number=SeqID_2000
MAQNDWQAIDIDLKRAFEVFDEMQEEENQFKNIECMFYHSMDNKHWHKVITTECRESMHNNIFPELYLYTNAYLVIIPAYSMQALSLLNYILALIVAKFGYSVSWAGSAQMAGLLFVFGGATGLMLVIGLITMVVFYATWHPSVSSPN

SEQ ID NO: 93686 - protein, 121 aa, Glycine max
  Coding DNA Sequence Number=SeqID_2001
  Pfam annotation: Domain name=zf-CCHC; Domain location=71-88; Score =20.2; E_value=0.0014; Accession=PF00098.14; Description=Zinc knuckle
CINSKWRWGGDLHDHINKFNRLSSKALVQTLLVGRSTLNLDERGRNHSRRHDGLRGRSKSQSHPQRDMSNIQCYYCGENDHVQVRCKQMKEDLKKLRDMNKDGVNSQANVVKSVKDEVHAY

SEQ ID NO: 93687 - protein, 129 aa, Glycine max
  Coding DNA Sequence Number=SeqID_2002
MVRTRGLGRALGQVTRRGVGRGDHDDSDDAPQRRRPTASTRRQRVAVTADHVDEPVIPDPDVQDDPMEAPAAMEDIPVDIPADAGAEVAEDQPQGFPGGPSDPSVLTAYADHVACSERPELKLSSHGRK

SEQ ID NO: 93688 - protein, 98 aa, Glycine max
  Coding DNA Sequence Number=SeqID_2003
  Subcellular localization annotation: CTP_CleavageSite=27; ConfidenceScore=5.39e-01
MDHLIRKQPSNFPMAVSAIDGNNGGRRSNAKEKRTSRKKLSVQDEAETRRRTTPPSYAETRRRNAKKMPRSRNAKSSEEDGIAAAHKKKIEEAENEED

SEQ ID NO: 93689 - protein, 197 aa, Glycine max
  Coding DNA Sequence Number=SeqID_2004
MEVPLSYHRQWSPNYPNYVLFDYEGDKHFIKLHKYGNRFYFGDGLKELRRIHGIHESVLMRFVGRDKNTTFSVDIVGPLHQRAAPTIRHHVFTIDVSEDMIQQNYQLVLPPEASIYLTASKKYMVVDRGSGRHKKWMITMNNGLSCVTDAWIHYLGDCHLKAEDEVIFFYNIDQHLWEVLYRKQVTWDDTEDEADSP

SEQ ID NO: 93690 - protein, 662 aa, Glycine max
  Coding DNA Sequence Number=SeqID_2005
  Gene Ontology: Mol. function=transferase activity, transferring glycosyl groups; Cellular component=integral to membrane; Biological process=metabolic process
  Homolog annotation: Hit_ID=Q8S996; Match level="QueryCoverage=98%, HitCoverage=83%, E-value=0.0, Identity=76%"; Hit description =Glucosyltransferase-13
  Pfam annotation: Domain name=UDPGT; Domain location=5-466; Score= -62.7; E_value=1.9e-07; Accession=PF00201.9; Description=UDP -glucoronosyl and UDP-glucosyl transferase
  Subcellular localization annotation: CTP_CleavageSite=44; ConfidenceScore=5.10e-01
MEKTVHIAVVPGPGFSHLVPILQFSKRLVQLHPNFHVTCLIPTLVSPPSASISILQTLPPNINTIFLQPVKPEDLPQGATIETQIQLIVALSMPSIHQALKTLTSRTRFVALVADSSAFDALDFAKEFNMLSYIYLPISATTLSWYFYVPMLDKETSCEYRDFPEPIKIPGCVPIHGRDLNNIVRDRSSEVYKTFLQRAWRFRFVDGVLMNTFLEMETSPIRALKEEGRGYPPVYPVGPIVQSGGDDTKGLECETWLDKQQVGSVLYVSFGSGGTLSQEQINELACGLELSNYKFLWVVRAPSSLASDAYLSAQKDVDPLHFLPCGFLERTKEKGMVVPSWAPQIQVLSHSSVGGFLTHCGWNSILERVLKGVPFITWPLFAEQRMNAVLLCEGLKVGVRPRVSENGLVQREEIVKVIKCLMEGEEGGKMSGRMNELKEAATNALKEDGSSTKTLSLLALKWKSLFLQEQITELAYGLELSNHKFLWVVRAPSSLARDAYFSTQKDVDPMQILPSGFLEKTKEQGTVIPSWAPQIQVLSHSSVGGFLTHCGWNSTLEGVLKGVPLITWPLFAEQRMNAVLLCEGLKVGVRPRVSENGLVEREEIVKVIKCLMEGEEGGKMSGRMNELKEAATNALKEDGSSTKTLSQRRWSTMILGTNGCYM

SEQ ID NO: 93691 - protein, 249 aa, Glycine max
  Coding DNA Sequence Number=SeqID_2006
MKQDVNKNANNRTRTKTQTWTEYKEKDLDRIKTVSRAEALIPDDVILTRSGSLDTGYEDLDNATSNDEPVVPATEADGASVEADVYANEPRARGDVHDTGVDTPTDTGAQAVEDEPEGFLSGPRDPSVLTEYADHVARSVWTGEMMLTNCVFLYTSIKERPELKLSSHGRKVHSLGRSVPAIEGLVVGTGLSPLTACSIVIEAVPESNKHENAVTRKVILGRFPTSNDKPNIHNTLAVTVTIRGGLFVL

SEQ ID NO: 93692 - protein, 88 aa, Glycine max
  Coding DNA Sequence Number=SeqID_2007
MVVTIRYFKGCSRSSQELKSQLAAFLASSKSKESLAQNLKEVLQLLQQEVEEEPSKKEAESSETNDDQEDDPFYQNEDDCFGISLDDD

SEQ ID NO: 93693 - protein, 125 aa, Glycine max
  Coding DNA Sequence Number=SeqID_2008
  Pfam annotation: Domain name=zf-CCHC; Domain location=14-31; Score =13.5; E_value=0.014; Accession=PF00098.14; Description=Zinc knuckle
MAARKAKERKLPDSTCGRCGQTNHNIRSCKNIGVPIRPKKYVAPPTSNEDDHLLSQDEQALNEAEEAAAHVQQDPVEINLSQPNLSQDSDMELVVLATIVPPVARNKLNITRAKQMKVADKDNAI

SEQ ID NO: 93694 - protein, 424 aa, Glycine max
  Coding DNA Sequence Number=SeqID_2009
  Homolog annotation: Hit_ID=A7QCS8; Match level="QueryCoverage=77%, HitCoverage=34%, E-value=3e-71, Identity=47%"; Hit description =Chromosome undetermined scaffold_79, whole genome shotgun sequence
MAKVESSSSISMSMSRVVLEPHAQFDLTAHSRASSIRSLAIAHSKRHHTTLFYVGTHSGTLFSLSAEDSNYTDDDAVLRKLSFLRSVSVSDTAVESISVIEEFGKLLLLSDGALFLVDSELSNGATKLSFPKGVSLVTRRRFRNNGGGESEGFGSGLGSGSGLGLFQKLRMNSMKEVDVQSETGGGFVFAVVVGKRLILAELVLGNRNGKTERDDGGGGTLVILKEIQCVDGVVSAMVWLNDSIVVGTVNGYSLISCVTGQNSVIFSLPDVSRPPRLKLLHKEWRVLLLVDNVGVIVDPHGQPVGGSLVFRHGLDLVGEIDSYVVVVSDGKIELYHKRHCGCVQVLPFGGEGVGRCVVASEEDRGGRLVAVATATKGSTQWINVLLGLWINGLLSRGCSCGFVVVLTLRANAADVVANGVVDFF

SEQ ID NO: 93695 - protein, 542 aa, Glycine max
  Coding DNA Sequence Number=SeqID_2010
  Gene Ontology: Mol. function=receptor activity
  Homolog annotation: Hit_ID=A7QCS8; Match level="QueryCoverage=84%, HitCoverage=45%, E-value=0.0, Identity=77%"; Hit description =Chromosome undetermined scaffold_79, whole genome shotgun sequence
MVVCYQKLPSVEQIKDLLRKKNYKGAISLVEELESEGEMSKDLLSFVHAQVGFLLLFDLHFKEAVDHFLLSETMQPSEVFPFIMRDPNRWSLLVPRNRYWGLHPPPAPLEDVIDDGLMTIQRASFLRKAGVETIVDSDLFLNPANRADLLESAIKNISRYLEACREKDLTESVREGVDTLLMYLYRALNSVEDMERLASSINWCVVEELEQMLEESGHLRTLAFLCASKGMSSKAVHIWRILARNYSSGLWKDPSLENITQNSGENLISGRAIAAAEASKILEESSDQELILQHLGWIADISQVLAVNVLTSDKREIQLSPDEVVTTIDPQKVEILQRYLQWLIEDQDCNDTQLHTLYALSLAKSAIKAFESENISENLDSGNIGTRSLAMLKNSIFKIPVRERLQIFLQSSDLYDPEEVHDLIEGSELWLEKAILYRRLGQETLVLQILALNNETDEELTKSRNMIICCKRIELRCSTPVTAQDGRSFNDLIKNVKDTKRRGKRVFLLSFRDLGSPRLASGLPGAPSYFSLKEPARLLLQE

SEQ ID NO: 93696 - protein, 39 aa, Glycine max
  Coding DNA Sequence Number=SeqID_2011
MAAELGQQTVELSTLITRGANGSSGSVVLSYISKEKLAN

SEQ ID NO: 93697 - protein, 149 aa, Glycine max
  Coding DNA Sequence Number=SeqID_2012
  Pfam annotation: Domain name=zf-CCHC; Domain location=77-94; Score =28.5; E_value=2.4e-05; Accession=PF00098.14; Description=Zinc knuckle
MELQRLNENEETDKRKRIIALKVSSSMQEENEDEESEDEEDFSLSVKKFHKFVKKRRIERHQNFNHGKRFQEDSPILRCYKCNQLGHIKENCPSNEQWPEKNEKKSHEERRSKKAYIAWDDNDSSDGSEKEINLLSKNYKSDENISQED

SEQ ID NO: 93698 - protein, 103 aa, Glycine max
  Coding DNA Sequence Number=SeqID_2013
MKNWMRNSKCDVYLEAYLNGAHWQMVVILPKENLIVWFCSLHNRPNNYLKGIINRQKGSTECGYYVMYWMSTIILGSFRSNWETYFNDVRPLEAERFKAFRIQ

SEQ ID NO: 93699 - protein, 189 aa, Glycine max
  Coding DNA Sequence Number=SeqID_2014
MMKLLLNIMLVDIYLSKMELEMLLLNGTCNSPKQTSVPHWTAYVCHLYTSLTSSPENLMTWTILQNLCKVRDYYELKFKSGTNMQTDCSFQEWVTTRKAMFYAITRCSTLLLLREFIVSEFLFLCTFAAKRDPNDTENAMLGAVAGYSTFNIGCDVNTDIKTYIFYIVYDYNTDVEGLISTSVVRTVLM

SEQ ID NO: 93700 - protein, 87 aa, Glycine max
  Coding DNA Sequence Number=SeqID_2015
  Subcellular localization annotation: CTP_CleavageSite=42; ConfidenceScore=5.18e-01
MHTYLCHNGMTLPGGTDTRGRSALWSPGGMLLSSYVIHIYVRVVMLVRMIRTRLFAVARVKSCPGMHSSCTITSSSSCARTVGTPPG

SEQ ID NO: 93701 - protein, 69 aa, Glycine max
  Coding DNA Sequence Number=SeqID_2016
MWYHVSEKPHRALWAKLTIFWLSAYPTLSAASARLARQRIWHNTNIKVVRDQCAKRSDCLQPGSAHDWR

SEQ ID NO: 93702 - protein, 100 aa, Glycine max
  Coding DNA Sequence Number=SeqID_2017
  Gene Ontology: Mol. function=ATP binding; Biological process=protein folding
  Homolog annotation: Hit_ID=A9P8A5; Match level="QueryCoverage=64%, HitCoverage=49%, E-value=1e-15, Identity=64%"; Hit description =Putative uncharacterized protein
  Subcellular localization annotation: CTP_CleavageSite=58; ConfidenceScore=5.47e-01
MASTFLTLPTPFLHKTNAITFSDKRPSFLQRSSLKINAITKKWEPTKVVPQADRVLVRLEELSDNIGATCAHVKCFKRYSEVSSYNVLSLVFCCVSVSKN

SEQ ID NO: 93703 - protein, 448 aa, Glycine max
  Coding DNA Sequence Number=SeqID_2018
  Gene Ontology: Cellular component=chloroplast envelope
  Homolog annotation: Hit_ID=O80503; Match level="QueryCoverage=100%, HitCoverage=99%, E-value=1e-81, Identity=40%"; Hit description =Expressed protein
MAKLKTSIDSSFWDFNVASPQLHEGWVKSVPGDPFPLDGSVASRVLRPRQLSVIGNGLPLPVIVPSLSPTSPKDLGSFCLQSLLLKLANPRWWLTMTGQFRPRKLIADVKNEISNAEEFDLSTVKDVAKHFINKSLYSFGLTSQFAFPPSTSLLLAIEGHGEKERLRSKVMLPDHDLTLEAAWPQLFVDHKGKYWDVPESLSVDLSSLVSESGLRYHIGMHKNSVNPQAMNATNGNPPLSLLPGLCAKVAVSYEKIKYFWRDKGAAEQENEEALPYDVAPLLPGFGMEGACLALIPEKIQRVDARLDISSASAFAKKILNGSSSSTAYVSEQPSASPRLNLIFQQQGIERGSYRTLDEIEEVEEHFCNAYFANGYTCHHDLCPRNGDVAGPVVFRADSRIALESFARKNGVSVEDFICSLSYSLKDLESGKIVAWYSPKRKEGMVEFR

SEQ ID NO: 93704 - protein, 190 aa, Glycine max
  Coding DNA Sequence Number=SeqID_2019
MGEVDEVQERIKANIEALKEQMATMMSMKKIMEVNVATVAATSAVAEVDPTSPFGLNQINHPISDMVGQRGKELGSTGAPHFVQVQNKHPFPPCGLPPNYTPPHVAHTPDENVNNSTPILIENQQPQSNHARVSQPMREDHEIPHHNLADFEPCLRYAPEGQAIGGVSLPNTLEGPQFCPEPQPLALCPC

SEQ ID NO: 93705 - protein, 97 aa, Glycine max
  Coding DNA Sequence Number=SeqID_2020
  Pfam annotation: Domain name=zf-CCHC; Domain location=40-57; Score =31.2; E_value=3.8e-06; Accession=PF00098.14; Description=Zinc knuckle
MHCVIDYMVMKFQKFVKKRRIERRQNFNDGKRSQEDSQILRCYKCNQLGHIKANCPSNEEWLEKSVRKGMRKEGPRRLTLHGMTMTYPMVQKRRSTF

SEQ ID NO: 93706 - protein, 370 aa, Glycine max
  Coding DNA Sequence Number=SeqID_2021
MGQLQRQAFRKAYGEWASFIDILALLIFGGVFFPNVDGLVDLAAIDAFLTYYDHKESPVIAMLADIYDTFDRRCEKTRFANVPLIGTRGCISYNPVLAIRQLGYPMRVTTRGRARACHFMRTELRGSNNGPIGGYRKWLKAHVQGLDWLPSLRTTKREEVEAPEEDEEVQALRAELEQAQIVKERFKSAAFKIRKENAKLRGINIATTKALEQETKRARKEEHGRNKFHGALWGRNSELKLRREERDQSRAHSMVLKEELAACSRYKRNLSQRLCKTETNMLAIVSKYQEELNLAMAHEHKVADEYAQVYAEKEARGRVIDSLHQEATIWMDRFALTLNESQELPRLLAKAKAMADTYSTPEEIHGLLSY

SEQ ID NO: 93707 - protein, 103 aa, Glycine max
  Coding DNA Sequence Number=SeqID_2022
THLLLEVASPLSLPFSIPLPFIFQEAKESIDEEDPRPTSSNGAYITGLNSLTVPSGVSNCRNLPSSGGTMRDSMDASSEEGKREESPPMFIRGKRQKNQNGKG

SEQ ID NO: 93708 - protein, 125 aa, Glycine max
  Coding DNA Sequence Number=SeqID_2023
MVLGSWYLFHLTSPLLGIDGFYTLKVGLDGKIDGFKAHMVAKGYTQNDAQKRFITTVKVENLEKFMELIRMMNPPNQSQKNDDLEPVHRWIVMKFEYHVRNPIPNILTVGNFKIISELRGKPFAL

SEQ ID NO: 93709 - protein, 72 aa, Glycine max
  Coding DNA Sequence Number=SeqID_2024
MEMQLKAKEKRRGETPSTREYVEAKLHDDDKGDDKKLKDQSKNNSSESKINQRTTQEFKIRIKKNSRLKKKI

SEQ ID NO: 93710 - protein, 82 aa, Glycine max
  Coding DNA Sequence Number=SeqID_2025
  Subcellular localization annotation: CTP_CleavageSite=63; ConfidenceScore=5.32e-01
MNRLSAKGTLSALIVISSNYSGVFTPFPVLYGTLSARLRLACPYDVWVLKPMRLAPVLALSISCSSNWFCNLRLAANGGLSA

SEQ ID NO: 93711 - protein, 110 aa, Glycine max
  Coding DNA Sequence Number=SeqID_2026
MANKVSELNVEGLEETGAKAGAGTDEAGAYGATVEVERAEVGKAEDGGASDLLPLALLSKDNESEVTPLALHRAVMRAAKPSHEDLALSNVISEVWEVGAKLENDKTLQV

SEQ ID NO: 93712 - protein, 303 aa, Glycine max
  Coding DNA Sequence Number=SeqID_2027
MKEGIGHILDLTPIGEKRKESLKRLTLTSHTSMERTMKSTPKSYGSHSYPKKDQGQGILGVTPSKLKDDTGKTIEKQPPKASMQEKTSFINQDEATTSPSASESEEEKGEESSEEIYPQEEGQPLMVKEECKEVSVSSKSLAKKESHLAIKTNLKETSPLRQPPHLLLCKKTLVSIATPLGKKTFIGDMMNVLSGAALFCKITHAPNIFMIHVHRDSLGRNNQHENTERDQGVPTYPKRIKVITACKHINIDYLQYVSPVYILDYMSSVYKVPLVGMCHHDYWPPYEGPQFCANLAMRRNKKG

SEQ ID NO: 93713 - protein, 153 aa, Glycine max
  Coding DNA Sequence Number=SeqID_2028
MASRNENAPAIVYYNAYVADCDEGVEFKGINNVFVSIRRGMTFNVLKTKIQHKMSLNRVGDFSDDEDEILADNNNNDDNDDNGIQFIFQQTSTENVYRPYPNSADVGDNQVPDNPDYRHFFGPTLNMSIVHTKLRCLWHIHGIFLSNVLESHL

SEQ ID NO: 93714 - protein, 205 aa, Glycine max
  Coding DNA Sequence Number=SeqID_2029
MEEEFSLQEKNITMKIILHDLHSPPFSSKFLILLDIIKIFMIYTYRMHARARVMSEIEEVQEQMKADMEAMKEKMATMMEAMMSMKKIMEINATTAVDASIATEVDPTHPSGLNQVNPLVSDIVGQGGEALGSTDDPYFVQVQNKHSFPQYGLPPNYTLPNVAPLPMRMSTTPLPYSLRANNPNLIMHMSLNPWGRHMRHPETII

SEQ ID NO: 93715 - protein, 89 aa, Glycine max
  Coding DNA Sequence Number=SeqID_2030
GQDHLGLPSGVGTKHGQQKPIKERMQVGMGSRSTDRCPFSVLDKQRTSLQGSPAQAGEAPPEVPGDGEEAHEDEEMADLLDFLGGSGAS

SEQ ID NO: 93716 - protein, 233 aa, Glycine max
  Coding DNA Sequence Number=SeqID_2031
  Homolog annotation: Hit_ID=Q2PEW8; Match level="QueryCoverage=98%, HitCoverage=57%, E-value=1e-68, Identity=51%"; Hit description =Putative uncharacterized protein
  Pfam annotation: Domain name=SURNod19; Domain location=2-233; Score =106.7; E_value=7.1e-29; Accession=PF07712.3; Description=Stress up -regulated Nod 19
MVIDTRGAQDKKACTQCRCDNMNLPKDFYNVTRDIHNQRLTTNYKGGLFCCQDNLQCKQIEGFQGSRRMVSLRYKISWVDWNIYQIPVKVYILDSTDKVRSNGSKILHDCLAEYTIPAGGGGDSPHVQKANIPMENGGYLIYGTAHMHSGVVNATLYGQDGRTLCTSTPKYGTGKEAGNEKGYLIGMSVCYPQPGSIKIHDGEILTLESRYKNEFRTGAMGHFYIYLAEELPQ

SEQ ID NO: 93717 - protein, 155 aa, Glycine max
  Coding DNA Sequence Number=SeqID_2032
MASRKRKATASRPQPHYDTHRFTSEWNRYADNILSRNILPERSMKLFVTEMLTNLMEGSIGVALMKEFYANLYVLENKSPKQVRVRGHLIKFDADSLNTFLETLVVLEPGETLPAYSMLYRLRPDPQELAAQLCIPGPAIEAIEEGPHYSGTDLE

SEQ ID NO: 93718 - protein, 179 aa, Glycine max
  Coding DNA Sequence Number=SeqID_2033
MAPRKLSSKRSRKDATAEGTSAAPEFDSHRFRSAEHQQCFEAIKGWSFHRERRVQLRDDEYTNFQEEIALRRWTSLVTPMAKFDPDIVLEFYANAWPIEEGVRDMWSWVRGQWIPFDADALSQFLGYPLVLEEGQECEYGQRRNRADGFDEESIAQLLCIPGMPHTRHPLDPDKSNRAL

SEQ ID NO: 93719 - protein, 120 aa, Glycine max
  Coding DNA Sequence Number=SeqID_2034
  Homolog annotation: Hit_ID=A5C1K9; Match level="QueryCoverage=81%, HitCoverage=8%, E-value=5e-07, Identity=30%"; Hit description =Putative uncharacterized protein
MAYDREGRRYGHMTTNLSECINKGFEGLSQHSHNSVGQINVQYSALHYPCSHIIAACGYVSMNYYQYIDVVYTNEHILKAYSAQWWPLGNEAAIPSSNDAWTLILTQLQFVRKVGQNQQG

SEQ ID NO: 93720 - protein, 154 aa, Glycine max
  Coding DNA Sequence Number=SeqID_2035
SGVECPLILQLGPSSHTSDLTVDRARLIFGLVSHLDMNIGALISGHMTSIAQSNTSRLGFPALITALCRARGVVSDSLTFERLSPVINLAYIRKNCWNPEDLTVSIRGARRARARPAELPSTSAASTPASTSAAPSVLAQTNSQHFEAMLQSIH

SEQ ID NO: 93721 - protein, 149 aa, Glycine max
  Coding DNA Sequence Number=SeqID_2036
  Gene Ontology: Mol. function=aspartic-type endopeptidase activity; Biological process=proteolysis
  Homolog annotation: Hit_ID=O22104; Match level="QueryCoverage=40%, HitCoverage=24%, E-value=2e-09, Identity=46%"; Hit description=MRNA expressed from retrotransposon-like gene
MPFGEALQQMPLYSKFLKRLGELEIMPTKMTLQLADHSITRPYGVIEDVLVRVKHFIFPADFVTSLLLGGSGGNGSGSRGSGGKNQNMISPIECKPRAKRIFGHTLSRESQALSTQPLHLRLIWSAKLAKAELSQFQFDLNLAKRQPDR

SEQ ID NO: 93722 - protein, 106 aa, Glycine max
  Coding DNA Sequence Number=SeqID_2037
LFPEEPWCLPTWMAKSYLHPDFLSVVSLVTIFQRNERGFEAFSPHGQDHLGLPSGVETKHERQKPIKVLKDERKWGWGHDRPIVAPSLCETSRECRCKAAPQDANP

SEQ ID NO: 93723 - protein, 24 aa, Glycine max
  Coding DNA Sequence Number=SeqID_2038
MGVKCGIYGANSAEWIMSMQFFPS

SEQ ID NO: 93724 - protein, 132 aa, Glycine max
  Coding DNA Sequence Number=SeqID_2039
MRVHCYQASRRPSMTTDSPQLLLFPWTWSPVESPTVATYPLVGGRRGTHGCVFHGRKMHGVATNVYSRKTSEKLERCGLRTLSVKGSGVVFTHAEGCFPRSYVSLIAMRKSDQRSSLRTKRWLSCFDLFPQD

SEQ ID NO: 93725 - protein, 77 aa, Glycine max
  Coding DNA Sequence Number=SeqID_2040
  Subcellular localization annotation: CTP_CleavageSite=19; ConfidenceScore=5.32e-01
MTFHSAPMHSSSFFQILPRAQPRSVAPSGWLAKPVDWLSERMKISASQTFLINLKFFACPQANKEQLTGPPSDKNMQ

SEQ ID NO: 93726 - protein, 87 aa, Glycine max
  Coding DNA Sequence Number=SeqID_2041
MAPTRHPLYPDKSNRALGFPALITGLCQSYGVPVTPSKVIQPLITRAFIEKYWTPRQAQGDAHHVAGTPPPTWQADPAGPLGMERYL

SEQ ID NO: 93727 - protein, 95 aa, Glycine max
  Coding DNA Sequence Number=SeqID_2042
MAPKKLSTKRSKKNAPGKGSSAAPKFDSHCFWSAEHKQRFEAIRGWSFHRERRVQLREDEYTDFQEEIARKRWTPLVTPMAKFDPEIVLEFYANA

SEQ ID NO: 93728 - protein, 129 aa, Glycine max
  Coding DNA Sequence Number=SeqID_2043
  Subcellular localization annotation: CTP_CleavageSite=58; ConfidenceScore=5.65e-01
MVKVGTSYVPIHVSFSPKVGPGLPGAPVASVSIQLSPPCSATDGVVRNGKSTPRTSALASVAVTLRVTTTPAALNAPATGRVPFAIQAAQLLGRAIGAGLFAITPAGERGMCCKAIKLGNARVFPVTTL

SEQ ID NO: 93729 - protein, 126 aa, Glycine max
  Coding DNA Sequence Number=SeqID_2044
  Gene Ontology: Mol. function=transferase activity
  Homolog annotation: Hit_ID=Q603E2; Match level="QueryCoverage=71%, HitCoverage=31%, E-value=9e-14, Identity=38%"; Hit description =ATP:dephospho-CoA triphosphoribosyl transferase
MSVLLNQQTNAATNWALCYWPLQCPGLANFQQPLQYGLQQVLQQTTIADAACVYQGIRLVNPAGMGQRQEHDVSEAPQIDLLEAMRLASAQDMVARQYVDGYATIFSAVLPLYRELIRRWEVQPGH

SEQ ID NO: 93730 - protein, 140 aa, Glycine max
  Coding DNA Sequence Number=SeqID_2045
MNKRFTFLYTTCSVPWTLFLHVSRLLAEVAEIKRVGKKKTNPQEFYTGLATTRAYIQFPSDLRSLRFLFNLVKSFTSKDPQGMYPPLFSLNYLVDAPSTRTNPQEMYPLLFSVTTTQVDVPSTCTTKDVPSNVLRQSSQA

SEQ ID NO: 93731 - protein, 105 aa, Glycine max
  Coding DNA Sequence Number=SeqID_2046
GMMRIMKLAKYRLKALVEKDEGPSGEGQSPRVEKDEGPEAKTLSRLLITYQGNPCGVYPDLSSFTGSGVYPDLSSFIGSGVYPDLSSFTGSGVIQTFVACIKRSA

SEQ ID NO: 93732 - protein, 158 aa, Glycine max
  Coding DNA Sequence Number=SeqID_2047
MERRGGQGNRQPRRTLGDYAYQQGLKNYNNMVVELKPALLSLIDSHPFAGIDHEDPYTHLSTFMELCSTMGASDKDAKVVDLRAFPFSLVGTMMSKSLEEAIVIIDSIAASDYHSHHDRAPIQRKCIMELDTQNAILAKNKLLNQQIEALTKQICQLP

SEQ ID NO: 93733 - protein, 57 aa, Glycine max
  Coding DNA Sequence Number=SeqID_2048
MAPDRMQVQHMCKRDNESFKEYAQSNKPNRDSSTFIAPRIQPKCDMCLSQWSPGAFH

SEQ ID NO: 93734 - protein, 120 aa, Glycine max
  Coding DNA Sequence Number=SeqID_2049
MTNRGYSMNDRLEFILTVIRQDYTLNNLLEFILTMIPDGIRMKMKTYVEPFLQPPSCLFIGNKRWTSHSNSPRRAVASSLSFLVGPGAEKCPKSDHFALLLNILRISFCNVTKPYGLHDN

SEQ ID NO: 93735 - protein, 121 aa, Glycine max
  Coding DNA Sequence Number=SeqID_2050
MTRNKKRLVVEDEDRVALEKQIVVKDGTEKKKEEVTDVTSQESEKQIVVEEKEINDQEKEIGKEKSRSEKARCGSNAFQDYFDDAKESRVKQVSRIKIKIQDSRINNQESRFKNQEKTQSR

SEQ ID NO: 93736 - protein, 215 aa, Glycine max
  Coding DNA Sequence Number=SeqID_2051
MAPRKLASKRSRKDKAVEGTSSAPEYDSHRFRSAVHQQRFEAIKGWEEIGHRRWASLVTPMAKFDLEVVLEFYANAWPTEEGVRDMRSWMRGQWISFDADAIGQLLGYPLVLEEGQECEYGQRRNRSDGFDDEAIAQLLCIPRQDFARTAAGRRVRIMRTNMTTLTQIWMTLLLSNILPTDHNSDLPLPKCQLVYAILTRMSIHVAQLIAYAIYI

SEQ ID NO: 93737 - protein, 130 aa, Glycine max
  Coding DNA Sequence Number=SeqID_2052
MAYERGGDFLEDARKILNREAFPPGGSLVRSPVPAFRFTGVIPLLWPRLSHSTPDTQFRVGSSLQAGLYARTPRSVRPLRLIRGVSLEVMRRVKAKLKGTSFGDCAPPSQLPRFKELVAQRTFEKPPCKA

SEQ ID NO: 93738 - protein, 110 aa, Glycine max
  Coding DNA Sequence Number=SeqID_2053
  Gene Ontology: Mol. function=transferase activity, transferring glycosyl groups; Biological process=metabolic process
  Homolog annotation: Hit_ID=Q2HT79; Match level="QueryCoverage=99%, HitCoverage=36%, E-value=7e-30, Identity=82%"; Hit description=UDP -glucuronosyl/UDP-glucosyltransferase
MSAEQLLEFAWGLANSKKPFLWIIRPDLVIGDQPTNCRYIYNEWEIGIEIDTNVKREEVEKLVNDMMAGEKGKKMRQKIVELKKKAEEATTPSGCSFMNLDKFIKEVLLN

SEQ ID NO: 93739 - protein, 98 aa, Glycine max
  Coding DNA Sequence Number=SeqID_2054
MKLASTKSTPVARVCGLCSSADHHTDLCPSLQQFGVNEQPEAYATNIDNRPPQQQNQQQQNNYDLSSNRYNPECCWSKQAICSSSNTTTAVTTKTTSN

SEQ ID NO: 93740 - protein, 129 aa, Glycine max
  Coding DNA Sequence Number=SeqID_2055
  Homolog annotation: Hit_ID=Q6UUU1; Match level="QueryCoverage=46%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGRNPDRTIKIPGVSPWGAPLGALS

SEQ ID NO: 93741 - protein, 175 aa, Glycine max
  Coding DNA Sequence Number=SeqID_2056
  Homolog annotation: Hit_ID=UPI00006A2D9E; Match level="QueryCoverage =94%, HitCoverage=85%, E-value=4e-11, Identity=15%"; Hit description =UPI00006A2D9E related cluster
RLHALAFRGLHVLTFRGLHVLNFRGLHVLAVKGSCTFTFVGRHVLTFRGLHVLTFVGLHALAIRGLHVLTFVGLHALTFRGLHVLANRGLHALTLRGLHVFANRGLYALTFRGLHVLVNRELYALTLRGLHVLANREMHALTLRGLHVLANRGLHALTSRGLHILALRGAARPHL

SEQ ID NO: 93742 - protein, 48 aa, Glycine max
  Coding DNA Sequence Number=SeqID_2057
MAFVDNWVVGKEKSIDNVSTITIIVSLSIIGGTTWAARSLHLLGVFFE

SEQ ID NO: 93743 - protein, 67 aa, Glycine max
  Coding DNA Sequence Number=SeqID_2058
MSCWHAKLRGPLGVTFAPKPLHLPNLKHLCTFYCVCIACLHLHCFISRTIQMNALSGPCCAKRVHPY

SEQ ID NO: 93744 - protein, 134 aa, Glycine max
  Coding DNA Sequence Number=SeqID_2059
  Gene Ontology: Mol. function=tetracycline:hydrogen antiporter activity; Cellular component=integral to membrane; Biological process=response to antibiotic
  Homolog annotation: Hit_ID=A6T506; Match level="QueryCoverage=97%, HitCoverage=33%, E-value=2e-43, Identity=70%"; Hit description =Putative drug efflux protein
LADRRGAVPALTLIFIALAILLVVFQFTASMHYPALLTVLVMGVFAFANVPGLQVYVVQKAEHYAPGAVDVASGLNIAAFNIGIALGSTVGGHIVEHYGLAQTPWVGAVIVFAALLLVRLSGQLDKPRTAAITE

SEQ ID NO: 93745 - protein, 178 aa, Glycine max
  Coding DNA Sequence Number=SeqID_2060
  Homolog annotation: Hit_ID=A5AZ88; Match level="QueryCoverage=82%, HitCoverage=13%, E-value=1e-08, Identity=30%"; Hit description =Putative uncharacterized protein
MERSMIDATSGGALGDMTPDEARNLIEKMASNSQQFNARNGAIILRGVHEVAMDSSSSTENKKFEGKLDALVNLVTQLAMNQKSAPVARIFVLLYSNLESMSNLKLNAANIYNRPPQQQNQQQQNNYDISSNIYNPGWRNHPNLKWTSPPQQQQHVPPFQNAAGPSKPYVPPPIQQQQ

SEQ ID NO: 93746 - protein, 226 aa, Glycine max
  Coding DNA Sequence Number=SeqID_2061
MDMNFGYLISHQISLTAQHDSSRLRLPALITALCKARGVQSNSRSLENFCPTINLAYIKKNCWNLDDPTMTFRGPRKAKGKRSEVPTTSAPPETAAPSSSTAPVPPIQTPSLHRGQSIIMQSLQGLGLPSIMSMDEFDLQVAWPGAQPSPSGGAGASAAQEPEPEEPEEETSTDQIPEPSLAPIPDDAIPSAPASELKQPISQDSPATQVLDLNEHAQEQPQEQDI

SEQ ID NO: 93747 - protein, 27 aa, Glycine max
  Coding DNA Sequence Number=SeqID_2062
MVDDSLPRGLSGLKIAHWQREGFNKNF

SEQ ID NO: 93748 - protein, 185 aa, Glycine max
  Coding DNA Sequence Number=SeqID_2063
  Homolog annotation: Hit_ID=A5BSR3; Match level="QueryCoverage=81%, HitCoverage=48%, E-value=4e-12, Identity=33%"; Hit description =Putative uncharacterized protein
MKKWALAVDQNGVEDTVCDKYDISKKKWAQFCQTRRDPSWELLAEKTKKKLQEAAQSGSVDGVIDPPSPVRCHVKWKMARTNKTGEMTTEVAKEIAEKIDSFEKQATQGSFIPHGHQDVLAAAIGRPEHPGLVRAARAGVTIKQYFGSAPRTSRSASSLPPDELQQLTQQIRDQLEESITEKVTR

SEQ ID NO: 93749 - protein, 212 aa, Glycine max
  Coding DNA Sequence Number=SeqID_2064
  Homolog annotation: Hit_ID=Q2HW90; Match level="QueryCoverage=86%, HitCoverage=36%, E-value=5e-25, Identity=34%"; Hit description =Putative uncharacterized protein
MVEVSIEAIASLAQYYDQPLRCFTFGDFKLSPMVEEFEEILGCPLGGRRPYLFSGFYPSLARISKIVQISAQELDHRTQVDNGVVGISRKYLEAKARILAGKDEWAPFIDILALLIFGGVLFPNVDGLVDLAAIDAFLAYHNHKESPVVTMLADLYDTFDRRCEKSNTRIVCCTPALYVWLVSHLFRQEVRHACPLESHRSCIEKGGDKGIL

SEQ ID NO: 93750 - protein, 136 aa, Glycine max
  Coding DNA Sequence Number=SeqID_2065
MKLAKYRLKAQVEKDGGLSGEGQSPQTYQGNPCGVYPDLSSFTGSGVYHDLSSFTGSGVIQTFVACIKRSAPGVYPDLSSFTGSGVYPDLSSLTGSGVYPDLSSFTGSGVIQTSVACIKRSAPTQVHIIWYQSFGS

SEQ ID NO: 93751 - protein, 121 aa, Glycine max
  Coding DNA Sequence Number=SeqID_2066
MGSCRPSAYMIPPHRTGSRLCFKDIDDRWMHFSDYLASVGQICVVHGQCAPDYMDWFYMISHPFMKLAQPGDPPRHPAVMQDETYMEPDMPKYPVATIAIEEAPAQAPSDVEQPRHVVEAC

SEQ ID NO: 93752 - protein, 234 aa, Glycine max
  Coding DNA Sequence Number=SeqID_2067
  Gene Ontology: Mol. function=chloramphenicol O-acetyltransferase activity; Biological process=response to antibiotic
  Homolog annotation: Hit_ID=P62577; Match level="QueryCoverage=93%, HitCoverage=99%, E-value=1e-130, Identity=99%"; Hit description =Chloramphenicol acetyltransferase
  Pfam annotation: Domain name=CAT; Domain location=6-209; Score=528.7; E_value=6.6e-156; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQAGVIFLRQLLVPRNILSD

SEQ ID NO: 93753 - protein, 287 aa, Glycine max
  Coding DNA Sequence Number=SeqID_2068
  Gene Ontology: Mol. function=exonuclease activity; Biological process= DNA metabolic process
  Homolog annotation: Hit_ID=A8GAK4; Match level="QueryCoverage=94%, HitCoverage=66%, E-value=1e-128, Identity=87%"; Hit description =Nuclease SbcCD, D subunit
PGAVLCAIPFLRPRDLLTSRAGESGAQKQQALQEAIAEHYQALYQAACERRDRLGLPLPIVATGHLTTVGVTTSDSVRDIYIGTLDAFPAQAFPPADYIALGHIHRAQNVAKSEHIRYSGSPIPLSFDELGKAKSVFLVDFADGALQQVEALTIPQFQPMQLIKGDLAEIERQLQQFADYAGELPVWLDIEVATQDYLSDIQRRIQLLADELPVEVVLLRRSKEQRRQAIAQQDKETLNELSVNEVFERRLAQEADMPEARQQRMHQLFRQGEWKIDFTAEPFASNG

SEQ ID NO: 93754 - protein, 32 aa, Glycine max
  Coding DNA Sequence Number=SeqID_2069
MNDRALRATHREVDGELTIVTMMDIPGGGKSG

SEQ ID NO: 93755 - protein, 245 aa, Glycine max
  Coding DNA Sequence Number=SeqID_2070
  Homolog annotation: Hit_ID=A7UQU7; Match level="QueryCoverage=44%, HitCoverage=19%, E-value=2e-17, Identity=42%"; Hit description=IMP dehydrogenase/GMP reductase, putative
  Pfam annotation: Domain name=DUF1723; Domain location=160-209; Score =58.7; E_value=1.9e-14; Accession=PF08330.1; Description=Protein of unknown function (DUF1723)
RGLGRAIGRVVGRDRAADEDAGDVPERRRPTASARRLRVHQMTMEGRDMAEDVAGMTDDVPEQPTEAPEMRADAQGADSGEGSDDDDAAEGFPGGPRDPSVLTSFAEHVAHAVWSGQERPDLKLVSHGRKVTLIGRPVSEIEGLVAATGLSPLIDCSVITDNPGLISAFVERWHNETSTFHLPVGELTITLDDVSSILHFPSLAPCTVSTLFLRRRPDSCLRSCWKCLLRRPEPRQHSHVEHMYD

SEQ ID NO: 93756 - protein, 152 aa, Glycine max
  Coding DNA Sequence Number=SeqID_2071
MTKLGLCLSSGPPPLDDKKVRITIRYLRVSWVQTDQTWSLLVIGPARLWMTKRMTKLGLCLSSGPPPLDDKKVRITIRMTKLGLCLSSGPPPLDDKRVRITIRMTKLGLCLSSGPPPLDDKRVWITVRYLRVSWVQNDQTWSLLVIGPAASG

SEQ ID NO: 93757 - protein, 280 aa, Glycine max
  Coding DNA Sequence Number=SeqID_2072
AFFVAVVVDSNNFTLKTTLKGTEILISKQLLTDLLGVPTDSSRIYDGWCEIMGLRKTKIIKIFLKDKDNDFKKIPLSLSHLIINQMIKETSSVPCRMLMTLVLRHFGVFLEDETKDDEEDAENKEKEKKKKKKAKEKKEKKDNVSTKRSSPLFIELIRSGKRLKVRARISPQSNSEEVSEQNEKFGDEDKVSFEEVQNSEEEKPSEGHFEGAQDEEEKEQSPQGEEQVSKAVPFKKPLDYGSFYETSKHFSMKEKKDEEYHFEPQNEVLSVDEGGQSAQN

SEQ ID NO: 93758 - protein, 128 aa, Glycine max
  Coding DNA Sequence Number=SeqID_2073
MAGCEKGSTYGLGRSDGDSALRGTRIRATWEYVSSVGGGQQGMVVVPGDMLRGSEDLGDVRQAPDSQQIKGTKTTKQGGLCGGWPAVNLEQDKVSSDELKLKDPRCRIQCPDILLDNTGSAVQCKIKV

SEQ ID NO: 93759 - protein, 32 aa, Glycine max
  Coding DNA Sequence Number=SeqID_2074
PKSKAPARCIVVKYFNDPRPLEPERLKALRIE

SEQ ID NO: 93760 - protein, 240 aa, Glycine max
  Coding DNA Sequence Number=SeqID_2075
  Homolog annotation: Hit_ID=A7QB92; Match level="QueryCoverage=60%, HitCoverage=21%, E-value=2e-07, Identity=30%"; Hit description =Chromosome chr4 scaffold_73, whole genome shotgun sequence
MTYKNIQKGVSVCVCVFVCDEGVCVCVFVCDEGVSLCVYHEDYGNLSTIALSVKDLVSVKERRERFLQGLGLVDSSAKVCSQEKMSLDESSISLGLERIRECSGAFSNACILLTDEVVFEKLILSGGKAGSKEKISLDEFKGCPQDEAQANIQGKEHELFYTPQEHRPSEGVSQEEFQDFYISKRKRKNWWKRFVNIRKIRDGNHKLDFKDNRSVDPQRYTFSLTATKPISLEDKRKLGE

SEQ ID NO: 93761 - protein, 73 aa, Glycine max
  Coding DNA Sequence Number=SeqID_2076
MVVEWRRKKDDWRRHLKEKMSQEQVHHHSDKMNGNGMEKEEREETPLQGEDESRRSSPPYEAMDKSLEEEGDK

SEQ ID NO: 93762 - protein, 275 aa, Glycine max
  Coding DNA Sequence Number=SeqID_2077
  Homolog annotation: Hit_ID=Q6WAY6; Match level="QueryCoverage=49%, HitCoverage=24%, E-value=3e-16, Identity=30%"; Hit description =Putative uncharacterized protein
SIEAIASLAQYYNQPLRCFMFGDFQLESTVEEFEEILGCPLGGRKPYLFSGLYPSMARIAKVVKISVQELDQVKQNRNGVIGIPRKHLEEKAKALADQGEWVSFLDVLALLVFGVILFPNVDGLVDLAAIDAFLRGTRIVYCTPALYVWLVSHLFRYESRLVSPLQGHRLCAEKGKANWEQLLPDKELRGSSNGIVSGYHKWMKAKRQEITWPLKLKITCEEEAETPEESEEVQALKRAQASKGQERPVESQRYDIKGQVEGLSKVKEELVRTVE

SEQ ID NO: 93763 - protein, 258 aa, Glycine max
  Coding DNA Sequence Number=SeqID_2078
MEFYAKACPMEEGVRHKCSWVRGQWIPFNEDVINKFLGHPLVLEEGQRCEFSQMRSQALGFDKEAINQLLCVPSNIFPSDHNSNLPLSKCHLVYVILTHTLSGPREVQKGTGVSYFDHGPVPILWSAGHSHQAHLASHQQSLHREILHAQTSTTVEGGLATASRRRTAVASTGDTILRAANHRGQVQLNESFYRYTQHQQIQDPSPFPWPTLETFGAMVAWPGDEPDFDTGARPVGAPGDDDGAQEDDDMADVLDFFT

SEQ ID NO: 93764 - protein, 66 aa, Glycine max
  Coding DNA Sequence Number=SeqID_2079
MRKMQGSCMSEHNMRTVKIEWTISGNVSPKEETLDEASLLSSESEMQHDHRSTSTPYGSHRPGYRA

SEQ ID NO: 93765 - protein, 148 aa, Glycine max
  Coding DNA Sequence Number=SeqID_2080
  Gene Ontology: Mol. function=phosphoprotein phosphatase activity; Biological process=intracellular signaling cascade
  Homolog annotation: Hit_ID=A5B3Q0; Match level="QueryCoverage=95%, HitCoverage=9%, E-value=1e-18, Identity=34%"; Hit description =Putative uncharacterized protein
  Pfam annotation: Domain name=DUF1723; Domain location=72-121; Score =64.5; E_value=3.5e-16; Accession=PF08330.1; Description=Protein of unknown function (DUF1723)
MTHAQPRHIDGSLLRLQDNHISNQVWEDKKRMIRLTYNSVWAFTHLDQIDNHVKNLITLAGFCHVINVRKIDINQHLVSALIERWRTKTHTFHFPHGEPTITLQDMTLQLNLKIDGLSVIDIITDDVRVACQTLLGDTPSDKYIKGKK

SEQ ID NO: 93766 - protein, 84 aa, Glycine max
  Coding DNA Sequence Number=SeqID_2081
MFSFARHGSDEDMTKSKGKDPLEGLGGPMTRARARKSKEALQQVLSILFEYKPKFQGEKSKGPIGNLGISLLGDQMVADLLAVG

SEQ ID NO: 93767 - protein, 151 aa, Glycine max
  Coding DNA Sequence Number=SeqID_2082
  Homolog annotation: Hit_ID=Q6WAY3; Match level="QueryCoverage=61%, HitCoverage=4%, E-value=1e-07, Identity=37%"; Hit description =Gag/pol polyprotein
MPCEWSLQPLHQKLKFAVGGLLVIVSGEEDMLVSCPSSAPYVEVAEESLETAFQSFEVVSCASVEPRTDLSPEMGLGKHGLGNADVVDIKGNPYKYGLGYEPGIPGRRNVPSRFRADRVWPGRISQCFTSAGMVSEEEVAAIEEEFPQDPP

SEQ ID NO: 93768 - protein, 53 aa, Glycine max
  Coding DNA Sequence Number=SeqID_2083
  Subcellular localization annotation: CTP_CleavageSite=24; ConfidenceScore=5.29e-01
MSSPARACSPLKPRACSPLKARMCSSLKARLCSPLKARTCSPLKANACSLLKA

SEQ ID NO: 93769 - protein, 50 aa, Glycine max
  Coding DNA Sequence Number=SeqID_2084
MKPSEGEGVQPSEGEDVQSSEGINETLGLVWILVVDLKRANKAALTLVNF

SEQ ID NO: 93770 - protein, 170 aa, Glycine max
  Coding DNA Sequence Number=SeqID_2085
LVPSEVSLRIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGRGSPSDSALCAYSKGIGLKFLNRDVAADGNVRESGDVGGGPGKSYLFCLTACPPWKRLSR

SEQ ID NO: 93771 - protein, 128 aa, Glycine max
  Coding DNA Sequence Number=SeqID_2086
  Homolog annotation: Hit_ID=Q84VH5; Match level="QueryCoverage=57%, HitCoverage=10%, E-value=7e-33, Identity=95%"; Hit description =Envelope-like protein
MLSQHPNILNYTDSLMKRESPLSLHYKLFEGTHVPDIVSTSGKAAASGAVYKDALIAELNDTCKVLEATIKATTEKKMEQLRKKKKQLWKKKKQLRKRKMQQRILNQMMMILKPPHDHQTFIFAFYSY

SEQ ID NO: 93772 - protein, 284 aa, Glycine max
  Coding DNA Sequence Number=SeqID_2087
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIHELKCLTAPGESLFWAFLLASDVAAVMGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 93773 - protein, 100 aa, Glycine max
  Coding DNA Sequence Number=SeqID_2088
  Gene Ontology: Mol. function=chitin binding; Cellular component =extracellular region; Biological process=chitin metabolic process
  Homolog annotation: Hit_ID=O44238; Match level="QueryCoverage=93%, HitCoverage=28%, E-value=8e-08, Identity=32%"; Hit description=mRNA, endostyle-specific
  Subcellular localization annotation: CTP_CleavageSite=91; ConfidenceScore=5.36e-01
MARTCCPLKVRACSLLMARTCSPLKVRTCSLLKARACNPMMARLCSPLMARTCCPLKTKTCSPLKVRPCSPTKAKACSPLKARMCCPLKVRVLVPKGPPL

SEQ ID NO: 93774 - protein, 91 aa, Glycine max
  Coding DNA Sequence Number=SeqID_2089
  Gene Ontology: Biological process=transposition, DNA-mediated
  Homolog annotation: Hit_ID=Q1J7G7; Match level="QueryCoverage=36%, HitCoverage=47%, E-value=1e-11, Identity=96%"; Hit description =Transposase
MVKVGTSYVPINVSFSPKSWPRASRYQQGHQDLVILRSDLPSQVLQWLLFLSAVPPVQLLTGWCVTAKAPPDISAGKCSGHAARNHHTRRA

SEQ ID NO: 93775 - protein, 65 aa, Glycine max
  Coding DNA Sequence Number=SeqID_2090
MRLPGKESLLMGSPITINEILDVSISFLNDHLEETLGSTIEENHSKCINLAQILSGQKDLSAHFF

SEQ ID NO: 93776 - protein, 113 aa, Glycine max
  Coding DNA Sequence Number=SeqID_2091
MSISPCKRIAPARHPVDPETSNRVLGFPALVTGLCKSYRAPVPPSSLCHRDLGIVPAKHSVDPKKANRFYGVPVAPNKVIRSRINRASSRSTTPPGRHRAKHHSSIGMAGSGQ

SEQ ID NO: 93777 - protein, 167 aa, Glycine max
  Coding DNA Sequence Number=SeqID_2092
  Homolog annotation: Hit_ID=A5BSR3; Match level="QueryCoverage=52%, HitCoverage=27%, E-value=3e-10, Identity=43%"; Hit description =Putative uncharacterized protein
MGPVLLDSQRSFLGGIAQKGTDHPETEHCPPTVCLVGVMNIWSRSSWLRRRRRSWRKLHSQEAAQSRSVDGIIDPPSPVRRHVKWKMARTKKTGEMTTEAAKEITEKIDSFEEQVTQGSFVPHGRQDVLTAAIRRPEHPRRVHVAGAGVTIKQYFGSAPRRLQMQML

SEQ ID NO: 93778 - protein, 86 aa, Glycine max
  Coding DNA Sequence Number=SeqID_2093
VDKSGALAPTYPPSKRKSDLRSSFQRGESSYSFLLGRWSFKALDLEMIHFYLVRKAEENEGGLCHSARPGELGCFHQKQPPSGGTS

SEQ ID NO: 93779 - protein, 269 aa, Glycine max
  Coding DNA Sequence Number=SeqID_2094
  Subcellular localization annotation: CTP_CleavageSite=41; ConfidenceScore=5.58e-01
MAEPSKKRKGSSSTTAAAAHRRHGPSGAPTTPIPPSLSSPRSSTLFSSDDQRLWYLSQFSSRIILDPKYLDVEFFNDETFDCYQVFQNSGLVDFMSLKLPYCPELVKVFYYNLKIQDGIIMSEVHGISMVIDQSLFFSLTHLPSQGAPFEGTIVDDWKFDYSSHDARRMVCNDQAEMTAQASEEDLILMWAFLTGRQIDWAHLVRYRMHKALRANAPLPYPHLITLFLRHFQIPLDDEPFVQVKRSFAIGAGAVTSIGYRKDRNGGDNG

SEQ ID NO: 93780 - protein, 96 aa, Glycine max
  Coding DNA Sequence Number=SeqID_2095
PLIEWVRNHVPSWEDVSREGAQSMKNLRILGQILSKVEGMMQSYPARALDRRLQLDWARDPWEGPRVLMSFKGELSYYRGNLLKEASQGGELSYER

SEQ ID NO: 93781 - protein, 99 aa, Glycine max
  Coding DNA Sequence Number=SeqID_2096
MIRGDTLRLFAPFCHPEPAGPMTSRDQVWSFGTLVSSRAGGPDDTRKYPSGADIVFCTFCSSGNNKSFTCGNFMVTRDSRQPRGAKLVSYTDFRPGAFA

SEQ ID NO: 93782 - protein, 315 aa, Glycine max
  Coding DNA Sequence Number=SeqID_2097
  Gene Ontology: Mol. function=RNA-directed DNA polymerase activity; Biological process=RNA-dependent DNA replication
  Homolog annotation: Hit_ID=Q0ZCD0; Match level="QueryCoverage=60%, HitCoverage=15%, E-value=5e-11, Identity=28%"; Hit description =Integrase
MNQKSTPVARVCGLCSSTDHHTDLCPSLQQSGVNEQPEAYAANIYNRPPQQQNQQQQNNYDLSSNIYNPGWRNHPNLRWTSPPQQQQPVPLFQNVVGPSKPYVPPPVQQQQQQQQQQRQQAIEAPPQPSLEELVRQMTIQNMQFQQETRAFIQSLTNQMGQIVTQMNQAQSQNSDKLPSQTVQNPKNVSAITLRSGNQIQVPPPVAAPTPEPVKLHSTLEKEDEIAAQKRKLANKNFHAGGPSSSNSDLQQLPIPIPFPPKAIPNKKNGRSGKGDLGDLQESRGEHTSARCHQADSKICQVSKGAVHPQKEAQRK

SEQ ID NO: 93783 - protein, 373 aa, Glycine max
  Coding DNA Sequence Number=SeqID_2098
VVEQLIKPGSAPLIGRGRRRHRQRVEYIQPVGVQPIDKRLPKPGIGDQEIRNAQRGKAERFAGGRRRNHPIAIFLAQMQHRRKRLAGQQQVGPNFIGDHRDVMGVAERHEPLQFIAAPATAGWIVRVAQQQQRRFTLRQAGGQLVEIDPVSLRGFPQRLDQHRQPRHHPFNRREPLAPQRQAVPLGKPVDCRLVVGVVAFAVAKDAVVHPLMQRLLHLWRARKVEIGHPHRQQFAAVQLQIAVDEVPLHGAGVVAIDDGVEMTRHVRLPYAASRSEIEGADPQRGGHVNAGGRPRDQRFDDGARIFDGARQIFVVQPHAPIGPFEQLRRDQQRQLAVAGRAGHQDSGGNGGGDQLAGGVHHVQQPADDHRQRA

SEQ ID NO: 93784 - protein, 42 aa, Glycine max
  Coding DNA Sequence Number=SeqID_2099
MEVRKPSRGLWLPLHYQVDKGARMTFVDNWVVGMLDKWPQIS

SEQ ID NO: 93785 - protein, 242 aa, Glycine max
  Coding DNA Sequence Number=SeqID_2100
  Gene Ontology: Mol. function=phosphoprotein phosphatase activity; Biological process=intracellular signaling cascade
  Homolog annotation: Hit_ID=A7R8Y3; Match level="QueryCoverage=83%, HitCoverage=62%, E-value=5e-28, Identity=34%"; Hit description =Chromosome undetermined scaffold_3090, whole genome shotgun sequence
MWAWERCPTLAPKRTPSQVENTPVGHRWLRRGNQHIGNDDVRVFRRKLDIMKRHEFVWESYPSTVISLLPPVCLVGSLAWYAVVPLICFQVIEWHQPDRVLRQFGMQQPIPESPSQPLNIHGITLKGKHDENWGQLFAPMIDQWNNRHAFRVDAYPRQEGLLSFNSDYMVWVKLRRHYNTWCLLKGGIHAHLMISCLMWKKLQFYPKSKRESLSQCHMVPHQSVNFLHNSFTCFSQVLKLRG

SEQ ID NO: 93786 - protein, 66 aa, Glycine max
  Coding DNA Sequence Number=SeqID_2101
  Subcellular localization annotation: CTP_CleavageSite=21; ConfidenceScore=5.04e-01
MRNLEGNLSRKHALSVSSACLASHLSPSRLSVSLAPSESSLTHAKCDVEELPCYGRLNPQLGILAE

SEQ ID NO: 93787 - protein, 73 aa, Glycine max
  Coding DNA Sequence Number=SeqID_2102
  Subcellular localization annotation: CTP_CleavageSite=48; ConfidenceScore=5.32e-01
MRLADRRNLEGNLSRRHALNMSSAHSVSRLSPSRLSASLALSESSLTRAKRENGTKRDVEVSEPFFKPDLRRI

SEQ ID NO: 93788 - protein, 151 aa, Glycine max
  Coding DNA Sequence Number=SeqID_2103
  Homolog annotation: Hit_ID=A5AQ58; Match level="QueryCoverage=62%, HitCoverage=7%, E-value=3e-08, Identity=35%"; Hit description =Putative uncharacterized protein
MHPPPSSPEPHELICVLVPCLPTEQGMSYESKYNRLLQPVSVPTQPWSDIAMDLITNEPSSRGHSMLWVVLQLYWQHSAFNLRDSKLHHCLCGPYPILICTRVVAYELEHPATARIHLMFHLGLFCRYKGPLPPAPLKFPSLSLLEEQCKS

SEQ ID NO: 93789 - protein, 186 aa, Glycine max
  Coding DNA Sequence Number=SeqID_2104
  Homolog annotation: Hit_ID=A5BSP7; Match level="QueryCoverage=37%, HitCoverage=5%, E-value=8e-07, Identity=39%"; Hit description =Putative uncharacterized protein
  Pfam annotation: Domain name=zf-CCHC; Domain location=119-136; Score =15.3; E_value=0.0075; Accession=PF00098.14; Description=Zinc knuckle
ALKGLDDTPQPKSKVGARWIVVKCNRQKGSTECGYYVIYWMSTIILGSFRNNWETYFNDVRPLEAERLKALRIQWAQHYLKDQAQGILGAAPSKPKEDKGKTIEKSTPKTSSQERTSNIKCFKCLGRCHIASQCPTKKTMIMKGQDIYSSQEKTTSSPSSSGSEDEVRGEESSEEVYPHEEGDLLM

SEQ ID NO: 93790 - protein, 162 aa, Glycine max
  Coding DNA Sequence Number=SeqID_2105
  Pfam annotation: Domain name=zf-CCHC; Domain location=58-75; Score =28.0; E_value=3.5e-05; Accession=PF00098.14; Description=Zinc knuckle
MTLINATEEEYDDDDSGEEDEELSLIIMKIKKIWKRRNSSKFNNSSKRSFHKKDKSLVICYECKKPGHFKSECSNLEKSKDKNKKLFKSEKKSDGSLLVEHLWRMDLGASMRSFNGDFSPWRCSGRQRRRGEGRHHPLGNKPRKKELHHQELPWIRSLKRML

SEQ ID NO: 93791 - protein, 52 aa, Glycine max
  Coding DNA Sequence Number=SeqID_2106
MEIINIHTNNEPSIHTLLDVAPCAACRPWIFFINGVLYFLKFNGSGMEKEER

SEQ ID NO: 93792 - protein, 92 aa, Glycine max
  Coding DNA Sequence Number=SeqID_2107
MDVYALLEKGKWLRRNSPRRGLEETPQQKGPVPPPEFDSHRFRSAEHQQRFKAIKGWSFHRERRVQLREDEYTDFQEGDSSQTLGAAGDSHG

SEQ ID NO: 93793 - protein, 84 aa, Glycine max
  Coding DNA Sequence Number=SeqID_2108
  Subcellular localization annotation: CTP_CleavageSite=53; ConfidenceScore=5.31e-01
MGPKSTLRLMRTLRLSRASLAQSSWSLLSNALAGKKKKNSPFAKRKPRPKRISVHALSPESQALSTQPLHLRPIWSTKLAKVEL

SEQ ID NO: 93794 - protein, 154 aa, Glycine max
  Coding DNA Sequence Number=SeqID_2109
QKKVYTDNHSGISARQRDSNVSMTDLVSAEDDVNLRVSTGLSAAIDEGRRRRVSLRAIRLFVLQTAKKNVYTDNHSGISARQRDSNVSMTDLVSAEDDTAKKNVYTDNHSGISARQRDSNVSMTDLVSAEDDTAKKNVYTDNHSGISARQRDSN

SEQ ID NO: 93795 - protein, 103 aa, Glycine max
  Coding DNA Sequence Number=SeqID_2110
MSPPPLEPHNHSQTHLKLLGQLPLQAWFSAGGFVRACEPSTILNCLALISGFWLCACFSRSADGLKWCTSLDDPSLSANAQLILLPDSSSRSTEECCTQRMAR

SEQ ID NO: 93796 - protein, 68 aa, Glycine max
  Coding DNA Sequence Number=SeqID_2111
MGEAKEVQEKMKAENGGHKRANGHNDGGHDEHEEIIEANVVIVAATSAVAKVNPMLPSGSANDHQLKY

SEQ ID NO: 93797 - protein, 32 aa, Glycine max
  Coding DNA Sequence Number=SeqID_2112
SNWAASFSTFLKNGFRGFRGFRNASVKFPKTL

SEQ ID NO: 93798 - protein, 61 aa, Glycine max
  Coding DNA Sequence Number=SeqID_2113
  Subcellular localization annotation: CTP_CleavageSite=11; ConfidenceScore=5.03e-01
MSQRALRGRARARLTGALSKGGKKNRRKPVKMKILSSGVVFTLEEGISTSHVCPKGQQSIF

SEQ ID NO: 93799 - protein, 138 aa, Glycine max
  Coding DNA Sequence Number=SeqID_2114
MAKFDPEVVLEFYANAWPTEEKVRDMRSWVRGQWIPFDVDALSQFLGDLVVLEEGQQCEFSQRRNKADGFDEEAIAQLLCTPGQDFARTAAGRRVRIMRTSMTTLTQTWMTLLLSNVLPSDHNSDLPCRSVCHPPGTL

SEQ ID NO: 93800 - protein, 428 aa, Glycine max
  Coding DNA Sequence Number=SeqID_2115
ERGGTAGATPRCCPANIAATLPVLAPGHAWTGASYTVLQRWRAGHTRMQWKLDTDQCTTARRIQNRDVAAVAVDHLAHQVQPQARARLPRPQPMEGFENAFALFDRYAGAVVLDLQAAALNAHDDLASAMFGSIQYQVGNYPLHCAGLAEHREMRFHRDGYGLLRLDQQRRQIGGHPFGHPRQVDGFLRPVFVHAVQIQQLLCQRRQPRHFHGQAARGGVVGRIDLHPQNRNGRAQLMRGGGDEAALPFVPLVQPLQCFIHRRHQRSDLHRHSGFCQADTAAAGGDVAGFLGDALHPGQGPSHDDRCQDDGGQAQQQEDRQGDDVCRQRHLPGQRIGFAMGHDGQLAGRPAVLADHDGQAIAAIPPAQVAKGDAIQCAYQRGIGRRHRPERYVVAVLILGDEPCTGNDLQQFGQFRRVLHVQFSIAVA

SEQ ID NO: 93801 - protein, 136 aa, Glycine max
  Coding DNA Sequence Number=SeqID_2116
MGSEIYPKVHENPRVFFSSSSPILLDSSIQYPWGVGLHQKGIGFGSILGRIDFPLRKSVADSDDEGSTDLRTNPLQEGGDDAILPRRGPITRAMARRLQEDWAIDAGEDPRVLMSLKGSIVYGECPSNVGFSALVF

SEQ ID NO: 93802 - protein, 69 aa, Glycine max
  Coding DNA Sequence Number=SeqID_2117
MLGHGYEPGMGLGWNDNGVASLVEVTKNRRRSDNESCEGNDTEDPDVDFEKLVNQAEEGEDEDWGLPHS

SEQ ID NO: 93803 - protein, 63 aa, Glycine max
  Coding DNA Sequence Number=SeqID_2118
MAILVDDKRLPLEGETTMWKRLTLEGEMCWVTSVRSPYVVTCGPQVYPSNLPNNIKSTKLEGI

SEQ ID NO: 93804 - protein, 64 aa, Glycine max
  Coding DNA Sequence Number=SeqID_2119
  Subcellular localization annotation: CTP_CleavageSite=34; ConfidenceScore=5.21e-01
MKKQGLFFSKMPSAKSPLELVGLGSSSSMDSFVSCKMNDSGMEKEEREETPLQGEDESRRSSPP

SEQ ID NO: 93805 - protein, 102 aa, Glycine max
  Coding DNA Sequence Number=SeqID_2120
  Homolog annotation: Hit_ID=A6FJQ2; Match level="QueryCoverage=37%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPDFSAHDAR

SEQ ID NO: 93806 - protein, 164 aa, Glycine max
  Coding DNA Sequence Number=SeqID_2121
  Homolog annotation: Hit_ID=A5B4G8; Match level="QueryCoverage=63%, HitCoverage=12%, E-value=7e-10, Identity=36%"; Hit description =Putative uncharacterized protein
MVAVVQTYNVTCMRRGNPSDLQPFDPEIDRTFHRLVRHHFVPFEHPEHSVIGDFEHYSFKHSDFVHSKNMAQPPPHERTLREMVAPDFTYESLCIQYPDEYVPYVPKIGLINLLPKFHGLAGEDPHKHLKEFHIVCSTMKPPDVQEDHIFLKAFPHSLEGVAKD

SEQ ID NO: 93807 - protein, 210 aa, Glycine max
  Coding DNA Sequence Number=SeqID_2122
  Gene Ontology: Mol. function=motor activity; Cellular component=cell projection
  Homolog annotation: Hit_ID=UPI00016621D1; Match level="QueryCoverage =89%, HitCoverage=40%, E-value=3e-22, Identity=36%"; Hit description =UPI00016621D1 related cluster
MTDPLDESISCFLIRVNPWVLVPITFRGLHAFTFRGLHVLAIRGLHALAFIGLHALTFRGLHVLAFIGLHALAFIGLLALTFRGLHVLTFKGLHALAFIGLHALTFRGLHVLTFRRLHALAFIGLHALTFRGLHVLTFRGLHVLTIRGLHALTFRGLHALAFVGLHALTFRGLHVLTFRRLHPLTFRRLHPLTFRGLHVLTIRGLHALTF

SEQ ID NO: 93808 - protein, 56 aa, Glycine max
  Coding DNA Sequence Number=SeqID_2123
MQGCSPRRANPVFLFLGRHRILGYLPAALSACPELGMGRRSINRDPSLYLRPSLST

SEQ ID NO: 93809 - protein, 19 aa, Glycine max
  Coding DNA Sequence Number=SeqID_2124
MKENSFPSKPYKLSPFKMG

SEQ ID NO: 93810 - protein, 67 aa, Glycine max
  Coding DNA Sequence Number=SeqID_2125
MGGGGELPGNHITSETSKRVGLRPQKETTPENLAFHGFKQKTPLKHRSRNVNEQKRKRTEMYNGTET

SEQ ID NO: 93811 - protein, 172 aa, Glycine max
  Coding DNA Sequence Number=SeqID_2126
  Homolog annotation: Hit_ID=Q0KIL1; Match level="QueryCoverage=56%, HitCoverage=10%, E-value=1e-07, Identity=35%"; Hit description =Gag/pol polyprotein, 3'-partial, putative
  Pfam annotation: Domain name=G-patch; Domain location=38-82; Score =15.7; E_value=0.0024; Accession=PF01585.14; Description=G-patch domain
MPYVEAAEESLETTFQSFEVVSIAAVDSLSRQPRLSDAAMMVARVMLGHGYEPEMGLGKNNGYRTSLVSTRGNRGKFGLGNKPTQANIRKNISERKNKGQGSRLGQRAKEAPPCHISRSFISAGLRCDGQVATICDDDSPRRSDLVRPYPLGFQLGNWRMEERPDVYATSIM

SEQ ID NO: 93812 - protein, 133 aa, Glycine max
  Coding DNA Sequence Number=SeqID_2127
MERCASRLRKWLPFAIWSRNGVQRLELCWSFNGEEEEKNGNMCHMSSFEWSKNDASSIGACRPRIFFINGFLCFLEEEWQRNGERKKERRRHFKEKMSLEEAHHHRRPWIRAWRKKEMNEGRGREEHEILCSK

SEQ ID NO: 93813 - protein, 118 aa, Glycine max
  Coding DNA Sequence Number=SeqID_2128
MVWHLQSSFFHLHYAAIDLQEAKDSIDEEIQGLQAPHGATSKVLGFNLKTNPTILHYTFVILSFNVEQILVDIISLPSSNILFRHIRKSGHFQKDCPKYKSWFEKKGELSAYVCLNQT

SEQ ID NO: 93814 - protein, 170 aa, Glycine max
  Coding DNA Sequence Number=SeqID_2129
MGSCQMPSLKKRFYQVKVKSLGTTSLKELGQLMGQLQRQAFRKAYGKIWDLAMVEVSTEAIASLAQLWNKRPRGLVGKSTAGTRFEGKGPITKTNMLAIISKYREELNLATTHEHRVADEYAQMYVEKEARGRVINSLHQEAVMWMDRFALTLNGSQELPRWLAKAKGIL

SEQ ID NO: 93815 - protein, 129 aa, Glycine max
  Coding DNA Sequence Number=SeqID_2130
  Gene Ontology: Mol. function=nucleoside diphosphate kinase activity; Cellular component=mitochondrial intermembrane space; Biological process=CTP biosynthetic process
  Homolog annotation: Hit_ID=Q9SP13; Match level="QueryCoverage=60%, HitCoverage=33%, E-value=5e-37, Identity=92%"; Hit description =Nucleoside diphosphate kinase
  Pfam annotation: Domain name=NDK; Domain location=28-113; Score=59.1; E_value=1.5e-14; Accession=PF00334.10; Description=Nucleoside diphosphate kinase
MRKEKIPHQAPFAIQAAQLLGRAIGAGLFAITPAGERGMCCKAIKLGNARVWEGQGVISYGRKLIGATDPQKSEPGTIRGDLAVVVGRNIIHGSDGPETAKDEIKLWFKPEELVSFTSNAEKWVYGVTD

SEQ ID NO: 93816 - protein, 64 aa, Glycine max
  Coding DNA Sequence Number=SeqID_2131
MENPNARRGRATCGVRKEQIWETGWPGTEKTMRWTYLSAEWEDKKSKQSMLTIISVTKLSLRAT

SEQ ID NO: 93817 - protein, 81 aa, Glycine max
  Coding DNA Sequence Number=SeqID_2132
  Gene Ontology: Mol. function=nucleic acid binding; Biological process= DNA integration
  Homolog annotation: Hit_ID=A5B7I7; Match level="QueryCoverage=90%, HitCoverage=8%, E-value=2e-22, Identity=67%"; Hit description =Putative uncharacterized protein
MLHEPIPLQRSTRERRSTILDDYVVFLKEHEENNGMMEDDSVTFHQVMQDSNSEKWIEAMNGAYKSMQDNKVWGLVLCETH

SEQ ID NO: 93818 - protein, 779 aa, Glycine max
  Coding DNA Sequence Number=SeqID_2133
  Gene Ontology: Mol. function=catalytic activity; Cellular component =nucleus; Biological process=metabolic process
  Homolog annotation: Hit_ID=A7PL36; Match level="QueryCoverage=88%, HitCoverage=93%, E-value=0.0, Identity=52%"; Hit description =Chromosome chr7 scaffold_20, whole genome shotgun sequence
  Pfam annotation: Domain name=PPR; Domain location=108-142; Score =11.8; E_value=0.31; Accession=PF01535.11; Description=PPR repeat
  Pfam annotation: Domain name=PPR; Domain location=170-204; Score =21.4; E_value=0.0034; Accession=PF01535.11; Description=PPR repeat
  Pfam annotation: Domain name=PPR; Domain location=305-339; Score =45.2; E_value=2.2e-10; Accession=PF01535.11; Description=PPR repeat
  Pfam annotation: Domain name=PPR; Domain location=38-72; Score=33.1; E_value=1e-06; Accession=PF01535.11; Description=PPR repeat
  Pfam annotation: Domain name=PPR; Domain location=407-441; Score =43.2; E_value=9.4e-10; Accession=PF01535.11; Description=PPR repeat
  Pfam annotation: Domain name=PPR; Domain location=442-476; Score=7.9; E_value=0.9; Accession=PF01535.11; Description=PPR repeat
  Pfam annotation: Domain name=PPR; Domain location=478-512; Score=9.3; E_value=0.62; Accession=PF01535.11; Description=PPR repeat
  Pfam annotation: Domain name=PPR; Domain location=544-578; Score=7.0; E_value=1.2; Accession=PF01535.11; Description=PPR repeat
  Pfam module annotation: Pfam domain module=PPR::PPR::PPR::PPR::PPR::PP R::PPR::PPR; Domain location=108-142::170-204::305-339::38-72::407 -441::442-476::478-512::544-578
MPLKTTFSWNTILSAHAKAGNLDSARRVFDEIPQPDSVSWTTMIVGYNHLGLFKSAVHAFLRMVSSGISPTQFTFTNVLASCAAAQALDVGKKVHSFVVKLGQSGVVPVANSLLNMYAKCGDSVMAKVVFDRMRLKDTSTWNTMISMHMQFCQFDLALALFDQMTDPDIVSWNSIITGYCHQGYDIRALETFSFMLKSSSLKPDKFTLGSVLSACANRESLKLGKQIHAHIVRADVDIAGAVGNALISMYAKSGAVEVAHRIVEITGTPSLNVIAFTSLLDGYFKIGDIDPARAIFDSLKHRDVVAWTAMIVGYAQNGLISDALVLFRLMIREGPKPNNYTLAAVLSVISSLASLDHGKQLHAVAIRLEEVSSVSVGNALITMYSRSGSIKDARKIFNHICSYRDTLTWTSMILSLAQHGLGNEAIELFEKMLRINLKPDHITYVGVLSACTHVGLVEQGKSYFNLMKNVHNIEPTSSHYACMIDLLGRAGLLEEAYNFIRNMPIEPDVVAWGSLLSSCRVHKYVDLAKVAAEKLLLIDPNNSGAYLALANTLSACGKWEDAAKVRKSMKDKAVKKEQGFSWVQIKNKVHIFGVEDALHPQRDAIYCMISKIWKEIKKMGFIPDTNSVLHDLEQEVKEQILRHHSEKLAIAFALINTPKHTTVRIMKNLRVCNDCHSAIRYISLLVEREIIGMSGRMIESIKLAGKLLYNNRKSISRSIVTIKDSTRSNTEHGEQEIGPNTETTQEAEFKLETGSSKEKASRPKREIVKPQYLKDFVEK

SEQ ID NO: 93819 - protein, 94 aa, Glycine max
  Coding DNA Sequence Number=SeqID_2134
MATQVAPPKRELITMIVDALSVSNYEKMVDYMPSRFGDLVFTGERIEVGLRRGKFDCLALTNKKPGANGEKENEEGTHVEEPYTGAMRGTVHEP

SEQ ID NO: 93820 - protein, 246 aa, Glycine max
  Coding DNA Sequence Number=SeqID_2135
  Homolog annotation: Hit_ID=Q5XM22; Match level="QueryCoverage=29%, HitCoverage=55%, E-value=1e-15, Identity=49%"; Hit description =Resistance-like protein HAAS-2
AQVSGEEARAETAFCDLGQSGGYAWGATALVHMYDQLNKASRTTTRKIEGYLTLLQCWIYEHFPSVHQCVTDDAYEEMSPRASRWLTIQAHMKGITRAPYRAHCDALTVTDGQLRWGPTMVTVRSERVLRQFGYIQSIPPLPVSADYMEWFFQISHPFMIPIQAGDQPRHAPAPDHEDYMQPNIPQVPVAFDPPRHAVDDYEGYGRSQKGTKLHDIMQDCLKIARGVPMQMEMLGLDKDAAQSIDD

SEQ ID NO: 93821 - protein, 150 aa, Glycine max
  Coding DNA Sequence Number=SeqID_2136
MASMMDAMLGMRQLMENNVATAAADEKKAHWGTSATPIWDTTEWLTLTDYHLITRHQSCVMTRIMSLPPSLKGSLLDSPTRFTRIAESMPKETSISTPRSLSRGRHPTCYLSPTSRENLKVSQHNQYSCPQKDHPRQRKEKGNSISSKRD

SEQ ID NO: 93822 - protein, 87 aa, Glycine max
  Coding DNA Sequence Number=SeqID_2137
MREGSFGRRETHPPLVFMFLGAGVLAQVRALYGSAFAYSNPLRAASLMQSYQLASLPAALPACPELDMGRRSIDHGPSLYSRPSLST

SEQ ID NO: 93823 - protein, 51 aa, Glycine max
  Coding DNA Sequence Number=SeqID_2138
DVQNYQPQNAQDAQKVQNVQGSKGCKSPGLPLVMHYMQQFMCFSDKAKEVG

SEQ ID NO: 93824 - protein, 302 aa, Glycine max
  Coding DNA Sequence Number=SeqID_2139
  Gene Ontology: Mol. function=nucleoside-triphosphatase activity; Cellular component=chloroplast
  Homolog annotation: Hit_ID=Q2PMM5; Match level="QueryCoverage=100%, HitCoverage=19%, E-value=1e-84, Identity=82%"; Hit description =Protein ycf2
  Pfam annotation: Domain name=AAA; Domain location=92-300; Score= -31.6; E_value=0.012; Accession=PF00004.20; Description=ATPase family associated with various cellular activities (AAA)
MIELRKLLDRYPTSELNSFWLKNLFLVALEQLGDSLEEIRSFAFGGNMLWGGGPTYGVKSIRSKKKYLNLIDLISIIPNPINRIAFSRNTRHLSHPSSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLDVNESNYLSLGLLVNYLSRDCERCSTRNILVIASTHIPQKVDPALIAPNKLNTCIKIRRLLISQQRKHFFTLSYTRGFHLPNPMSHTNGFGSTTMGSN

SEQ ID NO: 93825 - protein, 75 aa, Glycine max
  Coding DNA Sequence Number=SeqID_2140
CFPCSYVFLICDEDMFKSKGKDPLEGLGGPMTRARARKAKEALQQVLSILFEYKPKFQGEKSKVVSCIMAQMEED

SEQ ID NO: 93826 - protein, 46 aa, Glycine max
  Coding DNA Sequence Number=SeqID_2141
MGLRIKVENALGNEFMGLRIKVENGELANSARQQIRGDPYSSVEDA

SEQ ID NO: 93827 - protein, 76 aa, Glycine max
  Coding DNA Sequence Number=SeqID_2142
  Subcellular localization annotation: CTP_CleavageSite=56; ConfidenceScore=5.19e-01
MKEREQKIFRPDKFSARWKKPGGPFGPANKSFIRRPMNCVFRFMCPSILRVWEPMRSDLLNANSSHSQIFFGAVIP

SEQ ID NO: 93828 - protein, 62 aa, Glycine max
  Coding DNA Sequence Number=SeqID_2143
  Subcellular localization annotation: CTP_CleavageSite=19; ConfidenceScore=5.02e-01
MFVIVSSTRFLTFKMQNLPASASGHQVCSISRHLQTEIMFVNESKSMFYSNYKAINVSKLKY

SEQ ID NO: 93829 - protein, 141 aa, Glycine max
  Coding DNA Sequence Number=SeqID_2144
MTRGNLGDLQPFDPEIDRTFHRLVRHSVHPDHFEHSVAGDSEYSDFEHSTTNFHIENMAQPPPRETLREMDTPNFTYESLCIQYPDEGVPYVLEIGLIHLLPKFHGLAGRSYLSKGFSSFSGGSGKRLVVLPCSQIHLQLG

SEQ ID NO: 93830 - protein, 66 aa, Glycine max
  Coding DNA Sequence Number=SeqID_2145
  Subcellular localization annotation: CTP_CleavageSite=42; ConfidenceScore=5.02e-01
MKKRMKNVEERWKPSQNSSRKQNWGRSLPPSSPRRAGLLPPEATAFWRNLLEGPSGPGCYLHPHFY

SEQ ID NO: 93831 - protein, 96 aa, Glycine max
  Coding DNA Sequence Number=SeqID_2146
  Homolog annotation: Hit_ID=Q6UUU1; Match level="QueryCoverage=32%, HitCoverage=21%, E-value=5e-07, Identity=83%"; Hit description =Putative uncharacterized protein
ICDTGYIPLPRSLTRYARSFDCGERKWLTNGAEISWKMPGRYLTGNSLQAGTVCTNPPVQSDRCALIRHAPVKAKLKGQVLVTALLQASYLGSKSW

SEQ ID NO: 93832 - protein, 47 aa, Glycine max
  Coding DNA Sequence Number=SeqID_2147
MVMRGQDIYSSQEETTFFPSSSGSEDEVRDEESSEEVYPQEEGALLM

SEQ ID NO: 93833 - protein, 85 aa, Glycine max
  Coding DNA Sequence Number=SeqID_2148
  Subcellular localization annotation: CTP_CleavageSite=44; ConfidenceScore=5.74e-01
MGSPPASTPPLPPPPRTSDASALPSAVKRTRKASRLRSLSTRPPGAKRPAVHLILLPGRPTVDITYENWKEVPTAQKDLIWEDIQ

SEQ ID NO: 93834 - protein, 71 aa, Glycine max
  Coding DNA Sequence Number=SeqID_2149
MCGYSRIFCAYACSQMFFFREMCAQEMAPKKLSTKRSRRDVAEEGSSAAPEFDSHHFHSAEHQQRFEAIKG

SEQ ID NO: 93835 - protein, 75 aa, Glycine max
  Coding DNA Sequence Number=SeqID_2150
MPFRGLKSARKRTAFSAFSGKRDELAKQACCAKRVHQYALYPLTSLAKILAIDVQLSGHCPAKPILQNLNFCNFR

SEQ ID NO: 93836 - protein, 55 aa, Glycine max
  Coding DNA Sequence Number=SeqID_2151
MTVAPLYLSFIGDKREVSGMTIICLCMSSGPPPLDDKRAQNDHNLSLRAIRHDCV

SEQ ID NO: 93837 - protein, 156 aa, Glycine max
  Coding DNA Sequence Number=SeqID_2152
  Gene Ontology: Biological process=transposition, DNA-mediated
  Homolog annotation: Hit_ID=Q1J7G7; Match level="QueryCoverage=21%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVLKIEHEADYRDPRINRCWPQPVKRINITIAPV

SEQ ID NO: 93838 - protein, 173 aa, Glycine max
  Coding DNA Sequence Number=SeqID_2153
  Gene Ontology: Mol. function=metal ion binding; Biological process =metal ion transport
  Homolog annotation: Hit_ID=A7QZ63; Match level="QueryCoverage=78%, HitCoverage=100%, E-value=8e-53, Identity=72%"; Hit description =Chromosome undetermined scaffold_265, whole genome shotgun sequence
  Pfam annotation: Domain name=HMA; Domain location=41-103; Score=57.4; E_value=4.8e-14; Accession=PF00403.17; Description=Heavy-metal -associated domain
MGIKHVNYKATHHAPWGGPEEVASKSMGTNRGETEERNMIEVRVPNLDCEGCASKLKKALFKLKGVDEVEVEMEAQKITVRGYGLEEKKVLKAIKRAGKAAEPWPFPGHAHFSSFYKYPSYIVNHYYDAYKSEATNGVHTFFHTPAVYSVAVASDEAFASLFSDDNPHACTIM

SEQ ID NO: 93839 - protein, 586 aa, Glycine max
  Coding DNA Sequence Number=SeqID_2154
  Gene Ontology: Cellular component=endoplasmic reticulum lumen
  Homolog annotation: Hit_ID=Q9SMT6; Match level="QueryCoverage=72%, HitCoverage=80%, E-value=1e-177, Identity=64%"; Hit description =Putative uncharacterized protein T2J13.180
  Pfam annotation: Domain name=DUF821; Domain location=182-583; Score =958.8; E_value=2.3e-285; Accession=PF05686.3; Description =Arabidopsis thaliana protein of unknown function (DUF821)
MRKNNEVVFTPQQEENHEMVGNFRHFKDSIWWPVVKSLPRSTAVLLFPVMLIIGAFAYTRTLDTHFTKDSVREQEEYVSYLGVTYWKVRHGHVDVVGLTLAAKPMFLTATGARNCGLTRHREIPKVRMFSGASSSKSAQSTTPYGTSPFTVSIRKPIAPLNCTAYNLTGTCPTNLQDHQNSPATATCPDYFRWIHEDLRPWARTGITQDMVERAKQTANFRLIILKGRAYLETYSRPYQTRDVFSIWGILQLLRRYPGKIPDLELMFDCEDWPVVLADRYNGPNVEQPPPLFRYCGNDATLDIVFPDWSFWGWAEINIKPWHILLGELKEGTTRIPWLNREPYAYWKGNPAVAETRQDLIKCNVSENQDWNARLFAQDWFRESQEGFNKSDLPSQCTYRYKVYIEGSAWSVSQKYILSCDSTTLLVKPKYYDFFTRGLIPVHHYWPIKDDDKCRSIKFAVDWGNNHKQRAHQIGKVASDFIQEEVKMDYVYDYMFHLLNSYAKLFRYKPSKSANATELCVESMVCEAEGSVKKFMMESLVKVPANTDPCTMPAPFDPPTLYATLQRKESSIQQVESWEKSYWDIKP

SEQ ID NO: 93840 - protein, 92 aa, Glycine max
  Coding DNA Sequence Number=SeqID_2155
MSSQVSKHVTEQESGQDLFESKREKSLLKGIPRFKEVFAKYKARTGKRASNHWAIRVGVWSSRTSTSSNVDNRSKEQICACKMYVAGHLALG

SEQ ID NO: 93841 - protein, 353 aa, Glycine max
  Coding DNA Sequence Number=SeqID_2156
KKGHGEGCEICGDWAQMFEPLDSQHDIGAANGEGDLRGHSVTVEGVAVADHDAERGGGGSGEVKEACNPCLDEVMRTFAIHKDNDAVVADGTIEAKGGIRGEDVFVRDEQMEPGLASVARGAFIITMVAEPLVAAHGELLGGETLDREFRGERGGGVRERGMRRRPRAAATIEHLVLLKPGKLDGLGDADGAVGEALKSCKVIGNGACLLKLEQDTLVIEELGYFEYPAQRVVAIETGNVELEGYGGKAFEEGFNLGCEGRVDIVNLGIEGLMTLGEGSVALGEAVDSFFELVDGGLAGMVVGHGVEEQNSIRSSHEVFQVCGSVGHSLGPVSAAVIGICGLVLHNAIKMCTP

SEQ ID NO: 93842 - protein, 29 aa, Glycine max
  Coding DNA Sequence Number=SeqID_2157
MTWLDFVECPKVQDEQMENLEMDLMASIG

SEQ ID NO: 93843 - protein, 64 aa, Glycine max
  Coding DNA Sequence Number=SeqID_2158
MMTTKDDDKEQVKSSRIKKNSRLKKKVYNQESRFKIQDLKNQDEDSRLKIQDSRMKKRLNQDKY

SEQ ID NO: 93844 - protein, 212 aa, Glycine max
  Coding DNA Sequence Number=SeqID_2159
MAPRKLASKRSRKDKAAEGTSSAPEYDSHRFRSAEHQQRFEAIKGWSFLRERRVQLRDDEYTDFQEEIVRRRWASLVTPMAKFDPDIVLEFYANAWPTEEGVRDMQSWVRGQWIPFDADALSQFLGYPLVLEEGQECEYGQKRNLADGFNEGAITQLLCIPGQDFARTAAGRRVRIMRTNMTTLTQIWMTLLLSNIQPSDHNFDLPLSKCQL

SEQ ID NO: 93845 - protein, 148 aa, Glycine max
  Coding DNA Sequence Number=SeqID_2160
MGIYEGVMITFAAPDKNWKFDIHFSLPLHAQTCGRPVHSAREYVFTVDVDNRMIVRLYPLVLPLDAVGYVNAGDDYGTALGVRGRRHFWKLSMHNGLKCFAEPWFQFLIENDLMAGDEVVFYFRPNQLLWEVIARKQTVWDEDEDDSP

SEQ ID NO: 93846 - protein, 109 aa, Glycine max
  Coding DNA Sequence Number=SeqID_2161
FQPTYGCSNIISNIIRAKFDEPAASWLTVSVDLRDRLFGEFKFLFPILFRNSIGGIHKKSEPLELFLRQKSKEFQRPPTFWEVMEKTKKLKSGEWVNDKSRKFALSCFF

SEQ ID NO: 93847 - protein, 59 aa, Glycine max
  Coding DNA Sequence Number=SeqID_2162
  Subcellular localization annotation: CTP_CleavageSite=42; ConfidenceScore=5.32e-01
ASAGRSTTTALGWPVAGNRHTATTSKVHLSSSIKRRPAKDVKEALLGGNLVPFESMLVI

SEQ ID NO: 93848 - protein, 126 aa, Glycine max
  Coding DNA Sequence Number=SeqID_2163
  Subcellular localization annotation: CTP_CleavageSite=43; ConfidenceScore=5.17e-01
MVGCAPSKLCRFGLASKPSYNVKRGKFGHPLTNTFAENCTECECKPLRSELSRIRMSYGLLSLLKKKGGSHNIPQGSSISLFELRLMHTCSDLYWTRDPGLLSIDDPFRNKKCEESRRGLLERGRL

SEQ ID NO: 93849 - protein, 191 aa, Glycine max
  Coding DNA Sequence Number=SeqID_2164
  Gene Ontology: Mol. function=oxidoreductase activity; Cellular component=1-2nm peptidoglycan-based cell wall; Biological process =electron transport
  Homolog annotation: Hit_ID=Q57PH8; Match level="QueryCoverage=100%, HitCoverage=47%, E-value=1e-34, Identity=82%"; Hit description =Electron transport complex protein rnfA
  Pfam annotation: Domain name=Rnf-Nqr; Domain location=1-186; Score =109.0; E_value=1.4e-29; Accession=PF02508.5; Description=Rnf-Nqr subunit, membrane protein
MTDYLLLFVGTVLVNNFVLVKFLGLCPFMGVSKKLETAMGMGLATTFVMTLASICAWLIDTWILIPLNLIYLRTLAFILVIAVVVQFTEMVIGGFFISGRKMTDYLLLFVGTVLVNNFVLVKFLGLCPFMGVSKKLETAMGMGLATTFVMTLASICAWLIDTWILIPLNLIYLRTLAFILVIAVVVQFTEM

SEQ ID NO: 93850 - protein, 79 aa, Glycine max
  Coding DNA Sequence Number=SeqID_2165
MALLEKSIVPYGSTLVTRERQPAAFALGTVADPKDPHRYRPWDPGGPRQTQNTLRTRKYQSKFSLSLSLALSLFFYGGS

SEQ ID NO: 93851 - protein, 54 aa, Glycine max
  Coding DNA Sequence Number=SeqID_2166
MHPLSFRNSKLGGKRVDTNSAPFVIQEQQVERWAETNYGSAGREVHWPNGVSLE

SEQ ID NO: 93852 - protein, 78 aa, Glycine max
  Coding DNA Sequence Number=SeqID_2167
  Gene Ontology: Biological process=transposition, DNA-mediated
  Homolog annotation: Hit_ID=Q1J7G7; Match level="QueryCoverage=42%, HitCoverage=47%, E-value=1e-11, Identity=96%"; Hit description =Transposase
MVKVGTSYVPINVSFSPKVGPGLPRDLPSQVLQWLLFLSAVPPVQLLTGWCVTAKAPPDISAGKCSGHAARNHHTRRA

SEQ ID NO: 93853 - protein, 95 aa, Glycine max
  Coding DNA Sequence Number=SeqID_2168
MAPKKISTKRSRRDAAAEGTSAAPEFNSHNFRSAEHQQHIEAIKGWSFHRERHVQLREDEYTDFQEEIARRHWTSLVTPMAKFDLEVVLEFYANA

SEQ ID NO: 93854 - protein, 107 aa, Glycine max
  Coding DNA Sequence Number=SeqID_2169
MDWWLKDKGFQDLVKLEWGNYHPLGWGGLVLKQKIKFIKQKIRQWSISQGHISSRKVLNLKRERKALEEGFTSRILSQDEVKLRKSLQEQLWNASYAVESMLRQKLE

SEQ ID NO: 93855 - protein, 66 aa, Glycine max
  Coding DNA Sequence Number=SeqID_2170
MPTRDQRMLLLGLPLAPYEKSKSLGSGGIGGAICLVNSVNERDLSLLNSYVEVTLHGQLLRGTMAA

SEQ ID NO: 93856 - protein, 33 aa, Glycine max
  Coding DNA Sequence Number=SeqID_2171
MLKDQSKNNSSESRTIQEFKIRIKKNSRLKKKV

SEQ ID NO: 93857 - protein, 118 aa, Glycine max
  Coding DNA Sequence Number=SeqID_2172
MVFHLRLVMSFKTKKGEHRLKGAIKGINSTKHQQEPQVQAIVQAQVVYGSFSQSFACPQAKKEQFTCRQVKSYNDHLKMLPSNDPGTYTLESHLKKLVRMEKSFLSKVRHHQLSQRIG

SEQ ID NO: 93858 - protein, 81 aa, Glycine max
  Coding DNA Sequence Number=SeqID_2173
  Homolog annotation: Hit_ID=A0ST23; Match level="QueryCoverage=33%, HitCoverage=55%, E-value=2e-08, Identity=100%"; Hit description =Putative reverse transcriptase
PGGTIGKTTGRPTVIKLIDTVDLEGGPVGKPVVPAALMNRPTRGERRFAYWALAECILAYYVGTDEGVSEVLHVAGKKGCT

SEQ ID NO: 93859 - protein, 109 aa, Glycine max
  Coding DNA Sequence Number=SeqID_2174
MPECLLIPMSFLPKSFGLGLVEFSPNFPRLAILKFFNMLKFVVNHMINDICQLFRQLRHEIVYPDGYMLFFKGGRHGNILSISGSFAMTKDIRIWLGMFCIGWAIEIAK

SEQ ID NO: 93860 - protein, 164 aa, Glycine max
  Coding DNA Sequence Number=SeqID_2175
  Homolog annotation: Hit_ID=A5BGH9; Match level="QueryCoverage=59%, HitCoverage=19%, E-value=2e-07, Identity=32%"; Hit description =Putative uncharacterized protein
MTRGNPSDLQPFDPEIDRTFHRLIRHHFIPFDHSEHSITGESVHSVIGDFEHPDLEHYNFEHSDSEHSDFAHSENMAQPPPRERTLREMAAPDFTYESLCIQYTDEDVPYVLKTGLIHLLPKFHGLAGEDPHKHLKEFHIVCSTMKPPDVQEDHIFLKAFSSFI

SEQ ID NO: 93861 - protein, 81 aa, Glycine max
  Coding DNA Sequence Number=SeqID_2176
  Gene Ontology: Biological process=transposition, DNA-mediated
  Homolog annotation: Hit_ID=Q1J7G7; Match level="QueryCoverage=40%, HitCoverage=47%, E-value=7e-12, Identity=100%"; Hit description =Transposase
WNLYVPINVSFSPKVGPGLPGINRDTRIYLFCEVLQWLLFLSAVPPVQLLTGWCVTAKAPPDISAGKCSGHAARNHHTRRA

SEQ ID NO: 93862 - protein, 163 aa, Glycine max
  Coding DNA Sequence Number=SeqID_2177
  Homolog annotation: Hit_ID=A0ST23; Match level="QueryCoverage=15%, HitCoverage=53%, E-value=1e-06, Identity=96%"; Hit description =Putative reverse transcriptase
MVKVGTSYVPINVSFSPKVGPGLPGIKQGTPRIYLFCEVIFRHRVLQWLLFLSAVPPVQLLTGVVRNGKKPRRPSALASVAVPAARRVPFAIQAAQLLGRAIGAGLFAITPAGERGMCCKAIKLVGKTVVPAALMNRPTRGERRFAYWALAECILAYYVGTDE

SEQ ID NO: 93863 - protein, 163 aa, Glycine max
  Coding DNA Sequence Number=SeqID_2178
  Homolog annotation: Hit_ID=A8P6U5; Match level="QueryCoverage=15%, HitCoverage=40%, E-value=3e-07, Identity=96%"; Hit description =Putative uncharacterized protein
MKTSLANAFAVVRLHKSKNFTSDYEIRMPPTVPVNHYSDPEGQHNRIRILWCYPMLITGGTTRPVKDRSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 93864 - protein, 346 aa, Glycine max
  Coding DNA Sequence Number=SeqID_2179
  Homolog annotation: Hit_ID=Q2HW90; Match level="QueryCoverage=76%, HitCoverage=65%, E-value=3e-28, Identity=29%"; Hit description =Putative uncharacterized protein
MDQVQCQAFRKAYRKIWDLAMIEVSVEAITSLAHYYDQSLRCFTFRDFQLFPTIKEFEGILGCPQRLEERAETLADQGEWTSSIDILALLVFGIVLFPNVDGLVDLAVIDVFLAYHHNKESSVIAVLADAYDTFDLRCEKSSARIVCCTPALYVWLVSHIFLHEGRPVSPLQDHRMCAKKGKVNWEELLAGFPNVPLMGTRGCINYNPILAIRQLGYPMRRALPEEIITPFVARGFSEGNAKMLQRIRKAWNTMERKDKELIGSSNVPEESEEVQALKVELERTRVVKEKLKTIVTRVRKECDELRDVNITMAKALEWKTKRARKEEWGRNKFRGALWGSNNELKL

SEQ ID NO: 93865 - protein, 141 aa, Glycine max
  Coding DNA Sequence Number=SeqID_2180
MGYMRIRGEKGVFVPWREKERWSTKNIMKDTWRDHDHSYDLMDGTFLTAPPVTGEDPDKCRVAPPALINNIPTRVMCSLQSTFSVSVIISERNSTLLLSYRETFPAGGSILNKRTGVATRRRKCASFVVPKSIKLNNLSRH

SEQ ID NO: 93866 - protein, 312 aa, Glycine max
  Coding DNA Sequence Number=SeqID_2181
  Pfam annotation: Domain name=Retrotrans_gag; Domain location=64-138; Score=6.4; E_value=0.013; Accession=PF03732.8; Description =Retrotransposon gag protein
METRMEAMEKAMEENREVVESQLSLVEGMIQRLAVVWEKKSPATNVHTVYASGGDEVREEDKLEAVMITMEGEALSWFQWWESWNPNHFWDGFKIVVTQRFQAASLGNPFQALLTLQQEETGLEETFLVEVFLKGLKEEISTEVRRYEPKNLMEAMVKARRVEDKSKILGKLPVGDGRGSNLQKTVHSGQKGTFHNWSPVKELRLEVTPTGLYFVEVGDGHKNRKVLLRAEPELIKASINMKMIKGTMLESDQGFMMELKQVEGEKGWEVVPDLVAQLLTQFEQVFRNFKGYHHIEKEIMLSLSKREPRSPT

SEQ ID NO: 93867 - protein, 130 aa, Glycine max
  Coding DNA Sequence Number=SeqID_2182
MTNRLRILCLNTLEGTSFVVQVKGTSTWVAITENKRGYISCGSIQVEGTSTWLFKENKGGYIPCGSLLVKDFTRLKEISRTAPLELVGLGSSSSMDSFASWKMNGSGMEKKEREETPLQGEDESRRSSPP

SEQ ID NO: 93868 - protein, 116 aa, Glycine max
  Coding DNA Sequence Number=SeqID_2183
MAPKKLLSKRARQNAMGEGFRAAPQADLEFDGHRFRSEEHQRCFEAIKSWTFLKERRVQLREGEYNEFQEEVARRQWTQLVGPKAKYNLEIVMEFYTNAWPTEEGVRDKHSWVRGQ

SEQ ID NO: 93869 - protein, 64 aa, Glycine max
  Coding DNA Sequence Number=SeqID_2184
  Subcellular localization annotation: CTP_CleavageSite=16; ConfidenceScore=5.01e-01
MQRLTSSSAPVATYPSAGGRRGTHGCVLHGRKMCGVATNVYLRKTSGKIGKDVEYNGSCIYTWG

SEQ ID NO: 93870 - protein, 48 aa, Glycine max
  Coding DNA Sequence Number=SeqID_2185
MEIPYGHPHLSSTEGNELDDIKMMFYSHRPKTFKPNDARDSSLLGRDD

SEQ ID NO: 93871 - protein, 149 aa, Glycine max
  Coding DNA Sequence Number=SeqID_2186
  Homolog annotation: Hit_ID=Q1SN17; Match level="QueryCoverage=55%, HitCoverage=17%, E-value=4e-12, Identity=42%"; Hit description =Transposase, putative
MSEEVDMKVENEEDAGMKLFASHNKVLHWTRSVTHDIGFIVVIMRSDINTGVRGRASFLLIACERSGRLTKDEKIVVADMTKSMVKPRNILLMLKEHNANSYTTIKQIYNVRHAYRSSIRGSNTEMQQCMMLFDRDQYIHWHRMKDDNV

SEQ ID NO: 93872 - protein, 312 aa, Glycine max
  Coding DNA Sequence Number=SeqID_2187
MCIATDYNVKSIGGFTLLIQLWAWERCPTLVPPFIPPQQQIAPLAYRWLGGEFHHIGNDNLLELRRKLDVMKHDDFAWVPYSGHVEMNLSQGEIAETLHFMVSPVGRRVCTFEDLLPCIEKITLLFDEEDRILEAHEDAPPSQPQLEHQQFNILQRSVETRGLARHRQTVDAAPYSLPSMPERQHGMYYTPPTFTQEPSHMAPMYSYPHDFQPGYSMTGIFGSSPPLGGTLSFTQNNELSTPNAPLGGPWKVPGNIPDMDDLLGVDLRHDFSAKADEVDERAKCRRRNPDRAVRNWDRPCGTSSRHHRHSDD

SEQ ID NO: 93873 - protein, 59 aa, Glycine max
  Coding DNA Sequence Number=SeqID_2188
VKGRSPEYQEHLDLRSTPFQGGGDDAILPPRVLDRRVQEDWTRAVKEGPRVLMNLRVDF

SEQ ID NO: 93874 - protein, 227 aa, Glycine max
  Coding DNA Sequence Number=SeqID_2189
  Gene Ontology: Mol. function=hydrolase activity, acting on glycosyl bonds; Biological process=peptidoglycan catabolic process
  Homolog annotation: Hit_ID=Q8ZMY9; Match level="QueryCoverage=51%, HitCoverage=78%, E-value=3e-31, Identity=59%"; Hit description =Lysozyme
  Pfam annotation: Domain name=Phage_holin_3; Domain location=3-105; Score=33.3; E_value=1.5e-07; Accession=PF05106.3; Description=Phage holin family (Lysis protein S)
  Pfam annotation: Domain name=Phage_lysozyme; Domain location=109-220; Score=105.0; E_value=2.4e-28; Accession=PF00959.10; Description=Phage lysozyme
  Pfam module annotation: Pfam domain module=Phage_holin_3::Phage _lysozyme; Domain location=3-105::109-220
MKMPTNPHNWAELGDILAAWWRGDVPIGGVVMAVVMAVLRMAYAGSSWKETIFEGLMCGALALTTYSALDYFDVPKALTVGIGGFIGFVGVKKLSSFLSGYAYQDSVGVWTIGYGWTQPVDGKKVGPGMQIDQATADRLLKCGVVQYEQGVNQLVKVKITQGQFDALVSFAYNLGLRSLSTSTLLKKLNDGDKQGAANQFGRWVNSGVKRLDGLVARRAVEREMFLS

SEQ ID NO: 93875 - protein, 297 aa, Glycine max
  Coding DNA Sequence Number=SeqID_2190
  Homolog annotation: Hit_ID=Q6WAY6; Match level="QueryCoverage=74%, HitCoverage=41%, E-value=9e-18, Identity=29%"; Hit description =Putative uncharacterized protein
MSSPGKKTISFLRVSPLFEQNCNCGQGFSRGLDRIKQTRNGIAGLPQKYLEDKARGMANQGDWVPFMDVLALLIFGVVLFPNVDGLIDLAAIDAFLAYHHSKESPVVAVLADLFDTFDRRCEKSSARIICCLPALCVWLVSHLFQQDTRHPCPLLSHRSCTEKRRIDWDQLLAGIGGTRGCINYNPALAIRQLGYPMRGAPTEESMSPFLVRDFGAQNSKTIQRIHKEWETPLKKDQELRGIRNGIIGGYHEWLKVHIRGLDWLAKLKVVSKESFEAPEEDEEVQALKSELGKAKLA

SEQ ID NO: 93876 - protein, 55 aa, Glycine max
  Coding DNA Sequence Number=SeqID_2191
VVRVSFPHIVTMGIFKITSVDGEVLIARRQWNGGFNLFFFSLTLENPIRAVRGKA

SEQ ID NO: 93877 - protein, 161 aa, Glycine max
  Coding DNA Sequence Number=SeqID_2192
MPHHALLDCAHPYSLDLPNLSQVSEEDLIIMWVFLTDHQIDWAHLPFVKVKRSFSIGANVVSSFRYCKERDGSWVKKDAPVQAAEDRSPSPHSQRFDSSSLMHSILDRFDGLQTYVGERFDSLERQVDTRFEEMNSKMAKVEEDVTIIRNCLDLPPPPPPV

SEQ ID NO: 93878 - protein, 92 aa, Glycine max
  Coding DNA Sequence Number=SeqID_2193
  Gene Ontology: Mol. function=oxidoreductase activity; Cellular component=cytoplasm; Biological process=metabolic process
  Homolog annotation: Hit_ID=A7NVS1; Match level="QueryCoverage=90%, HitCoverage=21%, E-value=9e-30, Identity=68%"; Hit description =Chromosome chr18 scaffold_1, whole genome shotgun sequence
MTDGGADYCFECVGMASLMQEAYVSCRKGWGKTIVLGVDKPGSKLNLSCSEVHVCGKSLRGYLFGGLKPKSHVPILLKRYMDKGTPRYLGPL

SEQ ID NO: 93879 - protein, 183 aa, Glycine max
  Coding DNA Sequence Number=SeqID_2194
MAKFDPDIVLEFYANACPTEEGVRDMRSWVRGEWIPFDADALNQFLGDPLVLEEGQECEFSQRRNRADGFDEEAIAQLLCISGQDFARTAAGRRVRIMHTSMTTLTHMLMTLLLSNVLPIDHNSDFPLPKCQLVYATYQAPLGFPALITGLCQSFGVSITPSKVIRPPITRAFIEKYCTPRQA

SEQ ID NO: 93880 - protein, 63 aa, Glycine max
  Coding DNA Sequence Number=SeqID_2195
MMQEMCGDFKIQHHNCTPYRPKMNGAVLMDGRKERLGSQPIGRHPLPSPGQTESAAAKQPSIL

SEQ ID NO: 93881 - protein, 146 aa, Glycine max
  Coding DNA Sequence Number=SeqID_2196
MGPGAERNEEKGYVRVRKLSLKLICAIARSPPSTTYDGCPITQQARCEEETLGTLGGVPLPKTKLDQSRPTPGIGVWETLEGNERCRFRGIIRLTATSLVHPEQPACTLQQPVEWILPTPTPYRLVEPVQVIEVSSSEEDLEEDPE

SEQ ID NO: 93882 - protein, 76 aa, Glycine max
  Coding DNA Sequence Number=SeqID_2197
MKTGGAESGCHKRCLDILERLVADRRCCSKHEDRGSRSRKLMSHLQLEEFPLCLITLIMKVADPTCITARTCSGSV

SEQ ID NO: 93883 - protein, 93 aa, Glycine max
  Coding DNA Sequence Number=SeqID_2198
  Gene Ontology: Mol. function=structural constituent of ribosome; Cellular component=ribonucleoprotein complex; Biological process =translation
  Homolog annotation: Hit_ID=UPI0001596B81; Match level="QueryCoverage =65%, HitCoverage=65%, E-value=2e-26, Identity=91%"; Hit description =ribosomal protein L23
  Pfam annotation: Domain name=Ribosomal_L23; Domain location=6-86; Score=55.9; E_value=1.4e-13; Accession=PF00276.11; Description =Ribosomal protein L23
MESHHPYITNWCVFTDKSIRLLGKNQYTFNVESGSTRTEIKHWVELFFDVKVIAMNSHRLPVKGRRVRPIMDHSNALQTYDYYASTGFLYSTS

SEQ ID NO: 93884 - protein, 282 aa, Glycine max
  Coding DNA Sequence Number=SeqID_2199
  Gene Ontology: Mol. function=transporter activity; Biological process= transport
  Homolog annotation: Hit_ID=A5FBX4; Match level="QueryCoverage=97%, HitCoverage=67%, E-value=6e-66, Identity=43%"; Hit description=Outer membrane efflux protein
  Pfam annotation: Domain name=OEP; Domain location=101-279; Score =20.9; E_value=0.00068; Accession=PF02321.9; Description=Outer membrane efflux protein
MEKKVIYNQEQQKLYRGQISSIEKLTKSYQNQLNLGNISKSEYVRLKAQEIEFKKKLISLQQEIAEQQVELKALLILPATSYLVITDHLSIPEKELSELELPNWLNMAKENRPDIQITKNKEKYAQKNLELQRALRTPDIALSMGYDRGGNIMKDFVGLGISFDLPVFDRNKGNIQEAKLEVTKSNFETRKNILKSENEIVSVFQNYTRTQKISEELDGSDESTLDGLLASHEKNFRLRNISMLEYMDFLETYIGNKMIILDTKKELNQYYENLQYAVGQDL

SEQ ID NO: 93885 - protein, 34 aa, Glycine max
  Coding DNA Sequence Number=SeqID_2200
  Homolog annotation: Hit_ID=Q7XYU6; Match level="QueryCoverage=100%, HitCoverage=10%, E-value=7e-07, Identity=70%"; Hit description =Integrase
MAHFVACKKVDDAWHVADLFFKEVVTLHGLHRSI

SEQ ID NO: 93886 - protein, 66 aa, Glycine max
  Coding DNA Sequence Number=SeqID_2201
GCKYRPILTMLFLEGPMSIGKLCCVPARDPAKHRAWAWINAKGKGRKFSYCEWEMNPRACLNCLTL

SEQ ID NO: 93887 - protein, 112 aa, Glycine max
  Coding DNA Sequence Number=SeqID_2202
MGGTRAVEEEGATVSGDAEVVGTSNLLPLAFLGPLNVTVGSSRFQQFFLIYAKLMAGLKFFRDLEYDWTPLALHRVMIKAGNPSLDVSCCVVREIWWEIRYPKFISIFIMMP

SEQ ID NO: 93888 - protein, 65 aa, Glycine max
  Coding DNA Sequence Number=SeqID_2203
MVVSFFYTHLLLAFASPIILLLLYSAATKLQEAKDFIDEEDPRPTTSTWSYIMWFYHFSFIIFLC

SEQ ID NO: 93889 - protein, 155 aa, Glycine max
  Coding DNA Sequence Number=SeqID_2204
MTGMIDLEVSVRGSLTTMTKFLIRLVEAKQAQLLEGKEYHKMQNPTVETNDHPHAPADSNIYTQPEDVSSDSAARELRPPKMGYCKICEVHLPYCKTLEMHNQENSHQRMLKLYEEIQRLKTSGSSTNTQTTDGCSKAEQRIDILTHQSGTTQLS

SEQ ID NO: 93890 - protein, 129 aa, Glycine max
  Coding DNA Sequence Number=SeqID_2205
MAMRIISKIGITYNTMKKLAVQRRVEGAAIGDLYELHERVQHKFLERLISLRRSEDVEERLEELVELGTEPREVAELGLVADDGGSGGGGGGRELGEEREEVGVEREEGFEDVVRRGRRGNEGWEKLVP

SEQ ID NO: 93891 - protein, 227 aa, Glycine max
  Coding DNA Sequence Number=SeqID_2206
MGEGPKSEPKTAVGGGGNEDAEKIGEGAKKARTAAMKECMQNWNFYRCKTGLYLEIERTKLKSMVDQFAELGVRNKKLNQFIAKSPQLLFGSPKTFYRIGPPNRFWFLRILSLVTQDGKYCLVLVFGAKALQLSDFEQRQTWTEAKFSRKFREVQPKTVLKFGKNGCPKNNVSSETTVAKHRSYLQKGRGVTPKVPTEGKLIDNNNAQGHNFKHKIGEGAKSEARTA

SEQ ID NO: 93892 - protein, 96 aa, Glycine max
  Coding DNA Sequence Number=SeqID_2207
  Subcellular localization annotation: CTP_CleavageSite=41; ConfidenceScore=5.34e-01
MEGANTFLKRKYNSRIWNILHDRFLSVFPTFSTNKRWWRLRAFSSFGRRSREPRLARPQKGRLRQIVYLLSADLALSTISSRAKPSLLALSAETPD

SEQ ID NO: 93893 - protein, 189 aa, Glycine max
  Coding DNA Sequence Number=SeqID_2208
MERSMIDAASGGALGDMTLAEARNLIEKMASNSQQFSARNDAIVIRGVHEVATNSSSSSETKKLKGKLDALVNLTFALLCSNLEQLSSMKLMLQTFTIDLLNLNRKINHNRTIMTSPATDSILDGGITLISDGLALNNNNNSLLLPSKMLLVQAGHMFLLQYSNNNNSNSHSSHSNRDNNQLRPFHNLL

SEQ ID NO: 93894 - protein, 120 aa, Glycine max
  Coding DNA Sequence Number=SeqID_2209
MFKMFKMIKMYKIIKIESRTLQGSRRNLTSRIKNQGSSFQESRSRLKTQDSRIKIRLNEDKCEKNKRGYMSCGSVLVEGTSTRFKENKGGYIPCGSLLVKGFLQGWKRNLKDRRSLEDWM

SEQ ID NO: 93895 - protein, 532 aa, Glycine max
  Coding DNA Sequence Number=SeqID_2210
  Gene Ontology: Mol. function=DNA-directed DNA polymerase activity; Cellular component=nucleus; Biological process=nucleobase, nucleoside, nucleotide and nucleic acid metabolic process
  Homolog annotation: Hit_ID=A4W6G4; Match level="QueryCoverage=98%, HitCoverage=63%, E-value=0.0, Identity=78%"; Hit description=DNA damage-inducible DNA polymerase II
  Pfam annotation: Domain name=DNA_pol_B_exo; Domain location=36-306; Score=-26.0; E_value=4.2e-06; Accession=PF03104.10; Description=DNA polymerase family B, exonuclease domain
MNSFSGVNVTEPRAGFLLTRHWRDTPTGIEVVLWLATDQGPQRLVLPVLESVAFIPREFQAQTEALIRDKRHTRLRPLNLKYFRRRPVLGLYCRSHRQLQSIEKRLRENGIAVYEAYIRPPERYLMERFITAPVWFSGEPRGDSLVNARLKPHPDYRPQLKWVSLDIETTEHGELYCIGLEGCGQRQVYMLGPPNGDASQLDFELIYLDSRPQLLEQLNAWFARHDPDVIIGWNVVQFDLRVLQKHADRYGIPLRLGRQQQPLEWREHGFKPGVFFAQASGRLVIDGIEALKSAFWDFASFSLEAVSRELLGEGKAINNPWQRMEEINWRFAHDKPALATYNLKDCELVTRIFQHTAIMPFLLERATVNGLAVDRHGGSVAAFSHLYIPRMHRAGFVAPNLGEVAPEASPGGYVMDSRPGLYDSVLVLDYKSLYPSIIRTFLIDPVGLVEGLAHPDDADSVPGFRHARFSRRTHCLPAIVGQIWQGREAAKRDGNQPLSQALKIIMNAFYGVLGTSACRFFDPRLASSITLR

SEQ ID NO: 93896 - protein, 69 aa, Glycine max
  Coding DNA Sequence Number=SeqID_2211
MSTQGAEGMGKEKDGKLARFKGWVVANFQGLNKVDLGIKWMNGMVEDEMVEGKNHSFQRGQHPKDVKDL

SEQ ID NO: 93897 - protein, 89 aa, Glycine max
  Coding DNA Sequence Number=SeqID_2212
MKTISKLFKELDVCVKVTLKSKLREIAYPDLNSMCPPLEKVNTKGAQKKLMTKHQRSTKCDPSYSKYVDALHSVQNSNSLVKCSASSSD

SEQ ID NO: 93898 - protein, 95 aa, Glycine max
  Coding DNA Sequence Number=SeqID_2213
  Subcellular localization annotation: CTP_CleavageSite=29; ConfidenceScore=5.29e-01
MYQSCLNQSQASKHSVATYPSAGGRRVTRGMGVPRKEYARSRHQRLFEENVGKTGKDEIYELFSERFGSCIYARGRVFPFAPTYSSIWDEKIRPT

SEQ ID NO: 93899 - protein, 165 aa, Glycine max
  Coding DNA Sequence Number=SeqID_2214
MAKFDPDIVLEFYANAWRTEEGVRDMRSWVRGQWIPFDADALSQFLGYPLVLEGGQECEYSQRRNRVDGFDEEAIAQLLCIPGQDFAQTAAGRRVRIMRTNMTTLTQAWMTLLLSNILPNDHNSDLPLPKCQLVYVILTRMSVHVAQLIADAIYLFAGMPPTSTL

SEQ ID NO: 93900 - protein, 162 aa, Glycine max
  Coding DNA Sequence Number=SeqID_2215
MTGRLLVGSLTFDCRIMHYIIVRILMPRSSNLAQAFEEDLILMWAFLTSRLIDWTHLIHYRMHKALRSSAPLPYPQLVTLLLRHFEIPLDSKPFVQVKRSFAIGVGAVTSFGYRKDIDGQWLKKDAQPPQDKRTPSPSPQRDDSSALMHEEWIPASLNLRRM

SEQ ID NO: 93901 - protein, 82 aa, Glycine max
  Coding DNA Sequence Number=SeqID_2216
FVGCVLHAKAFDEGVKDVYGPRWESTVPGQCCPLEGRLEDTNVAPCRACRPWIFSINGFLCFLRSDCSRMEKEKDEWRRHFK

SEQ ID NO: 93902 - protein, 239 aa, Glycine max
  Coding DNA Sequence Number=SeqID_2217
  Gene Ontology: Mol. function=proline:sodium symporter activity; Cellular component=membrane; Biological process=sodium ion transport
  Homolog annotation: Hit_ID=A8GFZ0; Match level="QueryCoverage=61%, HitCoverage=51%, E-value=2e-60, Identity=85%"; Hit description=Iron permease FTR1
  Pfam annotation: Domain name=FTR1; Domain location=78-239; Score= -30.9; E_value=8.2e-06; Accession=PF03239.5; Description=Iron permease FTR1 family
MWSRMTRNGALAGMLVGAVTVIVWKQYEWLGLYEIIPGFILGCLAIVVVSLMGRRPSATMTERFDQAEAEYKTSCAAHVEPAFSAAAVFSGAALIVSLIASYLKRTQRSQWLGAVWVGVIVAAALCLALGIFINETTGEFPQKQQELFEGIVAVVAVLILTYMVFWMRKVSKSVKAHLEGAIDQALSAGKGQGWALVAMVFFAVAREGLESVFFLLAAFQQDVGAAAPIGAVLGLAAAI

SEQ ID NO: 93903 - protein, 130 aa, Glycine max
  Coding DNA Sequence Number=SeqID_2218
MVRKPENFIKLLVQRRRRSSKRFKACKGLFKSTEGESLCAYSRFSLLRPDPQELAAKLCIPGRGFELNADGQPLKILRKNMTTLAQTWSVLSFSNLIPTSHTSDVTLDRARLIYGIIMKMDMNVGYLISH

SEQ ID NO: 93904 - protein, 168 aa, Glycine max
  Coding DNA Sequence Number=SeqID_2219
  Homolog annotation: Hit_ID=Q6UUU1; Match level="QueryCoverage=35%, HitCoverage=40%, E-value=1e-18, Identity=78%"; Hit description =Putative uncharacterized protein
RVGVTRCSVGELLSQDEHQAYRYRRPRGGARYQLLFPLVRVNFELGVIMLTHINCVALTARFPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 93905 - protein, 177 aa, Glycine max
  Coding DNA Sequence Number=SeqID_2220
  Gene Ontology: Mol. function=translation elongation factor activity; Cellular component=intracellular; Biological process=translational elongation
  Homolog annotation: Hit_ID=P33169; Match level="QueryCoverage=100%, HitCoverage=44%, E-value=8e-88, Identity=88%"; Hit description =Elongation factor Tu
  Pfam annotation: Domain name=GTP_EFTU_D2; Domain location=8-77; Score= 98.1; E_value=2.8e-26; Accession=PF03144.16; Description=Elongation factor Tu domain 2
  Pfam annotation: Domain name=GTP_EFTU_D3; Domain location=82-176; Score=210.8; E_value=3.4e-60; Accession=PF03143.8; Description =Elongation factor Tu C-terminal domain
  Pfam module annotation: Pfam domain module=GTP_EFTU_D2::GTP_EFTU_D3; Domain location=8-77::82-176
VFSISGRGTVVTGRVERGIVKVGDEVEIVGIKATAKSTCTGVEMFRKLLDQGQAGENCGVLLRGIKREEIQRGQVLAKPGTIKPHTQFESEVYVLSKDEGGRHTPFFKGYRPQFYFRTTDVTGSVELPEGVEMVMPGDNIKMVVTLIHPIAMDEGLRFAIREGGRTVGAGVVAKVIA

SEQ ID NO: 93906 - protein, 99 aa, Glycine max
  Coding DNA Sequence Number=SeqID_2221
MTVANVEAMTSKIILMMPKNQELRYILCGTSRGYIYLGCYTENKIGYYNSCGSVQVEGTSTWLFKENKGGYIPCGSLACKGFYKIERNLKNCWLLGDWM

SEQ ID NO: 93907 - protein, 96 aa, Glycine max
  Coding DNA Sequence Number=SeqID_2222
  Homolog annotation: Hit_ID=A0ST23; Match level="QueryCoverage=41%, HitCoverage=81%, E-value=2e-10, Identity=82%"; Hit description =Putative reverse transcriptase
MENWTKSITVHGSKLEAGGHMNENAIHGAPKKVEKSSLSIPSTSRGGPLTHINCVALTARSPVGKPVEPAALMNRPPRRERPFAYCSLAQCILAYY

SEQ ID NO: 93908 - protein, 96 aa, Glycine max
  Coding DNA Sequence Number=SeqID_2223
MKILQKKSKSNDELPRGMEKLQEIIPSTTLLVISQKVARLVLQKGIDQKIGMDRHAKHISTPMSTNCYLDKDECWSVYRHKTISRFQSNPNGITFK

SEQ ID NO: 93909 - protein, 82 aa, Glycine max
  Coding DNA Sequence Number=SeqID_2224
MMTKVMNKKLKDQRTTQVNQRTSQVNQEQVKSSRKKNQEESKTQEESLESRIKIQGSRSQESRSRFKTQDSRIKKRLNQDKY

SEQ ID NO: 93910 - protein, 378 aa, Glycine max
  Coding DNA Sequence Number=SeqID_2225
  Gene Ontology: Mol. function=serine-type endopeptidase activity; Cellular component=extracellular region; Biological process =proteolysis
  Homolog annotation: Hit_ID=Q6X5Y8; Match level="QueryCoverage=100%, HitCoverage=65%, E-value=1e-157, Identity=75%"; Hit description =Minor extracellular protease StmPr2 preproprotein precursor
  Pfam annotation: Domain name=Peptidase_S8; Domain location=127-378; Score=230.1; E_value=5e-66; Accession=PF00082.13; Description =Subtilase family
  Pfam annotation: Domain name=Subtilisin_N; Domain location=22-111; Score=7.5; E_value=0.031; Accession=PF05922.7; Description =Subtilisin N-terminal Region
  Pfam module annotation: Pfam domain module=Peptidase_S8::Subtilisin _N; Domain location=127-378::22-111
  Subcellular localization annotation: CTP_CleavageSite=81; ConfidenceScore=5.51e-01
LGKPALPGDVQLSGLQSAPTHQRFIVKYRDGSAPVANTTALASSLKSAAAGLASSQGRALGMQQVRKLAVGPTLVKTDRPLDQAESEQLMRKLAADPNVEYVEVDQIMRATLIPNDTRFSEQWGFGTSNAGINIRPAWDKATGTGVVVAVIDTGITNHADLNANILPGYDFISDAAMARDGNGRDNNPNDEGDWYGANECGSGIPAANSSWHGTHVAGTVAAVTNNSTGVAGTAFNAKVVPVRVLGKCGGYTSDIADAIVWASGGTVSGVPANANPAEVINLSLGGGGSCSTTYQNAIDGAVGRGTTVVVAAGNCNTNVSSSVPANCPNVIAVAATTSAGARASFSNYGTGIDISAPGQSILSTLNTGTTRPGSATYA

SEQ ID NO: 93911 - protein, 178 aa, Glycine max
  Coding DNA Sequence Number=SeqID_2226
MRVQDIYSSQDEATTSPSSSESEEAKGEESSEEIYPQEDGQPLVVKEKCKETLASIATPLGLKFIPQVKKLLDEGIIRHQVPKIGGMMNVLNGATLFCKITRTPNIFMVCVHRDPLGSFSNNDQGVPMNPKRIKVIPEWPAPPSVEEKSPEFQEPRDLRSNPFQGGENDAILPRKGIG

SEQ ID NO: 93912 - protein, 87 aa, Glycine max
  Coding DNA Sequence Number=SeqID_2227
MGMYNVRIIILSNKLDKCLRHYKLRTPLPRGSSLCKGMGEGYCTQPYPCICKEAVSGFEPMTNKSPRHNFTAAPGLALCLRHYKDEK

SEQ ID NO: 93913 - protein, 121 aa, Glycine max
  Coding DNA Sequence Number=SeqID_2228
MGCRNVIHKREENWIICQPNSLEFNWQIPGLWQESTTMLSGKEDEDHGDEDEPWDPASTIPTRNLKFKLGGKIYTAKLGCMSTPMEVQINQNLLSSQPPPKPPNLTPHARAVGHSQLSHNG

SEQ ID NO: 93914 - protein, 168 aa, Glycine max
  Coding DNA Sequence Number=SeqID_2229
MSHRIRVYIKYSAEFRNNGFSLPSQGNTFYKHEKGFESNSQIHRGQDVSSTSKDQKITQKPRIYLKAKVFAPLLCSAPLFSVFHYSPPSSLFSLHFRLKKDFLTSKARLTPFSRLAQVSEHSLSELGALSAGRDKHLAERANDALSAQKLLRFSFRFSQLAKRAECLA

SEQ ID NO: 93915 - protein, 68 aa, Glycine max
  Coding DNA Sequence Number=SeqID_2230
MRCLSRECDGSLLVGLLWRLDLLASMRSFNGDFPPWRCSGRQRRRGKRRRHPLGNKPWKKELHHQDEP

SEQ ID NO: 93916 - protein, 223 aa, Glycine max
  Coding DNA Sequence Number=SeqID_2231
MGDQEETQEQIKADMSALKEQMASMMEAMLGMRQLMEKNMAIATAVSSATEADPTLLATAHHPPPNAVGRERSGLGHNNNPHLGYNRVAYPYGLPHNYTLPVMHDDAGHVSSPILEGEPPRQPDEVHEDHREYAQGDVDFCPPLPVEGPAPNTLPQPNLTAQPIFLSTEGPPPAAEERRKHDLLEERLRAVEGFGDYPFADMTDLCLVPDVVIPPKFKVPDFD

SEQ ID NO: 93917 - protein, 18 aa, Glycine max
  Coding DNA Sequence Number=SeqID_2232
MKHSSKLEGPNGPPGFST

SEQ ID NO: 93918 - protein, 131 aa, Glycine max
  Coding DNA Sequence Number=SeqID_2233
  Pfam annotation: Domain name=Transposase_23; Domain location=46-111; Score=-12.2; E_value=0.026; Accession=PF03017.5; Description =TNP1ENSPM transposase
  Subcellular localization annotation: CTP_CleavageSite=29; ConfidenceScore=5.13e-01
MASFSQLQSQMQSQGPPEPLVGPGPSGPRVSTKGSCVDPSGNDPETGDSDRCGLYIEADPACLVAVGRVYEGSTLVHNTPLLPGQVKVSVDEVKDAHAAVPVPTAEKCMRAGNSDIYGFLEPQSIQRSGQS

SEQ ID NO: 93919 - protein, 103 aa, Glycine max
  Coding DNA Sequence Number=SeqID_2234
HKISFQVNLTIIPLPKPYKLQWLNEQREMIVNQQVKVGKDQLTMKDMRDEEEKLEKQKKKKDSKALSSKDKGKEKEEKDSSKKMVKKENHFATKGDIIKGTPS

SEQ ID NO: 93920 - protein, 64 aa, Glycine max
  Coding DNA Sequence Number=SeqID_2235
MPISPCRCIGWNHTYKDTQWTRRSPIGPWGFQLWLRASVVLQGARSPQQGHVIIGKYAHRSTDF

SEQ ID NO: 93921 - protein, 117 aa, Glycine max
  Coding DNA Sequence Number=SeqID_2236
  Subcellular localization annotation: CTP_CleavageSite=69; ConfidenceScore=5.17e-01
MRPPPHEFGAMRSDCLVQFSILNLFRSPMNCVFVHGSSTHEFGAMRSDCLVQFSILNLFRSPMNCIFVHVSSTFEFGAMRSDCLVQFSILNTFSEPHELRFRSWILHPSLEPCVVIA

SEQ ID NO: 93922 - protein, 28 aa, Glycine max
  Coding DNA Sequence Number=SeqID_2237
MAEINQGKTMTAHDRSHIVRLLLAVIDA

SEQ ID NO: 93923 - protein, 212 aa, Glycine max
  Coding DNA Sequence Number=SeqID_2238
  Homolog annotation: Hit_ID=Q6WAY4; Match level="QueryCoverage=87%, HitCoverage=33%, E-value=2e-21, Identity=36%"; Hit description =Putative uncharacterized protein
MGSSQTPSLKKRFYQVKVKSLGITSLKELGQLMGQLQRQAFRKAYDKIWDLAMVEVSIGVIASLAQYYDQPLRCFTFGDFQLSPMVEEFEEILGCPLGGRRPYLFSGFYPSLARISKIVQISTQELDHRKQVENGVVGIPRKCLEAKARILAGRGEWAPFIDILALLIFGGVLFPNVDGLVDLAAIDAFLAYHDHKESPVVTMLADLYDTFD

SEQ ID NO: 93924 - protein, 150 aa, Glycine max
  Coding DNA Sequence Number=SeqID_2239
  Gene Ontology: Mol. function=endonuclease activity
  Homolog annotation: Hit_ID=Q9AY32; Match level="QueryCoverage=26%, HitCoverage=60%, E-value=2e-13, Identity=95%"; Hit description=RRNA intron-encoded homing endonuclease
MVVTVKKLVVGPWVGSIGPPPVCTGRLVPSAGDALLSLTGRVVPPHGITPQDSDPIVLAFGIGVMINRDSRGHSYFIVRGEILGFMKDEQLPKASAKDVFINQERKLGARRRSDTVLVSTINDADQGSADVAFRTPLAPYEKSKSLGSGG

SEQ ID NO: 93925 - protein, 207 aa, Glycine max
  Coding DNA Sequence Number=SeqID_2240
  Homolog annotation: Hit_ID=A7UQU7; Match level="QueryCoverage=70%, HitCoverage=23%, E-value=4e-19, Identity=40%"; Hit description=IMP dehydrogenase/GMP reductase, putative
  Pfam annotation: Domain name=DUF1723; Domain location=130-179; Score =56.8; E_value=7.2e-14; Accession=PF08330.1; Description=Protein of unknown function (DUF1723)
MVRTRGLGQRVAVTADHVDEPVIPAPDVQDDPIEAPAAVEDIPTDIPVDTGAKPAEDAHEGFSGGPSDPSMLTLYADHVACSVWTGEERPELKLSSHGRKVHSLGRSVPAIEGLVAGTGLSPLIACSVDTGDRGLLSAFVERWHQETSSFHLPVGELTITLDDVSSLLHLSIIGDLHAFEPLHVDDAVQMLVDLLMVSPESARAETV

SEQ ID NO: 93926 - protein, 162 aa, Glycine max
  Coding DNA Sequence Number=SeqID_2241
  Homolog annotation: Hit_ID=Q6WAY4; Match level="QueryCoverage=91%, HitCoverage=26%, E-value=2e-16, Identity=35%"; Hit description =Putative uncharacterized protein
MVEVSAEAIASLAQYYDQPLRCFTFGDFQLSPMVEEFEEILGCPLGGRKPYLFSGFYPSLARISKIVQISVQELDHRKQVENGVVGIPRKWLEAKAIILAGGGEWAPFINILALLIFGGVLFPNVDGLVDLAAIDAFLAYHDRQESPVVAILANLYDTFDRR

SEQ ID NO: 93927 - protein, 35 aa, Glycine max
  Coding DNA Sequence Number=SeqID_2242
KRKMFNIFKHNLDFSESLDFVGNLEEADIGKAKNL

SEQ ID NO: 93928 - protein, 111 aa, Glycine max
  Coding DNA Sequence Number=SeqID_2243
  Subcellular localization annotation: CTP_CleavageSite=80; ConfidenceScore=5.47e-01
MHTRSFTNPQFLKSRPNSQKVPSGVANCRNVPFAGEREARLTGALSKGGKVRGVATNVYLWKTSGTEGNRSNENSSSGVVFTLERSTKARLLLLRTLHQRGNQTYVVLSYA

SEQ ID NO: 93929 - protein, 221 aa, Glycine max
  Coding DNA Sequence Number=SeqID_2244
MKWFRQVNNSLKKTFTDPTQIPVIGRDLFLPFHTARHSTLPLRHGRFCGVLTAGINGAICSCLRDDSFLQALRSCATTSGSAGGCGAYSFAVSISAPFSTCTSSPVRPKILTASDCECGYLDACSAKMYNQLTQTRQKNPLFELFNSPVGAELSGCGNRNDFVFSQRRRFVTQSTVPHAAIISPQSLTCRSTPQISALCLVKARLPDYTLSILVITVLSAV

SEQ ID NO: 93930 - protein, 254 aa, Glycine max
  Coding DNA Sequence Number=SeqID_2245
MEENMWAIIDQYKEKLSLAATHKQRLEDEYTKVVNTITKHALRHPYRIRSKTRVMGDIEEVQEQMKADIEALKDQVASIMEAMLSMKRMMESNMTAVAAASIAIEVNPTHPSAINQANQPAPDMVGQGGKVLGSTGGPHLGYNRNAYPYNLPPNYTPPTTHMPNKNVNSAVPVTFEGQQPQPVGGTREEPRERAQGDFDPYPTFTVEGPAFNAMPQPNTAGAPQPRPLQPLHFSVEGHLRQWKGEGNLISSKRD

SEQ ID NO: 93931 - protein, 64 aa, Glycine max
  Coding DNA Sequence Number=SeqID_2246
MRRRNFQTELSIKVVGVIQCSVAAKNNAVTCIWPKRVGSMILSSEFYETNRRTGSYGSNTGKLG

SEQ ID NO: 93932 - protein, 92 aa, Glycine max
  Coding DNA Sequence Number=SeqID_2247
MVIISFSIIGGATRPFQNILEAGVPNPLGYAFLLFWVKKIVSVKKIQAASVTLLRRFREQFREDFPSFFTVLHPFFVLQPQNLTDRSHCNHG

SEQ ID NO: 93933 - protein, 134 aa, Glycine max
  Coding DNA Sequence Number=SeqID_2248
  Subcellular localization annotation: CTP_CleavageSite=41; ConfidenceScore=5.18e-01
MVEPSKKRKGSSSTAAATAPRRHEPSEAPTAPIHPSLSSPRSSTLFSSDDQRLRYLSQFSSRIILDPKYLDVDLFNDETFDCYQVFQNSGLVDFMSLKLPHYPKLVKVFYCNLKIQDGIISSESRAPFEAQGIL

SEQ ID NO: 93934 - protein, 31 aa, Glycine max
  Coding DNA Sequence Number=SeqID_2249
MGPTHFISKRKSYLVKVSAIALALANKRGSS

SEQ ID NO: 93935 - protein, 222 aa, Glycine max
  Coding DNA Sequence Number=SeqID_2250
GELICAIARLPPSTTYDGVVPRDMSRGSGDLGDVRWGAIAQNQAWLIPTQPEHSQSVRTCDVPKQGDRALVIDYQLGVIDYTVLPATAQLIHDRVVMECLEGVWETLEGNERCRFRGTIRLTATILVHLEEPARTFQQPVEWILPTPTPYRLVEPVQVIEVSSSKEDLEEDPEELPPEPDMDALDLPEDDEDPLPDVDSPEDIMSASEADSTEESGPGGTTN

SEQ ID NO: 93936 - protein, 61 aa, Glycine max
  Coding DNA Sequence Number=SeqID_2251
MEKSEKKNFNEKKAKRAYITWDDNDMDSSEDSENEVVNLSLMAKSYESDEEERTWHIYMLF

SEQ ID NO: 93937 - protein, 418 aa, Glycine max
  Coding DNA Sequence Number=SeqID_2252
  Homolog annotation: Hit_ID=Q2HW90; Match level="QueryCoverage=35%, HitCoverage=27%, E-value=6e-16, Identity=38%"; Hit description =Putative uncharacterized protein
RGEWVPFIDILALLIFRGVLFPNVDGLVDLAAIDAFLAYHDSKESPVVTILVDLYDTFDRRCEKSSTRIVCCTLALYVWLVSHLFRQEVRHACPQESHRSCTEKRGANWDRLLASKEGASVNWIPRWKEGRTGILISCGGFPNVPLMGTRGCISYNPVRKAWEMVQKKDKELRGSNNGPIGGYRKWLKAHMQGLDWLPSLRTTKGEEVEAPEEDEEVQALRAGLEQAQIVKERFKSAALKIRKENAELRDVNIATTKALEQETKRARREEHGRNKFRGALWGSNSELKLRREESDQSRVDSLILKDELKVCLRSKRSLSQRLCEIETNMLAIISKYQEELNLAMAHKHKVADDYARVYVEKEARGRVIDSLHQEATMWMDCFALTLNGSQELPRLLAKAKAMADTYSTPEEIHGLLSY

SEQ ID NO: 93938 - protein, 416 aa, Glycine max
  Coding DNA Sequence Number=SeqID_2253
  Gene Ontology: Mol. function=oxidoreductase activity; Cellular component=membrane; Biological process=metabolic process
  Homolog annotation: Hit_ID=A1FZK1; Match level="QueryCoverage=43%, HitCoverage=96%, E-value=8e-94, Identity=96%"; Hit description=NADPH- dependent FMN reductase
  Pfam annotation: Domain name=FMN_red; Domain location=20-186; Score =93.2; E_value=8.2e-25; Accession=PF03358.6; Description=NADPH -dependent FMN reductase
  Pfam annotation: Domain name=Flavodoxin_2; Domain location=20-196; Score=-56.6; E_value=0.0032; Accession=PF02525.8; Description =Flavodoxin-like fold
  Pfam module annotation: Pfam domain module=FMN_red::Flavodoxin_2; Domain location=20-186::20-196
GPATRLGLPHHEEYVPMSVPTIAVFVGSLRKESCNRRLAHALEKIAGDRARFQYVQIGDLPLYDQDFDGQYPPQGTRLKDQVRAADAVLFVTPEYNRSVPGVLKNAIDIGSRPYGDSAFAGKPAAVIGASIGQIGTAVAQQHLRNSLAFLDMHVLGQPEAFIHFKDGLIDADGTVHNEGTQKFLQGYVDRFLALIAVPSRARPRVPAAWPRCWPSPDYARGIGDVYRNRISRWRDPTACKTSTGRAAAGSLDYDSWPIRCTAPHPPADAMMLADYVTTCRMTRQGRRTSMAVSLEAARRCWTGAWLSSPGRCRWASSAVKPQLEVLLSASQWVASHGGRVRHRRGQPVHSFSDRLHRFGPRRGAAGQFLGWPRIWAVTTPELYVSGADAAGGGAAGVTVALSGDGGDELFFGYTRY

SEQ ID NO: 93939 - protein, 51 aa, Glycine max
  Coding DNA Sequence Number=SeqID_2254
MNVRTLSPIKARTLSPMKNKGEDFESYEGKDFEFSKGEDFESSEDEDFVNV

SEQ ID NO: 93940 - protein, 381 aa, Glycine max
  Coding DNA Sequence Number=SeqID_2255
MASRKRKRIGSRPTVHYDTRRLSSFEAWTRYTNNVLGRHILPERKVEIYHTELDEFKAELERRNFHKSLTNLVDNNIDLALVKEFYANLYSSEGPSPKQVKIIGHLVRIDADNLNTFLETPVVLAEGETLPTYSKYYRSSTDIREIKASLCIPSRGFILNSEGHPGKILRKDLTTLAQVWSVLSYSNLAPTSHTLDLTVDRARLIFGLVSEMDMNVGALISGQITSMAQSNSSRLGFPALITALCKSRGVASDSLIFERLSSVINLAYIRKNYWNPDDLTVTIRGARKVRTRLVEAPSTSTAPPLAHTLTPGTQSSLHREDAGPTAQVPQQMEDESSKTTTPDPLVRRKKADETQEAAVTSEKSLEATSEPSEPVANTTSL

SEQ ID NO: 93941 - protein, 94 aa, Glycine max
  Coding DNA Sequence Number=SeqID_2256
MGGGGVALCMIGCPRLCGHAEPIFLMNGITLHLGVKLLSQHALLRANEARLTGVLSKGGKMRGVATNVYLWKTLGKPKETGQNENSMFGSYIYV

SEQ ID NO: 93942 - protein, 69 aa, Glycine max
  Coding DNA Sequence Number=SeqID_2257
TNTEDLDVDFERIANQAEDEEDKDAGFPLELERMVTQENREMKPHEEETEIVNLGVGEEKKEVKVGTPI

SEQ ID NO: 93943 - protein, 50 aa, Glycine max
  Coding DNA Sequence Number=SeqID_2258
MEADMKAMKEKMAAMMEAMMSMKKIMEANAVAVAATSAVAKISKKPKINM

SEQ ID NO: 93944 - protein, 286 aa, Glycine max
  Coding DNA Sequence Number=SeqID_2259
  Homolog annotation: Hit_ID=Q2HW90; Match level="QueryCoverage=86%, HitCoverage=61%, E-value=6e-24, Identity=29%"; Hit description =Putative uncharacterized protein
MGSSQKPSLEKRFYQVKIKSLEVTSLRKLGQLMGQLQRQAFHKAYGKIWDLARVEVSMEPIASLAQYYDQPLRCFIFEDFQLVPTVKEFEEILGCPLGGRKPYLFSWVLSLHDKSCQGQRPWQIKANGLSFIDILALLIFGVVLFPNMEGLVDLAVIDAFLAFQHGKESPVVAILAMNDTFDRGCEKSGARIVCCALALYVWLVSHLFLQEGRKNQDSIFMRRMYKCSLDGTRGCINYNPVLAIRQLGYPMRGVPSDESITPFIARGFSDPNAKVLQGVRKACDAV

SEQ ID NO: 93945 - protein, 58 aa, Glycine max
  Coding DNA Sequence Number=SeqID_2260
STKFRALLSLSLHSSPSSSKLLSMAFYGEAKESIDEEDLRPTSSNGAYIMWYQEHLHL

SEQ ID NO: 93946 - protein, 53 aa, Glycine max
  Coding DNA Sequence Number=SeqID_2261
MASYGEAKDSIDEEDPRPTSSTWSYITCAWFNPIIPGIEILIVNTSTTSHRVE

SEQ ID NO: 93947 - protein, 248 aa, Glycine max
  Coding DNA Sequence Number=SeqID_2262
  Homolog annotation: Hit_ID=Q6WAY6; Match level="QueryCoverage=60%, HitCoverage=31%, E-value=6e-21, Identity=34%"; Hit description =Putative uncharacterized protein
MGTNQTGKRFYQVKVKSPDTTSIKELGRLMEPLQMQAFRKTYGKILELTIAEDVLSGEENHIFPPGCLPSLSRIATVVKDSARGLDRIKQTRNGIAGLPQKYLEDKARGMANQGDWVPFMDVLALLIFGVVLFPNVDGLVDLAAIDAFLAYHHSKESPVVAVLADLFDTFDRRIDWDQLLAGIGGRTISWFPRWKEGKEGVLFSCGRYPNIPLVGTRGCINYNPTLAIRQLGYPMRGAPTEESMSPFL

SEQ ID NO: 93948 - protein, 48 aa, Glycine max
  Coding DNA Sequence Number=SeqID_2263
MVVTKGIKELEKKFMKKHDKGKGSLKNNDDFLQIQKKEIPYNPNHKPK

SEQ ID NO: 93949 - protein, 222 aa, Glycine max
  Coding DNA Sequence Number=SeqID_2264
ELATQLAQASKVASSRSNSLLEEGSGRPNFQRSYGNSWIAQKHIFRFPPHHGISRIAQACFLLISDTSQDFIYCATKDAKYLKAANQRLHIMVRTLGLGRALGVGRGRGISEDTHEADVPLCHRPTASARRQQVHLREDVTERPEDVPQLHEDVPHVSDATPEMTGATDAVQTEGVATDGSLGSPAADEGFPGGPRDPSILTDFAEHVTHSIWSGRDEDFNG

SEQ ID NO: 93950 - protein, 251 aa, Glycine max
  Coding DNA Sequence Number=SeqID_2265
  Homolog annotation: Hit_ID=A5BS60; Match level="QueryCoverage=76%, HitCoverage=40%, E-value=9e-10, Identity=24%"; Hit description =Putative uncharacterized protein
MVIDQSLFYDLTQLSSKGVPFEGTLDDDWIFDFSVHDACRLVCTNKADMTGRLLAGSLALESQILHYLIVHILLPRSSNLAQVSEEDLIVMWAFHTGRQIDWAHLVQYRMHKALRLNAPLPYPHLVTLFLQHFNIPLDSEPYVPIKRSFLIGVAVVASFGYRKERDGSWVKKGAQPNDDEGHLPVEGYSSLLQSILDRFDGLQTYVGERFDSLELQVSTQFEEMNSRITKVEENVTIIRDYLDLPPPPPSV

SEQ ID NO: 93951 - protein, 71 aa, Glycine max
  Coding DNA Sequence Number=SeqID_2266
MEVQVSNPQRLWLYLSDANPIINLTCQTPNKGGLTSHSHERFYTSGANMDGRRGWMTRRKKEGMTKKEGFS

SEQ ID NO: 93952 - protein, 226 aa, Glycine max
  Coding DNA Sequence Number=SeqID_2267
  Homolog annotation: Hit_ID=A5AHQ6; Match level="QueryCoverage=95%, HitCoverage=20%, E-value=5e-09, Identity=23%"; Hit description =Putative uncharacterized protein
  Subcellular localization annotation: CTP_CleavageSite=15; ConfidenceScore=5.03e-01
MVEYSKKRKGSSSTTAAAGHRCHGPSEAPKTPIHPSLSSPRSSTMFASDDQHLRYISQFSSRIILDPKYLDPDFFNDETFDCYQVFQNSGLIDFMSLKLPYYPELVKVFYSNLKIQDGVISSEVHGSSMIIDQSLFFSLTKLPSQGAPFEGTIVDDWKFDYSSHDTRRMVCNDQAEMTGRLLAGSLTFDNRIMHYIIVRILLPRSSNLAQASEEDLILMWAFLTGR

SEQ ID NO: 93953 - protein, 66 aa, Glycine max
  Coding DNA Sequence Number=SeqID_2268
MAIEDQQISFDMFHEEGALLDQNFCLKVHVMVERRPEKKLSAHHYAKPNIFTGSKLQAVGLAEMMR

SEQ ID NO: 93954 - protein, 326 aa, Glycine max
  Coding DNA Sequence Number=SeqID_2269
  Homolog annotation: Hit_ID=Q84VI1; Match level="QueryCoverage=100%, HitCoverage=59%, E-value=1e-117, Identity=60%"; Hit description =Envelope-like protein
EQPEFNIQPIQIIPGQASVPEKLVPRRQQGVKIAENSSLATSPREVDTEMDKKIRSIVSSILKDASVPDAEKDVPTSSTPSVSVPDAEKDVPTSSAPNAEAFPSPSEEESTEEEDQASEETPAPRAPETAPGDLIDLEEVESDEEPYCQQTMAQKKSTPITPATSRRSKGQEIWKKGAWLAVERELGRDALDCKETMDLIKAAGLLKTVTKLGDCYEGLVREFIVNIPSDISNRKSDDYQRVFVRGKCVRFSPAVINKYLGRPTDGVIDIDVSEHQIAKEITAKRVQHWPKKGKLSAGKLSVKYAILHRIGAANWVPTNHTSTVAT

SEQ ID NO: 93955 - protein, 80 aa, Glycine max
  Coding DNA Sequence Number=SeqID_2270
MKNGGKSSRNRSQKRLESVAEVPGLGFSSRKQFFSLISREKREVVAAQLAWLLPPEGTAFCWNTLEGPSGPGCYLHTPFY

SEQ ID NO: 93956 - protein, 147 aa, Glycine max
  Coding DNA Sequence Number=SeqID_2271
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MSVKNLVGRLGVHDKTNHTIVSQVTLTSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 93957 - protein, 163 aa, Glycine max
  Coding DNA Sequence Number=SeqID_2272
MGDQEETQEQMKADMSALKEHMAFMMEAMLGMRQLMEKNAASASAVSSAAEEDPTLLATAHHPPSNIVGRGRDTLGHDGSPHLGYNQTAYPYGLPPNYSPPVLQDDAVHIASPVLEREPPQQPDEVHKDPQDYARRDVEFYPPIPEGPSPSTLPQPNITTQPI

SEQ ID NO: 93958 - protein, 73 aa, Glycine max
  Coding DNA Sequence Number=SeqID_2273
MVVGNATIEKPREEWDDDERRKLQEHEIELMRLHQHEENDKKNKGIALKASSSSIQEKGDKEDLNEIEEDEIQ

SEQ ID NO: 93959 - protein, 82 aa, Glycine max
  Coding DNA Sequence Number=SeqID_2274
  Subcellular localization annotation: CTP_CleavageSite=4; ConfidenceScore=5.12e-01
MRVHCNQASQRPSMITDSPPLLMFPQTRSPAESPTVATYPSMGGRHETHGCIFQERKMCGVTTNVYLRKTSEKPKKDVICEL

SEQ ID NO: 93960 - protein, 128 aa, Glycine max
  Coding DNA Sequence Number=SeqID_2275
SSSLGLVAKLGFSEIFTPCCLLGTSFSGTGPGPGIICMDWILSASCSWFDGVSEDDGDDGTEGQTGDEVSFGEVAMEKQSFGSVVNVLLMLSEKFEHVQIEVTAITPLADKCPACPSVFQTDLHPMPL

SEQ ID NO: 93961 - protein, 138 aa, Glycine max
  Coding DNA Sequence Number=SeqID_2276
EILPPVASCSTSEIAIEGDKEKDLPLEVILPHSSNLNIKKKSRVNVPFGQYDLKVASEEVAQRISGPADKWPNSFCHKVSKIDSMPSIQQDPIELQCALLKEMGLTYREDANKVKGLILDTENRDDMMAAERGIKKDQ

SEQ ID NO: 93962 - protein, 343 aa, Glycine max
  Coding DNA Sequence Number=SeqID_2277
  Homolog annotation: Hit_ID=A7PWH0; Match level="QueryCoverage=96%, HitCoverage=67%, E-value=1e-62, Identity=41%"; Hit description =Chromosome chr8 scaffold_34, whole genome shotgun sequence
MGTLHRRGTKSMSDLLICHVPDETPLQDFRIFLRLLHRSSLTSSSDVVFLFPSPSSSIKFTHIILQENTAFSSLLHLHAHLNSTRWRQHPKSTFDPNRFISKTTQQQQPLWGPKTRTNSNRSHSLSYGSVLSFDASELDPENSLSSFLDKVPLTLRRWACYPMLLGRVRRNFKHVMLADVRSLLILKDPLARVRNRSPDSVILFTKTEKHGKRTQRAVVSSVIMGGARGVRRLSGTVVVEIVRAATQHRKKKNSVSESAVLSQLVGGSEFVWKNKNVNLIASSESIPELTSASASASVSAASSTTSFSDSAMVQRGVSNHDLNYVIMRQICSSVVDSSVYSDC

SEQ ID NO: 93963 - protein, 116 aa, Glycine max
  Coding DNA Sequence Number=SeqID_2278
MCCNFMVDIHDAGLKVRYLWGVMGRNSEMLYTNLLQNITQDLTPVKPCLVEGIPDMWIWNHSVSGVYTTKSAYAWLSNVQVGDGVLSHRGFYSSQASSSDCFNVDGSVMNEGSLGI

SEQ ID NO: 93964 - protein, 114 aa, Glycine max
  Coding DNA Sequence Number=SeqID_2279
  Gene Ontology: Mol. function=protein binding; Biological process =defense response
  Homolog annotation: Hit_ID=A2Q3B3; Match level="QueryCoverage=96%, HitCoverage=94%, E-value=3e-29, Identity=55%"; Hit description =Putative uncharacterized protein
MKFLHIEHCPRQETLPQWIQGAADTLQTLIILNCDRLKMLPEWVTTMAHLKVLHIVNCPQLLNLPSDMHRLTALEDLSIDGCPELCRKCEPQTGEYWSFISHIKLISIGEKREG

SEQ ID NO: 93965 - protein, 169 aa, Glycine max
  Coding DNA Sequence Number=SeqID_2280
  Subcellular localization annotation: CTP_CleavageSite=31; ConfidenceScore=5.04e-01
MSDLEVSGVPNLKALDTNLYTSSHTVVQNVLYMTVVTQNLMNGVRDTQLVPLQGFNVKFGSFAGFPGGVADTRGGAVDEHESAVAATTKLGEEDEAKEVVEVEGLRSGVEATVDLEGWRCQAHAAERVTGDGLDQTALFDVWNERACGSVAGSCGCVGGNNGRWDRRGG

SEQ ID NO: 93966 - protein, 431 aa, Glycine max
  Coding DNA Sequence Number=SeqID_2281
  Gene Ontology: Mol. function=nucleotide binding; Cellular component =intrinsic to membrane; Biological process=defense response
  Homolog annotation: Hit_ID=A2Q3B4; Match level="QueryCoverage=63%, HitCoverage=57%, E-value=1e-102, Identity=68%"; Hit description =Disease resistance protein; Calcium-binding EF-hand
  Pfam annotation: Domain name=LRR_1; Domain location=137-158; Score =13.4; E_value=0.85; Accession=PF00560.24; Description=Leucine Rich Repeat
  Pfam annotation: Domain name=LRR_1; Domain location=160-182; Score =8.5; E_value=8.1; Accession=PF00560.24; Description=Leucine Rich Repeat
  Pfam annotation: Domain name=LRR_1; Domain location=184-206; Score =14.3; E_value=0.46; Accession=PF00560.24; Description=Leucine Rich Repeat
  Pfam annotation: Domain name=LRR_1; Domain location=231-250; Score =3.0; E_value=86; Accession=PF00560.24; Description=Leucine Rich Repeat
  Pfam annotation: Domain name=LRR_1; Domain location=254-277; Score =11.8; E_value=2; Accession=PF00560.24; Description=Leucine Rich Repeat
  Pfam annotation: Domain name=LRR_1; Domain location=284-306; Score =1.1; E_value=1.9e+02; Accession=PF00560.24; Description=Leucine Rich Repeat
  Pfam annotation: Domain name=LRR_1; Domain location=327-349; Score =8.2; E_value=9.2; Accession=PF00560.24; Description=Leucine Rich Repeat
  Pfam annotation: Domain name=LRR_1; Domain location=351-373; Score =11.0; E_value=2.8; Accession=PF00560.24; Description=Leucine Rich Repeat
  Pfam annotation: Domain name=LRR_1; Domain location=375-401; Score =2.7; E_value=96; Accession=PF00560.24; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=137-158::160 -182::184-206::231-250::254-277::284-306::327-349::351-373::375-401
FCFTSGHIAHLWLALGLLQSGVGSQKIENIARQYIDELHSRSFLEDFMDFGNLYFFKIHDLVHDLALYVAKGELLVVNSHTHNIPEQVRHLSIVEIDSFSHALFPKSRRVRTILFPVDGVGVDSEALLDTWIARYKCLRVLDLSDSTFETLPDSISKLEHLRALHVTNNCKIKRLPHSVCKLQNLQFLSLRGCMELETLPKGLGMLISLEQLYITTKQSILSEDEFASLRNLQYLSFEYCDNLKFLFRGVQIPSLEVLLIQSCGRLESLPLHFLPKLEVLFVIQCEMLNLSLNNESPIQRLRLKLLYLEHFPRQQALPHWIQGAADTLQTLSILNCHSLKMLPEWLTTMTRLKTLHIVNCPQLLSLPSDMHHLTALEVLIIDGCPELCRKCQPQSGVCWSFIAHIKCVCIGETKGKLHSQMLSRLRLRLRD

SEQ ID NO: 93967 - protein, 272 aa, Glycine max
  Coding DNA Sequence Number=SeqID_2282
  Gene Ontology: Mol. function=transferase activity, transferring glycosyl groups; Cellular component=cytoplasm; Biological process =carbohydrate metabolic process
  Homolog annotation: Hit_ID=Q9M442; Match level="QueryCoverage=99%, HitCoverage=69%, E-value=1e-130, Identity=83%"; Hit description =Putative imbibition protein
  Pfam annotation: Domain name=Raffinose_syn; Domain location=1-256; Score=-291.1; E_value=4e-10; Accession=PF05691.3; Description =Raffinose synthase or seed imbibition protein Sip1
MSYNNDKPGNHNFDLLKKLVLPDGSVLRAQLPGRPTRDSLFVDPARDGTSLLKIWNMNKCSGVAGVFNCQGAGWCKIEKKTRIHDISPGTLTASVCASDVDLITQVAGAEWLGETIVYAYRSGEVIRLPKGVSVPVTLKVLEFELFHFCPIQEIAPSISFAAIGLLDMFNTGGSVEHVEIHRASNNKPELFDGEVLSEMTSWLSSNRAATTTIALRVRGRGRFGVYSSQRPLKCVVGGTETDFNYDSDTGLTTFSIPVPPEEMYRWSIEFQV

SEQ ID NO: 93968 - protein, 242 aa, Glycine max
  Coding DNA Sequence Number=SeqID_2283
  Subcellular localization annotation: CTP_CleavageSite=86; ConfidenceScore=5.08e-01
MEAGTTTAKAGVQMTKTKRSITRPSYLKDYDNSVSTSLLFSGGPGPRSQLLIPAPLSLAIRLNELVWTWSDGGTITTPPVKFYPTSVSPLSKRKWPNILSLILLNHCWGSLLLMFLKKLLKPSYDVYEDLKGIQDTLSIVKDVFLDAEEKKEQKHGLRAQMAEADSKCKTFVDNSFCQSRICRKFSANFPAKEICRKLSYEISLNKIHKKFPMDLKITRKSAGKFPVNLYFRRKLPTDFLAK

SEQ ID NO: 93969 - protein, 44 aa, Glycine max
  Coding DNA Sequence Number=SeqID_2284
MHWLRWFLRIVNPVLTAEEEEAQTKKKGAHQQRGRVRERRRMSF

SEQ ID NO: 93970 - protein, 582 aa, Glycine max
  Coding DNA Sequence Number=SeqID_2285
  Gene Ontology: Mol. function=catalytic activity; Cellular component =nucleus; Biological process=metabolic process
  Homolog annotation: Hit_ID=A7PWC5; Match level="QueryCoverage=98%, HitCoverage=88%, E-value=0.0, Identity=68%"; Hit description =Chromosome chr8 scaffold_34, whole genome shotgun sequence
  Pfam annotation: Domain name=PPR; Domain location=175-209; Score =21.8; E_value=0.0025; Accession=PF01535.11; Description=PPR repeat
  Pfam annotation: Domain name=PPR; Domain location=278-312; Score =28.1; E_value=3.2e-05; Accession=PF01535.11; Description=PPR repeat
  Pfam annotation: Domain name=PPR; Domain location=313-347; Score =30.6; E_value=5.7e-06; Accession=PF01535.11; Description=PPR repeat
  Pfam annotation: Domain name=PPR; Domain location=348-382; Score=8.9; E_value=0.69; Accession=PF01535.11; Description=PPR repeat
  Pfam annotation: Domain name=PPR; Domain location=414-448; Score=1.7; E_value=4.9; Accession=PF01535.11; Description=PPR repeat
  Pfam annotation: Domain name=PPR; Domain location=74-108; Score=32.7; E_value=1.3e-06; Accession=PF01535.11; Description=PPR repeat
  Pfam module annotation: Pfam domain module=PPR::PPR::PPR::PPR::PPR::PP R; Domain location=175-209::278-312::313-347::348-382::414-448::74-108
MVVLSDCRDICKVLVWFTHTRSLRKGLQLHGQVIKLGFEAIPLVCHHLINFYSKTNLPHSSLKLFDSFPHKSATTWSSVISSFAQNDLPLPALRFFRRMLRHGLLPDDHTLPTAAKSVAALSSLPLALSLHALSLKTAHHHDVFVGSSLVDTYAKCGDVNLARKVFDEMPHKNVVSWSGMIYGYSQMGLDEEALNLFKRALEQDYDIRVNDFTLSSVLRVCSASTLFELGKQVHGLCFKTSFDSSCFVASSLISLYSKCGVVEGGYKVFEEVKVRNLGMWNAMLIACAQHAHTGRTFELFEEMERVGVKPNFITFLCLLYACSHAGLVEKGEHCFGLMKEHGIEPGSQHYATLVDLLGRAGKLEEAVLVIKEMPMQPTESVWGALLTGCRIHGNTELASFVADKVFEMGAVSSGIQVLLSNAYAAAGRWEEAARARKMMRDQGIKKETGLSWVEEGNRVHTFAAGDRSHGKTREIYEKLEELGEEMAKAGYVADTSFVLKEVDGDEKSQTIRYHSERLAIAFGLITFPPEWPIRVMKNLRVCGDCHTAIKFISKCTGRVIIVRDNNRFHRFEDGKCTCGDYW

SEQ ID NO: 93971 - protein, 117 aa, Glycine max
  Coding DNA Sequence Number=SeqID_2286
  Gene Ontology: Mol. function=carbonate dehydratase activity; Cellular component=extracellular region; Biological process=one-carbon compound metabolic process
  Homolog annotation: Hit_ID=Q9M501; Match level="QueryCoverage=68%, HitCoverage=29%, E-value=3e-17, Identity=50%"; Hit description =Dioscorin B
MQLFTALPVVDAILRLEHEEYTYAIGSSTGPENWWRINPKWKTCGDGKLQSPIDLLDQRVQELPQLGKLKKAYKSAPAVLKNSGHDIVGYEENARPTQELGGRQVWLYGPMENEKPT

SEQ ID NO: 93972 - protein, 102 aa, Glycine max
  Coding DNA Sequence Number=SeqID_2287
  Gene Ontology: Mol. function=acyltransferase activity; Cellular component=endoplasmic reticulum membrane; Biological process =metabolic process
  Homolog annotation: Hit_ID=Q2Z1Y8; Match level="QueryCoverage=56%, HitCoverage=15%, E-value=2e-15, Identity=67%"; Hit description=1 -acyl-sn-glycerol-3-phosphate acyltransferase
MAIAAAAVVVPLGLLFFASGLLVNLIQAICYVVVRPVSKNLYRRINRVVAELLWLELVWLIDWWAGVKPYPCICKKAVSGFEPMTNKSPRHNFTAAPGLALS

SEQ ID NO: 93973 - protein, 278 aa, Glycine max
  Coding DNA Sequence Number=SeqID_2288
  Gene Ontology: Mol. function=heat shock protein binding; Cellular component=nucleus; Biological process=protein folding
  Homolog annotation: Hit_ID=A2Q3D3; Match level="QueryCoverage=95%, HitCoverage=95%, E-value=1e-124, Identity=86%"; Hit description=Heat shock protein DnaJ
  Pfam annotation: Domain name=DnaJ; Domain location=23-86; Score =126.7; E_value=6.6e-35; Accession=PF00226.22; Description=DnaJ domain
MAQKKKARVSDDEEMEVQHDQTSLYQVLGVERTASQQEIKKAYYKLALRLHPDKNPGDDEEAKEKFQQLQKVISILGDEEKRALYDQTGCVDDADLAGDVVQNLQEFFRTMYKKVTEADIEEFEANYRGSDSEKNDLIDLYKKCKGNMNRLFCSMLCSDPKLDSHRFKDILDEAIASGELKAKKAYQKWAKEVSEIKPPTNPLRRREKSNKQSETDLCAIIAQRRNERKGQFDLMFSSLVSKYGGGDTPEPSEEEFEATRRKLETGRSSKNSKQSKRK

SEQ ID NO: 93974 - protein, 519 aa, Glycine max
  Coding DNA Sequence Number=SeqID_2289
  Gene Ontology: Mol. function=transcription factor activity; Cellular component=nucleus; Biological process=regulation of transcription, DNA-dependent
  Homolog annotation: Hit_ID=Q6J9N8; Match level="QueryCoverage=44%, HitCoverage=52%, E-value=1e-34, Identity=37%"; Hit description=AP2 -like ethylene-responsive transcription factor AINTEGUMENTA-LIKE 7
  Pfam annotation: Domain name=AP2; Domain location=131-185; Score =25.4; E_value=0.00021; Accession=PF00847.11; Description=AP2 domain
  Pfam annotation: Domain name=AP2; Domain location=34-89; Score=32.0; E_value=2.2e-06; Accession=PF00847.11; Description=AP2 domain
  Pfam module annotation: Pfam domain module=AP2::AP2; Domain location =131-185::34-89
MSPMQCTCHLWNENDRRQHGGHRSLSEIIRRGKSVYRGVIKCNYQRFEAFVWDNSDPGKRGRPVYVGAYSTEVDAAKAHDLVSVKIGGLNALTNFPVRCYSKEMDEMRWMSTRDYISAVRWTGKDYSDGDSPYRGVYRSYMVPIGKKWEARLGREGSPNLHLGTYYTPEDAARAFDIISIKIKGRDAITNSDLNSYEVDGIMKSQITTAMDGSITLKVDGVDNETEAYPPQTQSVFQHNHQQFINSSSFSRRYQNHNLFSSNPYALGGFIGGVGSSGSGNAYGNSIVNLAAQTAQFTNQNDTLQQPLQTQQSQVNVNNFNQNIRSNNINNNNKQFLSQDSNRSVLSHAPQNLNLDKCVPFPDWPSGFGLLGGNLELEPLRNINSLNVQPLEQVMVNESTGATNGVSSLGTQIQPVEPSNQEFGATQLPFLEVNQSFEPYNFQANTLNQIPHGNLNSSLSDSFQNPSSETNNNGSPGETSGCPIDLDMRDYLNRSYIEDKDFACDFDMFGALVNEDRQGL

SEQ ID NO: 93975 - protein, 407 aa, Glycine max
  Coding DNA Sequence Number=SeqID_2290
  Gene Ontology: Mol. function=carbonate dehydratase activity; Cellular component=extracellular region; Biological process=one-carbon compound metabolic process
  Homolog annotation: Hit_ID=A2Q4E5; Match level="QueryCoverage=57%, HitCoverage=26%, E-value=2e-48, Identity=44%"; Hit description =Disease resistance protein
  Pfam annotation: Domain name=Carb_anhydrase; Domain location=245-399; Score=-58.0; E_value=1.9e-06; Accession=PF00194.12; Description =Eukaryotic-type carbonic anhydrase
  Pfam annotation: Domain name=LRR_1; Domain location=167-189; Score =14.2; E_value=0.49; Accession=PF00560.24; Description=Leucine Rich Repeat
  Pfam annotation: Domain name=LRR_1; Domain location=19-41; Score=7.6; E_value=12; Accession=PF00560.24; Description=Leucine Rich Repeat
  Pfam annotation: Domain name=LRR_1; Domain location=191-213; Score =13.2; E_value=0.96; Accession=PF00560.24; Description=Leucine Rich Repeat
  Pfam annotation: Domain name=LRR_1; Domain location=215-243; Score =2.8; E_value=92; Accession=PF00560.24; Description=Leucine Rich Repeat
  Pfam annotation: Domain name=LRR_1; Domain location=66-88; Score=3.4; E_value=73; Accession=PF00560.24; Description=Leucine Rich Repeat
  Pfam annotation: Domain name=LRR_1; Domain location=89-111; Score =4.9; E_value=38; Accession=PF00560.24; Description=Leucine Rich Repeat
  Pfam module annotation: Pfam domain module=Carb_anhydrase::LRR_1::LRR_ 1::LRR_1::LRR_1::LRR_1::LRR_1; Domain location=245-399::167-189::19 -41::191-213::215-243::66-88::89-111
IQNNPNIKRLPNSICKLQNLQFLSVLRCKELEALPKGFRKLICLRHLGITTKQPVLPYTEITNLISLELLSIESCHNMESIFGGVKFPALKALNVAACHSLKSLPLDVINFPELETLTVKDCVNLDLDLWKEHHEEQNPKLRLKYVAFWGLPQLVALPQWLQETANSLRTLIISDCDNLEMLPEWLSTMTNLKVLLIYGCPKLISLPDNIHHLTALEHLHISGCPELCKKCQPHVEDEEYTYAIGSSTGPENWWRINQKWKTCGDGKLQSPIDLLDQRVQELPQLGKLKKAYKSAPAVLKNRGHDIVLLNDIKSSVDKDIDVGLINSREIKFKSRPYYRYVGSLTTPACTEGVVWTIVKKVRTVSSEQLSALKGAVHHGYEENARPTQELGGRQVWLYGPMENEKPT

SEQ ID NO: 93976 - protein, 96 aa, Glycine max
  Coding DNA Sequence Number=SeqID_2291
MTIKNFVPHCPEALRYAKEGLKGQVEEEKGGIKVSDTIFGESQANTARETMQLLDLHTFSNVTGAVVVILYQYFSPGLIENLNRKCASADIENIFF

SEQ ID NO: 93977 - protein, 277 aa, Glycine max
  Coding DNA Sequence Number=SeqID_2292
  Gene Ontology: Mol. function=binding
  Homolog annotation: Hit_ID=A2Q4U5; Match level="QueryCoverage=71%, HitCoverage=34%, E-value=1e-72, Identity=74%"; Hit description =Tubulin binding cofactor C
MTEPTEPCTSSSLARDPTTVIHPRREPFEHGLLPIPRFIFSDPAQTLIPLKQKLLELSSNQRVDSAAISESLQISIEHARLVLDTLASVLHSDAEPLVAAKLDEIDSVGVDVHDLVLFLYIQSYKRLLPRTHKDSAAVTDVWPSTSAFDGYLSALSPLQLVRSNSRRGMPSQVDEEAHQLSYLQKHLANIVSLLAQPVEGEGEESLIGIIVVKIAIQHLGLHDPTIFLATVDPDWAMNRNLAGSVWIVVEDHGNSELCISSERDVHWVCGLGSTAQL

SEQ ID NO: 93978 - protein, 538 aa, Glycine max
  Coding DNA Sequence Number=SeqID_2293
  Gene Ontology: Mol. function=transferase activity; Biological process= DNA integration
  Homolog annotation: Hit_ID=Q2HU07; Match level="QueryCoverage=20%, HitCoverage=20%, E-value=8e-12, Identity=27%"; Hit description =Polynucleotidyl transferase, Ribonuclease H fold
  Pfam annotation: Domain name=zf-CCHC; Domain location=140-157; Score =4.6; E_value=0.31; Accession=PF00098.14; Description=Zinc knuckle
  Pfam annotation: Domain name=zf-CCHC; Domain location=92-109; Score =6.3; E_value=0.17; Accession=PF00098.14; Description=Zinc knuckle
  Pfam module annotation: Pfam domain module=zf-CCHC::zf-CCHC; Domain location=140-157::92-109
MASIKQGDQSITDYFTKLRVIWDELESYRPDPVCSYDPKCMCDALTSVMERKKQDWAMSFHMQQERQLASNDVMGNISLINAANTNSSNLGNSCTYCGKDNHTVDRCYMKNGFPQNYASKGGRGNQSGFGRGNLGGKGSKLCTYCGFTNHTVDECYRKHGYLPRHKLYKSLGSNINNISAEKEESDSSAQQRLPNRGLLLIKFGEWVANAIVAFIEAAKSNHKLSSKVDSAFAKLLCTKLDGHELFKHCKGLQREKNELAGEMENTAAEKDKLAKVVVDLKAKLKKSESRPGSSLVNKDLGHHEVGGYDGDNHGVVLVDTLEVNTVDVDVPDGMEVTLWGLTGLPSIVVARIFAGGVFVFLDLLLCLFFCWHRGFCGDPFGFLKDCSAIDRQRTSFLNLDIPSILDIVFGSFMQLIPATGIETLNKSVEAVDGPKGRWEYTAHDCVVIGYVKFLDTVDKWVSTSISPFRTVYVGETRIILSIDYVSGVSVSVVVVGGGLKPLKGVSRLRLDCVLTIGEKKRLRGGLLDLARRTESSFC

SEQ ID NO: 93979 - protein, 430 aa, Glycine max
  Coding DNA Sequence Number=SeqID_2294
  Gene Ontology: Mol. function=DNA binding; Cellular component=nucleus; Biological process=regulation of transcription, DNA-dependent
  Homolog annotation: Hit_ID=A2Q4T4; Match level="QueryCoverage=86%, HitCoverage=85%, E-value=1e-125, Identity=63%"; Hit description=SBP
  Pfam annotation: Domain name=SBP; Domain location=140-218; Score =189.1; E_value=1.1e-53; Accession=PF03110.5; Description=SBP domain
GVNHIGGDDGDHGDDHIGGSSGGEGDDNDNDHGHVMVTVEINDHGSGCGGVYDSYGGNSHNMIMVMVMIAPMASDAKLSSSESLNGLKFGQKIYFEDVGLATPATSLTSSSSSSSAATVTSSSSSRKGRGGSVQPAQPPRCQVEGCKVDLSDAKAYYSRHKVCGMHSKSPSVIVAGLQQRFCQQCSRFHQLPEFDQGKRSCRRRLAGHNERRRKPPTSSLLTSRYARLSSSAFDNSGRGSNFLMELTSYPKLSLRNSLPTPRSSELAPGNQTSTLSWNGNSETSSDLFLQGSVGGTSFASPGHPPGESYIGVTDTSCALSLLSNQTWGSRNTAPSLGLSNMINFNGTPLTQLAASSHGASIHQLPNTSWFFKGIDSGNCSPEVVPDLGLGQISQPLNSQLHGELDLSQQGRRHYMDLEQSRAYESAHWSL

SEQ ID NO: 93980 - protein, 169 aa, Glycine max
  Coding DNA Sequence Number=SeqID_2295
  Homolog annotation: Hit_ID=A7Q0E7; Match level="QueryCoverage=69%, HitCoverage=17%, E-value=6e-15, Identity=36%"; Hit description =Chromosome chr7 scaffold_42, whole genome shotgun sequence
MADKKRKERNEGNRQRPKSKKKRPNTQQKERGPCLPSSLQKQLDCLNPTTSFDSIDSDDYNDNDVHEYKEERAEEVEDDDYSNENALSDDSGEEDDGRHTRMLQAITSMPSEAFQASQLVRPGSHHFPSCPNIIPDKQPLTTWKRLSIALPRDRPLWPKTMLHYPKLSP

SEQ ID NO: 93981 - protein, 215 aa, Glycine max
  Coding DNA Sequence Number=SeqID_2296
  Gene Ontology: Mol. function=nucleotide binding; Cellular component =intrinsic to membrane; Biological process=defense response
  Homolog annotation: Hit_ID=A2Q4E5; Match level="QueryCoverage=100%, HitCoverage=26%, E-value=1e-64, Identity=57%"; Hit description =Disease resistance protein
MAESFIFSIAESLITKLASHAFQEASRVVGLYDHLRDLKKTLSLVKAVLLDAEQKQEHNHVLREWLRQLKSVFYDAQNVLDEFECQTLRKQVLKDHGTIKDQMAQQIKDVSKRLDKVATDGQKFGLRIIDVDTRVVHRRDTSRMTHSRVSDSDVIGREHDKEKIIELFMQQNPNDDDKSLSVIPIVGIGGLGKTTLAKFVFNDKRIDECFKLKMW

SEQ ID NO: 93982 - protein, 142 aa, Glycine max
  Coding DNA Sequence Number=SeqID_2297
MRSMFRCSAQSSTDQSFSMISGMETKDAPSGREMGASRNSGESETTAAEAVEDGLVFGLKKGAELACWRGSEDEVNMEGGLDHLKAPFLSSNNNGELSEVTRLKCDFFSKLPDKVRCGLDPELSFHIDYSKATGLTKGIVEF

SEQ ID NO: 93983 - protein, 188 aa, Glycine max
  Coding DNA Sequence Number=SeqID_2298
  Gene Ontology: Mol. function=protein disulfide oxidoreductase activity; Cellular component=chloroplast; Biological process=cell redox homeostasis
  Homolog annotation: Hit_ID=A7PVY3; Match level="QueryCoverage=100%, HitCoverage=100%, E-value=1e-60, Identity=62%"; Hit description =Chromosome chr8 scaffold_34, whole genome shotgun sequence
  Pfam annotation: Domain name=Thioredoxin; Domain location=75-180; Score=30.7; E_value=6.7e-07; Accession=PF00085.11; Description =Thioredoxin
MSVIGAYSHFLYGEVYQKDQQCPQYLVSGRGYLFSHKSSCGSIWVGSRKSEGKIKRRNLRVEAMWPDLSRPNELEMEEISDSEQLDQILVHAQQNSQPILIDWMATWCRKCIYLKPKLEKLAPEYHNKAKFYFVDVNKVPQTLVKRGNISKMPTIQLWKDGEMKAEVIGGHKAWLVMEEVREMIQKYL

SEQ ID NO: 93984 - protein, 52 aa, Glycine max
  Coding DNA Sequence Number=SeqID_2299
MNSRSFYMERYGCLGLKYSFTREGDFNAIKRRTETSSFLGGFQSAEQISRVY

SEQ ID NO: 93985 - protein, 37 aa, Glycine max
  Coding DNA Sequence Number=SeqID_2300
MENPEVLVCCDNDAVGGERESWVLWQKKEEGRVKCEV

SEQ ID NO: 93986 - protein, 114 aa, Glycine max
  Coding DNA Sequence Number=SeqID_2301
  Homolog annotation: Hit_ID=A7PVZ9; Match level="QueryCoverage=79%, HitCoverage=36%, E-value=2e-13, Identity=48%"; Hit description =Chromosome chr8 scaffold_34, whole genome shotgun sequence
  Subcellular localization annotation: CTP_CleavageSite=51; ConfidenceScore=5.44e-01
MSNYSYSSSYPTWNSSNSSSAMIGRFYGNSYSHQQLQPINGSPLGSWRIPTAATTAHAQSNPIFNRECSLHPLPLFSGEEMVNARMGFSGSQNRFGNYDPKSSVNDHLSLDLHL

SEQ ID NO: 93987 - protein, 327 aa, Glycine max
  Coding DNA Sequence Number=SeqID_2302
  Gene Ontology: Biological process=response to biotic stimulus
  Homolog annotation: Hit_ID=A7P884; Match level="QueryCoverage=89%, HitCoverage=89%, E-value=7e-84, Identity=50%"; Hit description =Chromosome chr3 scaffold_8, whole genome shotgun sequence
  Pfam annotation: Domain name=Dirigent; Domain location=11-177; Score =210.7; E_value=3.4e-60; Accession=PF03018.5; Description=Dirigent -like protein
  Pfam annotation: Domain name=Dirigent; Domain location=178-326; Score= 190.5; E_value=4.2e-54; Accession=PF03018.5; Description=Dirigent -like protein
  Pfam module annotation: Pfam domain module=Dirigent::Dirigent; Domain location=11-177::178-326
  Subcellular localization annotation: CTP_CleavageSite=57; ConfidenceScore=5.10e-01
MANTKHLTFTFTIVLTLLFSFATAKSPTALGVQKEKLSHLHFFFHDIVSGPKPTAVRVAQAHMTNTSSTLFGLLMMADDPLTVGPEPGSKLVGKAQGIYGFASQEDMGLLMIMNFAFTEGKYNGSTLSLLGWNAVLSTVREMPIVGGSGAFRFARGYAQAKTHTVDYKTGDAVVEYNKEKLSHLHFFFHDIGSGPKPTAVRVAQAHMTNTSSAFFGILVMADDPLTVGPEPGSKLVGKAQGIYGFASQEDVGLLMIMSFAFTEGKYNGSTLSLLGRNAVFSTVREMPIVGGSGAFRFARGYAQAKTHTFDYKTGDAVVEYNVYVFHY

SEQ ID NO: 93988 - protein, 530 aa, Glycine max
  Coding DNA Sequence Number=SeqID_2303
  Gene Ontology: Mol. function=transferase activity
  Homolog annotation: Hit_ID=Q5QPZ6; Match level="QueryCoverage=100%, HitCoverage=100%, E-value=0.0, Identity=69%"; Hit description =Glycosyltransferase
  Pfam annotation: Domain name=DUF563; Domain location=99-386; Score =430.7; E_value=2e-126; Accession=PF04577.5; Description=Protein of unknown function (DUF563)
MVHYHRSHQPRKTNTDEESQNTVMLDCSTSAYYKRTRPKLLSFLFLITFLSCCYVFAPLFLGPSFPLSLLYSPATENDVNRDGVDANDSPCSSVSTGTICCDRSGYRSDVCVMKGDIRTHSASSSVFLYNSRSNNNVSRNFEEELQHEKIKPYTRKWETSVMDTIDELNLVPKNLNLGGVGGCDVQHDVPAVFFSNGGYTGNVYHEFNDGIIPLYITSQHFKKKVVFVILEYHSWWIMKYGDILSRLSDFPPIDFRGDNRTHCFPEAIVGLRIHDELTVDSALMRGNKSIADFRNLLDKAYWPRIKGLIRDEERKAQEKLREQVSSSESSEASQQQYIIRQQVQENPTKKPTLVILSRSGSRAITNENLLVKMAKEIGFLVQVLKPDRTTELAKVYRSLNASDVMIGVHGAAMTHFLFLRPGSVFIQVVPLGTTWAAETYYGEPARKLGLKYIGYQILPRESTLYEKYDKNDPILRDPTSINKKGWEYTKKIYLDSQNVMLDLRRFRKRLHRAYEYTLSKSKLSLQHQQM

SEQ ID NO: 93989 - protein, 402 aa, Glycine max
  Coding DNA Sequence Number=SeqID_2304
  Homolog annotation: Hit_ID=A7PGX7; Match level="QueryCoverage=92%, HitCoverage=100%, E-value=6e-96, Identity=49%"; Hit description =Chromosome chr17 scaffold_16, whole genome shotgun sequence
  Pfam annotation: Domain name=DUF789; Domain location=81-365; Score =280.2; E_value=4.1e-81; Accession=PF05623.3; Description=Protein of unknown function (DUF789)
MLGTALQFGCVRGDDRFYIPVKARKNQNQRKPVQREKGVGETERTDSVSKRELVASENGNSNESSYSLKKPSSCPSVEPASNIDRFLESTTPLVTAQYLAKTTMRGWKTCDVEYQSYFALDDLWESFKEWSAYGAGVPLVLDQRQSVVQYYVPYLSAIQLYGQSDKKSNAKPRYTSEDSDGDYCRDSSSDGSSDSEFGKRTELFTAQRNSHYHTGDASFQMSRLSVHDHNTMQEGFSSDDSETGNPKDLLFEYFDHDPPYSREPLSDKILDLARDYPSLKSLRSCDLLPARNGGTQAPILVYPNDIDGGVPKISLPTFAMASYKLKGSIWTQNGVSESQVVNSLLQAADNWLRLLQVNHPDYQFFVSHGTYNRLMMELGFLMWILVTHCISSTKDELVSSEE

SEQ ID NO: 93990 - protein, 72 aa, Glycine max
  Coding DNA Sequence Number=SeqID_2305
MDDQSTKCLIAKIPTMSFLTSHCHERLKITKMVKSGGREWRENGEELGRLLQNEWVPPLGCALGCSSVWEAK

SEQ ID NO: 93991 - protein, 39 aa, Glycine max
  Coding DNA Sequence Number=SeqID_2306
MAHGRQALTFDKVELVVGSLLQMGVPFPFHKPRNTVLPQ

SEQ ID NO: 93992 - protein, 85 aa, Glycine max
  Coding DNA Sequence Number=SeqID_2307
  Homolog annotation: Hit_ID=Q2A9Z4; Match level="QueryCoverage=100%, HitCoverage=14%, E-value=3e-08, Identity=43%"; Hit description=Zinc knuckle family protein
MTIEESIHVTFDETNITSPRKEFLDDIAYSLEDMHNQERNLKRKRNEENKDVQDDIAQENDDLPKEWKTKRNHPLDNIIVDISKG

SEQ ID NO: 93993 - protein, 169 aa, Glycine max
  Coding DNA Sequence Number=SeqID_2308
MVGYTPSSFIDLVFASKRIEVGLKRGKFNHPAWTNEKTGQMKRPVEFTPIPVSYADLLPYLLDNSMVAITLAEVHQPPFLQEYDSNATCACRGEAPGCSIEHCRALKRKVQGLIDMGWLKFEENRVIFNFHRKWVQAIGLFAQVTCAPEFGLLRSFNQRLLVLHVDGGA

SEQ ID NO: 93994 - protein, 154 aa, Glycine max
  Coding DNA Sequence Number=SeqID_2309
MGPLQRQAFRKVYGKILDFTAAEVFTEAVVSLAQYYDQPLRCFTFGDFQIVPTVEEFEEILGCLLGGEKTVSFLWVSSLLEQDCSCGQRFGERIGSYEANSKRHSGPTAEILGRQGKGYGESRGMGPVCRYTSFADLWGCPLSKHGRFGGSSRN

SEQ ID NO: 93995 - protein, 110 aa, Glycine max
  Coding DNA Sequence Number=SeqID_2310
MAPKKLSVKRSRRDVTAEGTSAAPEFDSHRFRSAEHQQRFEAIKGWSFHRERRVQLRDDEYIDFQEEIARRHWTSLVTPMAKFDPDIVLEFYANAWPTEEGVRDMQSWVR

SEQ ID NO: 93996 - protein, 58 aa, Glycine max
  Coding DNA Sequence Number=SeqID_2311
MSYADLLPSLLSNKMVVVSPGKVYQPPFSQWYNPNATCAYHGSVLGHSVEQCVAFKHK

SEQ ID NO: 93997 - protein, 69 aa, Glycine max
  Coding DNA Sequence Number=SeqID_2312
MLCCEGTGPRGEGNFCKTEQLHPFLRRRLISPTYYHLIYHHQGNLPLNYLKPLPWQKSMTRGLPLWALD

SEQ ID NO: 93998 - protein, 42 aa, Glycine max
  Coding DNA Sequence Number=SeqID_2313
MAATSHFECDVPILVTTTVLAEFPKRSAPIVVISVLGLILIE

SEQ ID NO: 93999 - protein, 148 aa, Glycine max
  Coding DNA Sequence Number=SeqID_2314
  Homolog annotation: Hit_ID=Q0RSL4; Match level="QueryCoverage=63%, HitCoverage=20%, E-value=5e-07, Identity=29%"; Hit description =Putative uncharacterized protein
MAAEKISRDYLTTELAVVLSCQSLSVLCVMRIMKLAKYRLKAQVEKDEGPSGEGQSPRVEKDEGPSNPCGVYPDLSSFIGSGVYPDLSSLTGSGVYPDLSSFTGSGVYPDLSSFIGSGVYPDLSSFTGSGVYPDLSSFTGSGVIQKTL

SEQ ID NO: 94000 - protein, 143 aa, Glycine max
  Coding DNA Sequence Number=SeqID_2315
MSKSCEFGMTGPLDESISCFLIRVDPWVLEPIAIRGLHVLTFRGLCTLTFRGLCILTFRGLHVLTFRGLHALTFRGLRVLIFSVLHIHTLREFKFLGHPLILEGDQLCEHNQRGGLSRNYYAYRGKISPVPLQRDKRRSCAPT

SEQ ID NO: 94001 - protein, 85 aa, Glycine max
  Coding DNA Sequence Number=SeqID_2316
MFIRGKRRKNRKKCGLRTLSVKGLGVVFTHGEGVSLAPMYSSIVMRKSDLRSSLRTDTKSECGNGSKQPITKGFYEKSARKNKQY

SEQ ID NO: 94002 - protein, 195 aa, Glycine max
  Coding DNA Sequence Number=SeqID_2317
MGDQEETQEQMKVDMSALKEQMALMMEAMLGMRQLMEKNVATAAAVSLAAEEDPTLLATAHHPPPNAVGRGRSTLGHNSNPHLGYNWVDYPYGLPPNYTPPVMQDDAGHVSSPILEGEPPRKPDNVHEDHQEYAQGYVDFYPPIPVEGPAPNTLPHPNLTTQPIFLSTEGPPPTTEERRKLDLLEERLRVVERLR

SEQ ID NO: 94003 - protein, 107 aa, Glycine max
  Coding DNA Sequence Number=SeqID_2318
  Subcellular localization annotation: CTP_CleavageSite=18; ConfidenceScore=5.11e-01
GSTHKTPSGPGGAQQGLRVSNFGYGPLSVLQGARTPWQALITGLCQFYGVPVIPSKVIRPPTNRAFIKKYCASRQAEGETPQQPGDGQQQATKASSPPPEPLSSSTK

SEQ ID NO: 94004 - protein, 75 aa, Glycine max
  Coding DNA Sequence Number=SeqID_2319
MSSITPYGLVMERSANWRVMRVGIISISPSHWHMERGLTLILAPKSMRALPTTTLPMEHGIVTLLGSLCFEGRMR

SEQ ID NO: 94005 - protein, 188 aa, Glycine max
  Coding DNA Sequence Number=SeqID_2320
  Homolog annotation: Hit_ID=Q6UUU1; Match level="QueryCoverage=31%, HitCoverage=40%, E-value=2e-18, Identity=78%"; Hit description =Putative uncharacterized protein
GLVDNDRRCEALRVRFMADGEADASEGAGGGGRERGGGGGGGEAEIIDNSTSKSRGRNDMKSLNDEGMKLGVTRGRVDWARLPLRKPAAPPALLKPPSRGERRDAYWALAECILAYYVGTDEGVSEVLHVAGEKRLHRCVSRICDTGYIPLPRSLTRYARSFDCGERKWLTNGAEISWKMPGRYLTGK

SEQ ID NO: 94006 - protein, 117 aa, Glycine max
  Coding DNA Sequence Number=SeqID_2321
MARHDTCQGLVWFKDKKGCPTLFLHIISASPHQLDFAPYASRSYSAQWNAPGLLHNMHMLCSSRILRKMEVDEPWLGLWLPWEQVSIGHQNGGEFYRLFCCKTHFFVGVLVRVKGGV

SEQ ID NO: 94007 - protein, 273 aa, Glycine max
  Coding DNA Sequence Number=SeqID_2322
MRGAPTEESLSPFLVRDLGAQSLKVIQRIHKAWRSPLRKDKELRGIQFTRGGRLALQVKVIDEEDFEAPKEDEEVRALKLELGKARLAKEKFKSAATHIRKECTELQEENAATARALEQETKRARKEEYGREKFRGALWGSNNELKLRREERDRSRVHDMILKEELVACARSKRSLAQHLEATEQSMLAIIGKYKEELNQSVAHEQKLVEDFAQVYAEKEARGRVRLDLKWKSRPPASISQSKSHGRSVYSPRRDSWANQLLSTHDRFDGPYN

SEQ ID NO: 94008 - protein, 22 aa, Glycine max
  Coding DNA Sequence Number=SeqID_2323
MEESQRSLKMSLSLPEDTELYV

SEQ ID NO: 94009 - protein, 141 aa, Glycine max
  Coding DNA Sequence Number=SeqID_2324
MTSRDQVWSFCTLVSSRGGGPDDTRRYLTVIRTLLSSRGGGPDDKQRPKFGHSAPLYHPEAAGPMTTRRYLTVIRTLLSSKGGGPDDKQRQNLVILHPCIIQRAAGPMIRGDTLRGGGPDDTRRYLTVIRTLLSSRGGRAR

SEQ ID NO: 94010 - protein, 42 aa, Glycine max
  Coding DNA Sequence Number=SeqID_2325
  Gene Ontology: Mol. function=aspartic-type endopeptidase activity; Biological process=RNA-dependent DNA replication
  Homolog annotation: Hit_ID=A5BBR9; Match level="QueryCoverage=97%, HitCoverage=4%, E-value=2e-09, Identity=60%"; Hit description =Putative uncharacterized protein
MNPEMSLKIKEEVKKQFNVGFLAVARYPKWVAYIVPVPKKDW

SEQ ID NO: 94011 - protein, 74 aa, Glycine max
  Coding DNA Sequence Number=SeqID_2326
MTSYGEAKESIDEEDPRPTSSNGAYINFPPPGTSDKVNAPPYKHTQHPTYETWAPSSTMTMDELKLISIHLRDA

SEQ ID NO: 94012 - protein, 67 aa, Glycine max
  Coding DNA Sequence Number=SeqID_2327
  Gene Ontology: Mol. function=binding
  Homolog annotation: Hit_ID=A7P213; Match level="QueryCoverage=74%, HitCoverage=9%, E-value=1e-17, Identity=84%"; Hit description =Chromosome chr19 scaffold_4, whole genome shotgun sequence
  Pfam annotation: Domain name=TPR_1; Domain location=3-36; Score=20.1; E_value=0.0083; Accession=PF00515.19; Description=Tetratricopeptide repeat
  Pfam annotation: Domain name=TPR_2; Domain location=3-36; Score=21.4; E_value=0.0033; Accession=PF07719.8; Description=Tetratricopeptide repeat
  Pfam module annotation: Pfam domain module=TPR_1::TPR_2; Domain location=3-36::3-36
MWESTVVNLAHAYRKLTMYQDAISYYEKALALSTRSVSTYAGLAYTYHLQPFMYELPWKFRFVVSLG

SEQ ID NO: 94013 - protein, 98 aa, Glycine max
  Coding DNA Sequence Number=SeqID_2328
  Homolog annotation: Hit_ID=A5BM97; Match level="QueryCoverage=68%, HitCoverage=9%, E-value=4e-14, Identity=53%"; Hit description =Putative uncharacterized protein
  Subcellular localization annotation: CTP_CleavageSite=81; ConfidenceScore=5.19e-01
MAEAHSISSPMVSNCKLSKHGADVFQDPSLYRCSTSGTAIFLGPNLVSWWSRKQKSVVSIAHNPVFHSRTKHMEIDVFFVREKILAKQLSIVHIPDLD

SEQ ID NO: 94014 - protein, 558 aa, Glycine max
  Coding DNA Sequence Number=SeqID_2329
  Subcellular localization annotation: CTP_CleavageSite=26; ConfidenceScore=5.59e-01
MAPPLTSSPLSSVATPWSPLQLPPITEESVSSLNGMDVLNSGHCSLSSCFLTFSCAFWLLVSFSSSSIFQRGSIEQPIMDREVISIGGSSFKDTRQGAFDSESSSLERVKVSHQTGGGASRLRERARPSATGVRRGDDDGDVRASPRVQCSISVGSMSSTPTVASYEWVKLVNTKDSCKLGVQACGSDDFLFLRAVPVCFVGALECDPFPASPEQLDDDWMGLPLNSVSKKLFEFDSNIFHHFKDHFFKVLATGVVADDMSLMFNRDGEPCFLFYWQSDPTRFKLYNEDLLTRVERVGKAMEQLPASLGMRAILSLLSVNDPFVVVDGKVPDLTLVWCRRMTNMCLCYCLACFASIMGDFACRPLMMQVGPVRETVSPSAATPSAGEGGQPAGEVGPVVAVVEVTLVLLPLSWQRRRGMIVLGHLATRSRRPLESLCPEAPTVAVVTLATLASLPSPVVIVVQEVTSSVVEVVVLATQVDSIVVSLFTVAAPLLSDGVIATNAPTVLPPSSTTLMVSPSTVLVAVVSPSSSSHPRILLDHLYTFSDVDSLWGATYKPE

SEQ ID NO: 94015 - protein, 137 aa, Glycine max
  Coding DNA Sequence Number=SeqID_2330
  Homolog annotation: Hit_ID=Q69F85; Match level="QueryCoverage=45%, HitCoverage=3%, E-value=3e-08, Identity=47%"; Hit description=Gag -pol polyprotein
MERTLQHTLGVPLYTPENNQRNFLTTHNGTNAMIPVEVGEPSTKRLLYQQQQNEDNIRVELETTDEVREITRIKEVVKLRATRRYNTKVKLEKIPKRESLALTGKVPSGSQPTLTMECTDYKSWMAEQSHEHGMPST

SEQ ID NO: 94016 - protein, 104 aa, Glycine max
  Coding DNA Sequence Number=SeqID_2331
  Homolog annotation: Hit_ID=A7QDG8; Match level="QueryCoverage=53%, HitCoverage=48%, E-value=1e-15, Identity=71%"; Hit description =Chromosome chr10 scaffold_81, whole genome shotgun sequence
  Subcellular localization annotation: CTP_CleavageSite=27; ConfidenceScore=5.19e-01
MSESELASSDDQSPSSFTSSTPTIQIVSKSFSERLLGKFFDASQFDFVYEQSELWSPPVRRTVFLASPGNICSQDEMLRKLKKAKRTWKRSPMSFGALEVDHGS

SEQ ID NO: 94017 - protein, 117 aa, Glycine max
  Coding DNA Sequence Number=SeqID_2332
MTGRLLAGSLAFESRILHYLIVRILLPRSSNLAHFWKVVIIKKGEIVEAKLHGESKVIQRLKVQEKNQEQFKTQEESLESRIKIQGSMISCENQDQDSRIKRRLNQDKYEKFFSKIE

SEQ ID NO: 94018 - protein, 90 aa, Glycine max
  Coding DNA Sequence Number=SeqID_2333
MKTKARSRITDNIVSETEHEAPYQDDELLELQVLEVDADVINESFADVDGGGEEIDADLLKQLDLVEPDEDECILSENDIESDFDDTNTS

SEQ ID NO: 94019 - protein, 224 aa, Glycine max
  Coding DNA Sequence Number=SeqID_2334
MHHKEAPGPLEHVRQRQEAERHILFADRQPFIMQGEEILQGALFKTLPTLSGKSRWIGSALEGAQMLCDLAAAQIGPLVEDDNVPQLWADAAQRDGGVKLRLLTDEQYADVGVVGDKRRLRRRIGGIERHADATQVQDREIGQRPGHRVIGENTDAFLHFDAQPQQPGGDAINAGGGRSPGQLQLAVGRPLAKSCAIGSVGDLMLYTMDQMSTYSQAGGKAISA

SEQ ID NO: 94020 - protein, 320 aa, Glycine max
  Coding DNA Sequence Number=SeqID_2335
  Gene Ontology: Mol. function=UDP-N-acetylmuramoylalanyl-D-glutamyl-2 ,6-diaminopimelate-D-alanyl-D-alanine ligase activity; Cellular component=cytoplasm; Biological process=peptidoglycan-based cell wall biogenesis
  Homolog annotation: Hit_ID=A8G9S3; Match level="QueryCoverage=84%, HitCoverage=59%, E-value=1e-124, Identity=83%"; Hit description=UDP -N-acetylmuramoyl-tripeptide--D-alanyl-D-alanine ligase
  Pfam annotation: Domain name=Mur_ligase_C; Domain location=198-284; Score=58.4; E_value=2.4e-14; Accession=PF02875.12; Description=Mur ligase family, glutamate ligase domain
  Pfam annotation: Domain name=Mur_ligase_M; Domain location=1-178; Score=182.8; E_value=8.7e-52; Accession=PF08245.3; Description=Mur ligase middle domain
  Pfam module annotation: Pfam domain module=Mur_ligase_C::Mur_ligase _M; Domain location=198-284::1-178
MTAAILRECGEVLYTAGNFNNDIGVPLTLLRLEPQHDFAVIELGANHIGEIAYTTALTRPQTALVNNLAAAHLEGFGSLAGVAQAKGEIFTGLPADGVAIINADNNDWPHWQSMLGGKTVWRFSPQAAAGVDFFADDVRVNGAGTQFTLHSPFGTAEIALPLPGRHNVANALAATALAMSVGATLEAVRQGLKQLQAVPGRLFPVALAEGKLLLDDSYNANVGSMTAAAQVLAEMPGYRVMVVGDMAELGAEAEECHRQVGEAARLAGVDKSDQRRRFEPRAERSLRQRRTLSGQDCSDRARGGITVGTCGHYRVNQRFT

SEQ ID NO: 94021 - protein, 70 aa, Glycine max
  Coding DNA Sequence Number=SeqID_2336
MGEVEEVQEQMKADMEAMKEQMATMMEAMMSMKKIMEANAVAVTATNNVAKENPMPPPGLNQMINQLHIG

SEQ ID NO: 94022 - protein, 103 aa, Glycine max
  Coding DNA Sequence Number=SeqID_2337
MGAKYLEVVKRGSHPNNGWSPGEIRSMTVAPLYLSFIGDKRETQNDHNLSLRFVGHDRAWAARHIMTIICLCMPPDTITSGWRKCVRNDHNLSPPTSQLAVLE

SEQ ID NO: 94023 - protein, 90 aa, Glycine max
  Coding DNA Sequence Number=SeqID_2338
MGNQPRNNFNARGFSGFQHGQQYNQQQGQWRNHPGNHFNRDQGGPSTRPQQQGPSLYDHTMKLEETLAQFMHVSMYNQKSTESPIKNLEV

SEQ ID NO: 94024 - protein, 106 aa, Glycine max
  Coding DNA Sequence Number=SeqID_2339
MGEVDKVQDRIKADLEAIKEKMATMMEAIMSMKKIMEVNAAAIVATSAIAEVDLTPPSSLNQINHAISDMVGETGKELGSMGGPLSYPNFVRGPLLDDMQLLFWSL

SEQ ID NO: 94025 - protein, 164 aa, Glycine max
  Coding DNA Sequence Number=SeqID_2340
MAPTRHPWDPDKSNRALGFPALITGLCQSFGVPVAPTKVIRPPITRAFIEKYCTQRQAQGDAPQAAGAPPPPHQAGQAGAFDIEQYLRHLVRQQAANHRAHSQGFASFSCPTPDQFRTEVAWPGDWPEAQAGEAPPEAPGDGEEAHEDEEMADLLDFLGGSGDT

SEQ ID NO: 94026 - protein, 84 aa, Glycine max
  Coding DNA Sequence Number=SeqID_2341
MNRNQRSTKRDLSYWEYVDALHSVQNSNSSVKRSASSFYQPIPRRMPKEEKVQVADDSLSEADLLSEWHPRSKAYSSLSGLGNL

SEQ ID NO: 94027 - protein, 97 aa, Glycine max
  Coding DNA Sequence Number=SeqID_2342
VFWKLLRPIPEEVIPENTSGRPSSGMGLSNFRKHFFRKLLKSIPEEGLLEVFSGITSSGMDLSNFRKKMDEDQWRYDFAMSQEVHMDYDYDNQEECG

SEQ ID NO: 94028 - protein, 84 aa, Glycine max
  Coding DNA Sequence Number=SeqID_2343
MVLSSWGFAKKGKEGRVNCSALLGFEHSLEISKENCFREKNPSRGTSVTPPRHFRGRFHGDSSPFFIVLHRSSFVLHCSSVFNR

SEQ ID NO: 94029 - protein, 82 aa, Glycine max
  Coding DNA Sequence Number=SeqID_2344
  Subcellular localization annotation: CTP_CleavageSite=46; ConfidenceScore=5.07e-01
SLSEAIVSSTLSARLVLSQISLTRAKRQNGAKCTFKVRKPFLSLICTEKKREYDDVKEVRIDCELCAENKGKDEQGSKGPNF

SEQ ID NO: 94030 - protein, 221 aa, Glycine max
  Coding DNA Sequence Number=SeqID_2345
  Gene Ontology: Mol. function=RNA-directed DNA polymerase activity; Biological process=regulation of transcription, DNA-dependent
  Homolog annotation: Hit_ID=A5BZZ9; Match level="QueryCoverage=80%, HitCoverage=20%, E-value=1e-16, Identity=31%"; Hit description =Putative uncharacterized protein
MLSDNFSIDKETLRKDFYSPENEPQRRWFFQHYKGTNRKQIQDKFYEFVERVKQDIIGDPTTNAITNWQVKDGELIQSELPPATQFQLPNIKDSNNKPVMAIPFKTKDVNEEVTSKDIKSLMEQANYTNKYFQALGETIKTKVVHKQKSIEEASPSIPIEKPLFKPFKVSEKAKRKIRELRKTKSLIEGVGDNHSELLNKIGSLIKVIRDTPQASKNTSKM

SEQ ID NO: 94031 - protein, 303 aa, Glycine max
  Coding DNA Sequence Number=SeqID_2346
MELIENMAASDQAILRDRSYVPTKRSLLELGTQDATLAQNKLLTRQIEALTETLSKLPQQLQAKDAPHAEEPMSLDSCVSQQDTSREVNYMGVPNRGYQGYNQGNSSGFHQGGAGFNHGPPGFNQGRNFTQGSGWRNQGNQYKEQRNQQPYQPPYQHPSQGPNQQDKPTNIEELLLQFIQETRSHQKSTDAAIRNLEVQMGQLAQDKAERPTRTFGANTEKNPKEECKAVLTRGQRKAQEEGKVEEEDQTEEDQTEEDKTETQEDRTEVEEKVASPPKTKSQKAREARKEEPPALPQDLPYPV

SEQ ID NO: 94032 - protein, 187 aa, Glycine max
  Coding DNA Sequence Number=SeqID_2347
MSILALKKTQREGKFPIQEREKTQKEKKIPKPRKGEDTKKKENPNERVGESKEKKEKFSIRIGRKRNMQKGLWTRQYLNSTKLSPSNQEKGNHDLKCVSSKWSFRNEMLNIQNLIYGYEKISSAYSPSPIDTLFFIQKAYVALIGWKFCLFTKACSHFGEENTETIFSLTVVKNYVGLSSSSQIEDT

SEQ ID NO: 94033 - protein, 199 aa, Glycine max
  Coding DNA Sequence Number=SeqID_2348
MSFAFMLSKTTMSSVIYDFKNYNFFIYISKTSMSSVIYAFKDYNGFIYISKTSMSSVIYAFKDYNVFTYISKTSISSVIYAFKDYNVFTYISKTSMSSVIYAFKDYNVFIFISKTSMSSFIYAFKDYNVFIYISKTTNSLVIYISKTSMSSVLYTFKDFNDSMSLSQPTFRREGNARLMGASSKEGKRAESPPTFIRGK

SEQ ID NO: 94034 - protein, 128 aa, Glycine max
  Coding DNA Sequence Number=SeqID_2349
MASMMEAMLGMRQLMEKNVAATVSSAAKADPTLLAIARHPPSNTVGRGRNTLGHDGNPHLGYNRTTYPYGLPPNYSPPVMQDDAGHISSPVLEGEPPQQPDEVHENPQDYARRDVEFYPPIPEGPAPN

SEQ ID NO: 94035 - protein, 149 aa, Glycine max
  Coding DNA Sequence Number=SeqID_2350
  Gene Ontology: Cellular component=chloroplast
  Homolog annotation: Hit_ID=Q49KT9; Match level="QueryCoverage=57%, HitCoverage=92%, E-value=1e-25, Identity=63%"; Hit description =Putative uncharacterized protein ORF113
EREGWGFSAFGIAGPAGGPHDGLLAQWALSHMDSLMCSSAPDPEMWIIQGTLAWRTSPVRSNVDPTFSSLVGSGRSGGDHHGSSLLENSYIPYQYMDSYLSSTGLGLASMEKNGAPNNVSSQTKNYEIAPFILGDQEIGSSHKKNRMLG

SEQ ID NO: 94036 - protein, 99 aa, Glycine max
  Coding DNA Sequence Number=SeqID_2351
MRWVNRVGSYSIDPKNHFLQFTQWNSKDSTNKRWEFMWLALSFSIWYHRNAKIFKNQPFTPEKVMDDALFHTWSWIKCVEKDFQMHFNFWSTNLKDVLS

SEQ ID NO: 94037 - protein, 111 aa, Glycine max
  Coding DNA Sequence Number=SeqID_2352
MRKDVERERGREEVIQTFSFSFLEMRLREGLADELLLRKEERRRSYNIVPHKKPLLCGIGDLCGSVWRSTCDVGWGTKGGAMASGWERSGSRWVQERKRRPRKKRVQRKKK

SEQ ID NO: 94038 - protein, 132 aa, Glycine max
  Coding DNA Sequence Number=SeqID_2353
MTSKIILMMPKNQELSKFQRFKNQVSRIKIQESSFKNQDSRTIKIKIQESREDSIKIRYNLCGTSRGYIYLGCCTENKRGYISCGSVQVEGTSTWLFKENKGGYIPCGSLACKGFYKVERNLKNRWLLGEWM

SEQ ID NO: 94039 - protein, 123 aa, Glycine max
  Coding DNA Sequence Number=SeqID_2354
  Gene Ontology: Mol. function=aspartic-type endopeptidase activity; Cellular component=chromatin; Biological process=chromatin assembly or disassembly
MGPILNPLKVLDVRVVRRLEKEISQVLIQWEATEVKDAREDLQDIVNSYPQFNLKDKVVFDEKGRTHVRRSASHGSQEKHTVEEIEHIAEGLRTLGGHESDLLSNASSSLKFSGILIIFPFSL

SEQ ID NO: 94040 - protein, 103 aa, Glycine max
  Coding DNA Sequence Number=SeqID_2355
MKNNVKEVVMMLRSLMAYAEITDGIVGDNSAELFVIVVFVLCSSKKISFGFHPQLNAGKFLFLEFSAADLIDLITPEDLELTKQLNELGLPLSFQTNKESLEC

SEQ ID NO: 94041 - protein, 63 aa, Glycine max
  Coding DNA Sequence Number=SeqID_2356
MLVKNLVGRLGVHDKTNYTLASQVTLTRLKGALKSGVFTPKAYTLKNPSGPLPPDSGPTQKTF

SEQ ID NO: 94042 - protein, 217 aa, Glycine max
  Coding DNA Sequence Number=SeqID_2357
  Gene Ontology: Mol. function=protein serine/threonine kinase activity; Cellular component=plasma membrane; Biological process =protein amino acid autophosphorylation
  Homolog annotation: Hit_ID=A5AVT6; Match level="QueryCoverage=64%, HitCoverage=27%, E-value=1e-25, Identity=44%"; Hit description =Putative uncharacterized protein
MPYDHYQKSQTTKKFLLREDELVNIANLQGTTGIVFNGERTWTRDADTKYLSGDQGRTILTEAATQDPSVNQVPYTTARLSRSQFNYFFPVSASPKFIRLFFYLAYYPSFPHTDASFSVQSNGFTFLKGFNASLNADTEATKTIFREYVVNVNDGEILILSFTPSQPNSYAFINGIEVQGGEKEKKMGLSLSYPSRIGIVLKPCLALGSRIPAVSCI

SEQ ID NO: 94043 - protein, 63 aa, Glycine max
  Coding DNA Sequence Number=SeqID_2358
MSSSFNRIDGPMASLYDLKSGKFHSVIYQSVTIHFHPSMVYAGCSWVGSNRFLAKFKTQPNQI

SEQ ID NO: 94044 - protein, 63 aa, Glycine max
  Coding DNA Sequence Number=SeqID_2359
  Gene Ontology: Mol. function=RNA-directed DNA polymerase activity; Biological process=RNA-dependent DNA replication
  Homolog annotation: Hit_ID=Q946S9; Match level="QueryCoverage=57%, HitCoverage=14%, E-value=3e-09, Identity=80%"; Hit description =Reverse transcriptase
MVEKSIEVFMDDFSIFGSSFDNCLRNLEMVLQRCQKFLRACRILQEVHQGFLEDCQTLKQPAE

SEQ ID NO: 94045 - protein, 314 aa, Glycine max
  Coding DNA Sequence Number=SeqID_2360
  Homolog annotation: Hit_ID=A5B5G7; Match level="QueryCoverage=64%, HitCoverage=14%, E-value=9e-11, Identity=27%"; Hit description =Putative uncharacterized protein
MPSRKRRAVPTPGEASNWDSSRFTSEIAWHRYQDNIQLWNILPERNVELGPGMFDEFLQELRRCRWDQVLTHLPEKRIDVALVKEFYSNLYDPEDHSPRFCRVRGQVVRFDADTINDFLDTPVILEDGEEYLAYTRYLSTHPDPDTIAATLCTPGGRFVLNADGLPWKLLRKDMTTLAQTWSVLSYYDLVPTSHTSDVNLDRARLIYGLVSRMDMDVGSFISQQISQIAQSSTSRLGFPALITALCDIQGVVFDTLIFESLSPAINLAYVKKNCWNPADPSITFPGTRRTRTRASTSASEAPLPAQSPSQPSTQ

SEQ ID NO: 94046 - protein, 51 aa, Glycine max
  Coding DNA Sequence Number=SeqID_2361
MDPKRIKVIPEWPTPPSVEERIHEFQEPLDLRSNPFQGGGNDAILSSKGIG

SEQ ID NO: 94047 - protein, 108 aa, Glycine max
  Coding DNA Sequence Number=SeqID_2362
MHIRPQTHRHHLGRPIQLGHWAWSVIYSIGFASRRPTTVDSLSQQEQGSTPFVCPTPEQFRAEVAWPGDWPDAQAGEEPIGSPGEVDESHMNEDMTDLLGFLGGSGAT

SEQ ID NO: 94048 - protein, 153 aa, Glycine max
  Coding DNA Sequence Number=SeqID_2363
  Gene Ontology: Mol. function=chloramphenicol O-acetyltransferase activity; Biological process=response to antibiotic
  Homolog annotation: Hit_ID=P62577; Match level="QueryCoverage=86%, HitCoverage=60%, E-value=2e-77, Identity=100%"; Hit description =Chloramphenicol acetyltransferase
  Pfam annotation: Domain name=CAT; Domain location=1-143; Score=237.4; E_value=3.2e-68; Accession=PF00302.9; Description=Chloramphenicol acetyltransferase
MQLARQVSRLEKRAVSATQLIVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQGGA

SEQ ID NO: 94049 - protein, 54 aa, Glycine max
  Coding DNA Sequence Number=SeqID_2364
MDKSLKVGEDEWREKERRSMKFYASNELRFSTLIQDQVQDSPLSVLRCHEACKA

SEQ ID NO: 94050 - protein, 156 aa, Glycine max
  Coding DNA Sequence Number=SeqID_2365
  Subcellular localization annotation: CTP_CleavageSite=41; ConfidenceScore=5.38e-01
MPRALKNLALPLLFVTVKSLFSFSSSLKTAGNRSLDTHIVLAQTHRTPYTAGKPTFSSLEPTEPPTLFLEVWLKENPTYTVATRVLKQSWVLKAQSFLCEVRRSTSSMLSFHGCSCFIDDNNNNNNTSSVAVLLIKVQGKLKVSCHFVRSHCHCHC

SEQ ID NO: 94051 - protein, 329 aa, Glycine max
  Coding DNA Sequence Number=SeqID_2366
  Gene Ontology: Mol. function=motor activity; Cellular component=cell projection
  Homolog annotation: Hit_ID=UPI00016621D1; Match level="QueryCoverage =56%, HitCoverage=41%, E-value=4e-18, Identity=34%"; Hit description =UPI00016621D1 related cluster
LHALTFRGLHVLTFRGLQILTFRGLHVLVFRGLLALAFKGLQVLAIRGLHALTIRGLHVLAFRGLHVLTLRGLHVLVFRGLLALAFKGLHVLAIRGLHALTFKGLHVLAIRGMHALTFRGLHVLAIRLHVLTFRGLHALTFRGLHVLTFRGLNALAFIGLHALTFRGLHVLSFRGLHALAFRGLRILAFRWAIRPLLQRAASPRLQRATLSFYQFLGHPLISEEGQLCEHNQREAIAQLLCIPGQDFTRAAAKRRVRIMRTNMTTLAQIWMTLLLSNILPSDHNADLPLRKDRSHKTPSGPGGAQQGPGVSSSGYGPLSFLQGARPPQQ

SEQ ID NO: 94052 - protein, 46 aa, Glycine max
  Coding DNA Sequence Number=SeqID_2367
ENDRAYPAEVVAAQIRTLLYKHEGCTGFLIKSEIEEVDLYVQRAIS

SEQ ID NO: 94053 - protein, 273 aa, Glycine max
  Coding DNA Sequence Number=SeqID_2368
  Homolog annotation: Hit_ID=A2FDT0; Match level="QueryCoverage=37%, HitCoverage=17%, E-value=2e-07, Identity=33%"; Hit description =Putative uncharacterized protein
MTGPLDEEISCFLIRVDPWLLVPTAFRGLHAFAFRGLHVLALRGLHVLPFRGLHVLAFKGLHALAFRGLHVLAFRELHVLASRGLHALAFRGLHVLTFRGLHVLAFRGLFVLAFTGIHRAPHPRLQGTQGPLPLMLNQNLHSRFLGHPPDLRGGPTVRAQPEEEGSCPQDTLMDPKKSNRVLGFPALIMGLCQFYGVLVAPNKVIKPPINRVFIKKYHAPREAQGEAPQQPGDGQQQATDAPPPPPESTSAHLQRLEHCLRHMADQQATNHPG

SEQ ID NO: 94054 - protein, 256 aa, Glycine max
  Coding DNA Sequence Number=SeqID_2369
MASKKRKAPSTPTQARFDRSRFTSQEAWERYTYIVVPRKILPERNVILHHSEFDEFTEELKRKSWHKELTNFMDGNIDVAIVKEFYTNLYDLEDKPPKQVKHDSSRLGFATLITALYKARGVISDSLTLESLGPAINVAYVKKNYWNLDDLSVTFRRPRKAKGKRSEAPPSSESLQGLGLPSIMSMKEFEAQVAWPGDQPSSSGGGGASIAQEPDIEEPPALAPAPAKDEDKLTPPKPSYFDASTHMVQEEETTPD

SEQ ID NO: 94055 - protein, 178 aa, Glycine max
  Coding DNA Sequence Number=SeqID_2370
MIMRGQDIYSSQDEATTSPSSSKSEEAKGEESSEEIYPQEEGQPLMVKEECKEVSVSSKRLAKKERHFEIKTNINEISLLRQPPHFLLCKKTLVSIATSLRLEFIPQVKELLDEGLVRKRLNPCALLVPKIGVPMNPKRIKVIPEWPAPPSVRKIWGFQDLTNFYKREKAQSFKNLGI

SEQ ID NO: 94056 - protein, 111 aa, Glycine max
  Coding DNA Sequence Number=SeqID_2371
  Homolog annotation: Hit_ID=A5C922; Match level="QueryCoverage=91%, HitCoverage=35%, E-value=2e-09, Identity=35%"; Hit description =Putative uncharacterized protein
MAQPPPREKTLREMAAPDFTYESLCIQYPDEGVPYVLKTRLIHLLSKFHGLAGFPHSLERVAKDWLYYLAPRSIFSWDDLKRVFLEKLFPASRTTSIRKDISGIRQLSGES

SEQ ID NO: 94057 - protein, 100 aa, Glycine max
  Coding DNA Sequence Number=SeqID_2372
MDCSRWEWKRDKRLRCRMKLDRFRCRCCYWWRHLNLVARPQDSEWRLLSLAEIAYSGWSFASLTLLRKVEEEPQLLIVFVVTAAVAAATLEEEHMACLDQ

SEQ ID NO: 94058 - protein, 78 aa, Glycine max
  Coding DNA Sequence Number=SeqID_2373
MHKKKKKKKQEVESLHDIDSTVKFGVREADGKHVSSRNPRIEKCSSMLDNLVGSLDFPKVWYPRDIGFFSPCILGHLD

SEQ ID NO: 94059 - protein, 94 aa, Glycine max
  Coding DNA Sequence Number=SeqID_2374
MTEASGKSVKRQPPYFLLCKKTLVSIATPLGLEFIPQVKELLDESLVRKSLNPCALLVSKIGIIRHQIPKIGGMMNVLSGATLFCKILIHPTPS

SEQ ID NO: 94060 - protein, 122 aa, Glycine max
  Coding DNA Sequence Number=SeqID_2375
  Subcellular localization annotation: CTP_CleavageSite=48; ConfidenceScore=5.51e-01
MSISPCGSISWSVPSRHRDRAHKTPSRPGGAQQGPGVSNSGNGPLSILQGARPPSKVMDRVHKTPSGPEGVQQGLRISNSNYGPLSVLWSVLYPQQGHQTPYQPDFHREVLGPRQAHGGASQ

SEQ ID NO: 94061 - protein, 131 aa, Glycine max
  Coding DNA Sequence Number=SeqID_2376
MTKGAELTIIFLCVPPDSIVSGWDKGVQMTIICLRMSSGMPPVHDKRCRMTIICLCVPPDSIVSGWRKGVRITIICLRMSSGSPPLDDKRCRMTIIFLCVPPLDDNTCVMTIIWLCVPPDSIVSGWRKVHG

SEQ ID NO: 94062 - protein, 144 aa, Glycine max
  Coding DNA Sequence Number=SeqID_2377
MRCEIPHRCVRRKYRIRRHSPFRLRNCWEGRSVRASSLLRQLAKRGMCCKAIKLGNARVSQSRRCKTTASAKLACLQESFQVKHQKAHIYACKADLPGQKEEEARAQSADGRVFKIVPWHHLEHSTSNSLSIQALSHDLTGSDR

SEQ ID NO: 94063 - protein, 159 aa, Glycine max
  Coding DNA Sequence Number=SeqID_2378
MLVVTTATGLASIIFFMLIMASIIVAICSFMASYVGLHLLLHLLYFTYYSCSSIGSVKLEVTRISTILNVFGSRLSNDVTRSIFCPNFCKMVTSILQLDSMNLFVEARAWFNPITQGMAILIANTSTTFHRDERLGNTHAMHGKCNYEIEMPEETSFLS

SEQ ID NO: 94064 - protein, 73 aa, Glycine max
  Coding DNA Sequence Number=SeqID_2379
  Subcellular localization annotation: CTP_CleavageSite=53; ConfidenceScore=5.05e-01
MELMPNGFSSGELSQCVSPHPFHSITLATKRKERQMPPSTKSNSRKATSIGARQSHLKEDFALSSNPKEMGPK

SEQ ID NO: 94065 - protein, 249 aa, Glycine max
  Coding DNA Sequence Number=SeqID_2380
  Homolog annotation: Hit_ID=UPI00016621D1; Match level="QueryCoverage =48%, HitCoverage=39%, E-value=1e-08, Identity=35%"; Hit description =UPI00016621D1 related cluster
GGPLGTSTLTFRGLHTLAFRGLHALTFRGLHVLSIRGLHVLVFRGLLALTFRGLHVLLFRGLHVLLFIGLHVLPFRRLHALAFRGLHFLPLQGLHVLAFRGRHALTFVGLHALAFRGLRVLTFRIAPKRHPVDPEKSNRALGFPALVTGLYQSYRVLVPPRQGHIIIGIAPARHLVDPKKSNRVLELSSSNYGSLSVLRRRNTTAAWGWSVAGNRRTATTLEFTSAHPQKSLSIATPHGRPIDNQVQAK

SEQ ID NO: 94066 - protein, 140 aa, Glycine max
  Coding DNA Sequence Number=SeqID_2381
MVMGDFISRLSFPACLHFSGENTETFSSLTSYPELRRSEFLIGGYVGARALLRLVSAAETHNLCHTDPEGSCDVHPLSSRGGKGCTDDTRRYLTVIRTFCHPEQMTSRDQVWSFCTHDTRRYLTVIRTLLSSREQMTSRA

SEQ ID NO: 94067 - protein, 39 aa, Glycine max
  Coding DNA Sequence Number=SeqID_2382
MSSKGSFQSGGCMIGEVGWSSTKPICPLEEAWTMAVQYC

SEQ ID NO: 94068 - protein, 90 aa, Glycine max
  Coding DNA Sequence Number=SeqID_2383
  Subcellular localization annotation: CTP_CleavageSite=41; ConfidenceScore=5.01e-01
MNCVFVHASSTHEFGALGSDCLVQLLVSTLFQSPMNCVFVHASSTHEFGAMCSDCLVPICPFSTLFRSPMNCVFIHASSTHEVGSHGEGM

SEQ ID NO: 94069 - protein, 183 aa, Glycine max
  Coding DNA Sequence Number=SeqID_2384
  Subcellular localization annotation: CTP_CleavageSite=41; ConfidenceScore=5.50e-01
MAEPSKKRKGSSSTATAAAHRRHGPSGAPTAPIPPSLSSPRSSTLFSSDDQRLRQGAPFEGTIVDDWKFDYSSHDARRMVCNDQAEMTVTSFGYRKDRNGQWLKKDALPPQDERTPSPPPQREDFALMNEVLSELRGLRSYVGDRFDSLDSRFAGMDIRLTQLEEDVGYIRQSFDLPPLPPSS

SEQ ID NO: 94070 - protein, 69 aa, Glycine max
  Coding DNA Sequence Number=SeqID_2385
MPPQHGPQWIEAKSHVQTGNYECGYYVMQWIWCIGGADKDYKEVPPPPLFKLAGGHINQAVTFNRSYYK

SEQ ID NO: 94071 - protein, 81 aa, Glycine max
  Coding DNA Sequence Number=SeqID_2386
MKHLSDQGVPTDPKRIKVSEGRSLEFQEPLDLRSNPFQGGGDDAILPLRALDKRLQEDWTKVAGEDPRILMSLRVDFGPMG

SEQ ID NO: 94072 - protein, 151 aa, Glycine max
  Coding DNA Sequence Number=SeqID_2387
YIYLGLTENKRGYISCGSVLVEGTSTRFKENKGGYIPCGSLLVKVSSPSSVTSINVAAGVSSGIPQVSPLALAVAPRLHKPWWRLCNISTIMFVLEVERPEGVVSAGARAGVEAKLMAGLRDSKVRKSGTTPLAMHKAVIKARKPSLEELD

SEQ ID NO: 94073 - protein, 104 aa, Glycine max
  Coding DNA Sequence Number=SeqID_2388
MNNTLLFSRFGKPENFRKLFAKEEKEEEEEEEEVQRDSKVVNEYVEKLFVKVETGNRLPESKNSGNLENFEKNSFQKQKCAMLFFEKSFQYFPCEVFLISSLET

SEQ ID NO: 94074 - protein, 106 aa, Glycine max
  Coding DNA Sequence Number=SeqID_2389
MASGNRLPRVGNRLQGLKMKTGGQDGLWHQVVEASGNRLPVCVIDYTEEWVTGNRLPGFHVLKLCDSSLASGNRLPRLCNRLPGMKSLEIPLLLACSGHETHCVAA

SEQ ID NO: 94075 - protein, 48 aa, Glycine max
  Coding DNA Sequence Number=SeqID_2390
MKMLLIPHDVAPFGALEWRKKKDDWRFHFKEKMSQEEAHHHRKPWIRA

SEQ ID NO: 94076 - protein, 93 aa, Glycine max
  Coding DNA Sequence Number=SeqID_2391
MHGLIIIERLLSQIVEAKLHDESRLIQRCFDDNKDDDKGDDKKLKDRIKNTSRFRGKLKNTSRSRGKLISRIKIQGSSFQEVKIKIQDSRFKN

SEQ ID NO: 94077 - protein, 137 aa, Glycine max
  Coding DNA Sequence Number=SeqID_2392
MQKSGPVPVPTDEVSLVGQTLHTFLAWSTHLVKSLSQQVVVSPAKPPPKPDDPLYLMTLTIPELFSRPYQVRWDATVFGVFNPDFPLYIKHEDLSKIAHGGQCLSISVLQLWILNLTETCMRAGNSDIYGYLEPQSI

SEQ ID NO: 94078 - protein, 64 aa, Glycine max
  Coding DNA Sequence Number=SeqID_2393
MKKQQWKRSERQRRRGKRRRHPLGNKPWKKELHHQDEPWIRSLERMLQWRKRKRERKREGGARN

SEQ ID NO: 94079 - protein, 128 aa, Glycine max
  Coding DNA Sequence Number=SeqID_2394
MASITEAMLKIQKSIEDNAMAAASNTTRETEPVLQPTLNLGREKSTTGFNRRYSPQAYPYGLPPDFTPRTAPDDLSQAPTFEGQLPPHADYPLQEDDEGEAHLGPLLPPREPPPHELPQPNIIRHAPP

SEQ ID NO: 94080 - protein, 121 aa, Glycine max
  Coding DNA Sequence Number=SeqID_2395
MEESSGFPVLFGGENSNPPDDGGKDKILGLQLSARLQNNGLKDKIFLGLELIARLQHRTRGLRHLTRIHGVDLTNETQDTYLYLFHSPLCQFPSHTNTPTFNSLSFIYHNLKNSLSISFNI

SEQ ID NO: 94081 - protein, 60 aa, Glycine max
  Coding DNA Sequence Number=SeqID_2396
MGCYKQTPSILMQSYPPRALNRRLQEDWVKDAREDPRVLMSLRVGYPRNVGFFSPRILGT

SEQ ID NO: 94082 - protein, 66 aa, Glycine max
  Coding DNA Sequence Number=SeqID_2397
MEKSEKKNLSEKKLKKAYITWDENDMESSEDSENEEINLCLMAKSYESDKEMHLLICIKSQLNLQS

SEQ ID NO: 94083 - protein, 119 aa, Glycine max
  Coding DNA Sequence Number=SeqID_2398
MGIAPTKTPSEPEEVQQGPRVSSSGYGPLSVLQGARTPPPRQGHVIIGKDRDCRHLVDPKKSNRVLELSSSNYGSLKGIRPPTNRAFIKKYCAPDRRRAKHHSSIGMAGSGKQTHCHHL

SEQ ID NO: 94084 - protein, 131 aa, Glycine max
  Coding DNA Sequence Number=SeqID_2399
MSCPVIITPTFLYQSVSWCMPPTRHPLDPDKSNRALWFPALITGLCQSFGVPITPSKVIRPPITRAFIEKYCTPRQAQGDAPQVAHAPPPPHQADPAGSLGMEQHLVRQQAANHRGQVQIHECLYQLSLSQ

SEQ ID NO: 94085 - protein, 37 aa, Glycine max
  Coding DNA Sequence Number=SeqID_2400
MEEIHGEDDEEQGIKLVDLGSSSSMESFASRRSMVVE

SEQ ID NO: 94086 - protein, 266 aa, Glycine max
  Coding DNA Sequence Number=SeqID_2401
  Gene Ontology: Mol. function=methylcrotonoyl-CoA carboxylase activity; Cellular component=mitochondrial matrix; Biological process=metabolic process
  Homolog annotation: Hit_ID=Q42777; Match level="QueryCoverage=33%, HitCoverage=14%, E-value=1e-22, Identity=60%"; Hit description =Methylcrotonoyl-CoA carboxylase subunit alpha, mitochondrial precursor
  Pfam annotation: Domain name=Biotin_carb_C; Domain location=191-263; Score=-33.5; E_value=0.00094; Accession=PF02785.10; Description =Biotin carboxylase C-terminal domain
  Pfam annotation: Domain name=CPSase_L_D2; Domain location=31-183; Score=-126.9; E_value=0.051; Accession=PF02786.8; Description =Carbamoyl-phosphate synthase L chain, ATP binding domain
  Pfam module annotation: Pfam domain module=Biotin_carb_C::CPSase_L _D2; Domain location=191-263::31-183
MTPFPPMHALSRMSRCMPFRGGVDGGRARQRDDSDGDHDDDNWEGMESTKLDEAFSVATALVDAAATVDRLSQKVGCSLCFIGNFQETIGARIINNLLLNVAMSEYVPAGVDGKRCLENVVNEAVLLVAHREAKEVRIYNGGFHCAYQVDHPVTEMIVGQDLVEWQILVAIGEALPLSQSQFLPTLFSCISTSAQILLYTLQVRVGTGVKEGDKVSMHYDHMIAKLVVWGENRVASKHQFDRRSSCIEFKENVAGYVGCNFFPNTH

SEQ ID NO: 94087 - protein, 87 aa, Glycine max
  Coding DNA Sequence Number=SeqID_2402
MLFTMWSSALKMYARLNASQNEYVMWNCICTLEMAPKKLSANRSRRDAAAEGTSAAPEFDSHRFRSAEHQQRFEAIKGWSFHRERRV

SEQ ID NO: 94088 - protein, 135 aa, Glycine max
  Coding DNA Sequence Number=SeqID_2403
MGEVEEIQEKMKADMEAMKEQMAMMMEAMMIMKNIMEASAVAVAATSTVAKVNLMPPSGLNQMNHPTSAMVGKDLGSMGGPHDVQIQNEHAFPPYGLPLNYTPPNVAYTPNKNVNNSTPISIESQQPQTDHAHVS

SEQ ID NO: 94089 - protein, 90 aa, Glycine max
  Coding DNA Sequence Number=SeqID_2404
MRGYLMFTRTFHQPGANEPVDAQRLALSSASFAIQGQRVRWQAEIPYGHLHLSSTKGNEFDGIRMMFYLRRPETFKPNDAQDSSLLGRDN

SEQ ID NO: 94090 - protein, 107 aa, Glycine max
  Coding DNA Sequence Number=SeqID_2405
MTLAQLGDPPRVPLVQQYDTFVEPDMPQQPVAIVAPDEPDIDVHRPRHPDVYVAIIDKLERLLNLRISTEGTKAYTIAQECLSITRSCIGQPTRGHKSRRRRRMDDH

SEQ ID NO: 94091 - protein, 202 aa, Glycine max
  Coding DNA Sequence Number=SeqID_2406
  Gene Ontology: Mol. function=transferase activity, transferring glycosyl groups; Biological process=metabolic process
  Homolog annotation: Hit_ID=A7R6I5; Match level="QueryCoverage=60%, HitCoverage=38%, E-value=4e-30, Identity=51%"; Hit description =Chromosome undetermined scaffold_1295, whole genome shotgun sequence
MFPWLAFGHMIPNLERAKLLKRGSPREFRIHPKKYTTSPQTTLIKFVQLPLPKVDNLTEHAEATSEVPYDVVPFLKTAYDALEEPLTHFLESSKPDWVFYDFVPFWTGSAASKLGMESVFFSILYGQNLKATLSLHCGCVSRPASHFEVSRSRESQTTVWAIANPGSRTLVGWVLLSRTTILSPLEAVPNLNLSGFKDVSKF

SEQ ID NO: 94092 - protein, 101 aa, Glycine max
  Coding DNA Sequence Number=SeqID_2407
  Subcellular localization annotation: CTP_CleavageSite=54; ConfidenceScore=5.27e-01
MVVHGGSSVEQWFTNFNSRVLTLLLLLLVALQLSFSLGDSHSRSLTVTQLLVVRRVHRATTAFLLCDSRSRSDSRPLVLALIHNSTHFGSYSRSRKVWVLL

SEQ ID NO: 94093 - protein, 165 aa, Glycine max
  Coding DNA Sequence Number=SeqID_2408
  Subcellular localization annotation: CTP_CleavageSite=27; ConfidenceScore=5.21e-01
MTTLTQTLMMLLLSKSCPAIIIPTSLCRSVSWCMPPTRNPLDPDKSNRALGFPALITGLCQSFGVPVTPSKVIRPPITRAFIEKYCTARQAQGGNPQAPDAPPPPTQADPAASFDTEWAEVAWPGDWPEAQAGEAPAEAPDDADEARVDEEITDLLDFLGGSGAT

SEQ ID NO: 94094 - protein, 67 aa, Glycine max
  Coding DNA Sequence Number=SeqID_2409
VLMITMMTTKDDDKGDEQKAQRSKNNSSESKNISSESRTSQEFKNQEEFKTQEESLESRIKIQDSRS

SEQ ID NO: 94095 - protein, 161 aa, Glycine max
  Coding DNA Sequence Number=SeqID_2410
  Pfam annotation: Domain name=G-patch; Domain location=26-70; Score =27.7; E_value=4.3e-05; Accession=PF01585.14; Description=G-patch domain
MAFQSFEVVSIASVDSLSEQPCLSDTAMMVARVMLGYGYEPEMGLGKNNGDRTSLVSTRGNRGKFGLGYKPTQADIRKRISERKNKGQGSRLGQQDKGAPPCHISKSFISVGLRHEGQVAAICKDDSPRRSDLVQPCPPGFRLGNWRVEERPDVYAVGPRL

SEQ ID NO: 94096 - protein, 68 aa, Glycine max
  Coding DNA Sequence Number=SeqID_2411
MMVYVKNDVKMGMLIDVGNALACACCVCSWGAKGTDLRRSLAFALGHVHTLDFVYVRGGRSALTFQGL

SEQ ID NO: 94097 - protein, 41 aa, Glycine max
  Coding DNA Sequence Number=SeqID_2412
MDAMFVIIKKGEIVEASFMMMNQVDSSSFDDDKVDDKKPKE

SEQ ID NO: 94098 - protein, 139 aa, Glycine max
  Coding DNA Sequence Number=SeqID_2413
MTKTSMQVGNADVYGFLEPHSIQRFGQSQFESESYIKNLMQNSKRDVYLRAYLNGALKGLDDTPQSKSKVATRWIVVKCNRQKGSIECGYYVMHWMSTIILGSFKNNWETYFNDARSLKPERLKALRIRWEKFYLKVKK

SEQ ID NO: 94099 - protein, 112 aa, Glycine max
  Coding DNA Sequence Number=SeqID_2414
  Subcellular localization annotation: CTP_CleavageSite=55; ConfidenceScore=5.13e-01
MRGYLMVNHTIRQPWANEPINARRLTSSSVPFVVLTRELMVTRTFRQPGANEPINAQRLNHLLHVLSSLPVKSGYMRGYLMVIHTFGQPGANEPVDARGLTSSSAPFVVLHL

SEQ ID NO: 94100 - protein, 104 aa, Glycine max
  Coding DNA Sequence Number=SeqID_2415
MGGCKYWVASRSNPARVGELRSPGRAGRQPPPPFSYKKAEGGYSKDPSAPWLCISAVLGEKNCFREENPSRGASVTLPRCFRKQIREGFRPFFIVLHPFFVLQR

SEQ ID NO: 94101 - protein, 228 aa, Glycine max
  Coding DNA Sequence Number=SeqID_2416
VRHACPLESHRSCTEKGGANWDQLLASKEGAFVNWFPRWKEGRTGVLISCGGFPNVPLMGTRGCISYNPDQRGDTSKGPQGMGGVAKEGQGTQGQTAKREEVEAPEEDEKVQALRAELEQAQTVKESACREEHGRNKFRGALWVSNSERKLRREERDQSRLDSLIVKDELKFCSRSKRNLSQWLCETETNMLAIISKYQEELNLATAHEHRVANEYAQVYAEKEARGR

SEQ ID NO: 94102 - protein, 190 aa, Glycine max
  Coding DNA Sequence Number=SeqID_2417
MIMRGQYIYGSQDEATTFPSSSESKEAKGEESSEEIYPQEERQPLMVKEECKEASVSSKRLAKKERYFEIKTNIKVISPLRQPPHFLLCEKTLVSIATPLRLEFIPQVKEFLDEGLVRKSLNPCALLVPKIGVPMNPKRIKVIPEWPTPPTPLIELVRNHVPSCKDTQEMGVLRKKAQSFKNLGICGLIL

SEQ ID NO: 94103 - protein, 91 aa, Glycine max
  Coding DNA Sequence Number=SeqID_2418
QPVEWILHTPSPYRLVEPVQVIEVSSSQEDPEEDPEELPPEPVVDALDLPEDDEDPLLNVDFPEDIMSTSEADSTEENGPGGTANSDDSSS

SEQ ID NO: 94104 - protein, 238 aa, Glycine max
  Coding DNA Sequence Number=SeqID_2419
MVLLTGWFNSAPAGSAAAGASAATGGMTMSGAADAAGVAASAGGADSADCAAADRHCHPAPAAAVRQRARRCPGLPPASLPRQGRAAAWWSARWPAACTSMFSCCAVLFGRCLAITLARLTAIFPAQPEQLKDGTDDGAERHQRIVLLIFRLDPRIGPRQHHAHQFTAARQRHRAKAQANALLITGDLAHRNGDGTRFQQQIDLFDFIVLMPVVRRIQLRAAHRQIAGLRARRDAAGV

SEQ ID NO: 94105 - protein, 107 aa, Glycine max
  Coding DNA Sequence Number=SeqID_2420
ANRGNAETINKLNAKLLAKANKEKTLEEKMLQMMENHDHQSQEMRQQMQQQNEQIRQQNEQMQRILQHLYIQSIIPAPSLSPIIADGIEHHVNDAQVDRPHDMGNDH

SEQ ID NO: 94106 - protein, 190 aa, Glycine max
  Coding DNA Sequence Number=SeqID_2421
MGDLESLRWNPAEERAIRVDFETKGSRILKNAMNKMRNALDEPWGSTNFLNKSSIAKENRSIDRGASAYCGGSISTTAHFEKLDKYQHHREEILQHSTKEGTFTQDSPNTATFVNDNEIYLNVVGGPNYKGNIYRLGTLSKRFSCSKSGSSTFVAPVEGQIEEMHETINKLNAELLAKANKEKTLEEKML

SEQ ID NO: 94107 - protein, 76 aa, Glycine max
  Coding DNA Sequence Number=SeqID_2422
MALKKLSTKRSRRDATGEGSSAASEFDSHRFHSAEHQQRFEAIKGWSFHRERRVQLREDEYPDIQGEIARRHWARL

SEQ ID NO: 94108 - protein, 184 aa, Glycine max
  Coding DNA Sequence Number=SeqID_2423
MSLHSSSSVNGEGSTPKDPLYKILDELRSLKLWKEKQERKEKGKKRVEEISQDEREKIREEERRKIMKEMKREKHASYSSHNSCKSLSEELRNYYEERKPQEANINLPYFHGKDNVEANLDWEIRVKQQLKNKSTSKSYGSHSYPKKEKGQGILGVTPSKPNDDKGKTIEKQPLRLVCKKKLAP

SEQ ID NO: 94109 - protein, 220 aa, Glycine max
  Coding DNA Sequence Number=SeqID_2424
  Homolog annotation: Hit_ID=UPI00016621D1; Match level="QueryCoverage =68%, HitCoverage=42%, E-value=3e-17, Identity=37%"; Hit description =UPI00016621D1 related cluster
MDSTSSPSEDYAPSPLEDYTGLRTLTFRGLHILTFRGLHILTFRGLHALTDRGLHVLAFRGLHALTFRGLHVLTLRRLRALTFKGLHVLTLRGLHSLTFRAINILTFRGLHALTFRGLHVLAFKRLHALTFKGMHVLTFRGLRTLTFRGLHILTFKGRTARPNLQSATRPQLQRTTRPHLDRATRCYLQKTTRPRLQRVALLHHHRTARRHLQRVTRLHL

SEQ ID NO: 94110 - protein, 169 aa, Glycine max
  Coding DNA Sequence Number=SeqID_2425
MDFKNKANNNALDQTPVSLHKSGESISGFTKGHHFEIRSRQCDRGSVKGSSRCGVPTEKNGNLWWLLVAVGDGEEAWHIGNGFGRKKEKEMAFFQSYLNYKAQKAQVTNALRNGNVVHTADVFSKIPMLQTQFREDAMINKGWAAFLPRQLHVASLRSFIKRLPREASS

SEQ ID NO: 94111 - protein, 165 aa, Glycine max
  Coding DNA Sequence Number=SeqID_2426
MSHHSSSVNGEGTSHKDPLSRILDELSSLKLWKEKQERKEKGKKRVEEISQDERKKIREEERRKIMKEMKREKHASYSSHNSCKSLSEELRDYYEGRHRSHLRPHSHKREKKRKPQEANINLPYFHGKDNVEANLIWEIRVEQQFKKKSTSKSYDSHSYPKKDQG

SEQ ID NO: 94112 - protein, 244 aa, Glycine max
  Coding DNA Sequence Number=SeqID_2427
  Homolog annotation: Hit_ID=UPI00006A2D9E; Match level="QueryCoverage =53%, HitCoverage=85%, E-value=3e-11, Identity=16%"; Hit description =UPI00006A2D9E related cluster
GLHALAFIELHSLTFKGLHILIFKRLHVRTFRELHALTIGGLHVLTIRGLRVLTFRGLHALAFRGLHILALRGLHVVPFRGTHALALRGLHVLAFRGLHTLTFRGLHVLAFRRLHVLAFRRLHALPFRGLHRATHHRRQRTTRPRFQRATRPWLHRATHPHLQMTTRPHLKGLHVRTFRELHALTFRRTTRPHHKKTTRPRLQREHAPFFGLHILVFRGLHALAFRGLHALAFKGYTSSSSRDL

SEQ ID NO: 94113 - protein, 562 aa, Glycine max
  Coding DNA Sequence Number=SeqID_2428
  Homolog annotation: Hit_ID=A5AP64; Match level="QueryCoverage=20%, HitCoverage=18%, E-value=3e-07, Identity=31%"; Hit description =Putative uncharacterized protein
  Pfam annotation: Domain name=Transposase_23; Domain location=370-442; Score=3.0; E_value=0.00056; Accession=PF03017.5; Description =TNP1ENSPM transposase
MDRQHLSQAHLYVLNNTSEVMSYIDCHREHVSDTNPKMKKMKLLDMISMAILFTQGHRMQKVSCRTVGVFDNNLIQASMPYYGVIEDIWELDYDEFRVSIFKCQWVNGNTKVRLMTTPPRFTPHSDIPLDAMSRRPRQSTRLRRLTVRTLDQPQPIVNVNPTIGRGSGPHKEKFHKTLKNLIWDDILGKFDIPEGDNAKKKVMPTVATRWRQFKSSLTTKYIYANSEGQAKDYPSVKYGIDATTWAEFAKSHQTPNWQASRGSDTSSTSITQRQLAEIIHNLKEEWRKEVEEDNKNQHEAWRRKVEEENQRTLEIIKQELKQTIKLELSQIASYHSPPLQPPDIQVLGERVRMKGSCAEADTNPLGKDTSYVHDDTIGLYVVAEQSTKLVALGKVYDSSSTIHNVPYADDVVRVSVVKVYHGDAQVPFPTSEIQFVRQAVGTFVGWPIHLVKPISDEDSQKRLPIPVKYAKIDNVVAAIDPLGELVKKLFDSYQNPIQLPWDGKKFGIPNVKDGFFITHIDVSEIILGDKCLNISILQLWLMFMNDWSTSIGYGSLYGFLEP

SEQ ID NO: 94114 - protein, 120 aa, Glycine max
  Coding DNA Sequence Number=SeqID_2429
MRFKRVIRSLLYSFDEYAFYSCVLNFVFILSLKYHDQEKGRNSSRYGSSSRRPIIPSSTRPSSSGDHTDSRTGQLSSSGNRPSTSHRNIQPMYETKQPTYMHSRSTRGNCDAGMQKLVNH

SEQ ID NO: 94115 - protein, 126 aa, Glycine max
  Coding DNA Sequence Number=SeqID_2430
  Subcellular localization annotation: CTP_CleavageSite=47; ConfidenceScore=5.20e-01
HKPVPTSSPQATCGPGDFFQPCKNPFTRKDPQGMYPPLFSLNLVDVPSTRIDPQEMYPLLFLVKPKEKGDTKEFRRLVLPSFGKGRRETQKEFRRLFLGEFFLAKGEENEKMNSTSFQGLENQKTS

SEQ ID NO: 94116 - protein, 210 aa, Glycine max
  Coding DNA Sequence Number=SeqID_2431
  Gene Ontology: Mol. function=structural constituent of ribosome; Cellular component=ribonucleoprotein complex; Biological process =translation
  Homolog annotation: Hit_ID=Q9M573; Match level="QueryCoverage=34%, HitCoverage=60%, E-value=1e-15, Identity=58%"; Hit description=60S ribosomal protein L31
  Pfam annotation: Domain name=Ribosomal_L31e; Domain location=113-192; Score=51.9; E_value=2.2e-12; Accession=PF01198.10; Description =Ribosomal protein L31e
MLGGEDLAGADVLAFASPWLGEGSGQGVTHHKLVGHLESFYVEKLQIVDVASCRTEIEGLEEHIVNHEGDIEPTIFVLNGLVAMTRYCRFLLFGFEEDELGFESGSQKKPKTHDSLVGKRRSSLESTPSTSTNTCMAAMGTNDVKVDMKLNKVVWSHGIRSVSRRIRVRIAHKRNNDEDAKEELYSLVIVIKIAKDELKGLGTKVIDDED

SEQ ID NO: 94117 - protein, 192 aa, Glycine max
  Coding DNA Sequence Number=SeqID_2432
  Gene Ontology: Mol. function=transcription regulator activity; Cellular component=nucleus; Biological process=regulation of transcription
  Homolog annotation: Hit_ID=A7PD24; Match level="QueryCoverage=69%, HitCoverage=83%, E-value=6e-37, Identity=58%"; Hit description =Chromosome chr17 scaffold_12, whole genome shotgun sequence
MIKTNTSTSGSPKLHRKTIQRNRRIHIKSLCFKYLSSIPYNDLKPTKDMLYQQDQLDLAATYIKHLKERIQKLKGEKEIFNIGSQLPLIEIKDLGLGIGVKLISGLNKNLMLYEVISVLEEDGAEVVTVNFSTVADKFFTRVMLRWLGGLLSLATLSSQSEEDTSCIFGNITSATLVEFGRKGWILLEKTEY

SEQ ID NO: 94118 - protein, 145 aa, Glycine max
  Coding DNA Sequence Number=SeqID_2433
MVSIVTKLQVLTVVGEGDTIIKALDDIVPEDDCGKKETNKCNDNNDTNEESKGKVVPDVGHNNNGLETVARGEKPTYPSLKAKRTDWDKLEPQLKKEVGTLGSSTLTLHFRRKKKNLMVMLRSTNVLATATELAPLAFPLSETEP

SEQ ID NO: 94119 - protein, 74 aa, Glycine max
  Coding DNA Sequence Number=SeqID_2434
MLHSHLLETAELPASSLSHSFYCIFAFFCIKASTIQSRYAFPDELAKRAYRAKRVHLVRMNTHPLVEILVAKRG

SEQ ID NO: 94120 - protein, 68 aa, Glycine max
  Coding DNA Sequence Number=SeqID_2435
MSLPSAVHVFSIIKCEASGDWEARYSVVFPDFLRQKKKRRSRDESRHRKKGQDGRNQCPYLCFPEPHE

SEQ ID NO: 94121 - protein, 44 aa, Glycine max
  Coding DNA Sequence Number=SeqID_2436
MDGEELPSPMNFDVVKQYYAYNLGQLRISRGKIVLGSGQMPGRS

SEQ ID NO: 94122 - protein, 197 aa, Glycine max
  Coding DNA Sequence Number=SeqID_2437
MDNEEGMQEQMKADLSALKDQMASISEVMLKLQKTIEDKVTTTASSTVREAEPVLQPALDTGRDRNMAVFGRRYSPQAYPYGLPPDFTPRATPEDLSQAPTFEGQLPPYDDYPGQDDEEGDTHLGPLLHLKDPSPHELPQPNIVLHIPASPTPVKEYVPFVEDKGKIEALEERLRAVEGLGNYPFSDLADLCLVPNI

SEQ ID NO: 94123 - protein, 65 aa, Glycine max
  Coding DNA Sequence Number=SeqID_2438
MKNYANIPKGYPHPAQHLLILTLESGDRQIYPAVIRTSITSVDPDPSVRRQTDIPSGNPYKHNIC

SEQ ID NO: 94124 - protein, 47 aa, Glycine max
  Coding DNA Sequence Number=SeqID_2439
MSVKNLVGHLGVDDKKDYTLEYQSRSLYFARTLQPYRISIGFKEHSN

SEQ ID NO: 94125 - protein, 104 aa, Glycine max
  Coding DNA Sequence Number=SeqID_2440
MSHHSSSVNDEDTSHKDPLSRILNELSSLKLWKEKLPPPKKNSHDSCKSLSEELHDYYEGRHRSRLRPHFHMREKERKPQEAKINLPYFHGKYNVEAYLDWEMK

SEQ ID NO: 94126 - protein, 83 aa, Glycine max
  Coding DNA Sequence Number=SeqID_2441
MPEIKRKYCYAIQNPSQGASVTFPWVILRRTALGNQFMGLRIRWWRIHEQCQTINSWGSELDGGGCMNDNQFMGLQIRFEGGG

SEQ ID NO: 94127 - protein, 170 aa, Glycine max
  Coding DNA Sequence Number=SeqID_2442
MGTNQNGKRFYQVKVKSLDVTSLKELGQLMGPLQRQAFCKVYGKILDLTAAEVFMEVAVSLAQYYDQPLRCFTFGDFQMLWLEIQQTRNGIVGLPRKYLEGKARDMASQEKWGPFVDILALLIFGVVLFPNVDGLVDLAAIDAFLAYHHSKESPVVAILADLFDTFDSEM

SEQ ID NO: 94128 - protein, 218 aa, Glycine max
  Coding DNA Sequence Number=SeqID_2443
VDSRGSPELEQAQTVKERFKSAALKIQKENAELRDINTTTARALEQETKRDRKEEHVRDKLCGALWGSNSELKLRREERDQSRVDSLILKDELKFCSRSKRNLSQWICETETNMLAIISKYQEELNLATTHEHRVADEYAQVYAEKEARGRVIDSLHQEATMSMDRFALTLNGSQELPRLLAKAKAMADTYSAPEEIHRLLNYCQHMIDLMAHIIRNR

SEQ ID NO: 94129 - protein, 139 aa, Glycine max
  Coding DNA Sequence Number=SeqID_2444
  Subcellular localization annotation: CTP_CleavageSite=32; ConfidenceScore=5.04e-01
MPFFFPEKLLTSIFKKLCFLFSLFRAALPLVRGGSSVERSGEGEGEGSGVELFGGRWRQTRYADGGFFIADMDEDEWMYEIMSERGDMDYENAESCGANEPHVDCSDAFKTSQVIMCLSAERMFCGGLDPWLMKTDLWR

SEQ ID NO: 94130 - protein, 34 aa, Glycine max
  Coding DNA Sequence Number=SeqID_2445
MEKRLSPSKKGEIVEASFMIMNQVVLMMTKSPKE

SEQ ID NO: 94131 - protein, 84 aa, Glycine max
  Coding DNA Sequence Number=SeqID_2446
MAERPTNSFGANTEKNLKEGCKVIFTRRESTEKKKRIDKDVHDEEGEKKEEEKKIRENRKFEDSTYKDDAPVGRPLHHKTVRGS

SEQ ID NO: 94132 - protein, 200 aa, Glycine max
  Coding DNA Sequence Number=SeqID_2447
  Subcellular localization annotation: CTP_CleavageSite=27; ConfidenceScore=5.57e-01
MVESSKKRKGSSASASASRAHRSEATSASTAPIPPSLSSSTLFSSEEQHKRYSNLFSSRSIIDPKFIDMKFFFAETFDCIQAFQNLGLIPFMSLQLPVYPELVKSFYCNLEIQDNTLISEVFGIKMVIDQSLFHDLTQLSSDGVPFEGTLNDDWKFDFSAHDVRQLVCTNNADMTGCLFVGSLAFESRILHYLIVRILLP

SEQ ID NO: 94133 - protein, 50 aa, Glycine max
  Coding DNA Sequence Number=SeqID_2448
MTKGYGNFTEALWVSRKPQNPIFQQNGGCGGPLARPGELSLARQARLLQP

SEQ ID NO: 94134 - protein, 606 aa, Glycine max
  Coding DNA Sequence Number=SeqID_2449
  Gene Ontology: Mol. function=protein binding; Cellular component =histone methyltransferase complex; Biological process=histone H3-K4 methylation
  Homolog annotation: Hit_ID=Q1S5M0; Match level="QueryCoverage=83%, HitCoverage=92%, E-value=0.0, Identity=73%"; Hit description =Putative uncharacterized protein
  Pfam annotation: Domain name=WD40; Domain location=185-222; Score =14.9; E_value=0.3; Accession=PF00400.23; Description=WD domain, G -beta repeat
  Pfam annotation: Domain name=WD40; Domain location=304-342; Score =22.5; E_value=0.0015; Accession=PF00400.23; Description=WD domain, G- beta repeat
  Pfam annotation: Domain name=WD40; Domain location=36-73; Score=22.2; E_value=0.0019; Accession=PF00400.23; Description=WD domain, G-beta repeat
  Pfam module annotation: Pfam domain module=WD40::WD40::WD40; Domain location=185-222::304-342::36-73
MGLCAICSNVGGVNIIAIGCNDGSCVIWDFETRGIAKILRDDECSSPITSICWSKYGHRILVSAADKSLILWDVMSGKKITRIVLQQTPLQARLHPGSSTPSLCLACPLSCAPMIVDLNTGDTTLLIVSVSETCNGPTPPPRNKCSDGITSFTPTAACFNKYGTLVYVGNSKGEILVIDYKNGDVRAVVPISGGSVVKNIVFSRNGQYLLTNSNDRIIRIYENLLPLKDEVRALDDLSGNHNDLNNIENLKAVGSKCLTLFREFQDSITKVHWKAPCFSGDGEWVVGGSASKGEHKIYIWDRAGHLVKILEGPKEALIDLAWHPVHPIVVSVSLNGLVYIWAKDYTENWSAFAPDFKELEENEEYVEREDEFDLIPETEKVKGPDVDEDEEVDIVTVEKDATFSDSDMSQEELCYLPSTPSHDVPEQQEKCVESSSKLLDSNNTGSPLSEEAGPNGHMMNHASSPLEDDAGRMKRKRKPSEKVLELQAEKVKKPSKSSKSEKPKSRSLADEDNGNSFHGVVLSFASLILTCFGVVSCWFEMFSCGSSGAVRVNGGAGAAGRFDDAESVRVGFFKCRKMLLEIGVMQDASFGQNTKMLGLANLLEIK

SEQ ID NO: 94135 - protein, 186 aa, Glycine max
  Coding DNA Sequence Number=SeqID_2450
MDDSSTIEEMMINSEFEEVLEAFKKMHDQVQWLVVSNNKLRSDLKLHITKLALAQTEIKRVGKKKTNTQEFYTSSATTRAYIQSPSDRRSLRFLLNLVNSFTSKDPQGMYPPLFSLNNLVDVPSTRTNPQEMYPLLFSVTTTQVDIPSTCTTKDVPSNVLRQSSQAISPLKLCEGGNKRILRRLVL

SEQ ID NO: 94136 - protein, 71 aa, Glycine max
  Coding DNA Sequence Number=SeqID_2451
MTRGNPSDLQPFDPEIDRTFHRLVRHHFVPFDHPEHSITGESVHSVIGDFEHPDFEHYNFEHSENMAQPPP

SEQ ID NO: 94137 - protein, 78 aa, Glycine max
  Coding DNA Sequence Number=SeqID_2452
MGKPRRVEVRDLCTQPACPVRMLFLLALSVSTLAKRKFTNSRLASHAHYASLRKLKSPRAFKTLRLAEFRERETSLEQ

SEQ ID NO: 94138 - protein, 201 aa, Glycine max
  Coding DNA Sequence Number=SeqID_2453
  Gene Ontology: Mol. function=ATPase activity, coupled to transmembrane movement of ions, phosphorylative mechanism; Cellular component=membrane; Biological process=transport
  Homolog annotation: Hit_ID=A7QLM8; Match level="QueryCoverage=91%, HitCoverage=16%, E-value=8e-57, Identity=58%"; Hit description =Chromosome chr13 scaffold_120, whole genome shotgun sequence
MNGAPRYNSIIYSSLPTIIVGILNKDLRKRTLLKYPQLYGAGQRHEAYNKKLFLLTMLDTLWQSMVIFWAPLFAYWSSTIDVASIGDLWTLGVVILVNLHLAMDVIRWYWVTHVVIRGSIVATFISVMIIDSIPNLPGYLAFFDAAGTGLFWLLLLGIIVTALLPYLVICREAEKIGYDRVVESGQTSLVAIRRIEVLLSL

SEQ ID NO: 94139 - protein, 57 aa, Glycine max
  Coding DNA Sequence Number=SeqID_2454
MGRPVKVTLCEIGTSLKEHSNRVTPKAYIPKSPSGPLLPDSDTAHELYNTHDLTLVF

SEQ ID NO: 94140 - protein, 178 aa, Glycine max
  Coding DNA Sequence Number=SeqID_2455
DEDSVMHKKKIADKKGTDGKKNEVRGGSEKVVDEGVEVHASKHPSGADYLIIEFTDAWPGTYSSLHRKDEGPTNQVPQQMEDESSETTTPKPLVRRKKDDETQEAAATSEKSLEATFEPSEPVADTASPQQAVHPPLLRIRLHQSCLRTPLLQLPLCFHLTDEEDVQTQDIQDQSQDF

SEQ ID NO: 94141 - protein, 112 aa, Glycine max
  Coding DNA Sequence Number=SeqID_2456
  Homolog annotation: Hit_ID=Q6VPE8; Match level="QueryCoverage=50%, HitCoverage=7%, E-value=6e-07, Identity=47%"; Hit description =Putative gag-pol polyprotein
MAGTSDGGGEYHQLDGSHRLLLDVMTTQMQRLLNRNNEELYGRIEGLENQLNQNVGRHYGGNRGGNDGPRKNKIEGVKLNVPHFKGKSDPDAYLDLEMKIEHVFSCNDYTKE

SEQ ID NO: 94142 - protein, 107 aa, Glycine max
  Coding DNA Sequence Number=SeqID_2457
FYRFGLRQQKIEVDPKRGKFDHPTRTTEKTGANKEGEDEGETHAVTAIPVRPSFPPTQQCHYSVNNKPPPYPPPSHNPSQGSSTSTFLRIRLECNVCLSWRSPGAFH

SEQ ID NO: 94143 - protein, 97 aa, Glycine max
  Coding DNA Sequence Number=SeqID_2458
TSATPEFDSHRFRSAEHQQRFEAIKRWSFHRERRVQLKDDEYTDFQEEIARRCWTSLGVRDMRSWVRGQWIPFDVDALSQFLGDMLVLEEGQECEFS

SEQ ID NO: 94144 - protein, 254 aa, Glycine max
  Coding DNA Sequence Number=SeqID_2459
DIVSDIVDPAASLLDFYLALYSNSSILGQDVLDIVSDIVDPAASMLLAIPVFSSRMSWTCPILFFDITLDIMCSNSSFPSLSKYALQKPSERKEEAIDIDSLSAKVTNITRLSGVTHRGHIFVALDMPVRPTNAKGKAKVAVEDTNEASPTPDEDVPAGRFAVVTTCPFTGERGKAHGCAFQRRKYVRSRHQRLFVENVGKNRRKPVIKNIPSSGVVFTFEEGISTSHVDKSGALAPTYPPSKRKSDLRSSFLR

SEQ ID NO: 94145 - protein, 65 aa, Glycine max
  Coding DNA Sequence Number=SeqID_2460
  Homolog annotation: Hit_ID=A5AXN9; Match level="QueryCoverage=87%, HitCoverage=9%, E-value=1e-10, Identity=49%"; Hit description =Putative uncharacterized protein
MSLNQVPVKRKKAEWCDKNTEVMLKVCIEEVNAGNKPHSHFTKLGKDTGLGWDGEKKTIAASDEW

SEQ ID NO: 94146 - protein, 62 aa, Glycine max
  Coding DNA Sequence Number=SeqID_2461
MKLKLKKKGGESSLSSSKKGRLWKQSYHDDSPRCFDDAKAQRVLSRLKNQAFKIPLKDSRIK

SEQ ID NO: 94147 - protein, 186 aa, Glycine max
  Coding DNA Sequence Number=SeqID_2462
  Homolog annotation: Hit_ID=A5C7Z4; Match level="QueryCoverage=42%, HitCoverage=28%, E-value=7e-09, Identity=37%"; Hit description =Putative uncharacterized protein
MQMLQFLYPLMRFPLVGQALHTFLAWPTHLVKSLSQQVAVSQPKPPPKPDPEVDDPLYLMTLTIPEPQSTETCMRAENSDIYGFLEPQSIQRFHCSGHWQMVVILPKEHLVVWFCSLHNRPNNYLKGIINSAIKGLDDAPQPKSKASARWIVVKCNRQKGSTECGYYVMHWMSTIILGTFRNNWEA

SEQ ID NO: 94148 - protein, 180 aa, Glycine max
  Coding DNA Sequence Number=SeqID_2463
  Homolog annotation: Hit_ID=A5AWV3; Match level="QueryCoverage=62%, HitCoverage=6%, E-value=3e-09, Identity=33%"; Hit description =Putative uncharacterized protein
MTRGTPSDLQPFDPEIDRTFHRLVRHSVHLDYPEHFVPFEHPEHSVIGESEHSVVGNFEHPDFEHYNFEHSDFEHSENMAQPPPRERTLREMAAPDFTYESLCIQYPDEDVPYVLKTGLIHLLSKFHGLAGEDPHKRLKEFHIVSSTMKPPDVQEDHIFLKAFPHSLEGVAKDWLYYLAP

SEQ ID NO: 94149 - protein, 39 aa, Glycine max
  Coding DNA Sequence Number=SeqID_2464
MAPPYRILGCLAATFSACPAPRRDDDRSVMTLSFICIRP

SEQ ID NO: 94150 - protein, 137 aa, Glycine max
  Coding DNA Sequence Number=SeqID_2465
RNIQLNGLVIGTLSNRMKCLKMFFTMPLGYINGVKVGTSYVPIKVSFSPKVGPGLPAVPPVQLLTGWCVTAKAPPDISAGKCSGHAARRVPFAIQAAQLLGRAIGAGLFAITPAGERGMCCKAIKLGNARVFPVTTL

SEQ ID NO: 94151 - protein, 163 aa, Glycine max
  Coding DNA Sequence Number=SeqID_2466
  Homolog annotation: Hit_ID=A5BSR3; Match level="QueryCoverage=76%, HitCoverage=41%, E-value=9e-13, Identity=33%"; Hit description =Putative uncharacterized protein
MDEKRKKKLEEATQSGSTDTVIDPPSPIKRHVKWKLARTKKTGDMTSEAAKEIADKIDALEEQASQGSFVTHGRHDILTAAIGRPEHPGRVRAVGAGITIKQYFGSASRTSSIAPEYLQQLTQQIKDQLEDSITEKVTRRLMLSLSQMQSQGLHCLMNLMLVL

SEQ ID NO: 94152 - protein, 167 aa, Glycine max
  Coding DNA Sequence Number=SeqID_2467
ALVFPALIIGLCQSFGVPVTPSKVIRLPITRTFIEKYCTARQAQGGDPQAPDAPPPPPQADPAGSFDTERYLRHLVRQQPANHRAHVQTHDSLYQLSLSLQSQGFASFPCPTPDQFRAEVAWPGDWPEAQAAEAGEAPAEAPGEADEARVDEEMTNLLDFLGGSGAT

SEQ ID NO: 94153 - protein, 108 aa, Glycine max
  Coding DNA Sequence Number=SeqID_2468
MALKKLSMRRSRRDAATEGSSAAPEFDSHRFRSAEHQQRFEAIRGWSFHKERRIQLREDEYTDFHEEIARRHWTSLVTPMAKFNPEVVLEFYANAWPTEEGVRDMRSW

SEQ ID NO: 94154 - protein, 75 aa, Glycine max
  Coding DNA Sequence Number=SeqID_2469
MHERQSIHGAPNKSGEWRIGEQLGNQFAGLQTRWWRMHERQSIHGAPNKSGEWRIERTALGNQFAELQDSLVEDA

SEQ ID NO: 94155 - protein, 168 aa, Glycine max
  Coding DNA Sequence Number=SeqID_2470
  Gene Ontology: Mol. function=protein serine/threonine kinase activity; Biological process=protein amino acid phosphorylation
  Homolog annotation: Hit_ID=A2V6V5; Match level="QueryCoverage=54%, HitCoverage=13%, E-value=2e-20, Identity=51%"; Hit description =Lectin-receptor like protein kinase 3
ESQAIAQYNQSLTKAYRTAVQDGVVAGLGLGNQYSSVAASKKTLPMVRMGQQMKKSELPLKLLMQQNSLIDFHIAKILAWSFSDSNFSIGDALVTENLPSFVHHKKWFPGAQAFAVGVTSIVFVLIIGFGYVAFFVLRRRKTQEEVEDWELEYWPHRIGFHEIDAATT

SEQ ID NO: 94156 - protein, 383 aa, Glycine max
  Coding DNA Sequence Number=SeqID_2471
  Homolog annotation: Hit_ID=A5C7Z4; Match level="QueryCoverage=38%, HitCoverage=49%, E-value=2e-07, Identity=27%"; Hit description =Putative uncharacterized protein
  Pfam annotation: Domain name=Peptidase_C48; Domain location=186-373; Score=-35.9; E_value=0.1; Accession=PF02902.10; Description=Ulp1 protease family, C-terminal catalytic domain
MDTFKGQIQEAIKLELSQIASQHSAPLQPNDIQVLAARVSTKGSCAATETNALAKKPSKLNGDNVGLHVTAENSNKLVAVGKQCDSFGTIHNVPYADDVVPVSMVEVIFGDAEEAEKDVSSPLKTVEEEKVAEVIDPLGELVKNLFDIYQRPVEVSWDGAKFGINNVKDGFFITHADVSEIILGDKCLNISILQLWLMFIHDWSASIGYGPLYGFLEPQCIHNASSRRQECENYIGRWLKEAGKQIYIAPYLNQAHWQLVVLCPGDNVVVWFCSLKKKPDAAIKGAVNSAMKLVTKTAEGKPPQHGPQWIEAKSHVKTGNYECGYYVMQWIWCIVSGGLKDDWIHWFSDRSPLTEETMTTLRHKWAAYFIQMKKCEPRKNLIT

SEQ ID NO: 94157 - protein, 199 aa, Glycine max
  Coding DNA Sequence Number=SeqID_2472
MWGIPFILEPNQALTWRECQSLPSEAERIEGKFPIKEKERRKISNQRESKKEKKENSPIKEWEKAKRKERKFPIKEWEKVKKEEEEGKKAPDQGSKENRRNVQKGLWTGQYLNNTELSQIWGSLLGDNNCGKKMTAHTAKSISNKVAAGVSLSEAYALSESHVLSEVLSPLSELGEFGGESEKHMRAQLAQRGVGLFMF

SEQ ID NO: 94158 - protein, 293 aa, Glycine max
  Coding DNA Sequence Number=SeqID_2473
  Gene Ontology: Mol. function=oxidoreductase activity; Cellular component=apical plasma membrane; Biological process=L-ascorbic acid biosynthetic process
  Homolog annotation: Hit_ID=A7PNT4; Match level="QueryCoverage=93%, HitCoverage=100%, E-value=1e-101, Identity=64%"; Hit description =Chromosome chr8 scaffold_23, whole genome shotgun sequence
  Pfam annotation: Domain name=Aldo_ket_red; Domain location=10-270; Score=366.8; E_value=3.5e-107; Accession=PF00248.12; Description =Aldoketo reductase family
MAKLIKFFELNTGAKIPSVGLGTWQAEPGVVAKAVTIAIQVGYRHIDCAQAYNNQAELVLFYLLELLVCSDHVPEDVPKALDKTLQDLKLDYLDLYLIHWPVRMKSGSVGFKKEYLDQPDIPSTWKAMEALYDSGKARAIGVSNFSSKKLQDLLDIARVPPAVNQVELHPGWQQQKLHAFCESKGIHLTGYSPLGSPGVLKSDILKNPVVIEIAEKLGKTPAQVALRWGLQTGHSVLPKSTNESRIKGNFDVFDWSIPEELLAKFSEIKQASIGGGYKVVQDRPESRIEEDVE

SEQ ID NO: 94159 - protein, 90 aa, Glycine max
  Coding DNA Sequence Number=SeqID_2474
  Gene Ontology: Mol. function=carbon-nitrogen ligase activity, with glutamine as amido-N-donor; Cellular component=chloroplast
  Homolog annotation: Hit_ID=Q9MUK5; Match level="QueryCoverage=67%, HitCoverage=10%, E-value=1e-17, Identity=69%"; Hit description=Toc64
HEFRLKHDDWMNTVKPNLHPGVSAQLHEKFEVFDVEIENSKSVRSEMRAVINSLLKDILVIQICHHEQVRATTGFEELGANAILAVSLAV

SEQ ID NO: 94160 - protein, 155 aa, Glycine max
  Coding DNA Sequence Number=SeqID_2475
  Homolog annotation: Hit_ID=Q2HW87; Match level="QueryCoverage=49%, HitCoverage=7%, E-value=8e-08, Identity=40%"; Hit description=RNA -directed DNA polymerase (Reverse transcriptase); Zinc finger, CCHC -type; Peptidase ...
  Homolog annotation: Hit description=aspartic, active site; Retrotransposon gag protein
MGPKSTLRLIRMHLWPNLLGVFYPMPLRGGGLLRPVEGVVCYSHVVTVVHEGDEVPQAEIGEHDSGRGEVRERSKCVKFINGLRPEVKMMVNCHDIHNFAQLTNMCRIFDEDQREKLAFYRNANANHGKEKKLVTHSCAKPYSAPPGQYDNHFGG

SEQ ID NO: 94161 - protein, 118 aa, Glycine max
  Coding DNA Sequence Number=SeqID_2476
GARLASGSHLVQFQTREGFGLSGVTQLYYSIWSDFLDATPVFLDGSPSLAAFYHDSDEDNARNKGKEPLEGLGGPMARARTKKAKEALQQVLTMLFEFRPKLQVEKLRIVNCTMFQEE

SEQ ID NO: 94162 - protein, 114 aa, Glycine max
  Coding DNA Sequence Number=SeqID_2477
MKHSSKLIGWRTHERKHNSWGSEKKARMEACTRGSSLVNHEIAPKSLSGGCMNENAIHGAPKKSERMEDCTRGSSLVNHEAAPNTLGGGSMNEKEIHGAPKLKARWRVALEGPY

SEQ ID NO: 94163 - protein, 125 aa, Glycine max
  Coding DNA Sequence Number=SeqID_2478
MPKSSPNMHVKQEVSTRVKARLLCKQSMGQNTPNKIDDDGSNSHQGKLNFGGKFGLLGVLAFPLSVYFSFLFGSAWNKHGGDYFRHPSDSSVLSSKGKGRNSYPGLSFMVEKLRFGSKRLVEGST

SEQ ID NO: 94164 - protein, 239 aa, Glycine max
  Coding DNA Sequence Number=SeqID_2479
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLIVIADRKRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 94165 - protein, 93 aa, Glycine max
  Coding DNA Sequence Number=SeqID_2480
MAKINPGKTMTAHDWSHIILALTCRYIGTDASGARVTTDRSLPLPVAKQAANVAARQPRDGLKPRVHPEAMGHATLPPLSCYSCLNVRPPSAR

SEQ ID NO: 94166 - protein, 16 aa, Glycine max
  Coding DNA Sequence Number=SeqID_2481
MENCTKQSLRMDPHSK

SEQ ID NO: 94167 - protein, 93 aa, Glycine max
  Coding DNA Sequence Number=SeqID_2482
MGVQIATKLTWAFLRGKEGRANGFSPSGIEKSLEINEKNCFREKNPSRGTSVTLSRRFCKRFREDSSPFFIVLHSFFGLQPKNLTDRSCCNLG

SEQ ID NO: 94168 - protein, 91 aa, Glycine max
  Coding DNA Sequence Number=SeqID_2483
MDDDQWAYYSAMSEEVDMDFRDEEDCGVNEAHVDCLDAFNTSQVFATREDVLKWARTVAHENGFVAVIMRSDTYTGSRGRTSFVLIGCEIS

SEQ ID NO: 94169 - protein, 111 aa, Glycine max
  Coding DNA Sequence Number=SeqID_2484
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q37953; Match level="QueryCoverage=62%, HitCoverage=75%, E-value=3e-12, Identity=54%"; Hit description=LacZ protein
  Subcellular localization annotation: CTP_CleavageSite=32; ConfidenceScore=5.28e-01
MTMITPSSKLTLTKGNKSCPGDPLVLERPPPRWSSNSPYTHPPFASWRNSEEARTDRPSQQLRSLNGEWDAPCSGALSAAGVVVTRRGDRYTLPALMSGGAFAVTHHPVSS

SEQ ID NO: 94170 - protein, 275 aa, Glycine max
  Coding DNA Sequence Number=SeqID_2485
MERSMIDAASGGALGDMTPAEARNLIEKMASNSQQFSARSDAIVIRGMHEVATNSSGETKKLEGKLDVLVNLPKAYAANIYNRPPQPQQQNQPQQNNYDLSSNRYNPGWWNHPNLRWSSPSQQQQQQQQTYFQNVVDLSTPYVPPPIQQQQQQQPQKQQTVEALPQPSLDELVRQMTIQNMQFQQETRASIQSLTNQMGQLATQLNQQQSQNYDRLPSQSVQHPKNVSAITLRSGKQCESKEKHHIPLPFSPRAISNKKMEEAEKEILETFRKEE

SEQ ID NO: 94171 - protein, 92 aa, Glycine max
  Coding DNA Sequence Number=SeqID_2486
  Pfam annotation: Domain name=zf-CCHC; Domain location=20-37; Score =34.2; E_value=4.8e-07; Accession=PF00098.14; Description=Zinc knuckle
MERSHKFNNGKRSQEVSPTLKCYKCNQPGHIKANCPSNESWLEKNEKKSYKERRSKKAYIAWDDNDSSDGLEKEIKLLSKDYESDENISQEV

SEQ ID NO: 94172 - protein, 146 aa, Glycine max
  Coding DNA Sequence Number=SeqID_2487
LGHHFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSAT

SEQ ID NO: 94173 - protein, 181 aa, Glycine max
  Coding DNA Sequence Number=SeqID_2488
  Homolog annotation: Hit_ID=A6H5B3; Match level="QueryCoverage=37%, HitCoverage=84%, E-value=1e-27, Identity=88%"; Hit description =Putative ribosomal protein S3
QRKESKSDSRSSGERNGSSLNRENGVVGELYKCRAARRSSRECCTLDGESPVAESITSLRSDPSSMGHVESRVNQQGPPCKAKYSWVTDSEVVPETTGAVAKASLHRAIVTAYGPEPGGEMPLEPRASWFSPKCVEAQQLTRHLGGQGRPVRRWGISFIVERETARDHQLRPLNDRSVIKE

SEQ ID NO: 94174 - protein, 334 aa, Glycine max
  Coding DNA Sequence Number=SeqID_2489
  Homolog annotation: Hit_ID=Q6WAY6; Match level="QueryCoverage=89%, HitCoverage=50%, E-value=4e-31, Identity=32%"; Hit description =Putative uncharacterized protein
MVEEFEEILGCPLGGRRPYLFLGFYPSLARISKIVQISAQELDHRKQVKNGVVGIPRKCLEAKARILAGKGKWAPFIDILALLIFGGVLFPNVDGLVDLAAINAFLAYHDHKESPVVAMLADLYDTFDQRCEKSSTRIVCCTPTLYVWLVSHLFRQEIRHACPLESHRSCTEKGGANWDRLLANKEGESVNLFPRWKEGRTGVLISCEGFPNVPLMGTRGCISYNPVLAIRQLGYPMRGAPLEEELVPVISQGFNKTNVETLQKVHKAWEVVQKKDKELRGSNNGPIGGYRKWLKAHVQGLDWLPSLRTTKREEVEAPEEDEEMQALREELEQA

SEQ ID NO: 94175 - protein, 151 aa, Glycine max
  Coding DNA Sequence Number=SeqID_2490
MSPCKGIMVCVVLMGYIAPTKTLNGPKEVQQALGFPALVTGLCRPYRAPVPPSKDCARKTPSGPEEGQQGLELPALNTGLLLRPQAGAGRNTTAALGWPVAGNRHTATTSRVHLSSSAKRLERCLRHMADQQATKSKAKGKQSTRSVTDKS

SEQ ID NO: 94176 - protein, 111 aa, Glycine max
  Coding DNA Sequence Number=SeqID_2491
MTIEESIHVSFNESNVISPRKDVLDDVSDFLEEMHTHERDSKRKRDESNKDFQDYETKANNDLPKEWKASRIHFLDNIISNISKELEIGGSYWKLKLEVGNGSYWKLEVRI

SEQ ID NO: 94177 - protein, 88 aa, Glycine max
  Coding DNA Sequence Number=SeqID_2492
MLNQFVPFIQGFIHNVVDVKTDGNCGYQSIATLFGMGEDSWLLVHNELIKELGRWSHDYTNLFGGTERFKQLRLSLLVDGFSKVSVDK

SEQ ID NO: 94178 - protein, 120 aa, Glycine max
  Coding DNA Sequence Number=SeqID_2493
MVVISLSMKLKEEHCSIGFSRPLTNQNQNSFSYGSTENHKPEGQEVSAAGVNIDNHMNEGSGWLTQHNNAKPIADSSFSKAKPEDSLNSQFKLPEASQLLCHSLEGNAGALTNFEVLDFL

SEQ ID NO: 94179 - protein, 107 aa, Glycine max
  Coding DNA Sequence Number=SeqID_2494
MYPLLFSFNLVDVPSTRTDPQEMYPLLFSVKPKEKGDTKEFRRLVLCSFGKGRRETQKEFKRLVLGEFFLAKGEENEKMNSTSFQGLENQKAFGTKKKKKFKEIQGL

SEQ ID NO: 94180 - protein, 120 aa, Glycine max
  Coding DNA Sequence Number=SeqID_2495
  Homolog annotation: Hit_ID=UPI0000ECAFAB; Match level="QueryCoverage =27%, HitCoverage=40%, E-value=4e-12, Identity=100%"; Hit description= UPI0000ECAFAB related cluster
MDSLVDLAAIDAFLAYHHSKESPVVAILADLFDTFDQRQNNQLVSLMEGRKGRSSLLVWGLPKHPVDRDEGGRHRGGAPIRPIVSRITIHWPSFYNVVTGKTLALPNLIALQHIPLSPAG

SEQ ID NO: 94181 - protein, 186 aa, Glycine max
  Coding DNA Sequence Number=SeqID_2496
  Gene Ontology: Mol. function=protein binding; Biological process =embryonic development ending in seed dormancy
  Homolog annotation: Hit_ID=A7QFJ5; Match level="QueryCoverage=59%, HitCoverage=26%, E-value=6e-39, Identity=66%"; Hit description =Chromosome chr8 scaffold_88, whole genome shotgun sequence
MKNIVFSHIKVCCQRENVDDTAGAAQLQMVCMMLVRFPAFELRKSTGLMYLQNKFKIWNHEEATLLNTFGNHDFPDRGISKLCLVNELDDSLLLDASFDGNIQIWKDYLLKGKQKLVIAFSSIHGHKPGVRSLSAVVDWQQQCDYPYASGEISSIMLWDVDKEQLVNSKSSSSDCSVSVLVSLIFA

SEQ ID NO: 94182 - protein, 311 aa, Glycine max
  Coding DNA Sequence Number=SeqID_2497
VDSRGSPALAFKGLHALAFKGLHVLAFRGLHALTFRRLRILTLKRLHILSFRWLHVLAFRGLHVLAFRGLHVLAFKGLHALAFRGLHVLAFRRLHVLAFRGLLICALRGLKCLGHPLISEEGQLCEHNQREAIVQPLCILGQDFTCAAAKRRVQIMHTNMTTLTQIWMTLLLSNILPNNHNADLPLRKSSISPTRCPSPPARSRHHDIGITLARHPVNPEKSNRVLGFPVLITGLFQFYVVPVAPNKVIRPPNNWAFIKKYCTPQVGAGRDTPATWGWLIAGNRCTIATSKAPQLIYKGWGVAYDPWPTSR

SEQ ID NO: 94183 - protein, 207 aa, Glycine max
  Coding DNA Sequence Number=SeqID_2498
  Homolog annotation: Hit_ID=Q84VH5; Match level="QueryCoverage=68%, HitCoverage=34%, E-value=1e-47, Identity=90%"; Hit description =Envelope-like protein
MSTRLFPTSESQESRKKVPGNVLMPMDNISFHSIGNVKGGNLKSDEYQKVFVRGKCIRFSPAVINKYLGRPTEGVVDIAVSEHQIAKEITAKQVQHWPKKGKLSAGKLSVKYAILHRIGTANWVPTNHTSTVATGLGAVSKDDLIAELKDTCKVLEATIKANTEKKMELERLIKRLSDNGVDDGEAAEEEEDAAEDTESDDDSDATP

SEQ ID NO: 94184 - protein, 78 aa, Glycine max
  Coding DNA Sequence Number=SeqID_2499
MRVHCYQASRRPSMTTDSPPLLMFPWTRIASTNKALFQDSLKTKPCLKTKCFQDMQGSGNRLPGSVIDYQKTGLRNSC

SEQ ID NO: 94185 - protein, 174 aa, Glycine max
  Coding DNA Sequence Number=SeqID_2500
  Homolog annotation: Hit_ID=Q2HSV3; Match level="QueryCoverage=84%, HitCoverage=22%, E-value=1e-14, Identity=35%"; Hit description=IMP dehydrogenase/GMP reductase, putative
MSPRASRWLTLKAHIKGITGAPYRARCDGLTVTDVSWLLYTEHRGVRAFQEISSFQGQLRWGPMVVTVRPERVVRQFGYIQSIPPPPVSARLSHDQIDDRWMQFVDHLLPAGQLCLVPGQVSADYMEWFFRISHPFITPTQAGDQQRDAPAADPEDYIQPPSPQVPVALSPLHM

SEQ ID NO: 94186 - protein, 69 aa, Glycine max
  Coding DNA Sequence Number=SeqID_2501
MGDTEGPPKGFVGVYHQMLALQWYIRAKARSRLDCDGEFHGSLPRSGVIDILIGSVRPIGWRIVERQAI

SEQ ID NO: 94187 - protein, 47 aa, Glycine max
  Coding DNA Sequence Number=SeqID_2502
GRGRVARRLAEARAGEAPAKAPDEADEAREDEEMTDLLDLLGGSRAT

SEQ ID NO: 94188 - protein, 70 aa, Glycine max
  Coding DNA Sequence Number=SeqID_2503
MGEVKEVQEQMKANMEAMKEQMATMMEAMISMKKIMEANAVAIATTSTVAKVNPTPPSGLNQMNHPTSDM

SEQ ID NO: 94189 - protein, 104 aa, Glycine max
  Coding DNA Sequence Number=SeqID_2504
  Gene Ontology: Mol. function=phosphoprotein phosphatase activity
  Homolog annotation: Hit_ID=A7PHV0; Match level="QueryCoverage=100%, HitCoverage=33%, E-value=3e-17, Identity=40%"; Hit description =Chromosome chr13 scaffold_17, whole genome shotgun sequence
MWAWERCTTLAPKRTPPVIKNKPLGHRWLRRENQHIGNDDLIVFRRKFDIMKRHEFLWEPYTTTVMSMLPPICLVGSVAWCAVVPLICFHVVEWHQHNRVLRQF

SEQ ID NO: 94190 - protein, 66 aa, Glycine max
  Coding DNA Sequence Number=SeqID_2505
MKKIQGLQAPHGATSKALCRACRPWIFFINGVLCFLKINGSEMEKEERLLETPLQGEDESRTSSPP

SEQ ID NO: 94191 - protein, 114 aa, Glycine max
  Coding DNA Sequence Number=SeqID_2506
  Gene Ontology: Cellular component=chloroplast
  Homolog annotation: Hit_ID=Q3BAI1; Match level="QueryCoverage=76%, HitCoverage=66%, E-value=5e-41, Identity=89%"; Hit description =Putative uncharacterized protein rps12
  Subcellular localization annotation: CTP_CleavageSite=47; ConfidenceScore=5.59e-01
MRGVKAFHHPGAELFFRRTSPTVSSPQNGSSRRDLLLNSQNFFRSIPAGAENPSLSRLCYRRLWGSRNRRALILGWVYYLDAFSSYPLRTWLPSVYRGHDNWHTRGASFPVLSY

SEQ ID NO: 94192 - protein, 146 aa, Glycine max
  Coding DNA Sequence Number=SeqID_2507
MAEKTKKKLEEAAQSGSTEGVIDPPSPIRRHVKSKMAHTKKIGQMTSEAAKETTEKIEQASQGLFVPHGLQDLLTAVIGRPEHSGRVRATGSSVTIKQYFGLAPRSSRNSSSMAPEELEQLTKQIRDQLEESIMERVSRQLMLSFS

SEQ ID NO: 94193 - protein, 159 aa, Glycine max
  Coding DNA Sequence Number=SeqID_2508
GGAYGKRALPRPSHFPVKYLPGIFQENLRPVRKPFPLAAVERPERSESVSEESGNISCITYSADAPVQPFFSCHMKHFTDTLISANIGTKAGTGPPLEVDGIDKLDPLGTTVSEKYSDDVAWKTVKPISASLADIEFLQPGGSTSSRAAATAVELQFAL

SEQ ID NO: 94194 - protein, 128 aa, Glycine max
  Coding DNA Sequence Number=SeqID_2509
MPFDRKITKTERKNRKKKKQATTRTSENNIAERGGEGNRPPRRRTLGDYAYQQGPKHYNSKVIPSFSNKGVELKPALLSLIGSHLFAEMDHEDPYTHLSAFMELCSMMGASDEDVETVYLRSFPSSLA

SEQ ID NO: 94195 - protein, 113 aa, Glycine max
  Coding DNA Sequence Number=SeqID_2510
MIDQGRLEVGDEGREEQHICMQSADERSFERPKPLVIYFTKDAASPKPRYPSVVKPVPFPYRNSHAVPCVDAIGFDVLMMIMMMCCNLMQMGFSRLKFKTILQDYKSQHQDDH

SEQ ID NO: 94196 - protein, 310 aa, Glycine max
  Coding DNA Sequence Number=SeqID_2511
  Homolog annotation: Hit_ID=Q6UUU1; Match level="QueryCoverage=27%, HitCoverage=55%, E-value=3e-18, Identity=61%"; Hit description =Putative uncharacterized protein
LAQGFPGINRDTRISLFREVIFRHRYYSAQSASAVPPVQLLTGWCVTAKAPPDISAGKCSGLAARRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSCSCLSVYRGHSAVMGRFAPSWTVCTNPPFSPTAAPYPVTIVLSPTRKDMQKHHWAAAT

SEQ ID NO: 94197 - protein, 152 aa, Glycine max
  Coding DNA Sequence Number=SeqID_2512
MPQNVLYDAIGIYQRCWNLLRADQRLIFAKKLAQGFPGINRDTQDLFYFCEVIFPSQVLQWLLFLSAVPPVQLLTGVRSPLRVTTTPAALNAPLQGASHSPFRLRNCWEGRSVRASSLLRQLAKGGCAARRLSWVTPGFSQSRRCKTTASEF

SEQ ID NO: 94198 - protein, 83 aa, Glycine max
  Coding DNA Sequence Number=SeqID_2513
MSGFTRNSPQISASPYQLDFTLYASGSYNAQWNAPGLLHDKHTLRSSRILRKVEVDEPWLGLSRCKIHFLVGVLVCAKGGVRH

SEQ ID NO: 94199 - protein, 207 aa, Glycine max
  Coding DNA Sequence Number=SeqID_2514
  Gene Ontology: Mol. function=transporter activity; Cellular component= integral to membrane; Biological process=transport
  Homolog annotation: Hit_ID=A7MEZ7; Match level="QueryCoverage=68%, HitCoverage=31%, E-value=1e-53, Identity=68%"; Hit description =Putative uncharacterized protein
MAMILLWQLGGVTAAGAAGSRLYRHLVRAGAVARRAPDRAHHPAGAEADADCADALHHRLWLYLTLTPNVDFTTLVLMRSAQSIGLGFLFVPLTTIAFITVPQRLNADASALFTMFRNVAGSIGISLATAGITEREQHWAQAIRDFTSAVGDPLTLASGQLYQEMIAQARILAYIDVFMGLSIVAVLLIPFCWLLSPIKSEGSAGAH

SEQ ID NO: 94200 - protein, 251 aa, Glycine max
  Coding DNA Sequence Number=SeqID_2515
FDEFKEELERRHWDEKLTNFSNNSIGIAIVKEFYANLYDPEDKSPKFALLRPDPKKLAARLCISGRGFELNADGQPLKILRKNMTTLAQAWRIFSFSNLIATSHTYDVTLDRAKLIYGIIMKMNMNLGYLISHQISLIAQHDTSRLGFPALITALCKDRGVQSDSRSLENLSPGINLAYIKKNCWNLNDPTVTFRGPRKARGKRSEVPTTSAPPEAPTPSSSTTPVIPSASTQRPLPAPISAGPSDFIFTP

SEQ ID NO: 94201 - protein, 355 aa, Glycine max
  Coding DNA Sequence Number=SeqID_2516
  Homolog annotation: Hit_ID=A6BLN7; Match level="QueryCoverage=96%, HitCoverage=66%, E-value=5e-19, Identity=24%"; Hit description =Putative transposase
  Pfam annotation: Domain name=Rep_fac-A_C; Domain location=213-346; Score=-34.9; E_value=0.00025; Accession=PF08646.1; Description =Replication factor-A C terminal domain
MMGKFRVCDHEYKLCFTGVTVVRQCDMEQFPFRKFRYVAFSSVIAGHFKIGLLVDVIGVVDEVVFRYVSSKNTRVVLNLKDLSGQVLSYTLWENYCLQFLSYLNDIEDERLIVILLTHARIKEAQGSYPASVSNSFKASKLMINDLVLEIQEFRESLLDLGIEVRSIFAPIGQGSSQVSGSSQLSSKDVFLSKTEVKNISEINASSEEFVCVTVAKITTIVMNNYSWCYPACGQCYKKVDMQSVSFTCPCGKENNQHVLRYRVEVMVSHKGEQTKFLIWDCECAQLIGQSADEVNMLKIEDGDVDLNASPQALDRLLGCFLAFKVKVQPRFRNSVVLKYSDEPELINVMLDMIPD

SEQ ID NO: 94202 - protein, 58 aa, Glycine max
  Coding DNA Sequence Number=SeqID_2517
MAEKGKADHLKGRLRAIEGGCNYRTFAKEGDGSFKEHAQKVEGSGGPGGTPNDGKGER

SEQ ID NO: 94203 - protein, 69 aa, Glycine max
  Coding DNA Sequence Number=SeqID_2518
  Gene Ontology: Biological process=transposition, DNA-mediated
  Homolog annotation: Hit_ID=Q1J7G7; Match level="QueryCoverage=42%, HitCoverage=41%, E-value=8e-10, Identity=100%"; Hit description =Transposase
  Subcellular localization annotation: CTP_CleavageSite=44; ConfidenceScore=5.01e-01
MVKVGTSYVPINVSFRQKLAQSFPWLLFLSAVPPVQLLTGWCVTAKAPPDISAGKCSGHAARNHHTRRA

SEQ ID NO: 94204 - protein, 97 aa, Glycine max
  Coding DNA Sequence Number=SeqID_2519
HLLFAGIAPARHPVDPEKSNRVLGFPALIIGLGQFYGVPAAPSKAGAGRYTTTAWGLQIAGNRCTAATSRAPQLIHKKVRALPTTHGQPIGDQVQSQ

SEQ ID NO: 94205 - protein, 139 aa, Glycine max
  Coding DNA Sequence Number=SeqID_2520
KTLRRTGGATPEPAVDALDLLEGDEDPLLEVDSPEEVMSASEADSTEDSGPREMAISGGSSSYMGVKLLTFLSGVGATLGGAKLGAKSYGRKECLLDGGVKSTSAMALVAAIAAALTSIIFFMLIMASIIVAICSLMAS

SEQ ID NO: 94206 - protein, 55 aa, Glycine max
  Coding DNA Sequence Number=SeqID_2521
MGAKHLTRTKEWSHVIEQRFPDEIRGWIKWLTVRDEFSIIQDKRMASESEETTRF

SEQ ID NO: 94207 - protein, 192 aa, Glycine max
  Coding DNA Sequence Number=SeqID_2522
AEIPYGHPRLSSIEGNDFDGIRMMLAVRDDRVRWRREVSWFFNLVIFKMLKYLTPIVRQSVEFRDMSDVEGKHCCAIRKVPQYSRCQRRGYCIVRKVSGVQIAIKPTRAFQDVPTEGGAFWPRIFFINGFLCFLEYEWQRNGERGRERRRHFKEKMSLEEAHHHRRPWIRAWRKKEMNEGRGREEHEILCSK

SEQ ID NO: 94208 - protein, 343 aa, Glycine max
  Coding DNA Sequence Number=SeqID_2523
MFACSPFAKRLLLAKRIIIHALSHEFQVLSAQPYHLRLINSAKLAKYLWLSEADSLCPELERRNLHKRLANLQEGSIDVAVVKEFYANFYSPTDQAPKCAKIRGHLIKIDAESLNEFLQTPVLLEEGESLPTYSRFCRLRSDPREMEARLCITGMECFLRKDLTTLAQTWSVFSYSNLAPTSRTSYLNTDRARLVYGLITRMDMNIGGLISGQMTMIAQSNSSRLGFPALITALCRSRGVGSDALTSYENVRPTIDLAYIIRNFWNANDQIVNFPETKKTKLRAADIPSSFTPIVGISASSTLAPPPSLAELSAQSSQTSDAKFQSLFEGQVLIIQSLQELVQ

SEQ ID NO: 94209 - protein, 82 aa, Glycine max
  Coding DNA Sequence Number=SeqID_2524
MVAYVSKAQSEVEELKLSLEADKLEDMKPKLDNLYMVLGDEVVMETEEDELEEEVALNVLTVRKWATHKTLVILFTDSPENR

SEQ ID NO: 94210 - protein, 111 aa, Glycine max
  Coding DNA Sequence Number=SeqID_2525
  Homolog annotation: Hit_ID=Q1SN17; Match level="QueryCoverage=91%, HitCoverage=23%, E-value=1e-08, Identity=31%"; Hit description =Transposase, putative
  Pfam annotation: Domain name=FAR1; Domain location=54-102; Score= -30.3; E_value=0.1; Accession=PF03101.6; Description=FAR1 family
MDEDQWMYDSMMSEEVGMNVENEEDVGVKVDCSDAFNTSQLFDSRDEVLQWARSFAHDIGFVAVIMSRKCGCPFKLHAKPVSGGDRWIVKLICGVHNHEMAKSFIGHPYAG

SEQ ID NO: 94211 - protein, 310 aa, Glycine max
  Coding DNA Sequence Number=SeqID_2526
  Gene Ontology: Mol. function=phosphoprotein phosphatase activity
  Homolog annotation: Hit_ID=Q2HTA0; Match level="QueryCoverage=91%, HitCoverage=37%, E-value=3e-23, Identity=29%"; Hit description=IMP dehydrogenase/GMP reductase, related
MVFLDALRDLTQSRGYAWGAAALVHMYDNLNDTSKSTVRQLVGYITLLQCWIYEQFSSVSFTVPAEDYDEKRQRACRWTSGKALPISTYRRRMDRLTPDAVCWSPYGDHRSFREFEVISLFFGHFKWGPLAVIHRPERVVQQFGYIQTIPPHPIASSLSIEEINDRRMQFGEYIAPVGQLCAIPDHYSPDYMDWFYMISHPFMSLAQPRDPPRVPLVQQYEEFVEPYMYQQSMAAAASNEADVDVHHLRHAMDDFVAIADKLGKLLNLRILIEGTEAYTVVEECVGIARHYIGQSTVGHRSRRRRRTNDH

SEQ ID NO: 94212 - protein, 218 aa, Glycine max
  Coding DNA Sequence Number=SeqID_2527
  Homolog annotation: Hit_ID=Q2HTA0; Match level="QueryCoverage=73%, HitCoverage=26%, E-value=6e-11, Identity=31%"; Hit description=IMP dehydrogenase/GMP reductase, related
MAYLLHLPIIGAFHGFEPLHVDEVILMFVELLEVSGEEARAETTQYAFRDLSHSGSYAWGVVVLVHMYDHLIDACKSDDRQLAGYITLLQISPHVCRWIATKASLKSLPTSTYRKRLDGLTIPDVCWMPYNEHHGVRDFDLISCFSGHLRWGPVVSIPPQTTASMLSFKDIDDRWMHYFDYFAAAGQICVVPEQCASDYIEWCRSKLHDDESRLIQGG

SEQ ID NO: 94213 - protein, 228 aa, Glycine max
  Coding DNA Sequence Number=SeqID_2528
  Homolog annotation: Hit_ID=UPI000065F7CF; Match level="QueryCoverage =92%, HitCoverage=18%, E-value=1e-09, Identity=33%"; Hit description =Homolog of Homo sapiens "Leucine-rich repeats and IQ motif containing 1
  Subcellular localization annotation: CTP_CleavageSite=41; ConfidenceScore=5.16e-01
MDPWVLKPIIFRGLHVLALRTTRPPLQRATRPHLQRTTRPRLENYTSSPSEDYTSSPSKGYTPSLSEGYTPSPSEGCMPSPSEDYTSSPSEGCTPTLSEDYTSSPSEGCTPSPSEDYTRVARLRLQRTTRPHLQRVARPHLQRTTRPLLQRATRPHLQRITRPFLQRTSRPHLQRATRLCLHRATCLHLQRTTRPRLQRATHPHLQRTTRSRLENYMSFTSEDYTSSP

SEQ ID NO: 94214 - protein, 203 aa, Glycine max
  Coding DNA Sequence Number=SeqID_2529
  Homolog annotation: Hit_ID=A5BKB8; Match level="QueryCoverage=36%, HitCoverage=21%, E-value=4e-34, Identity=94%"; Hit description =Putative uncharacterized protein
MGGGAWPFLVGGAICLVNSVNERDLSLLNSYVEIIAIVGLQRGIPSKRESSARVDYVPALCTHRPSLLPIEWSGESVRIAATRNKVSVGEPAEGSLSMPHNQIDPRTCLFIYRREGGDDHGAPCARPPRPRDKHKPPALRAPRNSNLLSATPGGPETNVAKCDTWCELQNPVNHRVFERKLRPKPLGRGHACLGVTHRFPNAN

SEQ ID NO: 94215 - protein, 90 aa, Glycine max
  Coding DNA Sequence Number=SeqID_2530
  Gene Ontology: Biological process=transposition, DNA-mediated
  Homolog annotation: Hit_ID=Q1J7G7; Match level="QueryCoverage=35%, HitCoverage=45%, E-value=3e-11, Identity=100%"; Hit description =Transposase
VLQWLLFLSAVPPVQLLTGWCVTAKAPPDISAGKCSGHAARNHHTRPRLMRRYRARPIRHSGCATVGKGDRCGPLRYYASWRKGDVLQGD

SEQ ID NO: 94216 - protein, 256 aa, Glycine max
  Coding DNA Sequence Number=SeqID_2531
  Gene Ontology: Mol. function=motor activity; Cellular component=cell projection
  Homolog annotation: Hit_ID=UPI00006A2D9E; Match level="QueryCoverage =78%, HitCoverage=100%, E-value=2e-15, Identity=18%"; Hit description= UPI00006A2D9E related cluster
GPHDLAFRGLLVLTFRGLHALAFRGLHILCIRRLHVLTFRGLHILAFRGLHVLAFGQGLHALAFKGLHVLAFRGLHVLTFRGLHALTFRGLHVLALRGLHALAFRGLHVLLLRGLHVLAFRGLHALTFRGLLVLTFRGLHALAFRGLHVLCFRRLHVLTFRGLHVLSFRGLHVLAFGGLHALAFRGLHVLAVQRTTRPHLQRAARPHLQRTTRPRLERVARPRLQRATCPPPQRTTRPHLQRTTRPYLPKPTRPHL

SEQ ID NO: 94217 - protein, 189 aa, Glycine max
  Coding DNA Sequence Number=SeqID_2532
MKTIRIWGSQVMWLRMPPDSWVTVTKWWGGRQKQGFCSYVSSICDEETQTYVVLDNCETKNSLGVFFTKMRTCFSKETKLPTDQSNICFLDEKQCVYRGRRILDVSISFLNDHLEEALGSTKNRRKSLKVYQSHTWQGLTFSPWVKVYDKLGFWLKACRTAGHDICQGLASGSGIKGMSYIISMIHMQQ

SEQ ID NO: 94218 - protein, 107 aa, Glycine max
  Coding DNA Sequence Number=SeqID_2533
  Gene Ontology: Cellular component=nucleus; Biological process=cell division
  Homolog annotation: Hit_ID=A7NUY9; Match level="QueryCoverage=100%, HitCoverage=17%, E-value=5e-15, Identity=37%"; Hit description =Chromosome chr18 scaffold_1, whole genome shotgun sequence
MEIVNKEKEKVRYDFLADKAIAEIEAKCGQKIEECKEEQRQQLMRIEDEHTLLIKALRCELEDECQKLEEELHLQKSKEDRQRALLQLQLKVMSDKPKEDQEVNSKQ

SEQ ID NO: 94219 - protein, 176 aa, Glycine max
  Coding DNA Sequence Number=SeqID_2534
MEILPLYKRIVGLQGCVYKIDSLYGGSLKLEDRVFPSYLSSLSKRLSNFLAFSLQGVDSLLSWDRLTLRGAYSILRIETFQAIYLLSQRGSLLGSVRNEGSYPYLYYSTSTMNGGDYLYHRVEINYLECSTHSRSLYTLLLPSISFHKIPEGSTHLQNILKVSTFFHKLLENSTLL

SEQ ID NO: 94220 - protein, 18 aa, Glycine max
  Coding DNA Sequence Number=SeqID_2535
MPPFNSTALQVYQTSIFG

SEQ ID NO: 94221 - protein, 118 aa, Glycine max
  Coding DNA Sequence Number=SeqID_2536
  Homolog annotation: Hit_ID=UPI0000ECBAF8; Match level="QueryCoverage =34%, HitCoverage=48%, E-value=1e-16, Identity=100%"; Hit description= UPI0000ECBAF8 related cluster
MAPPDSIPSVEQFNEMDESFEATIPEPFDIGEEAEETQVRQVAAATPAQSLEATSEPSAPVSRPAGMQAWHWPSFYNVVTGKTLALPNLIALQHIPLSPAGVIAKRPAPIALPNSCAA

SEQ ID NO: 94222 - protein, 173 aa, Glycine max
  Coding DNA Sequence Number=SeqID_2537
MPQNVLYDAMGYINGGISSDFSPFSFLSSENLDNSKIRPVVILFHYGESWNLLRADQRLIFAKSWPRASRYQQGHQDLFILRSDLPSQHRRTSALASVAVTLRVTTTPAALNAPLQGASHSPFRLRNCWEGRSVRASSLLRQLAKGGCAARRLSWVTPGFSQSRRCKTTASEL

SEQ ID NO: 94223 - protein, 91 aa, Glycine max
  Coding DNA Sequence Number=SeqID_2538
MERSMIDAASGGALGDMTPTEARNLIEKMASNSQQFSARNDAIILRGVHEQSRINEQPEAYAGNIYNRPPHQQNQQLQNNYDLSSNKYNPG

SEQ ID NO: 94224 - protein, 166 aa, Glycine max
  Coding DNA Sequence Number=SeqID_2539
MGDQEETQEQMKADMSALREQMASMMEAMLGMRQLMEKNMATAAAVSSAAKADPTLLATAHHPPPNTVGRGSSTLGHNSNPHLGYNRVAYPYGLPPNYTPPVMQDDVGHVSSPILEGEPPRQLDEVHEDHQEYAQGDVKFYPPNPRRGAGTQHFASAQPHSTTNIL

SEQ ID NO: 94225 - protein, 76 aa, Glycine max
  Coding DNA Sequence Number=SeqID_2540
MRGLDQGPHKQHFSTWWADLKALNQDHNMTVVSKQFCWKMGRGDQILFWEDAWAEDGIPLKDQFPDLYSKMPQQCL

SEQ ID NO: 94226 - protein, 125 aa, Glycine max
  Coding DNA Sequence Number=SeqID_2541
MTNDGTYEFGDPTVMWLRMPPDSWVTVTKSGVVDKSRAFDPTTSFLNGHLEETLDPTKIGKKSIKVYQSHTGQGLTFSPWVKVHDKLGFWLKACRTVGHDICQGLASGSGIKGTSHIISMIYMQQ

SEQ ID NO: 94227 - protein, 123 aa, Glycine max
  Coding DNA Sequence Number=SeqID_2542
MVSRGIIPFEKHIAVVGTTSNNMLSKRKTLDEGSLLSSESETQHDHRFTSTPYVPMDPVPSGVANCCNLPFGGRATRGSWVCLPREEGVRSRHQRLFEGNVGKTGMCGLQTLIVKGSGVVTGK

SEQ ID NO: 94228 - protein, 88 aa, Glycine max
  Coding DNA Sequence Number=SeqID_2543
MKPLIQFKCVCKEWNSLISEPYFIKLHLSKSAAKDDLEHLQLIKNVCLGSIPEIHMESRDVVAIALTMLSLDVSEKTEMEVYGEGDSS

SEQ ID NO: 94229 - protein, 81 aa, Glycine max
  Coding DNA Sequence Number=SeqID_2544
MHAHRCCPVSRRTREELVNPTPSPSPKVSKGLGAGTRRYGAHDRQVAVLRSAQAVKEALLGGSLVPSKFILVSYSLMYLRS

SEQ ID NO: 94230 - protein, 102 aa, Glycine max
  Coding DNA Sequence Number=SeqID_2545
MTKQQRSTKRDPSYWEYVDALHFVQNSNSSFKRNASSSEQPIQRRTMPMLDQFHPCIHDSIVNIVDVKADSNCGYRAIAAILGMGEDLWSLVHNHLLKELTK

SEQ ID NO: 94231 - protein, 104 aa, Glycine max
  Coding DNA Sequence Number=SeqID_2546
MRSTGRLSKQTNGLHPLPMKVENPDESLETSNNNFQNPQISASPYQLDHAPYASEPYNAQWNAPGLLRDKHTLRSNRILGEIEVDEPWLGLWLPLNYQVDMGAS

SEQ ID NO: 94232 - protein, 173 aa, Glycine max
  Coding DNA Sequence Number=SeqID_2547
  Homolog annotation: Hit_ID=Q2HW90; Match level="QueryCoverage=52%, HitCoverage=18%, E-value=3e-11, Identity=38%"; Hit description =Putative uncharacterized protein
MGKNPNGKRFYQVKIKGLDVTSLKELGQLMGPLQRQAFRKAYGKILDLTTTEVFTEAVVSLAQYYDQPLRCFTFGDFQMVPTVEEFEEILGCPLGGRKPYLFSGCGRRFGERVGSYEANSKRRSGPTAEILGRQGKGYGESRGVGPVCGYTSFANLWGCPLSKRGQFGGPSRN

SEQ ID NO: 94233 - protein, 75 aa, Glycine max
  Coding DNA Sequence Number=SeqID_2548
MALTELACINTATLTGGNKHMDDGWMHGRMRGVDGGHGVSRQWEWRNPCMKNPPVVLADTLKKRPPPKKVCKQTF

SEQ ID NO: 94234 - protein, 65 aa, Glycine max
  Coding DNA Sequence Number=SeqID_2549
MEFVPNQCPLMGSFGNFVERVKRVGTLFVSAIIGNIFSAILTFCFALGTTPALFCVVIVSVLLWT

SEQ ID NO: 94235 - protein, 73 aa, Glycine max
  Coding DNA Sequence Number=SeqID_2550
MKGHTFLTPKVVQGKQMLGARTYEAKSASGELKKAIIMHEYALSIVDHLGFMRYFEFLMTPLPEREDKSGLTP

SEQ ID NO: 94236 - protein, 194 aa, Glycine max
  Coding DNA Sequence Number=SeqID_2551
  Gene Ontology: Mol. function=protein dimerization activity
  Homolog annotation: Hit_ID=A5BU52; Match level="QueryCoverage=89%, HitCoverage=23%, E-value=9e-20, Identity=31%"; Hit description =Putative uncharacterized protein
MHKPYAYIIKAQWDKHLKLKLHATTYWFNHAFRYNEKFNNKRRVIDSVVDLLEKRGLCENLTQVISEMEMYQDRQESFDRPSALPISNTIRPIITFLDDQWWSLFGSSAPILKKLVEEASPELDINDLENALYHENAITLGASNANNEGDKNLDNMDFQVESGDHGGGSIGVESNVIPTLSECDGINLGDYYDL

SEQ ID NO: 94237 - protein, 104 aa, Glycine max
  Coding DNA Sequence Number=SeqID_2552
MKSMWRQEFVIVNDLVLVIGFVHVRLVKQGCGSSLSEFLENCEVESVKESKNGVIWQIVRKIPRTPHKEPPMVNIGLSSFACMLPKILSSLWRDHRNHHLQPIL

SEQ ID NO: 94238 - protein, 332 aa, Glycine max
  Coding DNA Sequence Number=SeqID_2553
  Gene Ontology: Mol. function=helicase activity; Biological process =viral genome replication
  Homolog annotation: Hit_ID=Q2R1R7; Match level="QueryCoverage=53%, HitCoverage=11%, E-value=4e-37, Identity=42%"; Hit description=AT hook motif-containing protein, putative
MALADTTNSQPISQHVSTREWKTINNIFSIHSNLYDDFVAASSASTGHMDNEILDHSFGAQHANNSLHHTNESCLHKNAEDAYDVVPDYENELSDCVDNTVDDISIGYVNLGDPSQICPYCQVAMWYQERTRKNRKQTNPKYSLCCNMGNLQLPFLKNPPMLLQQLLCDDESHKNRNYQQYIRAYNMMFTFHSPGAKIYTSLLKGKGPTIYKIHGQSCHLIGSLLPMAGKPPQFSQLYIYDTKNEIENRIGASRQNLLDLELVSKLKDMLDEYNVFVSQPTLRREYEAKSQRSIFQKEKRVVVSTNVYSRKTFEKQKRQRYANFENEGSGVI

SEQ ID NO: 94239 - protein, 182 aa, Glycine max
  Coding DNA Sequence Number=SeqID_2554
MCVTRATELNDQGEEWMCDSRRGAITGGGKDGVGDDGGGDGFGGGGGCGGVHDGSVPELEDVIVVGDLVVTAVAVDVGTVVLPHADEEVDGGGAGGGGGGCAEGRNGGGDDGCAEGGNDGSGGGSGCTEEEIEFEEHGGVERVKTEVSSMKSGIHGSLGCGEVDHGGLEAVQAGIERFDICH

SEQ ID NO: 94240 - protein, 229 aa, Glycine max
  Coding DNA Sequence Number=SeqID_2555
MVYDFTLFDDVLTGSANPDYLIDVIRELVDVLQWSLDGKPKKVVFTMKDKCVLIKERASDIKQQMIDEEGEFDSKDIPEAIDRILGKKLAFRFKAIPNNTRYSMSQISEDEDLIMLLLKRLPTYELARIELEMSDSSVKHGDDIAYIQSLLAIGDFDHESSKSVTPAKRGFMISESQLESVPFEDLSLIQLSSPLTSKGRTTVLPLNYAVALVGSSYHRSTPQPPPVNK

SEQ ID NO: 94241 - protein, 176 aa, Glycine max
  Coding DNA Sequence Number=SeqID_2556
  Gene Ontology: Mol. function=transferase activity, transferring phosphorus-containing groups; Cellular component=membrane; Biological process=two-component signal transduction system (phosphorelay)
  Homolog annotation: Hit_ID=A0PEY0; Match level="QueryCoverage=75%, HitCoverage=23%, E-value=1e-29, Identity=85%"; Hit description =Cytokinin receptor 1
  Pfam annotation: Domain name=HisKA; Domain location=65-112; Score =6.2; E_value=0.069; Accession=PF00512.16; Description=His Kinase A (phosphoacceptor) domain
MCSINILIGSRYVGGSFDVESLVENLLGQLAGHQAILVNVYDIIKSTDHLIMYGNQNEEGDMSLIHERMLGLLLKIELSSTQRDYAQTAQACGKALIALINEVLDRAKIEAGKLELEAVPFDIHSILDDVLSLFSVKSRNVGLEPLCICKGKAAYNIPPPYLRIAKSLRAMGYEVF

SEQ ID NO: 94242 - protein, 42 aa, Glycine max
  Coding DNA Sequence Number=SeqID_2557
MASLVSVKDSPLRVAICPCKAQITSLRRRQLCFSVARLQELF

SEQ ID NO: 94243 - protein, 165 aa, Glycine max
  Coding DNA Sequence Number=SeqID_2558
  Homolog annotation: Hit_ID=Q39558; Match level="QueryCoverage=21%, HitCoverage=12%, E-value=2e-07, Identity=80%"; Hit description=14-3 -3 protein 32kDa endonuclease
MAKLAEQAKRYEEMVEFMEKVSSFVENEKQTVEERVQPPLRRLQEQGGEPRQQGPHGRNPQTPRHAPRPLHRLQGLLRQDERRLPKVQLWLCTMGLLKVVILEILFRCHHFGNNSKLSKSLEEYAMYGGLGLDKDKKMVVIFDENGVPYVLRRHGDIGPLLRLIL

SEQ ID NO: 94244 - protein, 78 aa, Glycine max
  Coding DNA Sequence Number=SeqID_2559
MTPKMLANHSRNFPVATYANHNGWRWDILRLLLPPTLCDRIAPIPPPKDTVDDVPLWKGLNDGSFSLKGSLHLSHKLV

SEQ ID NO: 94245 - protein, 260 aa, Glycine max
  Coding DNA Sequence Number=SeqID_2560
  Homolog annotation: Hit_ID=A7R2R6; Match level="QueryCoverage=36%, HitCoverage=75%, E-value=2e-12, Identity=50%"; Hit description =Chromosome chr4 scaffold_443, whole genome shotgun sequence
  Pfam annotation: Domain name=IQ; Domain location=61-81; Score=36.6; E_ value=8.9e-08; Accession=PF00612.18; Description=IQ calmodulin -binding motif
MGVPQKWFRNIVRGRFLRSSNKDIVLVLPRTSICTNECEEAMLRNEEFSFPTPISSITKEDASAIKIQAYFRGHLARRAYKALKSLVKLQALVRGHIKDSMQLEGELDSIRIGEQKLYVNLPRFTCNNFNEVEKKGKEIELGTKKKKGKEIDLGTKKKKGKGKHDNFMTIEKVLQSKEKKGRDLEVDRWKWLDLKLERSDEDGLVRESFILKGSEVIKAPSQQMMKRQGCSEGKKVMEIDGESSILGIDSRGEESYYYDE

SEQ ID NO: 94246 - protein, 335 aa, Glycine max
  Coding DNA Sequence Number=SeqID_2561
  Homolog annotation: Hit_ID=A9PAD8; Match level="QueryCoverage=69%, HitCoverage=58%, E-value=4e-22, Identity=34%"; Hit description =Putative uncharacterized protein
MDGKVDWSELPIELWPKIGKYLQNHVDGKVDCVCGSCRSSIPPSLPNSPSFPMQIPHPSNHSIETLLNQATVYVIEPTDANGASNLEPLAISTKWRLIKVEESKNHNHNHNHPLTLLSPISDRKILYPHGSNSPMLWNLLDFRVTELCKSYTPNISSATVSKVVFFPNSPWIGAEDSVACCIFLEGKLGFMKHGDEKWNLVDNENFFYDDVIVFKGQFYVTDKWGTISWIDTSSLKLLFYPGDFVVDSLLAQFLGSATKCLKESDIVRDSANITGSNSNDLNKPFRFKGYHFKRWQQKMMFSLTMRKAAYVLNTDIRVVPEDVEKEVKDKMIVEL

SEQ ID NO: 94247 - protein, 118 aa, Glycine max
  Coding DNA Sequence Number=SeqID_2562
MAYLWKRELYVVFDRTFSFMVFLPFFIFFFTHHVDPIIEQVEFDVEIEPVSMVVQIIGWKLPHPLMPLGSLSQPTLRREGDARLAGCVFHERNTRGVATNVYLRKTSEKPEKTRSTNF

SEQ ID NO: 94248 - protein, 89 aa, Glycine max
  Coding DNA Sequence Number=SeqID_2563
  Gene Ontology: Mol. function=protein kinase activity; Biological process=protein amino acid phosphorylation
  Homolog annotation: Hit_ID=A7P6T4; Match level="QueryCoverage=64%, HitCoverage=11%, E-value=2e-10, Identity=49%"; Hit description =Chromosome chr9 scaffold_7, whole genome shotgun sequence
METQVWKVVYLPLEYAESGKITKKADVYSFGVARPLLEEYAIEELIDLRLGNHYSEHEARPFLPSAITKDVFDLKLHDLARHGSLRPNI

SEQ ID NO: 94249 - protein, 39 aa, Glycine max
  Coding DNA Sequence Number=SeqID_2564
MSNKKCSVTVATEGAVKLCLGDLLVMGSNPETVSLHMQG

SEQ ID NO: 94250 - protein, 59 aa, Glycine max
  Coding DNA Sequence Number=SeqID_2565
MYHERKKHIDVKLHFIRDVIESEKIKVEKCVVVLRVAENREAKIKVAAENREFNRERKS

SEQ ID NO: 94251 - protein, 120 aa, Glycine max
  Coding DNA Sequence Number=SeqID_2566
  Homolog annotation: Hit_ID=A5AQT6; Match level="QueryCoverage=41%, HitCoverage=46%, E-value=3e-12, Identity=74%"; Hit description =Putative uncharacterized protein
  Pfam annotation: Domain name=Auxin_inducible; Domain location=5-75; Score=-17.8; E_value=0.0033; Accession=PF02519.5; Description=Auxin responsive protein
MAIKKSNKLPQADVIKQIVRRCSSFGKKQQGYNEEGGLPEDVPKGHFAVYGYSSKAEEVFKQGCRGVQAWPTILRVPLRPHPIDAPRAETMFLEKKIIGVRKESRVREQDFRNFHVEETG

SEQ ID NO: 94252 - protein, 204 aa, Glycine max
  Coding DNA Sequence Number=SeqID_2567
  Homolog annotation: Hit_ID=A5C169; Match level="QueryCoverage=75%, HitCoverage=13%, E-value=2e-08, Identity=29%"; Hit description =Putative uncharacterized protein
MTGRLLAGSLAFETRILHYLIVRILLPRSSNLAQVSEEDLIVMWAFHKGLQIDWAYLVRYRMHKALQLNAPLPYPHLVTLFLQHFNIPLDSEPYVPIKRSFLIGFAVIGSFGYQKEHDGSWVKNGARPVDEEGHLHGGEDSSLLQKILDRFDGLQTFVGERFDTLELQVDMRFNEMKSRITKVEEDVSHIRTSFDLPPPLPPSS

SEQ ID NO: 94253 - protein, 357 aa, Glycine max
  Coding DNA Sequence Number=SeqID_2568
  Homolog annotation: Hit_ID=Q2R0B2; Match level="QueryCoverage=41%, HitCoverage=62%, E-value=3e-07, Identity=28%"; Hit description =Transposon protein, putative, CACTA, En/Spm sub-class
  Subcellular localization annotation: CTP_CleavageSite=59; ConfidenceScore=5.26e-01
MREHSNVTAFYLHMGTPQGSPPQSDVQPEAMSRKTRQSTRLRSLTLRTLDQPRPTINVDAATGQGLGPIKRNVLESLKDLVWDDILAKFDIPKAPNAKKKVMSIVTTRWRQFKSSFTTKFVCANSEGQHKHDPLVKYGLDPQTWEEFAATHKTLNWQGIRKKMHEIQKYNDCPHLLSRGGYDLFEKKLLYKKIKKREHEAMMTENAPQIEDPLSPIERHVKWKLTHTKRASRASNSSSTSITQQQLVEIIGSLKEEWRNEIKEEVRNEIREENKQSTKGSNVETVVNPSGEEHVAHVILTMGLYMQRQHSTHLVALGKIYEGGFTIHNLVYADDIVRVSVEKIIDGDAEVLLSMLEI

SEQ ID NO: 94254 - protein, 619 aa, Glycine max
  Coding DNA Sequence Number=SeqID_2569
  Gene Ontology: Mol. function=protein binding; Cellular component =integral to membrane; Biological process=regulation of translational fidelity
  Homolog annotation: Hit_ID=A7QE27; Match level="QueryCoverage=96%, HitCoverage=89%, E-value=1e-169, Identity=55%"; Hit description =Chromosome chr4 scaffold_83, whole genome shotgun sequence
  Pfam annotation: Domain name=DUF726; Domain location=313-619; Score =247.9; E_value=2.2e-71; Accession=PF05277.3; Description=Protein of unknown function (DUF726)
  Subcellular localization annotation: CTP_CleavageSite=45; ConfidenceScore=5.08e-01
MAAPPPPPPSTPSFLSPTQRYAAGALFGLALHEAHLNQTNPLPLPASEDSLSEEQRTSSSSGSSSDSVSEDPDLWVHSNSGLLRPVFKFLDIDSAAWSGLEETAGSSSATHHVGPFLRLLSQELDDGSSQRLDQERALSSAVDGIALDMRRNSESSESKREKLREYEHQCREKFSIDDVQPHCEKVDAHLEVQKEMDAAPLLDCKETQQGSVDWKIDERPIEEVRMLSDQRKVTVLYELLSGCLSNLGEDVGRRRKGYDARHRVALRLLATWLDVKWTKMEAIETMVACSAMALIKEKESKNEETQSKESKWAKLKRGGIIGAAALTGGTLLAITGGLAAPAIAAGLGALAPTLGTLIPVIGASGFAAAASAAGTVAGSVAVAASFGAAGAGLTGSKMARRVGGVDEFEFKAIGENHNQGRLGVEILVSGFVFEKEDFIRPWEGQNDNLERYALQWESKNLIAVSTAIQDWLTSRLAMELMKRGAMMTVLSSLLTALAWPAALLAATDFIDSKWTIAINRSNKAGKLLAEVLLRGYQGNRPVTLIGYSLGARVIFKCLQYLAKTENGAELVEKVVLLGAPIPIKDENWEAARKMVAGRFVNAYSRNDWMLGVAFRASKR

SEQ ID NO: 94255 - protein, 352 aa, Glycine max
  Coding DNA Sequence Number=SeqID_2570
  Gene Ontology: Mol. function=potassium ion transmembrane transporter activity; Cellular component=membrane; Biological process=potassium ion transport
  Homolog annotation: Hit_ID=Q8VX37; Match level="QueryCoverage=39%, HitCoverage=16%, E-value=4e-55, Identity=79%"; Hit description =Putative potassium transporter
  Pfam annotation: Domain name=K_trans; Domain location=1-351; Score= -382.6; E_value=2.9e-07; Accession=PF02705.7; Description=K+ potassium transporter
MGTSPLYVFIDVFSKVPMGSNDDILGALSLVMYTIALIPLAKYVFIVLKANDSGEGMFALYSLICRYANVGLLPNLQQADEHISSFKVKLPTPEMERALKIKDTLERTSFLRNLLLELVILGASMVIGDGILTPKYQVDIDFEKEPIGIGKDGNNVYVRDIWPSTQEIVEANNTVYSWDPKSTYIHEPSYFNGMIMDPPGAHGVKDAYCLLNFGVSITTDHISPEISKTMSENDDTLQSLVKMGYKQVEVIALTPQTLLATNRFFLEICQKGFQRGQNLQLHRRRHNLSWKLKKKSSKDMRKKVYVCPEATCDHHDPSRALGDLTGIKKHFFKKHEEKKWKCDKCSKCYVVQ

SEQ ID NO: 94256 - protein, 647 aa, Glycine max
  Coding DNA Sequence Number=SeqID_2571
  Gene Ontology: Mol. function=nucleoside-triphosphatase activity; Cellular component=intrinsic to membrane; Biological process=innate immune response
  Homolog annotation: Hit_ID=Q5JBT4; Match level="QueryCoverage=98%, HitCoverage=92%, E-value=1e-168, Identity=54%"; Hit description =Candidate disease-resistance protein SR1
  Pfam annotation: Domain name=NACHT; Domain location=159-312; Score= -7.5; E_value=0.00023; Accession=PF05729.3; Description=NACHT domain
  Pfam annotation: Domain name=NB-ARC; Domain location=121-411; Score =136.9; E_value=5.9e-38; Accession=PF00931.13; Description=NB-ARC domain
  Pfam annotation: Domain name=TIR; Domain location=14-111; Score=45.3; E_value=2.1e-10; Accession=PF01582.11; Description=TIR domain
  Pfam module annotation: Pfam domain module=NACHT::NB-ARC::TIR; Domain location=159-312::121-411::14-111
MALGSCSSSFNYDVFLSFRGADTRHGFTGNLYKALDDRGIYTFIDDEELQSGEEITPALLKAIQDSRIAITVDPSDVRHQEGSYGEALAKHEERFNHNMEKLEYWKKALHQVANLSGFHFKHGKINHAPLPVADYPVGLESRLLEVTKLLDVESDDGVYMIGIHGIGGIGKTTLAIAVYNLIACHFDGSCFLKDLREKSNKQELQYLQIILLWEILGEKEINLASVEQGASIIQHRLQRKKVLLILDDVDKHEQLQAIVGRPCWFGPGSRVIITTRDKQLLASHGVKRTYEVKLLNESNALQLLTWKSFKTEKVDPSYKEDLNDVVIYASGLPLALEVIGSNLFGKSIEEWKSAIKQYKRIPSIQILEILKVSFDALEEEQKNVFLDIACCFNRYALTEVIDILRAHYGDCMKYHIGVLVEKSLIKKFSWYGRLPRVTMHDLIEDMGKEIVRQVSPKEPEKRSRLWLLEDIIQVLEYNKVPSSIVLMPELTEIFAVGLKGWQWLKQEEGEKTTGSTVSSKELHEAGNTVFCLPRDRIPEWFDQQSSGPSISFWFRNKFPDMVLCLIVAPIQDKFFRPMVFINGNQCSPYSCHFRTGMHHAYLCDLQEIKSRNSPYEMPFENGWNHEYAMEDVRFTDPFIARENQTMI

SEQ ID NO: 94257 - protein, 798 aa, Glycine max
  Coding DNA Sequence Number=SeqID_2572
  Gene Ontology: Mol. function=DNA binding; Cellular component=nucleus; Biological process=regulation of transcription, DNA-dependent
  Homolog annotation: Hit_ID=A7PT68; Match level="QueryCoverage=90%, HitCoverage=95%, E-value=0.0, Identity=59%"; Hit description =Chromosome chr8 scaffold_29, whole genome shotgun sequence
  Pfam annotation: Domain name=Myb_DNA-binding; Domain location=52-97; Score=32.7; E_value=1.4e-06; Accession=PF00249.22; Description=Myb -like DNA-binding domain
MEVEVPISLDLNNQLQPETVVSVQNGDPGVSSSVANAVNPQQPATKKPTRQWAAWTRQEEESFFTALRQVGKNFEKITSRVQSKTKDQVRHYYYRLVRRMNKLLGPGLCLDAKNSKDTNAAMLRWWSLLEKYSCKASKLHLKPRRFKIFLEALEHQLLKDRKKNVRKRPLQGGNCLPAAPTAVSNQSRASGNDARAVKLVLVDNQNILKLGPSKPSTKRTVNMGVNHSNTKGDSNTMKPTRQRKKSGTISTAAYKKWEKAAIAGVSLVADAAEHLERAATVKEIEQDQENPGERCSDPADYVLPSLAKCPQKQFVDNNVNNIMKLKLQLFPIDEPTRRALEMDKHNPHLELTLSTRKKISSILEHLNRKWGNSSIAAGEVMLFPYGIQRENLVNYPRWTQESTLSAADIYAMIGSPPIFRLRYGWFSNTELGLLNMQVPEASGSMLRQYKSSVDNAKDPIVNSVSFPTPLTNTLSMELSEDCRTSMNRNHTLMTASTDLSNARGNNVYLNTSTVESRDPTANTPWHGKDVRDGAVTTQLEDMDELKLSSGAGLSAGEWADSLTNISVGDLLSGVSQDLDNCINPPIAESCYDVQQIPFSSDSFDAAIAAHISRHQDRMGRSSLASHMSSIWDAEETCDAFLFKKDPILQEYRPCLSPVASLESEKKVTKRSFDKLDELSPERERLVDDCAQTDPMPMDSSESDADVQEHLGKDFSALADMYWPDSLGPLDLEIPSSTKYHSEDLIFSDSLSGLNRLIASSLDAFQNCSFFGFDKKEAPSTVEARESATLSDFKIGSGI

SEQ ID NO: 94258 - protein, 106 aa, Glycine max
  Coding DNA Sequence Number=SeqID_2573
  Gene Ontology: Mol. function=intramolecular transferase activity, phosphotransferases; Biological process=metabolic process
  Homolog annotation: Hit_ID=A9NVC7; Match level="QueryCoverage=70%, HitCoverage=22%, E-value=7e-19, Identity=65%"; Hit description =Putative uncharacterized protein
MAAEVYYQAIASQTSVADPVLSSSRSNAGDTYKKSTLILIGHGESLWNEKNLFTGCVDVLLSKKGIDEAIEAGKRISSIPSEAGVYAYTRILFVWKAAMALADLYQ

SEQ ID NO: 94259 - protein, 88 aa, Glycine max
  Coding DNA Sequence Number=SeqID_2574
MEDSPPFLTNEEVDALCKDLANMNIQPLSNDIGPLNLDDVDVDEAQDNPIENMNLNESNVKHEVTMGDSFGFFNEGIPKNDNDLVYVP

SEQ ID NO: 94260 - protein, 396 aa, Glycine max
  Coding DNA Sequence Number=SeqID_2575
  Gene Ontology: Mol. function=structural constituent of ribosome; Cellular component=ribonucleoprotein complex; Biological process =translation
  Homolog annotation: Hit_ID=P49204; Match level="QueryCoverage=65%, HitCoverage=99%, E-value=1e-129, Identity=85%"; Hit description=40S ribosomal protein S4-2
  Pfam annotation: Domain name=KOW; Domain location=309-343; Score =38.4; E_value=2.6e-08; Accession=PF00467.20; Description=KOW motif
  Pfam annotation: Domain name=RS4NT; Domain location=135-172; Score =84.2; E_value=4.3e-22; Accession=PF08071.3; Description=RS4NT (NUC023) domain
  Pfam annotation: Domain name=Ribosomal_S4e; Domain location=226-302; Score=151.1; E_value=3e-42; Accession=PF00900.11; Description =Ribosomal family S4e
  Pfam annotation: Domain name=S4; Domain location=174-222; Score=26.9; E_value=7.7e-05; Accession=PF01479.16; Description=S4 domain
  Pfam module annotation: Pfam domain module=KOW::RS4NT::Ribosomal _S4e::S4; Domain location=309-343::135-172::226-302::174-222
  Subcellular localization annotation: CTP_CleavageSite=63; ConfidenceScore=5.03e-01
GVGGLSGGGLNVVDIGEDARWTMITTKNAMVTTPLRSSSKPQNNRLSTMNTLADGVQTWVCVVVGTVDGNCCMGVHRCVSLWVVVRHCGWEICQRKEVVEVWEMKNFSCRSFESVGDEEKSRTYLLGIKSQFWARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSVRDDEAKFKLCKVRSVQFGQKGIPYLNTYDGRTIRYPDPLIRANDTIKLDLEENKIVDFIKFDVGNVVMVTGGRNRGRVGVIKNREKHKGSFETIHVQDATGHEFATRMGNVFTIGKGTKPWISLPKGKGIKLSIIEEARKRIAAQQATAA

SEQ ID NO: 94261 - protein, 492 aa, Glycine max
  Coding DNA Sequence Number=SeqID_2576
  Gene Ontology: Mol. function=molecular_function; Cellular component =anchored to membrane; Biological process=defense response
  Homolog annotation: Hit_ID=A5BG47; Match level="QueryCoverage=55%, HitCoverage=93%, E-value=2e-98, Identity=64%"; Hit description =Putative uncharacterized protein
  Pfam annotation: Domain name=Thaumatin; Domain location=227-441; Score=284.1; E_value=2.7e-82; Accession=PF00314.8; Description =Thaumatin family
  Subcellular localization annotation: CTP_CleavageSite=53; ConfidenceScore=5.85e-01
MARASASSSPTTAARISSSTSPPSDPTATAPSSRATALSSPSPPETTTRPRPSTSLASTAPLSSPAPLPPTTAPEDPASAPGAMVAAAPRATSVVISATSQGIATGAAIPAAVEAAVAVVVSIAAADLALGVADLDTWRGIVPPGRVTLAVGAAVAVVFGVGRLVIWLGIAAWKEGDMAMVVTVVAAAVEKARALTVGSQGILQGNVLKLQGEVKKGSNSATFSIVNKCSYPVWPGILSGAGTAQLATTGFALQPGQSNAVAVPTAWSGRLWGRTLCSTDSAGKFSCVTGDCGSSAVECGGGGAVPPATLAEFTLNGAGGLDFYDVSVVDGYNLPMLVEARGGGNCTATGCAADLNGGCPAELKVKTVASGEGVACKSACEAFGDPRYCCSGRYATPETCKASSYSQLFKSACPRAYSYAYDDATSTYTCASADYRITFCPSTSKSSIKSGSGKFPVAVDISVGHAYADKSANVMLVAISAVLLTILWQQLN

SEQ ID NO: 94262 - protein, 214 aa, Glycine max
  Coding DNA Sequence Number=SeqID_2577
  Homolog annotation: Hit_ID=Q53M85; Match level="QueryCoverage=68%, HitCoverage=17%, E-value=1e-07, Identity=30%"; Hit description =Transposon protein, putative, CACTA, En/Spm sub-class
MTQVSPLAVEKQMAIEASKISVFLMEEPPDDNKVAQCMEIAEGSITMCLHLQTAKAKFDIPEGLTAKKKVMSTAGTRWRQFKSSLTTRYVYAENDDEQNKDPSAKYGIDRNTWEEFAKTRQTPTWKGIRKKAQEIQKFNESPHVLSRGGYNVLEKKLMAEKTKSRLNEGDNSQNADMVVDPPSPIARHEKWKKARTNKFGQMTSAAAQEIADKI

SEQ ID NO: 94263 - protein, 343 aa, Glycine max
  Coding DNA Sequence Number=SeqID_2578
  Gene Ontology: Mol. function=serine-type peptidase activity; Cellular component=cytoplasmic vesicle; Biological process=proteolysis
  Homolog annotation: Hit_ID=A9PHA7; Match level="QueryCoverage=92%, HitCoverage=67%, E-value=1e-135, Identity=71%"; Hit description =Putative uncharacterized protein
  Pfam annotation: Domain name=Peptidase_S28; Domain location=53-343; Score=42.8; E_value=1.4e-12; Accession=PF05577.3; Description=Serine carboxypeptidase S28
MKQEEWMITTALLSLLFVSSFPPLSYGVVPPRTLLNKLSEGKYLNTQELWFDQTLDHFSPYDHRQFRQRYYEFLDYFRIPDGPIFLVIGGEGILNGVANDYLAVLAKKFGAAMVTLEHRYYGKSTPFNSLETENLKYLSSKQALSDLADSINAKLNRTKIENPWFIFGGSYSGALSAWFRLKFPHLTCGSLASSAVVLAVYNYTEFDQQIGESAGPECKEALQETTQLIEHKLATSGKELKASFDAADLEIDGDFFYFLADATAIAFQYGNPDKVCKPLVEAKKAGEDLVDAYAKYVKEYYIGTFGTDVQTYDQKYLKRTAMNEDNSARLWWFQVCTEVAYFQ

SEQ ID NO: 94264 - protein, 214 aa, Glycine max
  Coding DNA Sequence Number=SeqID_2579
  Homolog annotation: Hit_ID=A7PYF0; Match level="QueryCoverage=26%, HitCoverage=14%, E-value=7e-14, Identity=67%"; Hit description =Chromosome chr15 scaffold_37, whole genome shotgun sequence
MSFSIITSRVPKTCERSLSSHLSVGTMIFAQGNHDHHYHHQPQLPGSIDTSRQQFTSDHFELFSVKQESASFTLLPLRSHDSSEVQCVILLVALDVVKSAGGGFFRRFAKTPAFFEDIGGSSVLFLPCSLYNWTLPEGACLFHGMPLDVKIYTTHQLEFLEVVDLIFTLFDEDMTKSKGKDPLEGLGGPMTRARARKAKEALQQVQSILFEYKP

SEQ ID NO: 94265 - protein, 49 aa, Glycine max
  Coding DNA Sequence Number=SeqID_2580
MEEEEDDEGRGSSDDEEEEGGEEEESDNSSGSSGKKCHPNVILACFLGF

SEQ ID NO: 94266 - protein, 275 aa, Glycine max
  Coding DNA Sequence Number=SeqID_2581
  Gene Ontology: Mol. function=protein binding; Cellular component =protein complex; Biological process=chromosome segregation
  Homolog annotation: Hit_ID=A7QDW0; Match level="QueryCoverage=95%, HitCoverage=60%, E-value=2e-67, Identity=56%"; Hit description =Chromosome chr4 scaffold_83, whole genome shotgun sequence
  Pfam annotation: Domain name=UIM; Domain location=161-178; Score =18.4; E_value=0.026; Accession=PF02809.11; Description=Ubiquitin interaction motif
  Pfam annotation: Domain name=UIM; Domain location=193-210; Score =19.1; E_value=0.017; Accession=PF02809.11; Description=Ubiquitin interaction motif
  Pfam annotation: Domain name=UIM; Domain location=91-108; Score=14.8; E_value=0.33; Accession=PF02809.11; Description=Ubiquitin interaction motif
  Pfam module annotation: Pfam domain module=UIM::UIM::UIM; Domain location=161-178::193-210::91-108
MLEMIGRKLKKNSVALDVVNFGEEDEGKTEKLEALLSAVNNNDTSHIVHVPSGPNALSDVLISTPIFTGDGEGGSGFAAGSVSGFEFGVDPNLDPELALALRVSMEEERARQEAAAKKAAEDAAKQEKDGEQQASPQDTTMTKGVSAAASEAETKRTDLTVNENALLQQALAMSMDDPTINHDMRDTDMSEAAAEDPELALALQLSVEDSSKDSASQSDVSKLLADQSFVSSILASLPGVDPNDPSVKDLLASLQNQSEPQQKNEDKPPNEEEKK

SEQ ID NO: 94267 - protein, 16 aa, Glycine max
  Coding DNA Sequence Number=SeqID_2582
MTEFYPQTDLYSEVQT

SEQ ID NO: 94268 - protein, 92 aa, Glycine max
  Coding DNA Sequence Number=SeqID_2583
MVQVDDRLRRVCKYRRWSGVAKMASGQGKYRRSPYVVTRGPQVYPSNLANKVKGMEFYSEVKQPVKYNPRFQQILVEIKEDNKGMEFYIGSR

SEQ ID NO: 94269 - protein, 213 aa, Glycine max
  Coding DNA Sequence Number=SeqID_2584
MRRALTHQVAHQLSESGSNRKRLPNSTHDNQHIFSRFRPSSSLRGLRYGWTFIGGVEGRKVIWWSMAHYGGRLGRGYEAQHVKRGSRLGEKVEELGDSRLEEVVGAAAINEDSEAFMADNTEEAKGLNDGRPESAWRLICSKGPSHGGGPFHLGFFGRIKAWVLGLGECGGSTVKAGLCRFVMIHILQEKVLRLILSPTLEKVLQCAKVSKVY

SEQ ID NO: 94270 - protein, 573 aa, Glycine max
  Coding DNA Sequence Number=SeqID_2585
  Gene Ontology: Mol. function=nucleoside-triphosphatase activity; Cellular component=integral to membrane; Biological process=transport
  Homolog annotation: Hit_ID=A7P5L5; Match level="QueryCoverage=96%, HitCoverage=81%, E-value=1e-128, Identity=60%"; Hit description =Chromosome chr4 scaffold_6, whole genome shotgun sequence
  Pfam annotation: Domain name=ABC2_membrane; Domain location=345-540; Score=161.3; E_value=2.5e-45; Accession=PF01061.15; Description=ABC -2 type transporter
  Pfam annotation: Domain name=ABC_tran; Domain location=199-383; Score= 32.9; E_value=1.5e-09; Accession=PF00005.18; Description=ABC transporter
  Pfam annotation: Domain name=PDR_assoc; Domain location=43-89; Score =58.2; E_value=2.7e-14; Accession=PF08370.2; Description=Plant PDR ABC transporter associated
  Pfam module annotation: Pfam domain module=ABC2_membrane::ABC _tran::PDR_assoc; Domain location=345-540::199-383::43-89
MNLYHDISVPENVHKWFVWGYWSSPLMYGQSAIAVNEFLGHSWRKVTHNSNETLGVLILKTRGFFPEAYWYWIGLGALIAFRKDQAGLSQEKLIERNASTAEELIQLPNGKISSDESLSSKTKIVEEANLSSRSFSGRVSDDKANRSGRKGMVLPFQPLSLTFDEIKYFVDMPQEMKKQGVFEERLELLKGVSGVFRPGVLTALMDVSGASKTTLMDVLAGSKTGGYIEGGITISGCPKRQETFARISGYCEQFDIHSPNVTVYESLLYSAWLRLPREVDHATRKMFIEEVIELIELTSIREALVGLPGENGLSTEQRKRLTIAVELVANPSIIFMDEPTSGLDARAAAIVMRTVRNTSYTTVRLLFTMLIALLFGIIFWDINWPEKEKRARSFQCYGFNPIIAVERTVFYRERAAAMYSALPYALAQVIIELPHILVQILMYGIIVYAMMGFDWTTSKFLWYLFFMYFTFLYFTFYGMMTLAIAPNAHVAAILSSAFYAMWSLFSGFIIPLSRIPIWWKWYYWICPVAWTLNGLVASQYGDNRDKLENGQRVEEFVKNYFGLNMLVVLFHSI

SEQ ID NO: 94271 - protein, 89 aa, Glycine max
  Coding DNA Sequence Number=SeqID_2586
MAGLNNFRGSASRLAKETLQSNSLSMMEFHLTSYSLKDPTIEYGSNNRDEWVDFLRGDFLACSRLSIDAYFLQSMMVLDPTTYFHSGPA

SEQ ID NO: 94272 - protein, 167 aa, Glycine max
  Coding DNA Sequence Number=SeqID_2587
  Homolog annotation: Hit_ID=A5BU47; Match level="QueryCoverage=59%, HitCoverage=5%, E-value=1e-11, Identity=39%"; Hit description =Putative uncharacterized protein
  Subcellular localization annotation: CTP_CleavageSite=46; ConfidenceScore=5.70e-01
MTTPPRSPPPPDSPSATTKRKTRQTTRLRRLTARSLYQARPTVHVNTSTGRGSGPHKEKFHSYLGVVAREKIPIVHATWKDVPDTLKVIVWDDILAKFDIPEGLTAKKKVMSTVATRWRQFKSSLTSRYVYNDKDDQQNIDPSAKYGFDRETWEAFSKTRQTPTWKV

SEQ ID NO: 94273 - protein, 86 aa, Glycine max
  Coding DNA Sequence Number=SeqID_2588
  Gene Ontology: Mol. function=receptor activity
  Homolog annotation: Hit_ID=A5C4V3; Match level="QueryCoverage=88%, HitCoverage=5%, E-value=3e-18, Identity=55%"; Hit description =Putative uncharacterized protein
  Pfam annotation: Domain name=LRRNT_2; Domain location=24-66; Score =40.5; E_value=6.2e-09; Accession=PF08263.3; Description=Leucine rich repeat N-terminal domain
MQRWKAGSILGFNSLPNSAEIKCIESERQALLNFTHGLIDGYGILSTWRDHDTNRDCCKWKGIQCNNQTGHVEMLHLRGQDTQYLS

SEQ ID NO: 94274 - protein, 49 aa, Glycine max
  Coding DNA Sequence Number=SeqID_2589
MYAYGECGNWEVLLIAPRQKDTVCVDFLTPPTPVQSLNCKGNSPINYAK

SEQ ID NO: 94275 - protein, 1256 aa, Glycine max
  Coding DNA Sequence Number=SeqID_2590
  Gene Ontology: Mol. function=transferase activity, transferring phosphorus-containing groups; Cellular component=membrane; Biological process=two-component signal transduction system (phosphorelay)
  Homolog annotation: Hit_ID=A7QDV4; Match level="QueryCoverage=98%, HitCoverage=98%, E-value=0.0, Identity=63%"; Hit description =Chromosome chr4 scaffold_83, whole genome shotgun sequence
  Pfam annotation: Domain name=Cache_1; Domain location=304-383; Score=- 2.2; E_value=0.026; Accession=PF02743.9; Description=Cache domain
  Pfam annotation: Domain name=HATPase_c; Domain location=631-782; Score=119.9; E_value=7.8e-33; Accession=PF02518.17; Description =Histidine kinase-, DNA gyrase B-, and HSP90-like ATPase
  Pfam annotation: Domain name=HisKA; Domain location=518-584; Score =79.6; E_value=1e-20; Accession=PF00512.16; Description=His Kinase A (phosphoacceptor) domain
  Pfam annotation: Domain name=Response_reg; Domain location=1105-1249; Score=99.1; E_value=1.3e-26; Accession=PF00072.15; Description =Response regulator receiver domain
  Pfam module annotation: Pfam domain module=Cache_1::HATPase _c::HisKA::Response_reg; Domain location=304-383::631-782::518 -584::1105-1249
MKTKTKVLLKVLYGLSRFKVANEYQRSTTPTGRRIFHRDVEKEEFQYASTQCLSSYYSVFVVRLAIMAMLAILIGLLTFLTWHFTKIYTTKSLNSLAYDLRYELLQRPILRMWNILNSTAEITTAQVKLSQYVIRSHTNLATQADQVEVELTDNFFYAILMFDSICNLKFEYCSNSYQMYDAMRAVTWALFVSKKALNSITVKYKNGFVQAFHRDLKDNNTFYIYSDLANYSMAASGYNAINSHSSREAWNDKDIHGHKAAVWYREPLDPVSGEKIGKVMPIAPEDSINIAGLSQVPDGVASWHVAVSKFTDSPLLSAALPVWDSSNKSIVAVVGVTTALYSVGQLMKELVEKHSGHMYLTSQEGYLLATSTNAPLLSNTTKPPKLKMAVDCENEVIREGAQWLQKTYGNNFPQSHELHVENVRLGRQQYYIDSFFLNLKRLPLVGVIIIPRKHIMGQADERAFKTLVILISASLCIIVIGCVCILILTNGVSKEMKLRAELISHLEARRKAEASSNYKSQFLANMSHELRTPMAAVIGLLDILISDDRLTNEQCATVTQIRKCSTALLRLLNNILDLSKVESGKLVLEDAEFDLGRELEGLVDMFSVQCINHNVETVLDLSDDMPKLVRGDSARVVQIFANLINNSIKFTLSGHIILRGWCENPNSCSDNTNFPLEKKKSRCSQKTRAKQHENHAKRTSNRDNKIILWFEVDDTGCGIDPSKWESVFESFEQADPSTTRLHGGTGLGLCIVRTLVNKMGGEIKVVKKEGPGTLMRLCLRLSAPVDATEQHCQVDFANKGLVVLLALHGNMGRSATSKWLQKNGVVTMEAAEWNGLTQILRVLFHARSSSHNNGFDANYSVHDNLKSRLLSIQELRNPVFAIAVDIGLLDLSTDIWKEQINFLHKYYGRAKFVWMLNHDSSNSIKMELRRKGHTLTVNKPLYKTKMIHILEAIIKERNEELQKKNMTTPRATVKEGDLHESLEIDYTQCDVASSDGSDISEKGGSNPVSACGDKQREKVARSDPSSQHQINNLVGLTMEDNNHRKEELCQSSLNSNDVSANATPKSSSTKQSSTGAQDEDSEYGETRRASSSSRAVIGKKSLEGLRILLAEDTPVIQRVATIMLEKMGAVVVAVGDGQQAVDALNGMPGVEDCIRESLLKERNTRSSQTEILGCPPYDLILMDCQMPKMDGYEATKAIRKSEVGTDLHIPIVALTAHAMSCDEAKCLEVGMDAYLTKPIDFKLMESTILSLTRRTS

SEQ ID NO: 94276 - protein, 288 aa, Glycine max
  Coding DNA Sequence Number=SeqID_2591
  Homolog annotation: Hit_ID=Q94II1; Match level="QueryCoverage=69%, HitCoverage=45%, E-value=2e-65, Identity=63%"; Hit description=ERD7 protein
  Pfam annotation: Domain name=Senescence; Domain location=5-287; Score= 212.0; E_value=1.4e-60; Accession=PF06911.3; Description=Senescence -associated protein
MTLDDKIFFYIHQEVSTYYNISISEESSDSDSSSSDEEGGKAKRQNKKKKKKDSNSNFGASVLSHGLTIASKGQEDLLKELDKVLQECSAFSVQKVSEKAKKEGDVVDASVALAISPVDLEKEEKKEMMEEKCAAYWTTLAPNMEDYSGTATKLIAASSGQLVKGILWCGDVTVEQLRWGNEVMKRRMTLGSQGEISPKTLKRIKRVKKVTKMTESVANGVLTGVVKVSGFFTSSVANSKAGKKFFSLLPGEVVLASLDGFSTGIAIPPGGINFSVHTWTIPPLELTG

SEQ ID NO: 94277 - protein, 162 aa, Glycine max
  Coding DNA Sequence Number=SeqID_2592
MKNIDAAWGVAWESGNDRIYHHTRSQHSINGARHDPKTSRQQAHCLAGAVLRAPLCPHPINAPRAQWVFLEVEDLQCEGKSREFENEISGTLNTQTASTTGEFGDSEGTTACNGDIAMHRELPVQQWCNSGAVVQNGGDGSTVESPVRTASCIEKEPPAWLA

SEQ ID NO: 94278 - protein, 125 aa, Glycine max
  Coding DNA Sequence Number=SeqID_2593
  Subcellular localization annotation: CTP_CleavageSite=81; ConfidenceScore=5.22e-01
MSFYDTARVPHPKLATVLRYTQESCARNPSYCSSLLKVVLYSLKSPLNSSLSWTLTPSLGAFVFILQPSKCTVPLCLQSLRSSSREVFRQRGEEMVEGEWVQAFECIALKTTYLKFGGMANTSYF

SEQ ID NO: 94279 - protein, 54 aa, Glycine max
  Coding DNA Sequence Number=SeqID_2594
MRPNIGDGPFIHTMGMVEKEAMGKVGRPTMVVVTMSVILNAGLVAKLRNVFDIL

SEQ ID NO: 94280 - protein, 317 aa, Glycine max
  Coding DNA Sequence Number=SeqID_2595
  Gene Ontology: Mol. function=hydrolase activity, acting on ester bonds; Cellular component=cellulose and pectin-containing cell wall; Biological process=lipid metabolic process
  Homolog annotation: Hit_ID=A7NSR4; Match level="QueryCoverage=95%, HitCoverage=91%, E-value=1e-91, Identity=50%"; Hit description =Chromosome chr18 scaffold_1, whole genome shotgun sequence
  Pfam annotation: Domain name=Lipase_GDSL; Domain location=20-308; Score=167.0; E_value=5.1e-47; Accession=PF00657.13; Description=GDSL- like LipaseAcylhydrolase
MTSYASTSQTKYRNFTFPALIAFGDSVLDTGNNNYIETIVKANFKPYGRDFIGGQATGRFSNGRIPSDFLAEILGIKETLPPYLDPNLKVEDLLTGSVLSVEDQLNMFKGYIGKLKAAVGEARTALILAKSIFIISMGSNDIAGTYFMTSFRREYNIQEYTSMLVNISSNFLQELYKFGARKIGVVSLSPIGCVPLQRTIGGGKERDCVESINQAATVYNSKLSSSIMALNKKLSEARLVYLENYSEFNKLIQHHKQFGFEVEDSACCGPGPVCNSLSFKICEDATKYVFWDSVHPTERTYNILVSDIVKKNIHKFV

SEQ ID NO: 94281 - protein, 90 aa, Glycine max
  Coding DNA Sequence Number=SeqID_2596
  Subcellular localization annotation: CTP_CleavageSite=36; ConfidenceScore=5.02e-01
MKRIMMGLPCSLHAMKMMVPVSSPMRHSVIRVGQMLCKEEGPPFSKTMFEDNTFATIVGDMEGGKGKGFWVWFEIYQGKRRGMGTRGMKG

SEQ ID NO: 94282 - protein, 982 aa, Glycine max
  Coding DNA Sequence Number=SeqID_2597
  Gene Ontology: Mol. function=microtubule motor activity; Cellular component=microtubule associated complex; Biological process =microtubule-based movement
  Homolog annotation: Hit_ID=A7QE14; Match level="QueryCoverage=96%, HitCoverage=99%, E-value=0.0, Identity=53%"; Hit description =Chromosome chr4 scaffold_83, whole genome shotgun sequence
  Pfam annotation: Domain name=Kinesin; Domain location=25-364; Score =427.7; E_value=1.6e-125; Accession=PF00225.14; Description=Kinesin motor domain
MGSIAEEEAMPNLVGSEERILVSVRVRPLNEKELIRNDLSEWECINDTTIMYRSNLSATERSLYPTAYTFDRVFRTDSPTKQVYEEAAKEVALSVLSGINSSIFAYGQTSSGKTYTMSGITDFAIADIFNYIEKHTEREFVLKFSALEIYNESVRDLLSVDSTPLRLLDDPEKGTVVERLTEETLRDWSHFQELISFCEAQRQIGETALNEVSSRSHQILRLGRELYSTSSLRFLNNVILLQTIESSAREFLGNDKMSSLSASVNFVDLAGSERSSQTNSAGTRLKEGCHINRSLLTLGTVIRKLSKGRNGHIPFRDSKLTRILQSSLAGNAKTAIICTMSPARSHVEQTRNTLLFASCAKEVTTNAKVNVVVSDKLLVKQLQKELARLESELKNSGPTRLKFDSAALLKEKDLQIERLKKEVMDVSMQRDLAQSQIKDMLQVVGDDASSTELDSLGHQYPKLRVRSSFDFENQTAERPNLSNFDCIESVRSFDASQYSDGHSISSDDNYFQLPDLQKNLPVRISSPAISIVSGDAAKNDLDQKNVEDSLGDRCREVRCIESDDLTTNTHTHSTASSPAVSGLTEVDNRDKENLDLCSSGLKDNKEINGLQERFVLPSPEKISPCPTQSSASSSKTMKLTRSRSCKASLMRDPFSDWFDQEEMIQNTPPIGRPGGLQRKTYTLNYNPNAERLSWAGYENSLGRASDAQNMKSSTYNGSYKDNSLAPVRKEKNDLESSNMQANLEVQETGMESDVTTKKFKDVGLDPLQSEEEKQLEWPSEFKRLQKEIIELWHACNVSLVHRTYFFLLFKGDPSDSIYMEVELRRLFYLKQTFDQGNQTVEDGLTPESSKRYLRGERQMLSKQMQKKLSKSERENLYNNWGIRLSSKNRRLHLAHRLWSESDDLEHIRESATIVAKLVGSVEPDQAFKEMFGLNFAPRRTRKKSFGWTASLSRMCNPKVTDFFCTMCLTKNNCTYCAQKNAQ

SEQ ID NO: 94283 - protein, 90 aa, Glycine max
  Coding DNA Sequence Number=SeqID_2598
MQGIRRMDAALDAMRPLGFRTQLILRTVNELLDVGWREKKLVNTKGMLRAAGMSSGKSSVTSFQGSPVPAGLMEGGLIDVQQFSLKALLL

SEQ ID NO: 94284 - protein, 235 aa, Glycine max
  Coding DNA Sequence Number=SeqID_2599
MSGDKPRKALKFNTQGYVRVEVALEVGGTTLQREASFLGTCFDDGQGGFSSMALEAAAYCLKCIACRGDGELAVEIGGDGATHSLMRTVVATNGGVEIIVGLLSSCTDDTRRYLLYIVDTDSRFLMSLAFLMSPDGRILIFPKGLPKGSTFESFLWWGCPNCKSLCVAESKWNSERVLKVRAVTGGEGSEAMVLNEVYAFPNIFHVFVVGADVAASWGRESFVVQVVSAVAAGGG

SEQ ID NO: 94285 - protein, 218 aa, Glycine max
  Coding DNA Sequence Number=SeqID_2600
  Homolog annotation: Hit_ID=A7R115; Match level="QueryCoverage=61%, HitCoverage=63%, E-value=1e-50, Identity=73%"; Hit description =Chromosome chr4 scaffold_333, whole genome shotgun sequence
  Subcellular localization annotation: CTP_CleavageSite=76; ConfidenceScore=5.94e-01
MAFAHYLLAVPVEPSPNFPTNPPKPNPSLSSSSSSSISSHCFNLSSSLRPKHSLFSRFRRICHKAKAKPQEPEVTVASDAFTQFKHLLLPITDRNPYLSEGTRQAIATTSALAKKYGADITVVVIDAQQKESLPEHETQLSSIRWHLSEGGLKDYNLLERLGDGNKPTAIIGDVADDLNLDLLFNPHTSYILATRKLRFVKIDPLSRSILIGFEKTSE

SEQ ID NO: 94286 - protein, 715 aa, Glycine max
  Coding DNA Sequence Number=SeqID_2601
  Gene Ontology: Mol. function=RNA binding; Cellular component=nucleus; Biological process=regulation of transcription, DNA-dependent
  Homolog annotation: Hit_ID=A7R112; Match level="QueryCoverage=95%, HitCoverage=94%, E-value=1e-121, Identity=47%"; Hit description =Chromosome chr4 scaffold_333, whole genome shotgun sequence
  Pfam annotation: Domain name=NUC153; Domain location=585-613; Score =23.4; E_value=0.00055; Accession=PF08159.3; Description=NUC153 domain
MGSKNANGKNHKDKRKKFKDNLNSNHSSTGDAKVIIISDPRYSKAHTDPRFREAPKRETKVAIDSRFNRMFTHKSFLPSSALIDKRGKPKNNPTSQLGSLRHYYKVDEKEVEQSSDEEEDNEEELVKANRMKPESDKGTELEETSESESEETSESESDVDTDTDEGADEEVYEEEASDVHEDIATIDKETHRVAVVNMDWRYVKAVDLYVLLSSFVPPNGLIKSVTVYPSEFGLQRMKEEEVHGPIGLFDDEDEKNDEDSSNDDIDNEKLRAYEKSRMRYYFAVVECDSSATANYIYKECDGLELKQSSNALDLRFIPDNMEFKHPPRDVATEVPANYECKDFYSRALQHSEVNLTWDDDEPLRAKTLKQKFTDDQLAQMEVKEFLTSDESESDDSKDNNETDDQPDKRAKKRAKYRALLQAGDDSDGGNEHDNVQNMEVTFNTGLEDLSKHIMEKKDKKSETVWDAHLRKKCEKKKTRKNKRKYSSDDDDSDDTDQEATEEADDFFIEEPAVKKRKKLENKDEEPKEMNGLDEASKEELELLLADDKGTDTGLKGYNLKFKKGKGKRTENSIDEEKIPSNAYDDPRFSALFSPDYAIDPTNPQFKRSATYARQLAQKQQKDNADPPAEREPTKVKGMQLSFDDSGMMKKGEEERLDALKSTKDKYELSSLVKSIKMKSKQVQLPSDDKTMKDGKSHIKETQQGKKDLSRIMKEV

SEQ ID NO: 94287 - protein, 150 aa, Glycine max
  Coding DNA Sequence Number=SeqID_2602
MHTRISAHRRNLSKHGPNNRSKRVHTEAKAEAKAELSVAAHLVQSQGTQNRSLPVSSATMNFTPGGVSVGEGEAVVDLGELAAAEEAVAVGEFGVVLDGALLRRGGDSGGGGVGPLPDRLRVAVVHREGTPKKKLSIEVGKKHGSRSGGA

SEQ ID NO: 94288 - protein, 1062 aa, Glycine max
  Coding DNA Sequence Number=SeqID_2603
  Gene Ontology: Mol. function=nucleic acid binding; Cellular component= cytoplasm; Biological process=multicellular organismal development
  Homolog annotation: Hit_ID=A7QK09; Match level="QueryCoverage=82%, HitCoverage=80%, E-value=0.0, Identity=90%"; Hit description =Chromosome undetermined scaffold_109, whole genome shotgun sequence
  Pfam annotation: Domain name=DUF1785; Domain location=348-400; Score =114.9; E_value=2.4e-31; Accession=PF08699.1; Description=Domain of unknown function (DUF1785)
  Pfam annotation: Domain name=PAZ; Domain location=401-538; Score =187.9; E_value=2.6e-53; Accession=PF02170.13; Description=PAZ domain
  Pfam annotation: Domain name=Piwi; Domain location=689-1010; Score =541.0; E_value=1.3e-159; Accession=PF02171.8; Description=Piwi domain
  Pfam module annotation: Pfam domain module=DUF1785::PAZ::Piwi; Domain location=348-400::401-538::689-1010
MCPMRAVFVMVRKRRTELPSGGESSEAQHPSERSAPPPQQQAAAAAPGGAGPQGGRGWGPQGGRGGGRSRGMPQQQYGAPPDYQGRGRGGPSQQGGRGGYGSGRSGGGGGGMGSGRGVGPSYGGPSRPPAPELHQATSVQSYQTGVSSQPASSEASSSLPPEPIDLEQSMGQMVLHSEPAPTPPPASKSSMRFPLRPGKGSYGTKCVVKANHFFAELPNKDLHQYDVTITPEVISRGVNRAVMEQLVRLYRESHLGKRLPAYDGRKSLYTAGPLPFMSKEFRIVLVDDDEGAGGQRRDREFKVVIKLAARADLHHLGLFLQGRQTDAPQEALQVLDIVLRELPTTRYCPVGRSFYSPDLGRRQPLGEGLESWRGFYQSIRPTQMGLSLNIDMSSTAFIEPLPVIDFVTQLLNRDVSARPLSDADRVKIKKALRGIKVEVTHRGNMRRKYRISGLTSQATRELTFPVDERGTMKSVVEYFYETYGFVIQHTQWPCLQVGNAQRPNYLPMEVCKIVEGQRYSKRLNERQITNLLRVTCQRPGERERDIMQTVHHNAYHEDPYAKEFGIKISEKLAQVEARILPAPWLKYHDTGREKDCLPQVGQWNMMNKKMVNGGTVNNWFCINFSRNVQDSVARGFCYELAQMCYISGMAFTPEPVVPPVSARPDQVEKVLKTRYHDAKNKLQGRELDLLIVILPDNNGSLYGDLKRICETDLGLVSQCCLTKHVFKMSKQYLANVALKINVKVGGRNTVLVDALSRRIPLVSDRPTIIFGADVTHPHPGEDSSPSIAAVVASQDYPEITKYAGLVCAQVHRQELIQDLFKQWQDPVRGTVTGGMIKELLISFRRATGQKPQRIIFYRDGVSEGQFYQVLLFELDAIRKACASLEPNYQPPVTFVVVQKRHHTRLFASNHHDKSSVDKSGNILPGTVVDSKICHPTEFDFYLCSHAGIQGTSRPAHYHVLWDENNFTADALQTLTNNLCYTYARCTRSVSIVPPAYYAHLAAFRARFYMEPETSDSGSMTSGAVAGRGMGGVGRSTRVPGANAAVRPLPALKENVKRVMFYC

SEQ ID NO: 94289 - protein, 547 aa, Glycine max
  Coding DNA Sequence Number=SeqID_2604
  Gene Ontology: Mol. function=DNA binding; Cellular component=nucleus; Biological process=response to ethylene stimulus
  Homolog annotation: Hit_ID=Q0PJB9; Match level="QueryCoverage=59%, HitCoverage=88%, E-value=1e-118, Identity=72%"; Hit description=MYB transcription factor MYB131
  Pfam annotation: Domain name=Myb_DNA-binding; Domain location=126 -171; Score=57.7; E_value=3.9e-14; Accession=PF00249.22; Description =Myb-like DNA-binding domain
MEMQGTYEAWLHDLVIGYLLKEQWIHDMDMTLINDQIESTRSTIFGSASNIHSNGEKQSENVAHIPSVGNNQTPKVALLHKLKYSFPFHGEIWLKNYLYVALLFLIPETSFNSHQVRKPYTITKQREKWTEEEHQKFLEALKLYGRGWRQIEEHIGTKNAVQIRSHAQKFFSKVVRESEGSAESSIQPINIPPPRPKRKPLHPYPRKSVNSFKGHCIPNETEISPSTNLLVAEKDTPSPTSVLSTVGSEAFGSQFSEQTNRCLSPNSCTTDIHSVSLSPAEKENDCMTSKASEEEEKASPASLPLSTVSNPNMCMKPEFSSKDTFIEDAANMPQTTSIKLFGRTVSMVGNQKSLNIDDDDGKPITVKSDEVDDVENEKLGQSGESKQVDTQLSLGVVSGNWIITPDADGANTTSIEPPKENLCFSECAPDASFPQWSLYQGLPPFYLRPCNQVLNPLPLRPSLKVRTREEESCCTGSNTESVCDMENQGKNSDAVDSKCQKYHKEGAAPQKRARGFVPYKRCLSERDGNSLIVDMEEREGQRARVCS

SEQ ID NO: 94290 - protein, 69 aa, Glycine max
  Coding DNA Sequence Number=SeqID_2605
MKKERKTKAPPRAAAKRRCTGDSKTGSSFKAQLGHTPPWCDHHRLLYSAASLEICHNSLSHPPKSCRYL

SEQ ID NO: 94291 - protein, 293 aa, Glycine max
  Coding DNA Sequence Number=SeqID_2606
  Gene Ontology: Mol. function=oxidoreductase activity, acting on NADH or NADPH, quinone or similar compound as acceptor; Cellular component=photosystem II; Biological process=mitochondrial electron transport, NADH to ubiquinone
  Homolog annotation: Hit_ID=P12201; Match level="QueryCoverage=48%, HitCoverage=89%, E-value=1e-76, Identity=91%"; Hit description =NAD(P)H-quinone oxidoreductase chain J, chloroplast (EC 1.6.5.-) (NAD(P)H dehydrogenase, chain J)
  Pfam annotation: Domain name=Complex1_30kDa; Domain location=221-289; Score=127.6; E_value=3.5e-35; Accession=PF00329.10; Description =Respiratory-chain NADH dehydrogenase,
  Pfam annotation: Domain name=Oxidored_q6; Domain location=1-70; Score= 78.1; E_value=2.9e-20; Accession=PF01058.13; Description=NADH ubiquinone oxidoreductase, 20 Kd sub
  Pfam module annotation: Pfam domain module=Complex1_30kDa::Oxidored _q6; Domain location=221-289::1-70
MAPSLVRLYEQMPEPKYVIAMGACTITGGMFSTDSYSTVRGVDKLIPVDVYLPGCPPKPEAIIDAITKLRKKISREIYENQMSSQRENRCFTTNHKFHIGYSTHTGNYGQELFYQLPSTSEIPSDTFFFKEKQKNARSFVFLASQTWTECDRSLGFDYQGIETLQIKPEDWHSIAVILYVYGYNYLRSQCAYDVAPGGLLASVYHLTRLEYGIDQPEEVCIKIFVARKNPRIPSIFWVWKSADFQEKESYDMLGISYDNHPRLRRILMPESWIGWPLRKDYIAPNFYEIQDAH

SEQ ID NO: 94292 - protein, 153 aa, Glycine max
  Coding DNA Sequence Number=SeqID_2607
  Homolog annotation: Hit_ID=Q6UUU1; Match level="QueryCoverage=73%, HitCoverage=95%, E-value=5e-30, Identity=56%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPRALSVPAFRLPVSFRCYGRVCLIPRLTLSS

SEQ ID NO: 94293 - protein, 53 aa, Glycine max
  Coding DNA Sequence Number=SeqID_2608
MYSIIGAYVIPILVPKFQLKITVKTSAKARGNWKEDWCHPLKNLSQEERGQPP

SEQ ID NO: 94294 - protein, 199 aa, Glycine max
  Coding DNA Sequence Number=SeqID_2609
  Homolog annotation: Hit_ID=A7UQU7; Match level="QueryCoverage=46%, HitCoverage=15%, E-value=1e-14, Identity=48%"; Hit description=IMP dehydrogenase/GMP reductase, putative
DYDEASPRACKWIATKKTVKSIRTLSYREHLDRLRIPDVCWIPYGEHREFRDFHVRSCYSGLLRWGPIVVYYRPERVLRQFGYTQTIPAPPIDSWVSYDDIHDRWMHYEDHIIPAGEAPQTNIPRVPEPGASSTFAEEPRHAVEVCDDIAKRLECHLSLGVVTPGSSTHEVIEECLRLARSVTQDHLVYVRCRRRRRTD

SEQ ID NO: 94295 - protein, 132 aa, Glycine max
  Coding DNA Sequence Number=SeqID_2610
MGTIKYLTMDELKRLSIPLEMLRFFNHSIFPHQGHPTRDIQQGQCTPHEHTKHPTYETWAPSSTMTMDELKCLSIPSEMLKFFNHSISPNRDIRQGQCTPHEHTQHAHVNAFPTSSTFHFYIILNINIISSQ

SEQ ID NO: 94296 - protein, 51 aa, Glycine max
  Coding DNA Sequence Number=SeqID_2611
  Homolog annotation: Hit_ID=A5BMX7; Match level="QueryCoverage=82%, HitCoverage=5%, E-value=4e-09, Identity=54%"; Hit description =Putative uncharacterized protein
MKDSLKQSWYIDSGCSKHMVGDASKFIHISPKNSGHVSYGDNNKGGEIEKR

SEQ ID NO: 94297 - protein, 67 aa, Glycine max
  Coding DNA Sequence Number=SeqID_2612
MTIEFLEILRGSISGYSICDVLKSDIRVKGERPKWRRAKAQVEKDKAPEWRWMKAQVEKDEGPSGEG

SEQ ID NO: 94298 - protein, 112 aa, Glycine max
  Coding DNA Sequence Number=SeqID_2613
MTRGGNSGSLNHNIGFMTVFEGWFFHIGCIATTGVECVGFYSGSKAENGVEWVGFYIGYQSTDVENERFLHHLSSNRCSMRRFSTSFITKTDVEWIRMERFLHRSSINRCRI

SEQ ID NO: 94299 - protein, 95 aa, Glycine max
  Coding DNA Sequence Number=SeqID_2614
  Subcellular localization annotation: CTP_CleavageSite=51; ConfidenceScore=5.61e-01
MDESSRKRKGSSTFAMTTRTPRPGATGASLAPIPPSLSSSTLFSSDEQRIRCINESANARGEAVCVLGALPVPRSLTRCARSFGCGERYQLTQRR

SEQ ID NO: 94300 - protein, 111 aa, Glycine max
  Coding DNA Sequence Number=SeqID_2615
MKSVTKTAEGKPPQHGPQWIEAKSHVQTGNYECGYYVMQWIWCIVSGGLKDDWIHGGADKDYKEVPPPPLFKLAGGHINQAVTFNRSYYKVQIIGQLCTYYNLNSHPQGLG

SEQ ID NO: 94301 - protein, 169 aa, Glycine max
  Coding DNA Sequence Number=SeqID_2616
  Gene Ontology: Mol. function=phosphotransferase activity, alcohol group as acceptor; Biological process=phosphoinositide-mediated signaling
  Homolog annotation: Hit_ID=A0ST23; Match level="QueryCoverage=27%, HitCoverage=93%, E-value=4e-20, Identity=100%"; Hit description =Putative reverse transcriptase
DAGSRQARQGASAGVGGCRGWLNYAASEQIVLRVHHMRAIGAGLFAITPAGERGMCCKAIKLGNARVFPGMYRVLNIPEDEAVLLNSREKAPYLICVEEASSSQKLSQGGIPLANGDALMQKRLTHINCVALTARFPVGKPVVPAALMNRPTRGERRFAYWALFRFLAH

SEQ ID NO: 94302 - protein, 379 aa, Glycine max
  Coding DNA Sequence Number=SeqID_2617
  Gene Ontology: Mol. function=acyl-[acyl-carrier-protein]-phospholipid O-acyltransferase activity; Cellular component=integral to membrane; Biological process=metabolic process
  Homolog annotation: Hit_ID=A4WE11; Match level="QueryCoverage=93%, HitCoverage=54%, E-value=1e-178, Identity=82%"; Hit description =Bifunctional protein aas [Includes: 2-acylglycerophosphoethanolamine acyltransferase (EC ...
  Homolog annotation: Hit description=2.3.1.40) (Acyl-[acyl-carrier -protein]-- phospholipid O-acyltransferase) (2-acyl-GPE acyltransferase); Acyl- [acyl-carrier-protein] synthetase (EC 6.2.1.20) (Long-chain-fatty- ...
  Homolog annotation: Hit description=acid--[acyl-carrier-protein] ligase) (Acyl-ACP synthetase)]
  Pfam annotation: Domain name=AMP-binding; Domain location=86-379; Score=-26.1; E_value=3e-06; Accession=PF00501.19; Description=AMP -binding enzyme
MTARDLSRRSQKRPWCHCVSKARERSHFSRLKGLVKQRLFPKITLHILPPTSLPMPDAPRARDRRKIAGEMLHQIMMEARMAVRPREEATLFVGRILEKYSKKGEKIGLMLPNAGISAAVIFGAVSRGRIPAMMNYTAGVKGLTSAITAAQINTVFTSRQFLDKGKLWHLPEQLTQVRWVFLEDLKADVTTGDKLWIFAHLLMPHLAQVKQQPEDDAIILFTSGSEGNPKGVVHSHKSILANVEQIKSIADFTASDRFMSALPLFHSFGLTVGLFTPLLTGAEVFLYPSPLHYRIVPELVYDRNCTVLFGTSTFLGNYARFANPYDFYRVRYVVAGAEKLQESTRQIWQDKFGLRILEGYGVTECAPVVSINVPMAAKP

SEQ ID NO: 94303 - protein, 101 aa, Glycine max
  Coding DNA Sequence Number=SeqID_2618
  Homolog annotation: Hit_ID=Q2HW90; Match level="QueryCoverage=72%, HitCoverage=14%, E-value=1e-07, Identity=41%"; Hit description =Putative uncharacterized protein
MGTNQNGKRFYQVKIKGLDVTSLKELGWLMGPLQRQAFRKVYGKILDLTTAEIFTKAVVCLAQYYDQPLRCFTFGDFQIVPTVEEFEEYQDIFEWSYQDMP

SEQ ID NO: 94304 - protein, 371 aa, Glycine max
  Coding DNA Sequence Number=SeqID_2619
  Homolog annotation: Hit_ID=Q6WAY6; Match level="QueryCoverage=98%, HitCoverage=64%, E-value=6e-41, Identity=31%"; Hit description =Putative uncharacterized protein
MPSLKKKFYQVKVKSLRITSLKELGQLMGQLQWQAFRKAYGKIWDLAMVEVSTEAIASLAQYYDQPLRCFTFGDFQLSPMVEEFEEILGCPLGGRRPYLFSGFYPSLARIYKIVQISAQELDHRKQVENGVVGIPRKYLEEKARILAGKGEWAPFIDILALLIFGGVLFLNVDGLVDLAAIDAFLVYHDHKESPVVAMLANLYDTFDRSSLCLVGFAPFSSRIKACLPARSHCSCTDKGGANWDQLLANKEGASINWFPRRKEGRIRVLISCGGFPNVPLMGTRGCISYNLVLAIRQLGYPMRGPPLEEEIAPVISRGFNKTNVETLQKVRKAWEVVRKKDKELRGSNNGLIGGYRKWLRAHMQGWIGSQV

SEQ ID NO: 94305 - protein, 108 aa, Glycine max
  Coding DNA Sequence Number=SeqID_2620
MYICLMLSPGLLNPDVSCMFSLILIKHHRQMSLVGLNLTRSALRHNITKLAPVFLLSLRVKGDALSEFTLAQRLCTTNPSSRFFCVLSRRMVRLADDSPSAWPGSASS

SEQ ID NO: 94306 - protein, 40 aa, Glycine max
  Coding DNA Sequence Number=SeqID_2621
MHIVVVKHGQDHLELPSGVHRDGCKWGWGHDRPIVAPSLC

SEQ ID NO: 94307 - protein, 103 aa, Glycine max
  Coding DNA Sequence Number=SeqID_2622
  Gene Ontology: Mol. function=protein dimerization activity
  Homolog annotation: Hit_ID=A5ASU7; Match level="QueryCoverage=77%, HitCoverage=16%, E-value=9e-14, Identity=47%"; Hit description =Putative uncharacterized protein
MAQRKTHSPMFQDVKEIGVCLSKLEHKRLHDLVFVKYNQQLKQRYNARDEIDPISLNDIDVCNERIVGEMDQDDDNDAGNDLVFEDDDALNWATVYQASGVGV

SEQ ID NO: 94308 - protein, 92 aa, Glycine max
  Coding DNA Sequence Number=SeqID_2623
GQGQGRGKYAIIAKTQRNRGAMGDKWEGLSKELIQGRLIWLEAYKNKMPKSSPNMHVKQEVSTRVKPRLLCKQSMGQNTPNKIDDDGSNSHQ

SEQ ID NO: 94309 - protein, 97 aa, Glycine max
  Coding DNA Sequence Number=SeqID_2624
MIMRGQDNYSSQEEATSSPSSSGSEGEAKGDEHIEEAYPYEDGDLLMVRRILGSQSCALTQTQRENIFHTRCKHKVGIQVESHSYFPPKALQASMAQ

SEQ ID NO: 94310 - protein, 148 aa, Glycine max
  Coding DNA Sequence Number=SeqID_2625
VSVKPLHPSLILRLAAKVLHDLGMPTRRKEVVFVFWVIPLHGKSSEGGQDLDARIGPREWTSFIDVLALLVLGVVLFPDMDALVDLAAIDAFLAYHHTKENPSVPYKVTACAPGKGKQIRSSSWLEESIMPFIAQGFSDPNARMLQRV

SEQ ID NO: 94311 - protein, 141 aa, Glycine max
  Coding DNA Sequence Number=SeqID_2626
MEKRCAESPPTFICGKRRKNRRKPVIKNIPSSGVVFTFEEEENLHGFAYANISEVLRKHLGLDFLHGNNFFHPKQLKYISRGIWDPQNSPLQPIYRKKGEEVAAQLAQASWVASSRSNPASKILWKPNFKISKLLFASPHF

SEQ ID NO: 94312 - protein, 103 aa, Glycine max
  Coding DNA Sequence Number=SeqID_2627
  Homolog annotation: Hit_ID=A5YPB7; Match level="QueryCoverage=54%, HitCoverage=31%, E-value=2e-07, Identity=41%"; Hit description =Putative gag protein
MSGGGEHQLDSAQRFLLDAPNAQMQRLLRENNEELRGGNGGGPRPNRIEEVKLNIPPFKGKSDQKAYLEWELKIEHIFSCNTYEEAQKLKLAAAKFLNYAHVW

SEQ ID NO: 94313 - protein, 37 aa, Glycine max
  Coding DNA Sequence Number=SeqID_2628
MNKKMDWIRREKVASLWRAEWKGFGSKFECVGWRMMV

SEQ ID NO: 94314 - protein, 67 aa, Glycine max
  Coding DNA Sequence Number=SeqID_2629
  Gene Ontology: Mol. function=cysteine-type endopeptidase activity; Biological process=regulation of catalytic activity
  Homolog annotation: Hit_ID=Q2HV09; Match level="QueryCoverage=59%, HitCoverage=14%, E-value=4e-10, Identity=61%"; Hit description =Peptidase C1A, papain; Somatotropin hormone; Peptidase C1, propeptide
MELNHTFQSQEVPLNDGEDYWDGYFKIRRGKNECGIEEDVTAGWPSTKNLVIEVFFTSIKPYYVVVV

SEQ ID NO: 94315 - protein, 86 aa, Glycine max
  Coding DNA Sequence Number=SeqID_2630
MGAKYLEVVKRGSHPNNGWSPDKIRAQNDHNLSLRVFGHDRAWVARRRMTIICLCVPPDTIASGWRKGVGNDHNMSPPTSRLTVPE

SEQ ID NO: 94316 - protein, 119 aa, Glycine max
  Coding DNA Sequence Number=SeqID_2631
MMAHLNPPYLAFCTPGQNEIKKKIQGYQRETNQNIHIFLNEHQGMKACSELQNKERETRLKRAIKGINLRKHQQESSQGYCASNQWGKTHQMIMMMDGSNSHKGKLITFKLSFQNYHDM

SEQ ID NO: 94317 - protein, 104 aa, Glycine max
  Coding DNA Sequence Number=SeqID_2632
  Subcellular localization annotation: CTP_CleavageSite=25; ConfidenceScore=5.42e-01
MVKHLHKIKWPNSLKKQSPVESPTVATYPSAGGRRVTRGMRVPRKEYARSRHQRLFEENVGKTGKDEIYELFSERFGSCIYARGRVFPFAPTYSSIWDEKIRPT

SEQ ID NO: 94318 - protein, 184 aa, Glycine max
  Coding DNA Sequence Number=SeqID_2633
MILMSQSSQSNVVEQFLQNAQVGCYCLTVGTVDEIIIDAPWSYDSCPNCKTTFDPSKGGSACRSCHTSVVDTVPRLAMIIFCTDYLFTRFAVLANFPEISMDVKDATCIKLFGKTVGECRDELIAAGDDIKVFPTCVDEILLKTWAVRFKFRSQLRQSSVLDVSEELHHIQSLITTLGLKVITK

SEQ ID NO: 94319 - protein, 154 aa, Glycine max
  Coding DNA Sequence Number=SeqID_2634
MATAEALERETKKARKEEHESSRVKGMILKDELKAYLRSKRNLSQQLSETEGNMWAVIDECKEKLNLAATHEQRLEDEYAKISAESEARERVIDSWHQEATMWTDRFALTLNRSQELPRLLANAKAMADTYSAPKKITDFSAMSTYDRLNGPYD

SEQ ID NO: 94320 - protein, 88 aa, Glycine max
  Coding DNA Sequence Number=SeqID_2635
MRQGQADILIARFPDPNYGVKTGSSWCGFSMENNDGLWWLMVDVGDTKFREDPTVNEGWAAFLPRQLHVAFSRSFLVASLRSFLKRLL

SEQ ID NO: 94321 - protein, 97 aa, Glycine max
  Coding DNA Sequence Number=SeqID_2636
MRTTKDDDKSDEHKAQRSKNNSSESKNISSESRTSQEFKNQEEFKTQEESLESRIKIQDSRFKISRIKIQDSRSQESRFKIQDLKNQDQDSRLKIQE

SEQ ID NO: 94322 - protein, 76 aa, Glycine max
  Coding DNA Sequence Number=SeqID_2637
IDSCLLKSIPYTKNALRNGFLNPVPIANSFELLIIRFGVVHCSSFDQKSGPVPVSTDEVSLVGQALHTFLAWTTHL

SEQ ID NO: 94323 - protein, 89 aa, Glycine max
  Coding DNA Sequence Number=SeqID_2638
MEPIASLSQYYDQPLRCFTFEDFQLVPTVKEFEEILGCPLGGRKPYLFSGFYPSTTRVAKVVKISAQELNQVGPSIRYKVTARASKKER

SEQ ID NO: 94324 - protein, 112 aa, Glycine max
  Coding DNA Sequence Number=SeqID_2639
MEAKKEQMATMMEAMMSMKKIMEANAVAVAATSVVAKEMIWGVQAAPYDVQIQNEHAFLPYGLPPNYTPPNVAYTPDEDVNNSAPILIESQQPHHAHVSQPMGETHEISHHI

SEQ ID NO: 94325 - protein, 70 aa, Glycine max
  Coding DNA Sequence Number=SeqID_2640
  Homolog annotation: Hit_ID=A5BTR2; Match level="QueryCoverage=72%, HitCoverage=3%, E-value=2e-12, Identity=62%"; Hit description =Putative uncharacterized protein
MDGHRLCYKKRPIACNHLWNVIFIKTKILLKAIDDQFITSDKALASTLITKFSSLRLTSVKGVREYIMQM

SEQ ID NO: 94326 - protein, 86 aa, Glycine max
  Coding DNA Sequence Number=SeqID_2641
MRQTKFHITTNNCEDDVETKTDMETLTQEELKALMSLLKSTALNRVDKVQTVHTVNNVAFVLRLALGRNKVVWIVILEPQMISVAP

SEQ ID NO: 94327 - protein, 92 aa, Glycine max
  Coding DNA Sequence Number=SeqID_2642
MTEKEMITIIVDILPVFYYEKMVAYAPSSFADLVFAGERIKVAITPARVPQPPFFQEYDSNATCAHHGGVSGHSNEHCMTLKRKVQSVIDAG

SEQ ID NO: 94328 - protein, 45 aa, Glycine max
  Coding DNA Sequence Number=SeqID_2643
MKKQQWKRRCSGRQRRRGERRPHPLGNKPWKKELHHQDGPWIRSL

SEQ ID NO: 94329 - protein, 46 aa, Glycine max
  Coding DNA Sequence Number=SeqID_2644
MEDEEDEDVGLPLELEKIVTHEDQEMGPHQEETKIVDLGTSKGKKE

SEQ ID NO: 94330 - protein, 125 aa, Glycine max
  Coding DNA Sequence Number=SeqID_2645
  Homolog annotation: Hit_ID=Q2HW90; Match level="QueryCoverage=84%, HitCoverage=21%, E-value=7e-11, Identity=38%"; Hit description =Putative uncharacterized protein
MGTNQIGKRFYQVKIKGLDVTSLKELGRLMGPLQMQAFRKVYGKILDLTIAEISMEAVVSLTQYYDRPLRCFTFGDFQLVPTVEKFEEILGCPLGGRKPYLFSGFLPSLSKIAVVVKDSARELDR

SEQ ID NO: 94331 - protein, 75 aa, Glycine max
  Coding DNA Sequence Number=SeqID_2646
MNVEERSRIFTGGACHPARPGEQGGFLQKQQPSGGRIWKAQFSKKLQKFTNCTKTPLFDFRHITEFHRSRKPASF

SEQ ID NO: 94332 - protein, 114 aa, Glycine max
  Coding DNA Sequence Number=SeqID_2647
MEGSESECSEAKASSWTRKVKLSSFNRSIEGGTNLKETKSDEAKLAREIKIEKVMEEEVDPSIKREKHKENRVTNVGCEDEFLDNPITGLIKKEVEAGDTTEPHSFQVSIKRLL

SEQ ID NO: 94333 - protein, 30 aa, Glycine max
  Coding DNA Sequence Number=SeqID_2648
MDKSLKVGEDEWREGERGEQNFKREKRQNE

SEQ ID NO: 94334 - protein, 101 aa, Glycine max
  Coding DNA Sequence Number=SeqID_2649
  Subcellular localization annotation: CTP_CleavageSite=28; ConfidenceScore=5.05e-01
MINQMFITDSRKIVTVATYPSAGGRRVTCGMRVPRKEYARSRHQRLFEENVGKTGKDAIYELLSERFGSCIYARGRVFPFAPTYSSICDEEIRPTQFFLIK

SEQ ID NO: 94335 - protein, 44 aa, Glycine max
  Coding DNA Sequence Number=SeqID_2650
MEKVEGLRILKIRVWESFTHGEEERVVKVLDLETIVSSLKGENR

SEQ ID NO: 94336 - protein, 73 aa, Glycine max
  Coding DNA Sequence Number=SeqID_2651
MYLIDFRIVIIKKGEIVEAMSSKIILMMPKNQELSKFQRIRSQKASRIKFQRFKFKNNEVSRFNQVSRIKIQE

SEQ ID NO: 94337 - protein, 186 aa, Glycine max
  Coding DNA Sequence Number=SeqID_2652
  Homolog annotation: Hit_ID=A5C6C9; Match level="QueryCoverage=85%, HitCoverage=13%, E-value=7e-11, Identity=30%"; Hit description =Serine/threonine protein phosphatase
ALRDLSQTGRYAWGVATLVHMYNQLNDASISSNRQLGSFITLLQCWIYEHFPSVAESTADQDYDEDSPRACRWIATKKTVKSIRTPVYNERLDQLWILNVCWIPPFLLSLSINGCHMMIYTTGGCTTRIISFQQVRCALCQVSVPVTTWTAPIRPLSPTTDILHVPEPGAPSTSARPVVEEPRHAV

SEQ ID NO: 94338 - protein, 58 aa, Glycine max
  Coding DNA Sequence Number=SeqID_2653
MKLAKYRLKAQVEKDEGSSGEGQSPRVEKDDVNLGRSGSLDTGYRVWMTPLPMKEDKS

SEQ ID NO: 94339 - protein, 70 aa, Glycine max
  Coding DNA Sequence Number=SeqID_2654
MASSSSCSSNIKIKSDPIDGGDVLWMQAKHVSAHVWNGEEDKKLHIRRVVPTYQGEEEIPEEIIPLLRQS

SEQ ID NO: 94340 - protein, 85 aa, Glycine max
  Coding DNA Sequence Number=SeqID_2655
MVWQSPNQKSIFSKLEFDSLVTIFIKVQSFQSKGEFVPHLNNIVKPLHDRLKKNPPPWSDLHTQTVKEGDPVQKEKRFHWLYQSQ

SEQ ID NO: 94341 - protein, 116 aa, Glycine max
  Coding DNA Sequence Number=SeqID_2656
MLVATPRVFFSWNTHLRVTRRPPAEGKERALRLHYRMRARARVMSEEEDKVQEQIKADIEALKEKMATMMEAMMSMKKIMEVNAVAVAATSVVAKVDLAPLFGLNQINHPISDMIG

SEQ ID NO: 94342 - protein, 55 aa, Glycine max
  Coding DNA Sequence Number=SeqID_2657
MESYILCWFFLVGLGSSSSMDSFASWKMNGSGMEKEEREEMPLQGEYESRRSSPP

SEQ ID NO: 94343 - protein, 54 aa, Glycine max
  Coding DNA Sequence Number=SeqID_2658
MVETSQINTKRGVKDKLLRWLAPLLDSNSSRDGTNPPSNSLYGNPQTRKQRDKQ

SEQ ID NO: 94344 - protein, 76 aa, Glycine max
  Coding DNA Sequence Number=SeqID_2659
MTVRPFKDNGLMRDKYYDEIHCGKSDELNYFEEGEALTDSLESRPWGYIHLEQMVSWMTIENLILEDDVILCSDRM

SEQ ID NO: 94345 - protein, 139 aa, Glycine max
  Coding DNA Sequence Number=SeqID_2660
MECGHGMYYTPTTFSEYPSQMYQYPFAGHHTDISETSHSFGSVAETQPHFSWPTMTPSQQHDAPMATPNTSFAPQWNVPGAIPDMGDLLGVDLRQEFSAEGEQAEAGRQRGDRRNFNRQARRWDQPCGTSSRHHGHHND

SEQ ID NO: 94346 - protein, 189 aa, Glycine max
  Coding DNA Sequence Number=SeqID_2661
  Homolog annotation: Hit_ID=A5AZG1; Match level="QueryCoverage=50%, HitCoverage=30%, E-value=6e-08, Identity=34%"; Hit description =Putative uncharacterized protein
  Pfam annotation: Domain name=zf-CCHC; Domain location=102-119; Score =14.6; E_value=0.0095; Accession=PF00098.14; Description=Zinc knuckle
MSHLRTHSHRREKERNPQEANINLLYFHGKDNVEANLDWEIKVEQQLKRKSTSKSYGSHSYPMKDQGQGILVVTPSKPKDDKGKTIEKQPLKASMQEKTSSMKCFKCLGRAHITSQCPTKKTMIMRGQDIYSSQDEATTSPSSSESEEAKWEESSEEIYPQEEGQPLMVKEECKEGNPVCRKVHRIVKY

SEQ ID NO: 94347 - protein, 52 aa, Glycine max
  Coding DNA Sequence Number=SeqID_2662
MAQPTPLERTLREMAAPDFTYESLCIQYPDEDVPYVLKTSRSTCCPSFMVLQ

SEQ ID NO: 94348 - protein, 57 aa, Glycine max
  Coding DNA Sequence Number=SeqID_2663
MWYHIIGTPVRVTVFYENAPPYGINIGLKEHSNRVIPKAYTPKSPSRPLPRPTQKIF

SEQ ID NO: 94349 - protein, 129 aa, Glycine max
  Coding DNA Sequence Number=SeqID_2664
MEHASRVTRVALPPKGRFRQQPSSVLRCNGGPSDVGEWLRARKDNGGRTSLISARGNGGKFGLGYKPTQADIRKSVAGRKSGGQGSQLGQEVEGGPSCHISRSFISAGLGHEGQVIAICKDYSPSGLDL

SEQ ID NO: 94350 - protein, 84 aa, Glycine max
  Coding DNA Sequence Number=SeqID_2665
MAGWNDHAIANALQALAQAIGNPNRGEAGGAVEYQGLDRFQRNNPPSFNGGYNPDVEDAEYWWENTYQCLEAKCQDVTWDVFKR

SEQ ID NO: 94351 - protein, 79 aa, Glycine max
  Coding DNA Sequence Number=SeqID_2666
KLQQDGNCHYKVYKKDMLKWSPDKSGLEKAFVNTVDRVGSTSTIPPTGKTTTATILQISGALSREKKELQIRKQDVNCV

SEQ ID NO: 94352 - protein, 281 aa, Glycine max
  Coding DNA Sequence Number=SeqID_2667
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
LELYVPINVSFRQKLAQGFPVSTGTQDLFILRSDLPSQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSILVKLTSGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGRRFPGRCQRYLQG

SEQ ID NO: 94353 - protein, 255 aa, Glycine max
  Coding DNA Sequence Number=SeqID_2668
  Homolog annotation: Hit_ID=Q6WAY6; Match level="QueryCoverage=33%, HitCoverage=15%, E-value=3e-07, Identity=34%"; Hit description =Putative uncharacterized protein
MEGRKRRSPFLMWEDTQTFRWLGTRGCINYNPALAIRQLGYPMRGAPTEESMSPFLVRDLGAQNSKTIQRIHKAWETPLRKDQELRGIRNGIIGGYHEWLKVRIRGLDWLAKLKVVSEENFEAPEEDEEVQALKSELGKAKLAKEKFKLAATHVRKECAGLREENAITAKALEQETKRARKEEYGRHKFRGALWGSNNELKLRREERDQSRAHSMVLKEELIACSRSKRSLSQRLCETETNMLAIIAKYQEDAWV

SEQ ID NO: 94354 - protein, 128 aa, Glycine max
  Coding DNA Sequence Number=SeqID_2669
  Gene Ontology: Mol. function=nucleic acid binding
  Homolog annotation: Hit_ID=Q9FNZ1; Match level="QueryCoverage=97%, HitCoverage=30%, E-value=1e-22, Identity=45%"; Hit description=Zfwd2 protein
MTLNDHTDVVTSLICWDQYLLSSSSDRTIKVWACIEAGSLEVIYTHTEENKDVALIELCPGGLFFTGDESGLLMVWKWLESVFKFFLSLSKKDVALIELGPGGLFFTGDESGLLMVWKWLEVPKVASS

SEQ ID NO: 94355 - protein, 88 aa, Glycine max
  Coding DNA Sequence Number=SeqID_2670
MHAQGIVPKIHMSIFKQGNGGNVACPIISEHNLGLRPSLTTPQFNKNKQQFKDKSLTFLSKYMQLRAPKYINGKLESPRMRYLLVGDE

SEQ ID NO: 94356 - protein, 18 aa, Glycine max
  Coding DNA Sequence Number=SeqID_2671
LGFAQGILLDYYSELRVY

SEQ ID NO: 94357 - protein, 232 aa, Glycine max
  Coding DNA Sequence Number=SeqID_2672
MASITEAMLKLQKTIEDNAMATASNTAREAEPVLQPAINLGRDRNTTVFGRRYSHHAYPYGLPLDFTSRTASDDLSQAPTFEGQLPPYADYPLQENDEEDAHLGPLLPLKDPAPHELPQPNIVRHVPSPPAPVKESVPFAKDKGKIDLLEERPRAVEGLATTRSRIWRISVWDDMSKRSSSDVLPKDGGIFYGRKAVGAFLSRQLSRSSNGMVYQSGSFSDPVMERLGNYFY

SEQ ID NO: 94358 - protein, 58 aa, Glycine max
  Coding DNA Sequence Number=SeqID_2673
MAEEFVNDFVHQNGIAVITHNPPKAIPAPCTATHSPQAISAPCPQVVKTSFYHTHSPQ

SEQ ID NO: 94359 - protein, 267 aa, Glycine max
  Coding DNA Sequence Number=SeqID_2674
  Gene Ontology: Mol. function=aspartic-type endopeptidase activity; Cellular component=small subunit processome; Biological process=DNA integration
  Homolog annotation: Hit_ID=A5C4F6; Match level="QueryCoverage=99%, HitCoverage=21%, E-value=6e-25, Identity=29%"; Hit description =Putative uncharacterized protein
MELWFLGQGHHNHLEKSVDAVPNDKRPEWEKLDYQLCVVLWQSVEPNVLEIHRSFKTCRSFCEKAQDIFANDIQSLFDATMKVTNLKQISHDMIAHMGKARAIVEELKRFLVVDSLEEIKFLQWTLSSPDFFVPHVLKDENLVDVVEASAMVASHGRGGGHNNKGGGSGREKVALVSKLEKPESKFSDEEYQEYLKLKSEKSSNQASSSSVPCFSTACVSQSIAWILDSGASDHISGNKSSFSSISFSKIPHLVTVANGSKVMSQGS

SEQ ID NO: 94360 - protein, 66 aa, Glycine max
  Coding DNA Sequence Number=SeqID_2675
  Gene Ontology: Mol. function=hydrolase activity, acting on glycosyl bonds; Biological process=cell wall organization and biogenesis
  Homolog annotation: Hit_ID=Q8RXF9; Match level="QueryCoverage=65%, HitCoverage=8%, E-value=2e-15, Identity=81%"; Hit description =Putative uncharacterized protein At1g19170
MLGHKYCILGRLSSEVGWSYYDTIRDEKYWPLMPALPSYEYGREHPGPRYSSLIHGQNLRDVVITG

SEQ ID NO: 94361 - protein, 57 aa, Glycine max
  Coding DNA Sequence Number=SeqID_2676
  Homolog annotation: Hit_ID=A9NQZ9; Match level="QueryCoverage=49%, HitCoverage=10%, E-value=8e-07, Identity=89%"; Hit description =Putative uncharacterized protein
MAKAKIIKTSQNLHNHLIKHLVVQSGNVEDAIEKLNDLNPEILDTTPQLFSIFNNND

SEQ ID NO: 94362 - protein, 48 aa, Glycine max
  Coding DNA Sequence Number=SeqID_2677
MKKKGGVYWKSPRDPQTSICKPCRLSEELAGTSKGLSKLSHKKPSSLL

SEQ ID NO: 94363 - protein, 92 aa, Glycine max
  Coding DNA Sequence Number=SeqID_2678
MEIYVSDRLGKNDDKGDDKKLKDQSKNNSRESKINQRTTQVNQRAIKNNSRVQNKNQEEFKTQEESLETRIKIQGSRSQESRMKRRLNQDKY

SEQ ID NO: 94364 - protein, 156 aa, Glycine max
  Coding DNA Sequence Number=SeqID_2679
MPFKYKVQHLINVDWLSFQEEGPKVKTNPLASHGGASVNAIEEDGPSGAKRLEDVATSRQFIYQSLQAACMVSRGGDERDKCLFHLRESHDMETYPAVEELIQRLMDRGQLEVSKGDREEPQICMQSEEKKVPPTPKALVICFARKGTGSRPIVIP

SEQ ID NO: 94365 - protein, 155 aa, Glycine max
  Coding DNA Sequence Number=SeqID_2680
TCPKKKEQCADFVIEIIVRTRGLGRALGHVTGRGVGRGDRDDSDDALQRRRPTASTRKQRVPVTATHDEPVVPAPDVEADVFLDDPMAPTDVDTRVDILADTGVQAAEDEHEGFPGGPSDPSVLTQYEDHVACSVWTGEERPELKLSSHGRKSIV

SEQ ID NO: 94366 - protein, 256 aa, Glycine max
  Coding DNA Sequence Number=SeqID_2681
MTDLVSAEDDGAEDDISQCVLSGFSSYRQQKVYTDNHSGIYARQRDSKVSMTDLVSAEDDQQKVYTDNHSGISARQRDSKVSMTDLVSAEDYKTTLVSCAMRLFGLQQPKVYTDNHSGISARQRDSKVTMTNLVSAKDDGGEDDISQCVLSGFSSYRLKKVYTDNHSGISDRQRESKVAEDEVSLYVLSGFSSYRQQKVYTDNHTGISARQRDSKVSMTDLVSAEDDAFHLTDSKKFVRITTRACRARLTKGAEDD

SEQ ID NO: 94367 - protein, 173 aa, Glycine max
  Coding DNA Sequence Number=SeqID_2682
METMKDQMTSMMEAMLSMKGMMENNAAVVTTTSAVVEADPTHPSAINQVNQPILDMVGQGGDLGHTPFAQPVAEACEEPRDQALGDFEPYPMFATKGPACSGMPQPNTVGAPQHRPLQALHFSIGRLPPAVEGREKLDLIEERLRAIEGIGDYPFADMEELCLVPNVVIPSKF

SEQ ID NO: 94368 - protein, 66 aa, Glycine max
  Coding DNA Sequence Number=SeqID_2683
AWYPSLGEFVKFRERQVMVTRDSRCTLIRRFVKSGKSHGHPRLSLTERSEISEYPNISPEVKKGIA

SEQ ID NO: 94369 - protein, 61 aa, Glycine max
  Coding DNA Sequence Number=SeqID_2684
MANTVARQEEERVEIETYQGSIFQVTSIHHQMTTEEEMSKISSTPEYSCSATADYVRGIEK

SEQ ID NO: 94370 - protein, 89 aa, Glycine max
  Coding DNA Sequence Number=SeqID_2685
MRGNSSAGNLAPLDLEIEATCRRNNVERRRKALQERTAQPSLGEAQSSESSLAFPNLRESKVGASEAHIMVEDQPRRVTHEDYSSSIVP

SEQ ID NO: 94371 - protein, 92 aa, Glycine max
  Coding DNA Sequence Number=SeqID_2686
VVPSVVRLMKQANVFPLKKTLKKLIIWEINSDKGILKEDFQASNRVLIISKDSGAVMIRSKRFVEDEDEESVVHKKKAAEKKGTDDKKNDVR

SEQ ID NO: 94372 - protein, 216 aa, Glycine max
  Coding DNA Sequence Number=SeqID_2687
  Gene Ontology: Mol. function=UDP-3-O-[3-hydroxymyristoyl] N -acetylglucosamine deacetylase activity; Cellular component =cytoplasm; Biological process=lipid A biosynthetic process
  Homolog annotation: Hit_ID=A7FM60; Match level="QueryCoverage=88%, HitCoverage=68%, E-value=2e-92, Identity=81%"; Hit description=UDP-3- O-[3-hydroxymyristoyl] N-acetylglucosamine deacetylase
  Pfam annotation: Domain name=LpxC; Domain location=1-191; Score =211.9; E_value=1.5e-60; Accession=PF03331.4; Description=UDP-3-O -acyl N-acetylglycosamine deacetylase
MTCVFGELSTFTPRCKGCVSTPSKHEVDAAEIPIMDGSASPFVFLLLDAGIEELNSANKFLRLKETVRVEDGDKWAELSPHNGFRLDFTIDFNHPAIDASSQRYRLDFSAESFSRGLALGGSFDCAIVVDDYRVLNEDGLRFEDEFVRHKMLDAIGDLFMCGHNVIGAFSAFKSGHALNNKLLQAVLAKQEAWEWATFEDEAELPLAFKAPNLVLA

SEQ ID NO: 94373 - protein, 114 aa, Glycine max
  Coding DNA Sequence Number=SeqID_2688
  Homolog annotation: Hit_ID=Q2HTA0; Match level="QueryCoverage=44%, HitCoverage=7%, E-value=9e-09, Identity=58%"; Hit description=IMP dehydrogenase/GMP reductase, related
  Pfam annotation: Domain name=DUF1723; Domain location=27-76; Score =40.3; E_value=6.9e-09; Accession=PF08330.1; Description=Protein of unknown function (DUF1723)
MEGRLRNLAGLVAATGLSPLIACLLDTGDRRLMLVFEKWWHKETSSFHLPVGEVTITLDDVASLLHFSIIGAFRNFDSLHIDEAILLLVELLEVSLEEARAETVQCHGEFVRLS

SEQ ID NO: 94374 - protein, 37 aa, Glycine max
  Coding DNA Sequence Number=SeqID_2689
MKKKKKKIRRSPAQQGAKRKACPTCKKSLVHSGEGKA

SEQ ID NO: 94375 - protein, 175 aa, Glycine max
  Coding DNA Sequence Number=SeqID_2690
  Gene Ontology: Mol. function=chloramphenicol O-acetyltransferase activity; Biological process=response to antibiotic
  Homolog annotation: Hit_ID=P62577; Match level="QueryCoverage=72%, HitCoverage=57%, E-value=3e-72, Identity=100%"; Hit description =Chloramphenicol acetyltransferase
  Pfam annotation: Domain name=CAT; Domain location=54-175; Score =170.6; E_value=4e-48; Accession=PF00302.9; Description =Chloramphenicol acetyltransferase
  Subcellular localization annotation: CTP_CleavageSite=43; ConfidenceScore=5.27e-01
MANGTPPCSGALSAAGVVVTRSVTATLASADVRRCFCRYAPPRAKEAKMEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACY

SEQ ID NO: 94376 - protein, 208 aa, Glycine max
  Coding DNA Sequence Number=SeqID_2691
  Gene Ontology: Mol. function=manganese ion binding; Cellular component=mitochondrion
  Homolog annotation: Hit_ID=A7P3U4; Match level="QueryCoverage=53%, HitCoverage=66%, E-value=2e-28, Identity=55%"; Hit description =Chromosome chr1 scaffold_5, whole genome shotgun sequence
  Pfam annotation: Domain name=NUDIX; Domain location=33-157; Score =29.2; E_value=1.5e-05; Accession=PF00293.19; Description=NUDIX domain
DSGTRAFSMAALSDKLAFCLVSACLVTVAPKLFQWCIPYRYKEDNDGNVSNELEVLVVSSQKGQALMFPKGGWELDESVEEAASRESLEEAGVTGIVQHELGQWSFISKRLGTYYEGHMFPLLVKEQLDLWPEKDLRRRIWGWRMSRGGGSDLLAGVWPRSRKRSGVEELEMCNGVRVREGDARQSEGLKGKTLKSKVSTLNSNIQSV

SEQ ID NO: 94377 - protein, 263 aa, Glycine max
  Coding DNA Sequence Number=SeqID_2692
VVADYFSTYGNEVLQTNLRSLERSVDQLLTKEMFILFQSYVSRTIKLRVVDCKEMATFSVYTIVKYYSGSVWRVSYFPSTLPSCLVLNRWSKSATENIKDKYADSAIYWDSQLMARYVTLVQVSREVCEAAYYDEDEYEKILHFLSNEVRRLKSNKNSEPSIDDNDEQQGHNYDDILYPVVVQTKGCGQVGIDESGKRRRIQKYGQCGGSGHNKRSCTNRPRNANDYPLETNFWKHHAIIVDVDATLIAHELNDEGKKAWDIV

SEQ ID NO: 94378 - protein, 63 aa, Glycine max
  Coding DNA Sequence Number=SeqID_2693
  Subcellular localization annotation: CTP_CleavageSite=33; ConfidenceScore=5.13e-01
MVILLPTGSNRTQSKNHRKKKTKGQGGKLTSLIASEISCRRLSWQQLVQRLSWQQSGGPPGAF

SEQ ID NO: 94379 - protein, 119 aa, Glycine max
  Coding DNA Sequence Number=SeqID_2694
MAPKKLLSKRATKDAAGEGSTIKSWSFLKERQVQLRDGEYIKFQEEVARMQWTQLTGPMAKYDPKIVMEFYVNAWPPEERVRDKRLWVQGQWIPIDEDAINQFFGHPLVLKERLRCEFS

SEQ ID NO: 94380 - protein, 85 aa, Glycine max
  Coding DNA Sequence Number=SeqID_2695
MGSSQVPSLKNRFYQVKVRSLGVTSLKELGQLMGQLQRQAFRKAYGKIWDLAMAEVSTEAIASLAQYYDHYHPRWKSLKRSWDAL

SEQ ID NO: 94381 - protein, 154 aa, Glycine max
  Coding DNA Sequence Number=SeqID_2696
  Gene Ontology: Mol. function=chloramphenicol O-acetyltransferase activity; Biological process=response to antibiotic
  Homolog annotation: Hit_ID=P62577; Match level="QueryCoverage=100%, HitCoverage=71%, E-value=2e-77, Identity=89%"; Hit description =Chloramphenicol acetyltransferase
  Pfam annotation: Domain name=CAT; Domain location=6-154; Score=201.1; E_value=2.8e-57; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLIQKMSGCYGENLAYFTTWFIEKMFFVSAYLWVNFTIF

SEQ ID NO: 94382 - protein, 151 aa, Glycine max
  Coding DNA Sequence Number=SeqID_2697
MSRNFANFLTMGAKYLEVVKPGSHPNNGWSPDKIRVTMSNHKSTESALKNLEVQMGQLAKQIADKSSNSFGTNTENNPKEECRAVMTRSKRFVEAEDEENVVDKEQLSEKTGAEVKKNDVKGKENQEKRKKIMVQNKEIEDQEKEKEGEKE

SEQ ID NO: 94383 - protein, 62 aa, Glycine max
  Coding DNA Sequence Number=SeqID_2698
DLEEDPKELPPEPAMDAPDLPEDDEEPLPDVDSSEDIMPASEADSTEESGLGGTTSSDDSSS

SEQ ID NO: 94384 - protein, 260 aa, Glycine max
  Coding DNA Sequence Number=SeqID_2699
MVYTNQADMTERLHAGSLAFECRIMHYLIVCILLPRSSNLAQVSEEDLRIMWVFLTGHQIDWAHLPFVKVKRSFSIGANVVSSFGYHKERDGSWVKKDALVQADEDHSPSPHSQRDDSSSLMHNILDRLDGLHTFVGERFDLLDSRIVAMDAQFAGMDTHITKLEEDDCHRQKGGDCGSNDFQDYFDDAKESRVKQVPKNQESKSFKNQVSKNQDSRTIKFQDSRFKNNQVSRFKIQEQSRSRLKTQDSRNKRRLNQDKY

SEQ ID NO: 94385 - protein, 30 aa, Glycine max
  Coding DNA Sequence Number=SeqID_2700
MGAKHLTRTKEWSHVIEQRSPDEIRDNIPK

SEQ ID NO: 94386 - protein, 104 aa, Glycine max
  Coding DNA Sequence Number=SeqID_2701
MESKTRRKGDLRLENQGIPHNNNNFATYPSAGGRRVTRGMRVPRKEYARSRHQRLFEENVGKTGKDAIYELLSERFGSCIYAWGRVFPFAPTYSSIWDEKIRPT

SEQ ID NO: 94387 - protein, 59 aa, Glycine max
  Coding DNA Sequence Number=SeqID_2702
MKKQWSRRRRGERRCHPLENKPWKEKLHHQESVLDKKHREEASMEEENEREKEIEWHGN

SEQ ID NO: 94388 - protein, 103 aa, Glycine max
  Coding DNA Sequence Number=SeqID_2703
MRGTVHEPQVNIGADQKGLHVLANRGLHALTLRGLCVLTFRGLHILTFRGLHALAIRGLHVLTFRGLHALAIRGLHVLTFVGLHALTFRGLHVLATEGCTPSP

SEQ ID NO: 94389 - protein, 89 aa, Glycine max
  Coding DNA Sequence Number=SeqID_2704
MGKATLSVPRPAPTIEQIKQDNSGDPTTNVITNWKIKDGELIQLELSPTTQYQLPKVKDRKDKPVMATPFKTTDVNEEVTSKDIKSLME

SEQ ID NO: 94390 - protein, 193 aa, Glycine max
  Coding DNA Sequence Number=SeqID_2705
MVIRAPFATQRRSSSMARRDKLWLFYTFHHPEAASPMTGGDKLRSFAHLSPSRDNRVRWHAETNYGHSAPFVMRRRRARQHAEKNYVHPCTFHHSETIESGGTESQIMVILHLLSSRGGEPDDMGRQIMVIHTTFRHPETIESDGTLRKIIVILHLLSSRGGEPDDMRRQIMVILHLLSSRGGEPDDVGRQNM

SEQ ID NO: 94391 - protein, 139 aa, Glycine max
  Coding DNA Sequence Number=SeqID_2706
MERWIVSHLRVLIVPLVKQRMMVFFQEDGQPLMVKEKCKEVSVSSKRLAKKETHFTIKTNIKETFPLRQPPHFLFCKKTLVSTATPLGLEVIPQVKELLDEGLVRVEGRSLEYEEPRDLRSNPFQGGGDDAILPPKGIG

SEQ ID NO: 94392 - protein, 141 aa, Glycine max
  Coding DNA Sequence Number=SeqID_2707
MPISPGRNISWDRAHKTHNGPGEVQQGPRVSSSSYGPLSVLQGARFPQQGIAPARHLVGPKKSNRVLGFPALITGLCQFYGVLIAPSKFIRPPINRAFVEKYCAPRKAQGETPQQPRDGRQRATNALPPPLEFTSAYPQKG

SEQ ID NO: 94393 - protein, 79 aa, Glycine max
  Coding DNA Sequence Number=SeqID_2708
MHENEWHGARLLFCPYLGTYRTISRAKARLTGVLSKGGKMRGVATNEGISTSHVDKSGALAPTYPPSKRKSDLRSSFLR

SEQ ID NO: 94394 - protein, 84 aa, Glycine max
  Coding DNA Sequence Number=SeqID_2709
  Homolog annotation: Hit_ID=A5BJD2; Match level="QueryCoverage=67%, HitCoverage=3%, E-value=8e-08, Identity=45%"; Hit description =Putative uncharacterized protein
MAQPPPCERTLREMVAPDFTYESLCAFNILMRGVAKDWLYYLAPRSISSWDDLKRVFLEKFFPASRTTTIRKDISSIKQLSGES

SEQ ID NO: 94395 - protein, 201 aa, Glycine max
  Coding DNA Sequence Number=SeqID_2710
MSSRKRKSVGSRHTTQYDTRRFHSFEAWTRYTDNVLGRHILAERKVEIYHIELDEFKAELERRNFHKRLTNLADSSIDLALKEFYTNLYSPEGPSPKQVKIQGHLIRIDADNLNVFLETRVVLAEGESLPAYSRYCRMPTDIREIEVALCIPGRGFILNAEGHPRKILRKDLTTLAQVWSVLSYSNLALTSHTSDLTVDRA

SEQ ID NO: 94396 - protein, 64 aa, Glycine max
  Coding DNA Sequence Number=SeqID_2711
  Subcellular localization annotation: CTP_CleavageSite=26; ConfidenceScore=5.29e-01
MLTTSKDWKAISNDSSAASTGQLPLSGSMDVPKDSCRNLPFGGRATRDSRDACSTKGIRAESPP

SEQ ID NO: 94397 - protein, 180 aa, Glycine max
  Coding DNA Sequence Number=SeqID_2712
  Gene Ontology: Mol. function=sequence-specific DNA binding
  Homolog annotation: Hit_ID=Q5DY05; Match level="QueryCoverage=55%, HitCoverage=100%, E-value=3e-35, Identity=75%"; Hit description =Transcriptional Regulator
  Pfam annotation: Domain name=HTH_3; Domain location=89-143; Score =51.9; E_value=2.2e-12; Accession=PF01381.13; Description=Helix-turn -helix
MGPKPGRPYVDTLKGGQFPNLKELRVQHAGMPVRAFFAFDPVRRAIVLCAGNKAGWIMGTYKQLLAKQSPESQQRIAEKVEKLRQEIALSQLREELNLSQTELARTIGVSQPTLAKMENPENDPRLSTLKRYVAALGGELRIDVKLPNGKHFAFQLDRFWRKHRQSLLLSQCLTGGVGVL

SEQ ID NO: 94398 - protein, 258 aa, Glycine max
  Coding DNA Sequence Number=SeqID_2713
  Pfam annotation: Domain name=zf-CCHC; Domain location=97-114; Score =21.5; E_value=0.00084; Accession=PF00098.14; Description=Zinc knuckle
MKNFMTIMKEGIGHILDLTPIGEKRKESLKRLTLTSYTSMGRTMKSTSKSYGSHSYPKKDQGQGILGVRPSKPKDDKGKTIEKQPLKASMQEKTSSMKCFKCLGRGHITSQCPTKKTMIMRGQDIYSSQDEATTSPSSSKSEEAKGEESSEEIYPQEEGQPLMVKEECKEVSVSSKRLAKKERHFEIKTNIKEISLLRQPPHFLLCKKTLVSIATSLRLEFIPQVKELLDEGLVRKRLNPCALLVPKIGIINMKIQKK

SEQ ID NO: 94399 - protein, 149 aa, Glycine max
  Coding DNA Sequence Number=SeqID_2714
MYPSLFYLNLVDVPSTRTDPQEIYPLFSQSNSSRCTLYLEKEESKEFSDYVVLNSLTTEKGDTKEFRRLVLCSFGKGRRETQKEFRRLVLGEFFLAKGEGNEKMNSTSFQGLENQKTSESFWYKEEEEEVQRDTRLVKDCKNKCSRLNE

SEQ ID NO: 94400 - protein, 61 aa, Glycine max
  Coding DNA Sequence Number=SeqID_2715
  Homolog annotation: Hit_ID=Q9FZN9; Match level="QueryCoverage=60%, HitCoverage=1%, E-value=7e-08, Identity=72%"; Hit description =Retroelement pol polyprotein-like
MPFGLCNAPGFYRRFIKDFSKVALPLSNLLQKEVEFDFDDQCKEAFDASSVRDYHPYHSGT

SEQ ID NO: 94401 - protein, 152 aa, Glycine max
  Coding DNA Sequence Number=SeqID_2716
  Homolog annotation: Hit_ID=A5ALE6; Match level="QueryCoverage=56%, HitCoverage=13%, E-value=2e-15, Identity=48%"; Hit description =Putative uncharacterized protein
MGTNLQLVIQKLNGKNYVEWAQSVKLALDGKGKLGYLIGDTSQPGELDQCYEDDWENPNDATRLKKREENDRVYMFLVGLNQELDEEKKRSDLGVIIVEDHDTLRKPAGNSMENHPTQKRNQLERVGLSKPQMLKMWSRKATPSHLCSLRNN

SEQ ID NO: 94402 - protein, 112 aa, Glycine max
  Coding DNA Sequence Number=SeqID_2717
MSPPPLGISQSLKNSQIFLKDQNLASLLCSLPLCISHFKLLWLFSTLSSPPYILHKSGLKKGLTDLDVALSAKLIHKRCTLSCSQSNPSRCTLYLYHKGCTLQCVKTKILGG

SEQ ID NO: 94403 - protein, 305 aa, Glycine max
  Coding DNA Sequence Number=SeqID_2718
  Gene Ontology: Cellular component=Golgi apparatus
  Homolog annotation: Hit_ID=A7PT84; Match level="QueryCoverage=50%, HitCoverage=38%, E-value=1e-72, Identity=85%"; Hit description =Chromosome chr8 scaffold_29, whole genome shotgun sequence
MKSCNLDAQNILTYLAFLAVAQSRMLGFLLCAGFSEYVYHFGRSLSTTINFFPHSHLMSLFGQCFVVFPVAEWMKLLLIQPCREVKGQIREGNRTEISMPENGRNRDGESRQKELGFVGDDGCQNCAKAAAMCTTPAVTVKYDVRGVKEVADSCSQIKALLGDYDAIHVRRGDKIKTRKDRFGVARSLHPHLDRDTRPEFMLCRIAKWVPPGRTLFIASNERTPGFFSPLSARYRLAYSSNYSHILDPLIENNYQLFMIERLIMMGGKTFIRTFKEDETDLSLTDDPKKNTKLWQIPVYNVDETC

SEQ ID NO: 94404 - protein, 29 aa, Glycine max
  Coding DNA Sequence Number=SeqID_2719
MESTPLWVLGSPRTKSILISTQDAYGMGK

SEQ ID NO: 94405 - protein, 44 aa, Glycine max
  Coding DNA Sequence Number=SeqID_2720
MKIHKTNRMMNEEHRTKNDEMRRFGTSVARPSELLLHPEVTLLA

SEQ ID NO: 94406 - protein, 213 aa, Glycine max
  Coding DNA Sequence Number=SeqID_2721
VAGCTICGGAYESGCCIPNEKQVTHEVNYMGNQSRNHFNAGGFFGFQHGQQYNQQQGQWRNHPGNQFNRDQGSSIRLQPQGSSLYDRTMKLEETLAQFMQVSMSNQKSTESAIKNLEVQVGQLAKQLADRPSRSFSANTKENPKEECKAIMTRSRMTTHVDERKVEKKMEEHKQQLADELALEPVDDLVELEEIVEEAEGDEEGEISKTIKRE

SEQ ID NO: 94407 - protein, 143 aa, Glycine max
  Coding DNA Sequence Number=SeqID_2722
  Homolog annotation: Hit_ID=Q6UUU1; Match level="QueryCoverage=41%, HitCoverage=40%, E-value=1e-18, Identity=78%"; Hit description =Putative uncharacterized protein
MAQTKREKAIKAAVVPGKAYAFEDAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 94408 - protein, 143 aa, Glycine max
  Coding DNA Sequence Number=SeqID_2723
MASSIGGNGRGIGGCCKFRMKLDRFRCRCCYWWRHLNLVAIPQAICPSDLSDSEWRFLSLAEIAYSGWSFASLTLLRKVEEKPQLLVIFVVTAAAVAALEEEHMACLDQQHSRKEGQAVVVVEDLSISDLDDSSNLDCICCLK

SEQ ID NO: 94409 - protein, 41 aa, Glycine max
  Coding DNA Sequence Number=SeqID_2724
MVVRIKLVCRPKKRRCKNLLLNSLSEVDWLSEPQPLSEAAS

SEQ ID NO: 94410 - protein, 70 aa, Glycine max
  Coding DNA Sequence Number=SeqID_2725
MIVKETELCRSKLHDDEPSNFDDAKRPSLGSSSSMDSFASWKMNGRIVQKEDREETPLQGEDESRRSSPP

SEQ ID NO: 94411 - protein, 347 aa, Glycine max
  Coding DNA Sequence Number=SeqID_2726
  Gene Ontology: Mol. function=selenide, water dikinase activity; Cellular component=cellular_component; Biological process=electron transport
  Homolog annotation: Hit_ID=A7MNU8; Match level="QueryCoverage=98%, HitCoverage=98%, E-value=1e-132, Identity=68%"; Hit description =Selenide, water dikinase
  Pfam annotation: Domain name=AIRS; Domain location=6-157; Score=38.3; E_value=2.8e-08; Accession=PF00586.15; Description=AIR synthase related protein, N-terminal domain
  Pfam annotation: Domain name=AIRS_C; Domain location=168-344; Score =57.4; E_value=4.9e-14; Accession=PF02769.13; Description=AIR synthase related protein, C-terminal domain
  Pfam module annotation: Pfam domain module=AIRS::AIRS_C; Domain location=6-157::168-344
MSEPLRLTQYSHGAGCGCKISPQVLETILHSELAAFHDPRLLVGNETRDDAAVYDLGNGTAVVSTTDFFMPIVDDPHTFGRIAATNAISDIYAMGGKPIMAIAILGWPVNVLDAKVAQQVIEGGRAACQAAGIALAGGHSIDAPEPIFGLAVTGIVDVARVKKNSAAQAGCELFLTKPLGIGILTTAEKKGLLRAEHQTLAAQVMCQLNSAGAEFAKLPGVSAMTDVTGFGLLGHLSEICLGSGLRAHVQAAQVPRLPGVDQYIAAGAVPGGTSRNFASYGEHISAMDEATRALLCDPQTSGGLLVAVQPDAIAAFHACAVQAGVEATAIGSLLPADRAHPLITVVT

SEQ ID NO: 94412 - protein, 83 aa, Glycine max
  Coding DNA Sequence Number=SeqID_2727
MRNLSECENRSLRSFQISKVESIHITDCLIAGLMERVSHDITMRLQRRQASCIGCVGGGQGSVPERKCSLFLDSSATTISRSH

SEQ ID NO: 94413 - protein, 161 aa, Glycine max
  Coding DNA Sequence Number=SeqID_2728
MGDQEETQEQMKADMSALKEQMASMMEAMLGMRQLMEKNVAAAVSSTAEADPTLLATARHPPSNTVGRGRYTLGHDGNPHLGYNRTAYPYGLPPNYSPPVMQDDAGHISSPVLEGEPPQQPDEVHENPQDYARRDVEFYLPIPEGPAPNTLPQPNLTTQPI

SEQ ID NO: 94414 - protein, 244 aa, Glycine max
  Coding DNA Sequence Number=SeqID_2729
MGEVEEIQEKRKADMEAIKEKMATMMEAMMSVKKIMEANAVAIAATSVVAKVNLMSPSGINQMNHPTSDMVAKIWEVREAPIMYKFKTSTPSRHMACLSTIRHPKWRTLPIRMSITPLLYPLRANNPKLIMHMSLKSWGGHMIPHHNLADFEPCLGYATEGQAVGGIPLQNPLEGPQYHPQLHLLHSTTSKNPHAMAEMGKLDHLEERLRAIEGGEDYAFANLKELFLEPNIITPPKFKVLDLD

SEQ ID NO: 94415 - protein, 54 aa, Glycine max
  Coding DNA Sequence Number=SeqID_2730
VMGCTICGCTHESDLCIPFEEQTQEVSYMGNQQRQGYNQGGFSGFPQGPYNQQG

SEQ ID NO: 94416 - protein, 102 aa, Glycine max
  Coding DNA Sequence Number=SeqID_2731
PNFVWGLSFTDVLILDSRIAVFDTNPSSPRLASALPRPWNYLLGKQPALLGELITSVLRFSSPGVSLNRPKGLEGSALKGIERIERKEEREKEEEERRGNEA

SEQ ID NO: 94417 - protein, 46 aa, Glycine max
  Coding DNA Sequence Number=SeqID_2732
MKVSVEEVKDADAPIPVPTEEFKLVGQTLNTFLAWPTHLVKHLSER

SEQ ID NO: 94418 - protein, 154 aa, Glycine max
  Coding DNA Sequence Number=SeqID_2733
MVSGNRLPRGCNQLPGLKTRFHVLKLCNSSLASDRDGAIRFRGTIRFTATSLVHPDEPARTLQRIVEWILPTPTPYRLVEPVQVIEVTSSEEDPEEDPEELPPEPAVDALDFLEGDEDPLPEVDSPEDVMLAFEADSTEDSGPGEMAISGGSSS

SEQ ID NO: 94419 - protein, 167 aa, Glycine max
  Coding DNA Sequence Number=SeqID_2734
  Gene Ontology: Mol. function=protein kinase activity; Biological process=protein amino acid phosphorylation
  Homolog annotation: Hit_ID=Q8RV60; Match level="QueryCoverage=69%, HitCoverage=11%, E-value=4e-17, Identity=36%"; Hit description =Putative uncharacterized protein At2g05640
MSENLWKQSKKLRTRVSLLNLKNFGIKHGIELHIDDEQLKNLTLLEIEKLLHPNQKLLRDYPAMPYPKGGNPASCLENSLILFELNYNNDEARLEFENLFLSMTGKTYIWRTLASSLRAKNQIVIMVASSGIASLLLPRGRTAHFKFKIMIFDKFCQSFQEEVVQTL

SEQ ID NO: 94420 - protein, 59 aa, Glycine max
  Coding DNA Sequence Number=SeqID_2735
IFGPDVLDIVSDIVDPAASMLLATPDVLDIVSDIVNPAASILHLTFHLALCIVQPDLIL

SEQ ID NO: 94421 - protein, 67 aa, Glycine max
  Coding DNA Sequence Number=SeqID_2736
MHILLSYDRGRIVLGNGRMPGQIDRQRLIKGRTQVEARITIDRSSSRAQHWTSGKRSWGTAKYPLNS

SEQ ID NO: 94422 - protein, 173 aa, Glycine max
  Coding DNA Sequence Number=SeqID_2737
  Gene Ontology: Mol. function=arabinose transmembrane transporter activity; Cellular component=plasma membrane; Biological process =carbohydrate transport
  Homolog annotation: Hit_ID=A4WBR4; Match level="QueryCoverage=98%, HitCoverage=33%, E-value=6e-77, Identity=82%"; Hit description=ABC transporter related
  Pfam annotation: Domain name=ABC_tran; Domain location=1-142; Score =21.4; E_value=1.3e-08; Accession=PF00005.18; Description=ABC transporter
MLCPEDRKAEGIIPVHSVRENINISARRHNLSAGCLIKPGWEAKNADHHIRSLNIKTPGAHQLIMNLSGGNQQKAILGRWLSEEMNVILLDEPTRGIDVGAKHEIYNLIYQLANKGIAVLFASSDLPEVMGLADRIVVMREGEIAGELPHDAATEQLTLSLAMPKTTQAAAVA

SEQ ID NO: 94423 - protein, 195 aa, Glycine max
  Coding DNA Sequence Number=SeqID_2738
  Homolog annotation: Hit_ID=A6WYZ2; Match level="QueryCoverage=44%, HitCoverage=62%, E-value=3e-25, Identity=72%"; Hit description =Putative uncharacterized protein precursor
MDGRNECGCFCLRVLLTLATGGVGFAASCEQNFKSDGVPLVTSVSYRSTQSFTGVKSSAALQRLAQAIAAEGFSGIKVNKQLASIEAFQETTRIGPDPDLARHCPGAGQEHACRCGLHHSGGTGDQQVRRARRTLPHHYFCCKLSLSSQGPNDVFQAQNPPLTGDAAKLGLSLEKENGSGGGIRTPDTRIMIPLL

SEQ ID NO: 94424 - protein, 65 aa, Glycine max
  Coding DNA Sequence Number=SeqID_2739
  Subcellular localization annotation: CTP_CleavageSite=32; ConfidenceScore=5.27e-01
PSTFAYLWLWTWSPAGRPQVVGKVLAFVDKMRGSRDGGGASIARCRPSPAVVVSCPVPAWRRNTY

SEQ ID NO: 94425 - protein, 52 aa, Glycine max
  Coding DNA Sequence Number=SeqID_2740
MSYSLEKNLLEYKSCAFSIEGHANLGSAPMGGDQSSSLLDTYGLVILQWRIK

SEQ ID NO: 94426 - protein, 101 aa, Glycine max
  Coding DNA Sequence Number=SeqID_2741
TSSGQRLHGPEIGPRPKQERHPPAAPGDGEEAHEDEEMADLLDFLGGSGRYVTGEIPQIHGECCEDFPRRPKWTRMNAQIDKRTYFGNVGLTKIEEMNPEP

SEQ ID NO: 94427 - protein, 210 aa, Glycine max
  Coding DNA Sequence Number=SeqID_2742
  Gene Ontology: Mol. function=protein binding; Cellular component =mitochondrion; Biological process=defense response to fungus
  Homolog annotation: Hit_ID=Q1SWI6; Match level="QueryCoverage=73%, HitCoverage=73%, E-value=2e-36, Identity=50%"; Hit description =Leucine-rich repeat, plant specific
  Pfam annotation: Domain name=LRRNT_2; Domain location=27-67; Score =49.5; E_value=1.2e-11; Accession=PF08263.3; Description=Leucine rich repeat N-terminal domain
  Pfam annotation: Domain name=LRR_1; Domain location=109-134; Score =10.0; E_value=4.3; Accession=PF00560.24; Description=Leucine Rich Repeat
  Pfam annotation: Domain name=LRR_1; Domain location=136-158; Score =13.9; E_value=0.62; Accession=PF00560.24; Description=Leucine Rich Repeat
  Pfam annotation: Domain name=LRR_1; Domain location=160-181; Score =2.4; E_value=1.1e+02; Accession=PF00560.24; Description=Leucine Rich Repeat
  Pfam annotation: Domain name=LRR_1; Domain location=183-208; Score =10.8; E_value=3; Accession=PF00560.24; Description=Leucine Rich Repeat
  Pfam module annotation: Pfam domain module=LRRNT_2::LRR_1::LRR_1::LRR_ 1::LRR_1; Domain location=27-67::109-134::136-158::160-181::183-208
MNSSSIYILVFVQLWLLSLPCRESVCIPSERETLLKFKNNLIDPSNRLWSWNHNNTNCCHWYGVLCHNLTSHLLQLHLSSSDYAFYDEEAYRRWSFGGEISPCLADLKHLNYLDLSGNYFLGEGMSIPSFLGTMTSLTHLDLSHSGFYGMIPPQIGNLSNLVYLDLRSVANGTVPSQIGNLSKLRYLDLTYNHLLGEGMAIPSFLCAMLD

SEQ ID NO: 94428 - protein, 135 aa, Glycine max
  Coding DNA Sequence Number=SeqID_2743
  Homolog annotation: Hit_ID=A7QZ67; Match level="QueryCoverage=57%, HitCoverage=11%, E-value=9e-28, Identity=70%"; Hit description =Chromosome undetermined scaffold_265, whole genome shotgun sequence
  Pfam annotation: Domain name=DUF821; Domain location=5-134; Score= -246.0; E_value=2.3e-06; Accession=PF05686.3; Description=Arabidopsis thaliana protein of unknown function (DUF821)
MLTDSDRISAADNRDKEPEASIRKTETLKGVAVINKPEVQKEEKTKRKVVWSNRQDLMKCNVSENQDWNARLFAQDWFRESQEGFSKSDLPSQCTYRYKVYIEGSAWSVSQKYILSCDSTTLRVRLHVSSPEFIC

SEQ ID NO: 94429 - protein, 152 aa, Glycine max
  Coding DNA Sequence Number=SeqID_2744
IMEANAVAVAATSAVAKVNPTPPSGLNQMNHPTSDMVGKYLGSTGSPHDVQIQNKYAFSPYGLPPNYTPPNVAYTPNEDTYEIPHHNLADFEPCLGYAIEGQVVGGIPLQNTLEGPQFRPQSQPLHSTAGKIPPVMEEIGKVGSFRGKAHGH

SEQ ID NO: 94430 - protein, 156 aa, Glycine max
  Coding DNA Sequence Number=SeqID_2745
  Subcellular localization annotation: CTP_CleavageSite=45; ConfidenceScore=5.17e-01
MNLLPSAVHVSSTIESGAPRIYCLALFANSPFSTFIQSPMNLLPSAVHASSTHESGAPRIYCLALFANSPFSTFILRPMNSLPSVVHVSSTNESRAPRIYCLALFANSPFSTFIRSPMNLLPTAVHASSTHESGAPRIYCLALFANSPFSTFFGAP

SEQ ID NO: 94431 - protein, 94 aa, Glycine max
  Coding DNA Sequence Number=SeqID_2746
DLVVIDIEEDANIPIILGRPFMSTTSCVDKDPPSQNVCLKVHVMEEKRPEKKVLEEKTQKFFAIVYPLSTDLALSAQSSRAKLSLLALSIETPD

SEQ ID NO: 94432 - protein, 142 aa, Glycine max
  Coding DNA Sequence Number=SeqID_2747
MHLRDLHCLTSLWLVPQVGVEEVTDADAPVPVPTDEVSLVRQEIHTFLALPTHLVKSLSQQAAVSPAKPPQKPNLEVDDPLYLMTLTIPELFLRPYQVIWDVTVFGVFNPDFPLYIKHEDLSEIAHGGQCLSIQCYSCGFCI

SEQ ID NO: 94433 - protein, 181 aa, Glycine max
  Coding DNA Sequence Number=SeqID_2748
  Homolog annotation: Hit_ID=Q2HW90; Match level="QueryCoverage=90%, HitCoverage=38%, E-value=1e-17, Identity=33%"; Hit description =Putative uncharacterized protein
MGTNQNGKRFYQVKVKSLDVTSLKELGRLMGPLQRQAFRKVYGKILDLTAAEVFTEAVVSLAQYYDQPLRCFTFGDFQMVPTIEEFEEILGCPLGGRKPYLFSGFLPSLSKIAAMARDMASQEKWGPFADILALLIFGVVLFPNVDGLVDLAAIDAFLAYHHSKESPVVAILADLFDTFDR

SEQ ID NO: 94434 - protein, 214 aa, Glycine max
  Coding DNA Sequence Number=SeqID_2749
  Homolog annotation: Hit_ID=Q84VH5; Match level="QueryCoverage=78%, HitCoverage=28%, E-value=3e-82, Identity=83%"; Hit description =Envelope-like protein
MDIAVSEHQIAKEITAKQVQHWPKKGKLSAGKLSVKYAILHRIGAANWVPTNHTSTVATESFAVKLPIAFPTVLCGIMLSQHPNILNYTDSVMKRESPLSLHYKLFEGTHVPDIVSTSGKAASGAVSKDALIAELKDTCKVLEATIKATTEKKMELERLIKRLSESGIDDGEAAEEEEAAEQEEEEAEEEEEEADEEDAAEDTESDDDDSEATP

SEQ ID NO: 94435 - protein, 25 aa, Glycine max
  Coding DNA Sequence Number=SeqID_2750
MGAKYLEAVKQRLHATKQWSSDEIR

SEQ ID NO: 94436 - protein, 195 aa, Glycine max
  Coding DNA Sequence Number=SeqID_2751
GVEDDVSLCVLSGFSSYRQPKVYTDNHSGISARQRDSKVSMTDLVSAEDDGTEDDVSLCVLLAYFVLQTAKVYTDNHSGISARQRDSIESMTDLVGAEDDVYLRVSTGFSSYRQQKVYTDNHSGISARLRHSKVSMTDLVSAEDDGTEDDVSLCVLLAFSSYRQQNVYTDNHSGISARQRDSQVSMTDLVSAEDD

SEQ ID NO: 94437 - protein, 95 aa, Glycine max
  Coding DNA Sequence Number=SeqID_2752
MEKMDVHIITRGTPKACLGEPKLNPEAMSLPRQADFFTMKLFGGPGELEANLGELGSRKTKEKTLLPPLFLVFFAFLIKTLNDHLFSHCNWRSTP

SEQ ID NO: 94438 - protein, 273 aa, Glycine max
  Coding DNA Sequence Number=SeqID_2753
  Gene Ontology: Mol. function=transferase activity, transferring glycosyl groups; Cellular component=integral to membrane; Biological process=metabolic process
  Homolog annotation: Hit_ID=A7Q9P7; Match level="QueryCoverage=100%, HitCoverage=55%, E-value=1e-104, Identity=65%"; Hit description =Chromosome chr5 scaffold_67, whole genome shotgun sequence
LGTRNLTFTTCGAYGILAYISIWSNLPHRKTDSDEFHVPGFPQNYRFHKTQLHRFLQAADGTDDWSRFLVPQIQLSMKSDGWICNTIEKIEPLGLKLLRNYLQLPVWAVGPLLPPASLMGSKHRSGKETGMALDACMEWLDSKDENSVLYISFGSLHTISASQMMALAEGLEESGKSFIWVIRPPVGFDINGEFSAEWLPKGFEESMRDTKRGLLVHKWGPQLEILSHTSTGAFLSHCGWNSVLESLSYGVPMIGWPIVADQPYNVKMLVEEM

SEQ ID NO: 94439 - protein, 139 aa, Glycine max
  Coding DNA Sequence Number=SeqID_2754
MLVATPRVFLSWNTHPASLASPSRRRAPQQHELEPENDHSSEAIIPGAIDFSKRRLETRSNKADHLGPVPVSVDVPFPGLDPSSPQHAADSSTPVLKILEGQTIPVLALDISHPATPVLHLTDKEDVQTQDIQDQSQEF

SEQ ID NO: 94440 - protein, 177 aa, Glycine max
  Coding DNA Sequence Number=SeqID_2755
MEGSGLESSEAKASSWTRNLELPTFDGSIEGETDSKGNNFECDDDPLQFLKSENRSKEVSEEVDPSMKREKHKENKVKNVGCEDHFLDNPIPKMIKKEVEAGDAVKPHSFQDSDFHKKIVMMKQNSLLDPNSIMKVDRTSMMLESWNVNLLDVPLALNFVASMADSSAVELKGEGMY

SEQ ID NO: 94441 - protein, 122 aa, Glycine max
  Coding DNA Sequence Number=SeqID_2756
MIIRAQEIYSSQDEATTSPSSSESDEAKGEESSEEIYPQEEGQPLMVKDECKEVSVSSTRHQIPKIGGMMNVLSGATLFCIITRAPNIFMICVLSYPNFVREPLLDDVRPFFGPREVLGTHH

SEQ ID NO: 94442 - protein, 73 aa, Glycine max
  Coding DNA Sequence Number=SeqID_2757
CPIGSLVIPKKYNLLPLYCGSNVFQGYFDDAKESRVKKNPKIQESSFKNQDSRIIKIKIQDSRFKNQDKTQSR

SEQ ID NO: 94443 - protein, 165 aa, Glycine max
  Coding DNA Sequence Number=SeqID_2758
MAPTRHPLDPDKSNRALGFPALITGLCQSFGVPVTPSKVIRPPITRAFIEKYCTRRQVQGDVPQAADTPPPHQASPVGLFDIEQYLRHLVRQQAANHRAHGFTPFPCPTPDQFRAEVTWPGDWPEAQAAEAPAGAPAEAPDEADEAREDEEMTDLLDFLGGSGAA

SEQ ID NO: 94444 - protein, 99 aa, Glycine max
  Coding DNA Sequence Number=SeqID_2759
MDNEEGVQEQMKADLSALKDQMASNSEDKATATASSTVREAEPVLQPASNPGLDKNTGVFGRRYSPQAYPYGLPPDFTPRATPEELSQAPTFEGQLPPY

SEQ ID NO: 94445 - protein, 386 aa, Glycine max
  Coding DNA Sequence Number=SeqID_2760
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=100%, HitCoverage=67%, E-value=1e-150, Identity=91%"; Hit description =Photosystem I P700 chlorophyll a apoprotein A2
  Pfam annotation: Domain name=PsaA_PsaB; Domain location=1-386; Score =473.1; E_value=3.5e-139; Accession=PF00223.10; Description =Photosystem I psaApsaB protein
QGLAQDPTTRRIWFGIATAHDFESHDDITEERLYQNIFASHFGQLAIIFLWTSGNLFHVAWQGNFEAWVQDPLHVRPIAHAIWDPHFGQPAVEAFTRGGALGPVNIAYSGQWNLYAQNPDSNSHIFGTPQGAGTAILTLLGGFHPQTQSLWLTDIAHHHLAIAFLFLVAGHMYRTNFGIGHSIKDLLEAHTPPGGRLGRGHKGLYDTINNSIHFQLGLALASLGVITSLVAQHMYSLPAYAFIAQDFTTQAALYTHHQYIAGFIMTGAFAHGAIFFIRDYNPEQNEDNVLARMLDHKEAIISHLSWASLFLGFHTLGLYVHNDVMLAFGTPEKQILIEPIFAQWIQSAHGKTSYGFDILLSSTNSPAFNAGRSIWLPGWLNAVTEN

SEQ ID NO: 94446 - protein, 46 aa, Glycine max
  Coding DNA Sequence Number=SeqID_2761
GGGCRPPRRGEQGCFHQKAPPSVGTLRKAQGANKVQGLTASTPGRN

SEQ ID NO: 94447 - protein, 76 aa, Glycine max
  Coding DNA Sequence Number=SeqID_2762
MVRRRRSTFYPRTMKAMRTSLKKIKQKAKESLKWWNHQRSAKVLRVEANDILRFKIFQFLPPFPPPHCSHWKNNVY

SEQ ID NO: 94448 - protein, 409 aa, Glycine max
  Coding DNA Sequence Number=SeqID_2763
  Gene Ontology: Mol. function=hydrolase activity, acting on ester bonds; Cellular component=intracellular; Biological process =nucleobase, nucleoside, nucleotide and nucleic acid metabolic process
  Homolog annotation: Hit_ID=A8GKT0; Match level="QueryCoverage=100%, HitCoverage=52%, E-value=0.0, Identity=88%"; Hit description=RNA binding S1 domain protein
MERFAEDASLLAKVRDYLWKNAHLVSKVVEGKEEEGAKFRDYFDHHEPISQVPSHRALAMFRGRNEGVLQLALNADPQFEEAPRESQAELIIINHLNLRLNNAPADAWRKAVVNWTWRIKVLLHLETELMGTVRERAEDEAINVFARNMHDLLMAAPAGMRATMGLDPGLRTGVKVAVVDATGKLVATDTVYPHTGQAAKAAAIVAALCIKHNVELVAIGNGTASRETERFYLDLQKQFGEVRAQKVIVSEAGASVYSASELAAQEFPDLDVSLRGAVSIARRLQDPLAELVKIDPKSIGVGQYQHDVSQSQLAKKLDSVVEDCVNAVGVDLNTASVPLLTRVAGLTRMMAQNIVNWRDENGRFSNREQLLKVSRLGPKAFEQCAGFLRINHGDNPLDASTVHPEAYPV

SEQ ID NO: 94449 - protein, 524 aa, Glycine max
  Coding DNA Sequence Number=SeqID_2764
  Gene Ontology: Mol. function=nuclease activity; Cellular component =membrane; Biological process=polysaccharide catabolic process
  Homolog annotation: Hit_ID=Q1IZR2; Match level="QueryCoverage=86%, HitCoverage=33%, E-value=1e-88, Identity=42%"; Hit description =Extracellular nuclease containing Fibronectin III domain precursor
  Pfam annotation: Domain name=Exo_endo_phos; Domain location=105-419; Score=87.2; E_value=5.2e-23; Accession=PF03372.14; Description =EndonucleaseExonucleasephosphatase family
  Pfam annotation: Domain name=HemolysinCabind; Domain location=426 -443; Score=18.2; E_value=0.03; Accession=PF00353.10; Description =Hemolysin-type calcium-binding repeat
  Pfam annotation: Domain name=HemolysinCabind; Domain location=444 -461; Score=22.2; E_value=0.0019; Accession=PF00353.10; Description =Hemolysin-type calcium-binding repeat
  Pfam module annotation: Pfam domain module=Exo_endo_phos::HemolysinCab ind::HemolysinCabind; Domain location=105-419::426-443::444-461
MFKPSNVFPATSAAAAQMTDDNARRRLVLDDGSSVQNPNPIPFIGEDNTLRAGDVVENLTGVIDYGLITASNPGPRDYKLHPTEAVQFTRENQRTAAPASVQGNLKIASFNVLNYFTTFTNGATAGGQTGQGCSLGSSVSASNCRGANNLVEFNRQRSKIIRALTAMNADVVGLMEIQNNGATAAQNLVDGLNAALGTHTYAVIADPVTGTGTDAIKVAMIYKPAKLTPAAAALSDNDSINNRPTLAQTFVAANGEKFSVLVNHFKSKSCSDSAGANQDQGDGQGCYNPQRIAQANRLLQFINTVQTQSGDSDVVVIGDLNAYGKEDPILALTAGGLQDQVARFNGDTDYSYVFDGESGYIDHALASNSMAAQITGTLHWHINADEPFVIDYNTEFKPQDLYTDSPYRSSDHDPVIVGVQLVKAITGSSQRDTLVGTAGDDVITGGVGADTITGGAGRDTFVYQSMRDATDTITDFTPGEDQLDIAELLQSIGYTSSQPFADGVARWVNVAGGVQLPIDTDGTG

SEQ ID NO: 94450 - protein, 173 aa, Glycine max
  Coding DNA Sequence Number=SeqID_2765
MDLIENMATSDIDILRDRAHIPKKKSLMELTSQDALLQGVPSVVELTILAAVSLMKNQLMKSIIWGTRQDKISMPQQQGLSLYDRTTKLEETLAQFMQLADRPSSNFSANTEKNPKEKCKAIMTRSRMAIQADEGRAEEKVGGYKQQLTAEPALEPVSDFVELKEVVEDEDDQ

SEQ ID NO: 94451 - protein, 385 aa, Glycine max
  Coding DNA Sequence Number=SeqID_2766
MEASKYLTTLEAFGSGPNMSISHMAKGQGELRQHLIKGVVNPLLNSSPSGMTIYGGSLERLLDDGLELPNLLGASQLGEHVFLSIAFTKDVIHFETFKIFDERLHNVIVLEQHCFLGLACVGNLPLDKLQVYVASKLLSSDFSAWLFEALKLSLRACTRVTLLGPSRMIPASLPFTLDAPSTLSLNLLDGVVRLDYHLMTLKVGPKSSGRGACRICGVPRRLLSSPPHVGISVVGVHSSFAIDLFDHDDIGELGRKPDFSNEHIGDAPMLVTSEVPTEPRALPGFRFKLQLDKLFDGFRASIGGVISRIYVKFTAQDGLVDNQGSDLRPFLHGHDSSDFSHCVYVSLSEAPARSTRYKNLAENLPCKHTLSALSLAKRVIRHLPG

SEQ ID NO: 94452 - protein, 96 aa, Glycine max
  Coding DNA Sequence Number=SeqID_2767
  Subcellular localization annotation: CTP_CleavageSite=31; ConfidenceScore=5.02e-01
MPMRGRNNTIVNTHRRRTKHAIGRLGRRPTKVTKKTQNKTHKKTQPSFFKRKKKDSKKDVKVTNEGHEEVAMARKKRNGEEEEEATKIVKKKKWRK

SEQ ID NO: 94453 - protein, 137 aa, Glycine max
  Coding DNA Sequence Number=SeqID_2768
  Subcellular localization annotation: CTP_CleavageSite=38; ConfidenceScore=5.44e-01
MAESSKKRKGVSTSSAATETRSHGASRAQTAPIPPSISSSMLFSSKEQRIWYTSFFSSHSILDPKFLDLKFFDDEMFDCFQAFQNSGLIEFMSMKLPFYPELVRAFYSNLEIQEGTLVSEGIIDEDWKFDFSGHDAC

SEQ ID NO: 94454 - protein, 165 aa, Glycine max
  Coding DNA Sequence Number=SeqID_2769
MYPVQLIEGRHKTDIKESSLNHSLMATVSLKHKCLSYPSITTSKRWKTGESERATASPDRESERSVASPTGESGGAAASPNGESEMIIIGGNGGTASSLGESGFATRDYGSVALVQPVQLCSIGTKVWELWTSDHIVADRGARVDDEWLSPAEALVFLFLDAICK

SEQ ID NO: 94455 - protein, 333 aa, Glycine max
  Coding DNA Sequence Number=SeqID_2770
MVWAFEILCPFFNIRPSVSIFFQMKLSGKIGWVSLNNISKKLFEFDSSIFHRFKDRFFKVLATGVMADASLDVRAILSLSLVSNSLAALGGIMRDFAWRSLVKQVGSASQPAGEAGPVVVMVEVTPNAPSSVLAKRKSDDVVGPSGHKKLMAPMSLRALRQVAPATTTTTPAPSPSPVVTVQEVTSVVVEVTMRATQTDSVMAPSSTVATPLLSVDVATTSAPTAMQKVATLEVEVTKWRAIARTLWRVECPKVANAIVAFIEVVRSNCQLSSKFGGLLAKLLCTRADFDLLAKPICRLSKPFAERITLASERKEESRRRMSWTHALSEGSSR

SEQ ID NO: 94456 - protein, 168 aa, Glycine max
  Coding DNA Sequence Number=SeqID_2771
  Homolog annotation: Hit_ID=Q6Z8F0; Match level="QueryCoverage=30%, HitCoverage=47%, E-value=4e-15, Identity=76%"; Hit description =Putative uncharacterized protein P0459B01.18
GTWARSATEDASPDYNSDAEGDRFSWWAFPGSLAVTKGILRVAPPDLRSRWERACTQRVVDGSRTDRLARDWSRAWLIHHFITAKSGHEPQISTNHEAGARGRRALGLMASGATCVQRLDGSRDSAIHTKYRISLRSSSMQEPRYPLPRVIDEEAGRTGRRGHPLPPD

SEQ ID NO: 94457 - protein, 291 aa, Glycine max
  Coding DNA Sequence Number=SeqID_2772
  Gene Ontology: Mol. function=oxidoreductase activity, acting on single donors with incorporation of molecular oxygen, incorporation of two atoms of oxygen
  Homolog annotation: Hit_ID=A0JWL2; Match level="QueryCoverage=97%, HitCoverage=77%, E-value=2e-54, Identity=38%"; Hit description=Cupin 2, conserved barrel domain protein
  Pfam annotation: Domain name=Cupin_2; Domain location=87-160; Score =25.1; E_value=0.00026; Accession=PF07883.2; Description=Cupin domain
MKEKAALYSKLKEQNLVPLWLVEQDVLPLRPNPAAIPWLWKWDQLYELAATSGKLVNLEEGGDRRALGLSNPGLNGKPYATETLWMALQWLNGKEIAPPHRHISQASRFIIRSEGSYSTVEGNRIFLERGDYVLNPPMLWHDHGSTNDKHAIWLDALDIPLTNYLNANFFESYHLDQQEITKKMNASVLKHGNGNYRPLWEPSNNEYPPVSVFKWKDTLKALNDLKEADEASPYDDVALEYVNSFNGKAVMKTFGASIQMIRPKVHTKAHRHVSSNVYYVFEGNGYSVIDG

SEQ ID NO: 94458 - protein, 120 aa, Glycine max
  Coding DNA Sequence Number=SeqID_2773
MNDLVYVMYNLKLKSRQTRKTVALPFEDMEFDDEWITEEGDDIFDEDNLQVEQEQPLGESGSGSNIDLVGGSLTDPTLDAFDIDNLVLNDNVEDHFSTEEELEDDDGDIGDDFIRGLMNI

SEQ ID NO: 94459 - protein, 165 aa, Glycine max
  Coding DNA Sequence Number=SeqID_2774
HVVKIDVDNLNTFLETSVVLAEGETLPAYSKYCGLPADIREIKVALCIPSRGFVLNAEGQPGKILRKDLTTLAQADLWPSLSDGHECGSSHLWVASDSLVFERLSPIINLAYIRKNCWNPDDLEVTIRGAKRARTRPVEALSTSIAPPPARTLAAPSTSTPADFQ

SEQ ID NO: 94460 - protein, 181 aa, Glycine max
  Coding DNA Sequence Number=SeqID_2775
MATMMEAMMSMKKIMEANAVAVAATSAVAKVNPMPSSNLNQMNHPSSDMVGKDLGSTDGPMMCKFKTSTTSRHMACLPTIHHPMWRTLPMRMSITPLPYSLRADNLIIYATEGQVVGGIPLQNTLEGPQFRPQPQPFYGKMVGYTPSSFENLVFADERIKVGPEKGKSDHPALMIAKNWGK

SEQ ID NO: 94461 - protein, 172 aa, Glycine max
  Coding DNA Sequence Number=SeqID_2776
  Gene Ontology: Mol. function=sequence-specific DNA binding
  Homolog annotation: Hit_ID=A8GK39; Match level="QueryCoverage=65%, HitCoverage=100%, E-value=2e-49, Identity=87%"; Hit description =Uncharacterized conserved small protein-like protein
  Pfam annotation: Domain name=Gp49; Domain location=6-53; Score=61.1; E_value=3.7e-15; Accession=PF05973.5; Description=Phage derived protein Gp49-like (DUF89
  Pfam annotation: Domain name=HTH_3; Domain location=115-170; Score =19.1; E_value=0.017; Accession=PF01381.13; Description=Helix-turn -helix
  Pfam module annotation: Pfam domain module=Gp49::HTH_3; Domain location=6-53::115-170
STLEDPHATGGAFRVVYVAKFSEAIYVLHSFQKKTEKTSRHDIQIIKARYDAVIMSGVKVMTKPIDTGSRHVTPAGGNVFADLGFSADEARQLQAQSNAEIAQLIALKKQLMGEISAWIEEEGYRQEEAARYLHTSRPRVSDVVNQKTEKFTLDALVNMMANIGKSVKLIVE

SEQ ID NO: 94462 - protein, 128 aa, Glycine max
  Coding DNA Sequence Number=SeqID_2777
  Homolog annotation: Hit_ID=Q6WAY6; Match level="QueryCoverage=96%, HitCoverage=20%, E-value=2e-07, Identity=30%"; Hit description =Putative uncharacterized protein
MVEEFEEILGCPLGGRKPYLFSGFYPSLARISKIVQILAQELDHRKQVENGVVGIPRKCLEAKARILVGKGKWAPFIDILALLIFGGVLFPNVDGLVGLAAIDAFLAYHDRKESPVVVILADLYDTFD

SEQ ID NO: 94463 - protein, 157 aa, Glycine max
  Coding DNA Sequence Number=SeqID_2778
MDKGMTLADAPRSSMAFSNLLFPIRQGGNGRGIGGCDSEWRLLSLVEIVYSGWSFASLTLLRKVEEEPQLLVVFVVIATVVVVVLEEEHMACLDQQHSEKEGQTIVVVEDLSISDLEDSSNLDCIYYLKGHNYFAVVGFATEEVYYKCLQHKLQVAY

SEQ ID NO: 94464 - protein, 165 aa, Glycine max
  Coding DNA Sequence Number=SeqID_2779
MGFRLKEGFLAKRRKALVYAHPAERRLSGRTRRQLPMPSRQNEKAMEACGTDFTRDVSELDCKTESRGEGVLARPRPLSLSIDFLKDDLAVDDVPAREPLATLDTSYSRIVTLPSLSASSKAIEEFFNQYPLFCIWSFRKPAHRAERRAGFVVPSRDWNANPSRK

SEQ ID NO: 94465 - protein, 96 aa, Glycine max
  Coding DNA Sequence Number=SeqID_2780
  Subcellular localization annotation: CTP_CleavageSite=71; ConfidenceScore=5.10e-01
YNPGWRNHPNLRWSNPSQQRQQQQQPYFQNVAGPSRPYVPPPIPQQQLQQQPQKQQTVEAPPQPSLEELVRQMTMQNMQFQQETRASIQSLTNQMG

SEQ ID NO: 94466 - protein, 113 aa, Glycine max
  Coding DNA Sequence Number=SeqID_2781
MGKAEEVQETMKADMEAMKEQMAAMMEAMMSMKKIMEANAVAVVATNAVAKVNPTSPSGINQMNHPTSDMVGKHLGSTSDPHDVQIQDEHAFPPYGLPLNYTPPNVAYTLNEN

SEQ ID NO: 94467 - protein, 194 aa, Glycine max
  Coding DNA Sequence Number=SeqID_2782
DSDLNVWKPVEHSSDAKLAGESDPLGELMKILFYVYQNPVEVPWEANQFGLPEIGAKFYITHADLAEIISGDKCLNIAILQLWTIFMNECGRSKADQSLYGLLEPQSIQNAKERRQQCQQYIETWVKESQRQLYLGAYLNHAMKTITSSFEGMSNQGAPRWVEPKTNVQSGGFECGYYVMHWMWCIVTAGLKDD

SEQ ID NO: 94468 - protein, 142 aa, Glycine max
  Coding DNA Sequence Number=SeqID_2783
MSILASFIYLFFYSALLALSLYSHPQVLPPQPARTIAGHNHFSSHRHCSVCAVSNSEHVLHQRDSEFGSNTALKVIVVTHNAQCGINLQWHVHGGKVGGMGYVREREIQRREKGYTGTENVITKEREIGYMNYGGEKIEILF

SEQ ID NO: 94469 - protein, 95 aa, Glycine max
  Coding DNA Sequence Number=SeqID_2784
CPMCTVKKVIWTFQLPVTKDETSIQRMRDDMMQMHKSATGGCIIPFEKHIAAIGTTSNNMLSKRKTLDEGSLLSSKSETQHDHRFTSTPYVPMDP

SEQ ID NO: 94470 - protein, 65 aa, Glycine max
  Coding DNA Sequence Number=SeqID_2785
MLHHCGHLLFHGLHVGLPLLLYLLLFTHYSSSSTGKNAMSNATNEKHGCETGSNKDINSPKCVWQ

SEQ ID NO: 94471 - protein, 80 aa, Glycine max
  Coding DNA Sequence Number=SeqID_2786
MFQERNTRGVATNVYLRKNVGKTGEDMVYELYVKGSGVVFTHGEGKGRRSLPPSLPRRARLLPLEATAFWRNILEGPSGP

SEQ ID NO: 94472 - protein, 97 aa, Glycine max
  Coding DNA Sequence Number=SeqID_2787
  Subcellular localization annotation: CTP_CleavageSite=78; ConfidenceScore=5.04e-01
MQCGLTMEGFNIRQRTRLSARKPHSHPWLTPVVAAPQKQKPGPPSAPRQAGSSSPMSLSGKAAKRHRTPAGFGRERFRADVQGQRLQTAVPSRSLAT

SEQ ID NO: 94473 - protein, 126 aa, Glycine max
  Coding DNA Sequence Number=SeqID_2788
MPGILSRLNATIYCRIREAITRQQGVPTSLYRSSALPLCSLTSSHTLHTKSMITASHSNAMLGDVYAYGLISGRGSVRDFTKPAVGCLRGSVNLRRLQPLYGGSGIRVCCMDHGSRISQPLLLLAT

SEQ ID NO: 94474 - protein, 36 aa, Glycine max
  Coding DNA Sequence Number=SeqID_2789
ARLTGALSKGGKMRGVATNEGISTSHVRLKGQQPIF

SEQ ID NO: 94475 - protein, 123 aa, Glycine max
  Coding DNA Sequence Number=SeqID_2790
  Subcellular localization annotation: CTP_CleavageSite=48; ConfidenceScore=5.06e-01
MAVQLQYPMKRFSTFCRVGLPRSLSRIGHVRSLKEPKTSLSGKSQEVDAGLASVCPQVLEYSNGSLGNHPPTIGCPRVKRCILLKPEVTQNSYTASRRGYSLTKTGILVEGRAPQLLYPEVGT

SEQ ID NO: 94476 - protein, 141 aa, Glycine max
  Coding DNA Sequence Number=SeqID_2791
MMQSYPARALDRRLQEDWARDAREGPRVLMSLRDVLYLTMFMCSMLSPELLNPDVSCMFSLIPIKRHPQMSLVGLNLTRTALRHNITKTSLRVKGGVLSEFTLAQCLCTAHPSSRFFYTLSRRIMRLADGSPSAWRGSASS

SEQ ID NO: 94477 - protein, 484 aa, Glycine max
  Coding DNA Sequence Number=SeqID_2792
  Gene Ontology: Mol. function=enoyl-[acyl-carrier-protein] reductase (NADH) activity; Cellular component=chloroplast; Biological process =metabolic process
  Homolog annotation: Hit_ID=A3BWT0; Match level="QueryCoverage=95%, HitCoverage=98%, E-value=5e-96, Identity=48%"; Hit description =Putative uncharacterized protein
  Subcellular localization annotation: CTP_CleavageSite=47; ConfidenceScore=5.25e-01
MATTTVSNLPIAMSRPKIPSSQRIANVCPAILGGRSKVGSCYKLASVCHVASAQPFHQGLAMTSGAAKYGKILTKAMSESSSNKEVAGLPIDLKGKRAFIAGVADDNGYGWAIAKSLAAAGAEILVGTWVPALNIFESSLRRGKFDESRKLQDGSLMEIAKVYPLDAVYDNPEDVPEDVKANKRYAGATNWTVQVEGIKVADMARHIPTPEMAVRTHDVDLKSTVSRTQTKPEYPNANKNACREGHGCCGKYSNGASVEGSRHEGRGFRRRQVVQIFPPRIRGYPKSSLQSPPRRKSLADLEVAESVKKDFGTIDILVHSLANGPEVSKPLSETSRKGYLAALSASNGSAISLTYIASERIIPGYGGGMSSAKAALESDTRVLAFEAGRKKRIRVNTISAGPLGSRAAKAIGFIDMMIDYSFTNAPLQKELHAEEVGNTAAFLSSPLASAITGAVIYVDNGLNAMGVGVDSPIFKELDIPKEHH

SEQ ID NO: 94478 - protein, 83 aa, Glycine max
  Coding DNA Sequence Number=SeqID_2793
MNVVSFFFSDDIRRHLCGQRTNIVEWRRKRERRHHFKEKMSLEEAHHHRWPWIRAWRKKEMNEGRGREEHEILCSKRALKSEV

SEQ ID NO: 94479 - protein, 315 aa, Glycine max
  Coding DNA Sequence Number=SeqID_2794
  Subcellular localization annotation: CTP_CleavageSite=25; ConfidenceScore=5.04e-01
MHKYTVVAVTVGVARSSASSLSCVVCVTVAVALETAAGLAAEDCCAVLFVASFLRSEFPFARETRVGLGVRPPIKQVYEGRTHGKYKRKPEQQPELGLGSQLRDGLPRITHSRVITVVDVKLFMVSTRGNMDARVEFLERGFEGIINMREDVATPIMEAAIATMQNGKIAIERGRRSNPDSHGRNGRKGTNLVPMPSMNQSPYELLLNLKHEGTVEEYHEKFELYAGPLRGTEPEYLKGIFLNGVKEVVRAELKLHPINTLPELMDYAQRIKNFVPHCPEALRYAKPYPCICKEAVSGFEPMTNKSPRHNFTADR

SEQ ID NO: 94480 - protein, 340 aa, Glycine max
  Coding DNA Sequence Number=SeqID_2795
  Homolog annotation: Hit_ID=A5B5V0; Match level="QueryCoverage=75%, HitCoverage=56%, E-value=7e-09, Identity=21%"; Hit description =Putative uncharacterized protein
MVEPSKKRKEEQHTRYTNLFSSHSIIDPKFIDMDFFSDESFKCTQAFQNSNLIPFMSLKLHVYSELVKAFYSNLEIQESTLISEFYGIKMVIDQSLFYDLTQLSSDGVPFEGTLDDDWKFDFSMHDACRLICSNQADMTRRLLAGSLALESRILHYLIVRILLPRSSNLAQVSEEDLIVMWAFHIGRQIDWAHLIRYRMHKALRLNAPLPYPHLVTLFLQHFNIPLDSEPYVPIKISFFIGAIVVTSFGYHKEHDGSWVKKGTQPNDDEGQLPVEGDSSLLQSILDRFDGLQTYVGERFDALEEQVDMQFDAMDSRITKVEEDVTIIRDCLDLPPQPPLV

SEQ ID NO: 94481 - protein, 72 aa, Glycine max
  Coding DNA Sequence Number=SeqID_2796
MTPVVTYPSAGGRCGAHGCVFPGRKMCKVANNVYLRKMLEKLEKVGFVADLGVAFVDDWGFLADRVVGNENC

SEQ ID NO: 94482 - protein, 78 aa, Glycine max
  Coding DNA Sequence Number=SeqID_2797
  Homolog annotation: Hit_ID=A5BEV8; Match level="QueryCoverage=100%, HitCoverage=9%, E-value=4e-12, Identity=42%"; Hit description =Putative uncharacterized protein
  Subcellular localization annotation: CTP_CleavageSite=42; ConfidenceScore=5.27e-01
MRYVIASRYNIILVSLSRQQSMTFFPLRSQPPPNSSVHRMICVSHVFGNHFVQVYLKDRCPLPPLALLWSTNCYSQAK

SEQ ID NO: 94483 - protein, 108 aa, Glycine max
  Coding DNA Sequence Number=SeqID_2798
  Subcellular localization annotation: CTP_CleavageSite=59; ConfidenceScore=5.15e-01
MTKKSPFDSICVFITVGHEMNCKGHKKLKSCSAKRSSRAKRNLWAQLASITKRNYSMLSVMRKSGRAQESRPCAKQDIRLLPGSTHDWHQAQIHLLVLSAMVALSVIS

SEQ ID NO: 94484 - protein, 93 aa, Glycine max
  Coding DNA Sequence Number=SeqID_2799
MKMVAKIGGRKVGEGNGKKKYGCGCEVEKGRWKKKINSHYGEKRIHLKWEENSPIEGIAFQGGALCRSRFFHRHVYEVNFIVHTILDMLGLKQ

SEQ ID NO: 94485 - protein, 132 aa, Glycine max
  Coding DNA Sequence Number=SeqID_2800
MCIVQDDVSQEVNDMTNPDHQGFHQGGPPGHNLGGNFSQGQGWRSHHGNNFNINQGVSSNRPPNQGPDLYDKTTKLEDTLHQFMYVSLSNHKSIEFAIKNLEPNGDGGKEIGDTTSRRRWVKNKLTTIGSHG

SEQ ID NO: 94486 - protein, 78 aa, Glycine max
  Coding DNA Sequence Number=SeqID_2801
MENCTKQSLRMAPNSWVEDAVATYPSAGGRRETRGMRFHERIRLRMENCTKQSLRMAPNSVGGGHMNENAIHGAPKKD

SEQ ID NO: 94487 - protein, 247 aa, Glycine max
  Coding DNA Sequence Number=SeqID_2802
RLTNLADNSIDLALVKEFYTNLYSPKGPSPKQVRIRGHLIRIDADSLNVFLETPVVLADGHPGKIHRKDLTTLAQVWSVLSYSNLAPTSRTLDLTMDRARRPRARPTEAPSTSAAPHPASTSAAPSTLPPTDFQHSIPMVEQFNEWVSWPGTQPPLHREDEDLAAQVPHQSEDESSESSTPEPLNRKRRVVVTQEVAATSEKSPEATPEPPTPVADTTSPQQEADPSTPEDQTTSVQSPNASPLATP

SEQ ID NO: 94488 - protein, 135 aa, Glycine max
  Coding DNA Sequence Number=SeqID_2803
MKNHEIHFGTRYSIEKFQGRLELQPYYQNEAERGSNIDKLLMQFMETTKSTQQALQSVEIQVGQLVEAVTQFMSRREKSFVEAEAQEKSPVKEHESREKDEEKDEEQAQQQWEKYSKVETNKKIFSKAIPSSSTN

SEQ ID NO: 94489 - protein, 108 aa, Glycine max
  Coding DNA Sequence Number=SeqID_2804
MAPKKLSTKRSRRDAAAEGSSATPEFDSHRFRSAELQQRFEAIKGWSFHRERCVQLREDKYTNFQEEIAHRHWTSLVTPMAKFDPEIVLEFYANAWPTEEGVRDMRSW

SEQ ID NO: 94490 - protein, 101 aa, Glycine max
  Coding DNA Sequence Number=SeqID_2805
MAPRKLSNKISRRDAAAEGTSAAPEFDSHRFRSADHQQRFEAIKGWSFHRERRVQLMDDEYTDFQEEIARRRWTSLVTPMAKFDPEIVLEFYANAWPMEEG

SEQ ID NO: 94491 - protein, 125 aa, Glycine max
  Coding DNA Sequence Number=SeqID_2806
MGDQEETQEQMKADMSALKEQMASMMEAMLGMRQLMEKNVATATAVSSAAEADPTLLATARHPPSNIVGRGRNTLGHDGNRHLGYNRAAYPYGLPPNYSPLVLQDDAGHIASPVLEREPPQQPDE

SEQ ID NO: 94492 - protein, 141 aa, Glycine max
  Coding DNA Sequence Number=SeqID_2807
MSRGSGDLGDVSGRAPGSQQIKGTKTTKQEGLCGGWPAVNLELKNETRKLRGLLVIDYQGASGNRLPGCVIDYTEGHATASGNRLPRLCNRLPEMKSLKIPLLLACSGYETHCVAAQLDFRERVYPFLFFPVDRDGGAANP

SEQ ID NO: 94493 - protein, 189 aa, Glycine max
  Coding DNA Sequence Number=SeqID_2808
  Pfam annotation: Domain name=Transposase_23; Domain location=60-130; Score=0.1; E_value=0.0012; Accession=PF03017.5; Description =TNP1ENSPM transposase
DPANQGPARGVHHIKSDAAAHGILQPDAVQDSVPDAILGTCTASRASGWSLQSSRNDPETGDSDRCGFYIEEDPARLVTLGRVYEGSTIVHNTPLLPSQVNVGVEEVTDADAPVPVPTDEVSLVGHALHTFLAWPTHLVKSLSQQVTWDATVFGVFNPDFPLYIKHEDLSKIAHGGQCLNISVLQLWIL

SEQ ID NO: 94494 - protein, 124 aa, Glycine max
  Coding DNA Sequence Number=SeqID_2809
MGEVEEVQKQMKADMEAMKEQMATMMEAMMSMKKIMEANVVAVVATNAVAKVNPMPPSGLKQMNHPTSNMVGKDLGSTGGPHYAQIQNKHAFPLYGLPPNYTPPNVAYTPSEDVNNSAPILIES

SEQ ID NO: 94495 - protein, 419 aa, Glycine max
  Coding DNA Sequence Number=SeqID_2810
  Gene Ontology: Mol. function=motor activity; Cellular component=cell projection
  Homolog annotation: Hit_ID=UPI00016621D1; Match level="QueryCoverage =83%, HitCoverage=40%, E-value=1e-22, Identity=31%"; Hit description =UPI00016621D1 related cluster
MVTSEPYTVAMKGTMHKPQVNLGADQKFPTFNVQSCEFGMTGPLDESISCCTPSTSEDYTSSTSDDYTGLNVLAFRGLHALAIRGLHVLTIRGLHVLTFRGLHALAIRGLHILAFRGLQVLAFRGLHALAFRGLHVLTFRGVHALAFRGLHALAFRGLHALAFRGLHALTFKGLCTLTFRGLHVFAFRGLHALAYRGLHILTYRGLHVLAFRGLHVLAFRGLHVLSFRGLHALSFRGLHILTFRGQQALTFKGLHALAFRGLHIFVFRGLHALTFRGLHVLALRGLHVLVFRGLHLIAFRGLHALAFRGLQVLAFRRLDILAFVGQNVLTFRGLHALTFRGLHALTFRGLRTFTFRGVHALAFRGLQVLTFRGLHVLAFRGLHVLAFRGLHVLTFRGLLILAFKGLDVLTFRGLHALAF

SEQ ID NO: 94496 - protein, 103 aa, Glycine max
  Coding DNA Sequence Number=SeqID_2811
MGRNILPERKVELYHTKLDNFKAELERRNFHKRLTNLADESIDLALVKEFYANLYSSEDRPPKQSRVRGHLVKIDADNLKRIPGDTCAFQEGSRLTFTFLTSS

SEQ ID NO: 94497 - protein, 103 aa, Glycine max
  Coding DNA Sequence Number=SeqID_2812
MESGDMRGYLMVIPTFRQPGANKLVDVQKLTSPSAPFVVLTREVRFYSRHLETIKPGDARDSSLLGRDDRVQWRMEVSWLSNFVAFKTLKFVGASDAFSILSE

SEQ ID NO: 94498 - protein, 40 aa, Glycine max
  Coding DNA Sequence Number=SeqID_2813
MAVCGGYWWLWVMEKVLGTLEMRIISNWAWIQNWAEPAWT

SEQ ID NO: 94499 - protein, 77 aa, Glycine max
  Coding DNA Sequence Number=SeqID_2814
MVAQEDQEMKPHQEETEIVNLSVGKERKEVKVGMGMTTPLFPGKTKAKKDQARDVLKDLRRGKKAVRCWLFGSGLIP

SEQ ID NO: 94500 - protein, 69 aa, Glycine max
  Coding DNA Sequence Number=SeqID_2815
MDEDQWAYYSVMSEEVDMDFQDEEDCGVNEAHVDCSDAFNTSQVFATREDVLKWARTVAHENGFVAVIM

SEQ ID NO: 94501 - protein, 114 aa, Glycine max
  Coding DNA Sequence Number=SeqID_2816
MGSKIYPKVHENPRAFFSSSSLSLLESSIQYPWGSEVGQVHLQMRKMLLVESFASQVLQGKVVEEPQLFVVSEAVAIVVVVVGLVEECMVCLGQQHSENKAVVVAAAVVKDSTI

SEQ ID NO: 94502 - protein, 81 aa, Glycine max
  Coding DNA Sequence Number=SeqID_2817
MAQPPPRERTLREMAAPDFTYERLCEDPHKTSERIPYCLLHHETSRCPRRSHLSEGLSSFIRGSGKGLALLPCSKVHHEQG

SEQ ID NO: 94503 - protein, 231 aa, Glycine max
  Coding DNA Sequence Number=SeqID_2818
  Gene Ontology: Mol. function=aspartic-type endopeptidase activity; Cellular component=small subunit processome; Biological process=DNA integration
  Homolog annotation: Hit_ID=A5BEY3; Match level="QueryCoverage=93%, HitCoverage=19%, E-value=2e-22, Identity=30%"; Hit description =Putative uncharacterized protein
  Pfam annotation: Domain name=zf-CCHC; Domain location=126-143; Score =13.9; E_value=0.012; Accession=PF00098.14; Description=Zinc knuckle
MKVTTLKQTSHDMIAHVGKAWAVVEELRKFLVVDSLEEVNMKLDKFYMVLILKSLHSDFDHVRDQVLTGDQVPSMDSLITRLLRVPHLLKDENPTDGVETSAMVVSRGRGGIHNSRGSRSGRGGRSRCTYCKRMGHTQENCYSLHRFLNKVAQVSRSEKAESRFYDEEYQEYLKLKSEKPSNQAQSSSVPYFSIACISQSIEGPSPWILESGASDHISGITWDGATDSRRT

SEQ ID NO: 94504 - protein, 112 aa, Glycine max
  Coding DNA Sequence Number=SeqID_2819
  Pfam annotation: Domain name=zf-CCHC; Domain location=33-50; Score =28.1; E_value=3.3e-05; Accession=PF00098.14; Description=Zinc knuckle
METHIGENRTRPLLSNMCGKPGHNSSNYVDKGTTCFNCRQKGHIQRDCPYPKKEQNGESLNDQTRLLKTTGSDAILPRKGPVTRAMSKRLQEDWARAAEEGPRVLMNLRVDF

SEQ ID NO: 94505 - protein, 91 aa, Glycine max
  Coding DNA Sequence Number=SeqID_2820
MSGFTRNSPQISASPHQLDLAPYASEPYNAQWNAPGLFRDKHTLRSSRILGEMEVDEPWLGLWLPLNYQVVFVIGSAVDRLCGRFRDGLCG

SEQ ID NO: 94506 - protein, 86 aa, Glycine max
  Coding DNA Sequence Number=SeqID_2821
  Homolog annotation: Hit_ID=A5AG41; Match level="QueryCoverage=45%, HitCoverage=3%, E-value=3e-08, Identity=56%"; Hit description =Putative uncharacterized protein
MTTTKGNRGRNELVLNERDWVWLHLRKDRFPTKKKSKLSPRGGVDTEEEEPTNLRSNPLQGGRDDAILPRKGLITRAMSKRLRGLG

SEQ ID NO: 94507 - protein, 196 aa, Glycine max
  Coding DNA Sequence Number=SeqID_2822
MGDQEETQEQMKADMSALKEQMASMMEAMLGIKQLMEKNAATAAAVSSAAEADPTPLATTHHPPSNIVGRGWDTLGHDGSPHLGYNRTAYPYGLPPNYSPPILQEDAGHIASPVHEKEPPQQPDEVHKDPQDYARRDVEFYPPIPEGPAPGTLPQPNLAASPIVLSMEGPPPATEERRKLDLLEERLRAVEGFGDY

SEQ ID NO: 94508 - protein, 57 aa, Glycine max
  Coding DNA Sequence Number=SeqID_2823
MWRPVRVMLICENVPTIWDQYRLKGSLKPSVFIPKAYTPKSLSRPLPPDSGPTQKTF

SEQ ID NO: 94509 - protein, 119 aa, Glycine max
  Coding DNA Sequence Number=SeqID_2824
MCREFKERLLDLGVEVSPVLPPGDQESSQVSGGSQLSLKDAFLSKAKVKTISEINGISEDVVCVTVGTISKIVMDNHSWYRVEVMVTQNNESSKFLLWDHECAELNDQTADEVNRVKIE

SEQ ID NO: 94510 - protein, 223 aa, Glycine max
  Coding DNA Sequence Number=SeqID_2825
MWRHFRRSARHGRCCKDKELRGSNNGPIGGYREWLKAHVQGLDWLPSLKATKREEGEAPEEDEGVQALRTELKQAQTVKERFKSAALKIRKENVELRDVNIATTKALEQETKMARREEHSRNKFRGALWGKTNMLAIISKYQEELSLATAHEHRVADEYAQVYAEKETRGRVIDSLHQEATMWMDRFALTLSGSQKLPRLLTKAKAMADTYSAPEEIHGLLSY

SEQ ID NO: 94511 - protein, 181 aa, Glycine max
  Coding DNA Sequence Number=SeqID_2826
  Subcellular localization annotation: CTP_CleavageSite=22; ConfidenceScore=5.01e-01
MASRKRSRTDDISSSSIPAPQSAAIGPDVQHSQTLVPMLQSLFRGQLIIMPSLRELAHNRPIISMEHFLEQVAWPEAQLPLVRPNEATPPEPAPARVEPMPAEPRSPVVNPPPSPELEVVPPSPSLIIISDASSDETTALLIHQLEKQLIPLIPQLEELPIFLILHLEKFLLSLIPPFRHC

SEQ ID NO: 94512 - protein, 109 aa, Glycine max
  Coding DNA Sequence Number=SeqID_2827
MIESFQQQQQMSVLELYVEKDVAGGRNVSHHESELSRNISNLHDDDDDDDYLASNSYVEESFDEDDSDDGISDTDNEVTDIVDQSHLFTQPERYMSCEYGNLVDTSIFL

SEQ ID NO: 94513 - protein, 221 aa, Glycine max
  Coding DNA Sequence Number=SeqID_2828
IDANNLNVFLETPVVLTEGESLPAYSRYCRMPTDIKEIEVALCIPGRGFILNAEGHPGMILRKDLTTLTQVWSVLSYSNLAPTSHTLDLTVDRARGVASNSLVFERLSPARPAGVPSTSAAPHPASTSAAPPPAHMTTAPSTLPPVDFQHSILTVEQFNEWVAWPGTQPPLHREDKDLAAQVPHQPEDESSESLTPEPLIRKMKVVVTQEAAATSEKSLEA

SEQ ID NO: 94514 - protein, 68 aa, Glycine max
  Coding DNA Sequence Number=SeqID_2829
MGKVLVYELNLKGSGVVFTHEEGKRGRRLLPRSSRRAGLLPPEAIQLRKTIWKAQFKNFKITICIPPF

SEQ ID NO: 94515 - protein, 86 aa, Glycine max
  Coding DNA Sequence Number=SeqID_2830
MESEEDKHHGGSRDESSGASSDNFCTTKHGSPDKNTCQEICWKTEIVHWKKGNELNDTPETGKRMIEERQRAKGLTRATSKMLVGK

SEQ ID NO: 94516 - protein, 325 aa, Glycine max
  Coding DNA Sequence Number=SeqID_2831
  Gene Ontology: Mol. function=peptidase activity
  Homolog annotation: Hit_ID=A7PL17; Match level="QueryCoverage=93%, HitCoverage=93%, E-value=1e-140, Identity=83%"; Hit description =Chromosome chr7 scaffold_20, whole genome shotgun sequence
MANSSLLPKPYYYHNFHYQHLRCFKINLPKWTTSTRASSAAPGVDLNTLEFAISKKDSDAVKEALNQLSEVGWAKKWSSQPYVSCRTTSLRELTSLGIKNSENLAIPSVRNDAAFLFTVVGTTGFLAVLAGQLPGDWGFFVPYLIGSISLVVLAVGSISPGLLQAAIGSFSTLFPDYQERIARHEAAHFLIAYLLGLPIFDYSLDIGKEHVNLIDERLEKLIYSGQLDAKELDRLAVVSMAGLAAEGLTYDKVVGQSADLFSLQRFINRTKPPLSKDQQQNLTRWAVLFAASLLKNNKVTHEALMAAMTKKASVLECIRAIENAA

SEQ ID NO: 94517 - protein, 30 aa, Glycine max
  Coding DNA Sequence Number=SeqID_2832
MANRNKTPKYRDRYNYTVKDNLMGHQGVAS

SEQ ID NO: 94518 - protein, 324 aa, Glycine max
  Coding DNA Sequence Number=SeqID_2833
  Gene Ontology: Mol. function=nucleotide binding; Cellular component =intracellular; Biological process=small GTPase mediated signal transduction
  Homolog annotation: Hit_ID=A5AXG5; Match level="QueryCoverage=99%, HitCoverage=94%, E-value=1e-101, Identity=61%"; Hit description =Putative uncharacterized protein
  Pfam annotation: Domain name=Arf; Domain location=7-184; Score=-89.9; E_value=0.01; Accession=PF00025.12; Description=ADP-ribosylation factor family
  Pfam annotation: Domain name=MMR_HSR1; Domain location=10-150; Score=- 17.3; E_value=0.041; Accession=PF01926.14; Description=GTPase of unknown function
  Pfam annotation: Domain name=Miro; Domain location=13-150; Score =25.9; E_value=3.8e-05; Accession=PF08477.4; Description=Miro-like protein
  Pfam annotation: Domain name=Ras; Domain location=20-223; Score= -43.9; E_value=4.6e-06; Accession=PF00071.13; Description=Ras family
  Pfam module annotation: Pfam domain module=Arf::MMR_HSR1::Miro::Ras; Domain location=7-184::10-150::13-150::20-223
MGALRVMLMILAAMWGVVRVGKTSLVNLIVKGSPIARPPQTIGCSVDVKHITYGNSGSSSSSLKGDSERDFFVELWDVSGHERYKDCRSLFYSQINGVIFVHDLSQRRTKTSLQKWAAEIAATGTFSAPLGSGGPGGLPVPYIFIGNKADIAAKEGTRGSSGNLVDVARQWVEKQGLLPSSEELPLTESFPGNGGLIAAAKEARHDKEAVVKFFRMLIRRRYFSDEIQIPSPAWSIPSVQRQAQRIDENFTEDDQSYDTSLSSDPYKYNMLPPLPAQRNLTPPPTLYPQQPVSVSENYSFPRFSLSGSSEISTVARTKRSDINV

SEQ ID NO: 94519 - protein, 66 aa, Glycine max
  Coding DNA Sequence Number=SeqID_2834
  Gene Ontology: Mol. function=structural molecule activity; Cellular component=chloroplast; Biological process=iron-sulfur cluster assembly
  Homolog annotation: Hit_ID=A7PL00; Match level="QueryCoverage=100%, HitCoverage=62%, E-value=4e-27, Identity=82%"; Hit description =Chromosome chr7 scaffold_20, whole genome shotgun sequence
MDFEDRVNKRPDDSIIEYEVCDPKSLLFIFGMQLDYSDALIGGGFSFKNPNATQTCGCGKSFAAEI

SEQ ID NO: 94520 - protein, 484 aa, Glycine max
  Coding DNA Sequence Number=SeqID_2835
  Gene Ontology: Mol. function=hydrolase activity, hydrolyzing O -glycosyl compounds; Cellular component=anchored to membrane; Biological process=carbohydrate metabolic process
  Homolog annotation: Hit_ID=A7PKZ4; Match level="QueryCoverage=94%, HitCoverage=92%, E-value=1e-158, Identity=61%"; Hit description =Chromosome chr7 scaffold_20, whole genome shotgun sequence
  Pfam annotation: Domain name=Glyco_hydro_17; Domain location=30-349; Score=325.3; E_value=1.1e-94; Accession=PF00332.9; Description =Glycosyl hydrolases family 17
  Pfam annotation: Domain name=X8; Domain location=370-452; Score =126.9; E_value=6e-35; Accession=PF07983.4; Description=X8 domain
  Pfam module annotation: Pfam domain module=Glyco_hydro_17::X8; Domain location=30-349::370-452
MKASGGGNNNEQEMRPGLQGGEGAEAVSGIGVNWGAIASHPMDPPIVVNLLKDNGIKKVKLFDADSWTVSAFSGTDIEVMVGIPNDQLKELSKDQDNAEDWVKQNVSKHVHDGGVNIRYVSVGNEPFLKSYNGSFVGITFPAMENVQKAIDKAGLGDKIKVTTALNADVYESNSNKPSDGNFRKDIYGVMKQIVKFLDEKKSPFLVNIYPFLSLYQNEDFPEDYAFFEGHGKSTDDKNAHYTNMFDANLDTLVWSLKKIGHPNVSICVGEIGWPTDGDKNANDKNANRFYQGFLKKMASKKGTPLHPGPVNTYLFSLFDENMKSVAPGDFERHWGIFRYDGKPKFPIDFSGKGEDKMPIGAKGVRYQEHKWCVLKNNANKSALGGSLSYACAGGDCTSLCPGCSCGNLDASGNASYAFNQYFQINDQSVEACDFEGLATIVSKDPSKGDCYFPIAIISSGNILRVMQNVVGILIGFTLIFTTFM

SEQ ID NO: 94521 - protein, 124 aa, Glycine max
  Coding DNA Sequence Number=SeqID_2836
  Homolog annotation: Hit_ID=A5ATU3; Match level="QueryCoverage=66%, HitCoverage=23%, E-value=1e-11, Identity=44%"; Hit description =Putative uncharacterized protein
  Pfam annotation: Domain name=Mito_carr; Domain location=50-111; Score= -9.1; E_value=0.021; Accession=PF00153.18; Description=Mitochondrial carrier protein
  Subcellular localization annotation: CTP_CleavageSite=36; ConfidenceScore=5.05e-01
MGPFSLSVMVNDSAISLPDTCTKRKQNLLLKNSFASVSMGDEKPFDFLRILFEGVIAGGTAGVVVETALYPIDTIKTRLQAGGCWKVPCRLPQLMGVIYLLIGRVHLMPIAFKMKSNNEEIGKL

SEQ ID NO: 94522 - protein, 101 aa, Glycine max
  Coding DNA Sequence Number=SeqID_2837
MAVAATTMVVDEAVVTGIATTVVNWDIWLGTAAKGAVADMEWRWQKVRWWWRRGGGRYGTAVAKDTMVVEEEAVAAEEVATVVESLGIWSEIAHQVLARLG

SEQ ID NO: 94523 - protein, 469 aa, Glycine max
  Coding DNA Sequence Number=SeqID_2838
  Gene Ontology: Mol. function=DNA binding; Cellular component=nucleus; Biological process=regulation of transcription, DNA-dependent
  Homolog annotation: Hit_ID=A7PKY2; Match level="QueryCoverage=98%, HitCoverage=98%, E-value=3e-48, Identity=41%"; Hit description =Chromosome chr7 scaffold_20, whole genome shotgun sequence
MVGYGRSLDRKAVKASGKCNLKTGSIGVRNSPKRTNKLDSKARGCSQELTDKENQYFPFKEHMRKCPELSNKCTFLTEKRKAIELHPGQMLTSAKIKLQLFPINEETRIGLEKDGHNPYLELTLRGRKKISSILKHLGKKWGSSSIANGDLILFPYNVMENLSDCRRWTINDSDTTASAVYAAVGTPALFRLKYGWFYMHEPGSFGIPSTPTPYKLVVPGGDNANLEETLRGERDEVEISKEYKETEVGNAASETVAQKVENAAVDPTDNEPRTRISSSLQQSSSPWVDSLSNISIGGLLSEASLFGGLDPKSFAGIQPCDITSDSLDAFIAAAQINNCPVPRLPADDLHTSILDAEETCHAFPLQKLSSPTDVQAACRKDYSAVCSQGVFSNLLKLSNIDKVNDQDGASQNPPSGKTQTDLLSSRPYDDDRSLGLTGINWNDSMGPFDLGMPAQKLIGGDGLTGKFVK

SEQ ID NO: 94524 - protein, 437 aa, Glycine max
  Coding DNA Sequence Number=SeqID_2839
  Homolog annotation: Hit_ID=A5BUX4; Match level="QueryCoverage=97%, HitCoverage=83%, E-value=1e-46, Identity=34%"; Hit description =Putative uncharacterized protein
MDPIILSDEEDPSTPFPLRPKKRRTEPDPNPNPNRTVFVIDDDPTPHKSATPSIVPETPMSALFDSDIAIVKCTIPSDPTARVSPKKFSAPSGISQMICLESDNESENCGMGTRDKNEPRDSRWISNSMGSGSSPGICLESDNELENCGMDKPVENEPRDSRWTSNSRESGSSPHICLESDNELENCGMGERGENELRESRWTSNSMGFGSSPERHISWGNATQTEMPGDDLSNPASSQVENMNMQQEENANNIKKSKVSAKNTTKAVGKTKMTKEERSRLMEEKKLQKEQEKLKKAALKAEAAELKKIEKEKQKWEKGKFAMKSIVAEIDAKVVELGSIGGHLLTRFAEKGLTYHITSNPITGSILWSMKVPEHISQLSTERIEIPYILLVYEADKFCNLVMNDSLFDQLSSIQSLYPAYTVCYLTNRLLAYINKK

SEQ ID NO: 94525 - protein, 444 aa, Glycine max
  Coding DNA Sequence Number=SeqID_2840
  Gene Ontology: Mol. function=nucleic acid binding; Cellular component= nucleus; Biological process=mRNA processing
  Homolog annotation: Hit_ID=Q9FT01; Match level="QueryCoverage=88%, HitCoverage=95%, E-value=1e-165, Identity=76%"; Hit description =Putative splicing factor
  Pfam annotation: Domain name=RRM_1; Domain location=163-234; Score =99.6; E_value=9.6e-27; Accession=PF00076.13; Description=RNA recognition motif. (a.k.a. RRM, RB
  Pfam annotation: Domain name=RRM_1; Domain location=347-402; Score =3.1; E_value=0.077; Accession=PF00076.13; Description=RNA recognition motif. (a.k.a. RRM, RB
  Pfam annotation: Domain name=RRM_1; Domain location=37-131; Score =12.9; E_value=0.0095; Accession=PF00076.13; Description=RNA recognition motif. (a.k.a. RRM, RB
  Pfam module annotation: Pfam domain module=RRM_1::RRM_1::RRM_1; Domain location=163-234::347-402::37-131
MTLRWPENLYQSYHRRFRVKKEASEPEADPERDQRTVFAYQMPLKATERDVYEFFSKAGKVRDVRLIMDRNSRRSKGVGLNETQLELSALEFLFPYISLLYALYIEFYDAMSVPMAIALSGQLLLGQPVMVKPSEAEKNLVQSNASGGAAGVAGPYGAVDRKLYVGNLHFNMTESQLREIFEPFGPVEVVQLPLDLETGHCKGFGFVQFTHLEHAKAAQSLNGKLEIAGRTIKVSCVTDHVASQDATAKSADLDDDEGGLTLNAHSRALLMQRLAGADPASIGLPVVNGSVPAQQAISLPIGAPVLPTLVMPNPVVEPVGNPSECLLLKNMFDPSTETEPDFDIDIKEDVEEECSKYGRVKHIFVDKKSAGFVYLRFDTVEAASAAQHAMHLRWFARRLISAVFMSPEAPCYAEGEESYPCICKKTDSRFEPMTNQTPRTERDP

SEQ ID NO: 94526 - protein, 67 aa, Glycine max
  Coding DNA Sequence Number=SeqID_2841
  Gene Ontology: Mol. function=inositol-3-phosphate synthase activity; Cellular component=cytoplasm; Biological process=phospholipid biosynthetic process
  Homolog annotation: Hit_ID=P42802; Match level="QueryCoverage=91%, HitCoverage=12%, E-value=9e-28, Identity=98%"; Hit description =Inositol-3-phosphate synthase
  Subcellular localization annotation: CTP_CleavageSite=35; ConfidenceScore=5.33e-01
MSLWLQQGKFHSFHPVATILSYLTKAPLVPPGTPVVNALSKQRAMLENILRACVGLAPENNMILEYK

SEQ ID NO: 94527 - protein, 432 aa, Glycine max
  Coding DNA Sequence Number=SeqID_2842
  Gene Ontology: Mol. function=protein binding; Cellular component=cell surface; Biological process=protein amino acid phosphorylation
  Homolog annotation: Hit_ID=Q63FD2; Match level="QueryCoverage=43%, HitCoverage=38%, E-value=6e-14, Identity=33%"; Hit description =Collagen-binding surface protein
MGGCATKPKVSQDDPDGKPKAPQPEPEPEPEHQQPNNKDTLQTKVPQVEQGAAHKDHNNLNVNEIVDDDQANKPRSLSSLFKQNEDKRGSTENEKNKVEESVKEEVLEVKKPAEDTKSNEPTVKQESLKPEEKLSEESKNNESSKQEYETLKAETHVNEPSKETVKRESEAEKPSEETHISEPVKETEKLESETEKPSVETHISEAAKETVKLESKAEKPSEETHINEPDKKTVIVESEAKKPSEETHINEPVKETVIVEAEKPSEETHINEPAKEIMIVESEAENPSKETLVNEPAKETVKLESDAEKPSEENNQSSESLKEEFVEAMEAPSEETQSIEPIKLKEEPIEPSEEGKPSGESEKNASETKTLIVESINSEVAPVPEERVIEEIPTAAKSFEKVTKEAASSTEEKSHNGVENAPKAVDAGAEIH

SEQ ID NO: 94528 - protein, 195 aa, Glycine max
  Coding DNA Sequence Number=SeqID_2843
MTVGEEIEQGCEAEKCEGSIKIPNGDVAALLGGRELAWECSNSNSNSKNPICTMQIMMIVDEKETLASQGKYKSIPQTHCILTYPIVLHTWQDGTGHIQICNMYQIVLRILKPPELISLAVWFLLTGFYCFAPFNELKYFLFQVISLSSFFGVSAATSLIPCAKYSNPHHLANLSGLVISISDCNHFVDIKELLT

SEQ ID NO: 94529 - protein, 418 aa, Glycine max
  Coding DNA Sequence Number=SeqID_2844
  Gene Ontology: Mol. function=ubiquitin-protein ligase activity; Cellular component=ubiquitin ligase complex; Biological process =protein ubiquitination
  Homolog annotation: Hit_ID=A7QB93; Match level="QueryCoverage=100%, HitCoverage=100%, E-value=1e-128, Identity=59%"; Hit description =Chromosome chr4 scaffold_73, whole genome shotgun sequence
  Pfam annotation: Domain name=Arm; Domain location=132-175; Score=1.4; E_value=7.5; Accession=PF00514.14; Description=Armadillobeta-catenin -like repeat
  Pfam annotation: Domain name=Arm; Domain location=227-269; Score =13.0; E_value=0.25; Accession=PF00514.14; Description=Armadillobeta -catenin-like repeat
  Pfam annotation: Domain name=Arm; Domain location=270-312; Score=7.5; E_value=1.2; Accession=PF00514.14; Description=Armadillobeta-catenin -like repeat
  Pfam annotation: Domain name=Arm; Domain location=313-354; Score=2.7; E_value=5; Accession=PF00514.14; Description=Armadillobeta-catenin -like repeat
  Pfam annotation: Domain name=U-box; Domain location=9-83; Score=60.2; E_value=7.1e-15; Accession=PF04564.6; Description=U-box domain
  Pfam module annotation: Pfam domain module=Arm::Arm::Arm::Arm::U-box; Domain location=132-175::227-269::270-312::313-354::9-83
MVRDDLCITVPSFFRCPISLDVMKSPVSLCTGVTYDRSSIQRWLDNGNNTCPATMQVLQTRDFVPNRTLQRLIQIWSDSVTLRVDSPESPTSTQSESVLSKDQILVAISELQTHCANRFDSLAKIARFAQDSEENLDFLVRTECFVPALVGFLDNVNDGVEFLEQVVTALDLVVSKMEDCEGLKNLILKRQGGGEKQSVDSLLLLLQQGSHVIKIASARVLKSLAVDAESKLLLAEKDGLLSELLNLITPEKDPDLMENCLSCLVSLSTPRRSKMKLVRLGAVKVFSNLLSTPSLSVSVTEKVLKLVETVSSTKEGRSEICEDSACVSAIVNKVLKVSSVATEHAVTTLWSVCYLFRDQKAQEAVTKANGLTKILLLMQSNCSPQVRQMSSDLLKIFRVNSKSCLSSYDTKTTHIMPF

SEQ ID NO: 94530 - protein, 257 aa, Glycine max
  Coding DNA Sequence Number=SeqID_2845
  Gene Ontology: Mol. function=DNA binding; Cellular component=nucleus; Biological process=cell division
  Homolog annotation: Hit_ID=A7PCD6; Match level="QueryCoverage=42%, HitCoverage=23%, E-value=2e-34, Identity=69%"; Hit description =Chromosome chr2 scaffold_11, whole genome shotgun sequence
  Pfam annotation: Domain name=Myb_DNA-binding; Domain location=197 -246; Score=27.4; E_value=5.4e-05; Accession=PF00249.22; Description =Myb-like DNA-binding domain
  Subcellular localization annotation: CTP_CleavageSite=56; ConfidenceScore=5.02e-01
MEFLDEDARPRFVFQSGAAARSSEPPHPIHKPTKPFLFATVSLSSLFLTLSLFFLEAEPFKSLLFWLALSLLVGPFAPPSITGGDVRVGRGEVVNFPDPEPEPDEDATRSEKRKESSGIEKRATGGGGGEGVERGGCGGAEEADGEESVDSVIKKAKELGEKRVDDSESYALFLKKRKALDKRVVEENADEGEKVVDNGWSSAEDIALLNALKAFPKEVSMRWEKVAAAVPGRSKAACMKRFAELKKGFRTAKAAAE

SEQ ID NO: 94531 - protein, 730 aa, Glycine max
  Coding DNA Sequence Number=SeqID_2846
  Gene Ontology: Mol. function=protein phosphatase type 2A regulator activity; Cellular component=protein phosphatase type 2A complex; Biological process=signal transduction
  Homolog annotation: Hit_ID=A7QB92; Match level="QueryCoverage=92%, HitCoverage=98%, E-value=1e-174, Identity=48%"; Hit description =Chromosome chr4 scaffold_73, whole genome shotgun sequence
  Pfam annotation: Domain name=WD40; Domain location=216-254; Score =36.3; E_value=1.1e-07; Accession=PF00400.23; Description=WD domain, G-beta repeat
  Pfam annotation: Domain name=WD40; Domain location=304-341; Score =39.4; E_value=1.2e-08; Accession=PF00400.23; Description=WD domain, G-beta repeat
  Pfam annotation: Domain name=WD40; Domain location=345-384; Score =39.8; E_value=9.7e-09; Accession=PF00400.23; Description=WD domain, G-beta repeat
  Pfam annotation: Domain name=WD40; Domain location=387-425; Score =1.8; E_value=19; Accession=PF00400.23; Description=WD domain, G-beta repeat
  Pfam annotation: Domain name=WD40; Domain location=489-529; Score =12.3; E_value=0.95; Accession=PF00400.23; Description=WD domain, G -beta repeat
  Pfam module annotation: Pfam domain module=WD40::WD40::WD40::WD40::WD4 0; Domain location=216-254::304-341::345-384::387-425::489-529
MDVFFDSVDSLSTQDSVLAKEEFGSGRCGYDEIWVKEPVSVKERRERFLQGLGLADSSSKVCSQEKMNLDDSSISLGLERIRECSGAISNACILHTDQVVSEKLILSGGKAASKEKISLDEFKGCPQDEAEANIQGKEHEFSSTAEEHRPREAVSQEEFQDFDMSKRKRKNWWKRFVNIRKSGEGNVRSKLNAGTNKTRRIKVRQNKKRWLEFSGLYLGQEVRAHKGLVWTMKFSPCGQYLASGGEDGVVRIWCVTSLDKSSICFTPEDSTSKSKVECDNSSPRKKHSSQPFIFLPNSVFQIEESPLQEFFGHSNDVLDLAWSNSDILLSSSMDKTVRLWQIGCNQCLNVFHHNDYAVTCIQFNPVDENYFISGSIDGKVRIWGIREERVIDWADIRDAISAISYQQDGKGFVVGSVTGTCCFYVASGTYFQLEAQIDVHGKKKASGNKITGIQADVRPEQLSYKLEDVATLFLMPNVYPTFLHQIGSYNVYCVGRGGEAFFGKMSSSFTSSGKHIISVGEDSHVYIWNFDDMGNASSKQTKSERSCEYFFSKGVTVAIPRSGMKADKRDSSGNYSHHSSEMPTQQLEVASEARDHKRFSLGNWFAIDGTCRGSMTWPEEKLPSWDLPITEDEYGHQQLCYKDNCHGRNVSETWGLSIVAAGCDGTIKTFHNFGLPALPGKGGNLQRCVMALESNVSGSKCGKTEFEAFASAYMMIIAKSMLSLKALEMF

SEQ ID NO: 94532 - protein, 266 aa, Glycine max
  Coding DNA Sequence Number=SeqID_2847
  Gene Ontology: Mol. function=transcription regulator activity; Cellular component=nucleus; Biological process=regulation of transcription
  Homolog annotation: Hit_ID=A2YQH4; Match level="QueryCoverage=47%, HitCoverage=41%, E-value=1e-42, Identity=72%"; Hit description =Putative uncharacterized protein
  Pfam annotation: Domain name=HLH; Domain location=133-180; Score =28.2; E_value=3e-05; Accession=PF00010.17; Description=Helix-loop -helix DNA-binding domain
METNTSAFTNVNSTWNLEKMETNEQQNDEHNIILQVQDPMGSGIWPSNNYHNLLQMHQTPNTTTLSIIAPPPSSSGFLGDILGVHNLEEDEEPEEELGAMKEMMYKIAAMQPVDIDPATIRKPKRRNVRISDDPQSVAARHRRERISEKIRILQRLVPGGTKMDTASMLDEAIRYVKFLKRQIRLLQSIPQSSNPPQCIGVATTSHHASTLLLAPSCDWPFAPNVLPSSTAATASMDMSAGLGFDVGHAHACDGSSSFNHHEVISE

SEQ ID NO: 94533 - protein, 359 aa, Glycine max
  Coding DNA Sequence Number=SeqID_2848
  Homolog annotation: Hit_ID=A7R1E2; Match level="QueryCoverage=36%, HitCoverage=32%, E-value=5e-43, Identity=67%"; Hit description =Chromosome undetermined scaffold_349, whole genome shotgun sequence
  Pfam annotation: Domain name=DUF966; Domain location=34-354; Score =118.1; E_value=2.7e-32; Accession=PF06136.4; Description=Domain of unknown function (DUF966)
MDVVRSQRGSSRNTSPDRAKICRMNKKVKPFRKVQVVYYLSRNGLLEHPHFMELTLLSNQPLRLKDVFDRLMALRGSGMPLQYSWSSKRNYKSGYVWYDLGLKDIIHPAEGGEYVLKGSELVEGCSERFNVSNKQQGIHQQAEAEAEANYNYNYDSRSKALGVCNKQQQQQKEREELEEYEEQEKEYEEGEKTSYTSSTTTPHSRCSRGVSTEELVYDEEENKNATKVNAEGTNKNKKNKGEKVKRRDGEGSVSSRYSALLQLIACGGGSTGEAAGEYLKGPRLSDVGTKENNKALFWEEMENPILLGNLQTEEKEYFSGSFLDSIKPNHGGGGEVQGNGTRQEEGRNERQMYPSHEIH

SEQ ID NO: 94534 - protein, 857 aa, Glycine max
  Coding DNA Sequence Number=SeqID_2849
  Gene Ontology: Mol. function=phosphotransferase activity, alcohol group as acceptor; Cellular component=Golgi apparatus; Biological process=phosphoinositide-mediated signaling
  Homolog annotation: Hit_ID=Q9FMJ0; Match level="QueryCoverage=99%, HitCoverage=76%, E-value=0.0, Identity=55%"; Hit description =Phosphatidylinositol 4-kinase
MVRFLGLTLGYAEEPREIASRSNLTSDSGENGWLIRFFDSAFFCEWIAVSYLYKHDHAGVRDYLCNRMYTLPLQGVESYLFQICYMMIHKPSPSLDKYVIDVCSKSLKIALKVHWFLMAELEDSDDNNGISRIQEKCRIAATLMGEWPPLIRPQTEPPSPGGKSQVLNRLLSSKNRLLSLTSSPPSQKSLSFSPSSGNNVQEDGKPLSPDENKIFKKFMPSPKVRDALLFRKSVDKDDDGSEKDGFFKRLLRDSKGDDELGQKIRDSFLFRKSSVKDDEDSEKDNFFKRFLRDSRGDDDDSEKDGFFRRLLRDSRSEDEDIASSSEGLFKRLFRDSKNDSEDRTHTKTIEDEDKEGFFRKFFREKSEDRKDGSHRNDHRDVANFEEKYAKPAEEDEKEGFFRKLFKDKFEDKKDTNDKIEEGTANGEEEESSEFSLFKRLFRVHPEDAKSSLVNENSNNGGLFESSPGTENFFRKLFRDRDRSIEDSELLGSKRQKEKHPGSPKQQSEKLSTKPPLPISLSQFRKGAYHDSMEFVQSLCDTSYGLVDVFPIEDRKSALREALVEINLHVAEVQNTGGVCFPLGKGMYCVLNIPEDEAVLLNSREKAPYLICVEVLRCEMPSNSKEASSSQKLSQGGIPLANGDALLQKPPPWAYPLRTAQEVYRNSNDRMSSSTAHAIDQAMTHVSEAKIKFVSVNFSVEMQLNDQPEEIEVADLHGGSQRSASVHRECVYDAAAAERGSDLEWVRVVLSADPGARLEDIEDQAPPRRKEHRRVPSTVAIEEVKAAAAKGEAPLGLPLKGAGQDSSDAQPRVNGLNPKASDALSGELWEAKKDRICKASIYGKLHGWDLRSVSACFK

SEQ ID NO: 94535 - protein, 307 aa, Glycine max
  Coding DNA Sequence Number=SeqID_2850
  Gene Ontology: Mol. function=DNA binding; Cellular component=nucleus; Biological process=regulation of transcription
  Homolog annotation: Hit_ID=Q9M4U3; Match level="QueryCoverage=63%, HitCoverage=59%, E-value=8e-57, Identity=51%"; Hit description=NAC1
  Pfam annotation: Domain name=NAM; Domain location=3-123; Score=34.0; E_value=1.2e-10; Accession=PF02365.6; Description=No apical meristem (NAM) protein
MAKAVGVRFHPTGVELVVYFLKRKVMAKKICDGFIAELDIYKYAPWGLPDKSCLRTGELEWYIFCPLEKKYGSGSKMKLATKIRLEDKDLADKGIAQDSYVVCKVFQKEGLGPRKGAHCARPFNEEEWDDEEIGIPCAALTAPVPILPMTSDGSVPNDNLPASGCTVSASISCLSGSLPSPGTVNPTGPNDQAANDNDILPMLDIFNDDKWFEEVYNPGQENIVEGASPSDDFFEGLEDYLAGFSSGQNTEFNTNGMRLLQGLKDYWAALAGFSAGQNTGDIGNSDNLDFIELNDLDTPLFYPITQP

SEQ ID NO: 94536 - protein, 100 aa, Glycine max
  Coding DNA Sequence Number=SeqID_2851
  Gene Ontology: Mol. function=ubiquitin-protein ligase activity; Cellular component=ubiquitin ligase complex; Biological process =protein ubiquitination
  Homolog annotation: Hit_ID=A7R3F8; Match level="QueryCoverage=99%, HitCoverage=8%, E-value=8e-21, Identity=50%"; Hit description =Chromosome chr4 scaffold_519, whole genome shotgun sequence
MAPVAMRIIEKVMWLKSAKEALVKHPNGVQTMVNMVFRVSDQECSESAVEVLLTVCGEFERAREEAIESGVLTRLLLLLQSQCSNPTKSKARMLLKLLRS

SEQ ID NO: 94537 - protein, 394 aa, Glycine max
  Coding DNA Sequence Number=SeqID_2852
  Gene Ontology: Mol. function=phosphoribosylformylglycinamidine cyclo -ligase activity; Cellular component=mitochondrion; Biological process=purine nucleotide biosynthetic process
  Homolog annotation: Hit_ID=P52424; Match level="QueryCoverage=100%, HitCoverage=100%, E-value=0.0, Identity=84%"; Hit description =Phosphoribosylformylglycinamidine cyclo-ligase, chloroplast/mitochond rial precursor
  Pfam annotation: Domain name=AIRS; Domain location=63-217; Score =187.5; E_value=3.4e-53; Accession=PF00586.15; Description=AIR synthase related protein, N-terminal domain
  Pfam annotation: Domain name=AIRS_C; Domain location=228-394; Score =166.1; E_value=9.6e-47; Accession=PF02769.13; Description=AIR synthase related protein, C-terminal domain
  Pfam module annotation: Pfam domain module=AIRS::AIRS_C; Domain location=63-217::228-394
  Subcellular localization annotation: CTP_CleavageSite=58; ConfidenceScore=5.76e-01
MSFSTCAELSRCFAAASAKPNSGQSNGTSTTSLSFLTPIGRYGAVSSVSRSNKTNRIVAEATQGLTYRDAGVDIDAGSELVRRIAKMAPGIGGFGGLFPLGDSYLVAGTDGVGTKVMLAFETGIHDTIGIDLVAMSVNDIVTSGAKPLFFLDYFATGHLDVDVAEKVIKGIVDGCKQSDCVLLGGELILFASQTAEMPGLYKEGEYDLSGCAVGIVKKDSVINGSNIVAGDVIIGLPSSGVHSNGFSLVRRVLAQSGLSLKDQLPGSDVTIAEALMAPTVIYVKQVLDLVSKGGVKGIAHITGGGFTDNIPRVFPEGLGAVIYDGSWEVPAVFKWLQEAGKIEDSEMRRTFNMGIGMILVVSPEAANRILENRGETEKFYRIGEIISGKGVTFS

SEQ ID NO: 94538 - protein, 215 aa, Glycine max
  Coding DNA Sequence Number=SeqID_2853
MKGRNSYSFRGRHISLALVTLVIFTTLLWTWERNPIIAMTLRSAHEWYRLPSEFPVEAPTESVGTPTLEKGVEKSISPIRENGTKLQLDTQGVAAVDSTPAESLETQYYQNVTPSSRRKGTPTLEKGVEKSTTPITENGTKLQLDTKDVAAVDSIPAESPETQYNQNVMSSSRSKDKVMGPLIHPTVSKQLSMLMDSGSPAFKLISTQALGEPSL

SEQ ID NO: 94539 - protein, 207 aa, Glycine max
  Coding DNA Sequence Number=SeqID_2854
  Gene Ontology: Mol. function=sequence-specific DNA binding; Cellular component=intracellular; Biological process=regulation of transcription, DNA-dependent
  Homolog annotation: Hit_ID=A5B0K3; Match level="QueryCoverage=98%, HitCoverage=99%, E-value=4e-70, Identity=68%"; Hit description =Putative uncharacterized protein
  Pfam annotation: Domain name=CBFD_NFYB_HMF; Domain location=39-104; Score=127.0; E_value=5.4e-35; Accession=PF00808.14; Description =Histone-like transcription factor (CBFNF-Y) and archaeal histone
MEDESHNNTLPNGFNTGSPESPFLKTSTTTTQHNKEQDRFLPIANVGRIMKKVIPPNGKISKDAKETVQECVSEFISFVTGEASDKCQREKRKTINGDDVIWAITTLGFEDYVEPLKTYLQKYKEIEGEKLSIPKQMRSEQRLQQHHNNYHDQNNQPFNGAYASSNLISQPPYVPTDQKFSLTFSPNSIQSQLRQQDQIDSVGHWYE

SEQ ID NO: 94540 - protein, 1027 aa, Glycine max
  Coding DNA Sequence Number=SeqID_2855
  Gene Ontology: Mol. function=nucleic acid binding; Cellular component= transcription elongation factor complex; Biological process =transcription-coupled nucleotide-excision repair
  Homolog annotation: Hit_ID=A7PKT1; Match level="QueryCoverage=58%, HitCoverage=93%, E-value=0.0, Identity=62%"; Hit description =Chromosome chr7 scaffold_20, whole genome shotgun sequence
  Pfam annotation: Domain name=Helicase_C; Domain location=152-230; Score=81.7; E_value=2.3e-21; Accession=PF00271.22; Description =Helicase conserved C-terminal domain
MALLEKSIAPYGPTLAARERQPAAFALGTVADPKDPHRYRPWDLGGPRQTGNTLRTRFLALEARLFSFPCLRAAEGVLEGIDSMLKPEEANVAEKLAMHIADVAGKDKFKDKQDVSCKISFIMSLLDNLIPEGHCVLIFSQTRKMLNLIEECLVSEGYDFLRIDGTTKASDRLKIVNDFQEGFGAPIFLLTSQVGGLGLTLTRADRVIVVDPSWNPSTDNQSVDRAYRIGQKKDVLVYRLMTCGTVEEKIYRKQGGLFKIATEHKEQIRYFSQQDLRGLFSLPKEGFDVSVTQRQLNEEHDRQHTVDDSFKAHIKFLKSQGIAGVSHHSLLFSKAEPVRADHEDDEVTRNHRVKYVGTSRSSSNEHVAYGPEFAFNPKDVGLSKKGSSPSSAVDLPLHFIFVRAVPSRTEFCVFFSTTNAFYNQENFAHRNNPIHLRDVCNLSLCCKSLYALGSSEKVWFTQCDMVGVVPQKDLVEWREGVSSYKSLCRFLLSVKPLLGIWVNQNPELGNLVYVMPGFVSVVGCRIIPQELGPLGIQDGPIQWSSVFEVIGDFDGSATFFLHGREEGMDYVYRGSVKYIDESCNVLLLEVQPREQDNGSNLLQSRSLDDSGGTISGKVCRSNSELSRFQKMGGNDEAMAPFSKLSFSDRRKLLEVTIGLLRQEVSSVAAGPLFPRLRDDCDNFQKDLVLLKERRAIFCEMNNLGSGQIDNEEVSQGAVGPMQLELDDIRKSCYWWKDISDLLNKEDGHIQCTKKKCLGGYLWGSFKQIVGRSSSINESHTIFRKLTARREIKHARLEDFLRSSDAIGLSLKASTVKLSSYRAWPNMPDTWFALYKMPLRVPSADQIYVGLWGGTFGWPPGIPSEDKPGKALFFLLLSYEESQEQKLLIATKILEGTHYVLHPNGSAMFIVDVNQPSSDPFPWDTNKDSFSVDITHSFTGEGISNGYGFRYPGSKPGTLFVFQNGILAFVWKDTRAVLTLQRLDLQDILKKGERVPSLPPINNFSYLTKSYSNVFTGFPGASTCLPSP

SEQ ID NO: 94541 - protein, 484 aa, Glycine max
  Coding DNA Sequence Number=SeqID_2856
  Gene Ontology: Cellular component=integral to membrane; Biological process=peroxisome organization and biogenesis
  Homolog annotation: Hit_ID=A7PKT9; Match level="QueryCoverage=100%, HitCoverage=100%, E-value=0.0, Identity=72%"; Hit description =Chromosome chr7 scaffold_20, whole genome shotgun sequence
  Pfam annotation: Domain name=Aa_trans; Domain location=41-472; Score =521.1; E_value=1.3e-153; Accession=PF01490.9; Description =Transmembrane amino acid transporter protein
MPENAATTNLNHLQVFGIEDDVPSHSQNNSKCYDDDGRLKRTGNVWTASSHIITAVIGSGVLSLAWAIAQLGWIAGPTVMFLFSLVTFYTSSLLADCYRAGDPNSGKRNYTYMDAVRSILGGANVTLCGIFQYLNLLGIVIGYTIAASISMMAIKRSNCFHKSGGKNPCHMSSNVYMIIFGATEIFLSQIPDFDQLWWLSTVAAIMSFTYSIIGLSLGIAKVAETGTFKGGLTGISIGPVSETQKIWRTSQALGDIAFAYSYAVVLIEIQDTIKSPPSEAKTMKKATLISIAVTTTFYMLCGCMGYAAFGDAAPGNLLTGFGFYNPYWLIDIANAAIVIHLVGAYQVFSQPIFAFVEKEVTQRWPHIEREFKIPIPGFSPYKLKVFRLVLRTVFVVLTTVISMLLPFFNDIVGVIGALGFWPLTVYFPVEMYISQKKIPKWSNRWISLKIFSVACLIVSVVAAVGSVAGVLLDLKKYKPFHSHY

SEQ ID NO: 94542 - protein, 101 aa, Glycine max
  Coding DNA Sequence Number=SeqID_2857
  Subcellular localization annotation: CTP_CleavageSite=47; ConfidenceScore=5.11e-01
MAPLQPGQRHSLPDLRNGARRRRRLRRLLRRPHGRRVRPELEKFDSVGQHRRCSSVFVAAEQGRGGAGHGSRRHAQSLLLTFQFFPEPGKGKTFKRYENEA

SEQ ID NO: 94543 - protein, 23 aa, Glycine max
  Coding DNA Sequence Number=SeqID_2858
DIRLNTALEVAIKAVLKEVATKA

SEQ ID NO: 94544 - protein, 387 aa, Glycine max
  Coding DNA Sequence Number=SeqID_2859
  Gene Ontology: Mol. function=diacylglycerol kinase activity; Cellular component=integral to membrane; Biological process=intracellular signaling cascade
  Homolog annotation: Hit_ID=A5AUB2; Match level="QueryCoverage=92%, HitCoverage=99%, E-value=1e-124, Identity=60%"; Hit description =Putative uncharacterized protein
  Pfam annotation: Domain name=C1_1; Domain location=171-232; Score =44.8; E_value=3e-10; Accession=PF00130.13; Description=Phorbol estersdiacylglycerol binding
  Pfam annotation: Domain name=C1_1; Domain location=98-161; Score =15.7; E_value=0.00039; Accession=PF00130.13; Description=Phorbol estersdiacylglycerol binding
  Pfam module annotation: Pfam domain module=C1_1::C1_1; Domain location=171-232::98-161
MCDSLACIVIQVLCLSEEFNQMSLTMIDLGISFLRLVTSPDASSASIFGWLITGSFGLMAVIYAVLKWQRRSSLNWIKAAAREKKKVWKKFKVPLSEHLWVEDFTYREQPSTCCFCLTSLWPSQNLGTTASPRTPLHRCSVCGVAAHFLCSQFAAKDCKCVAQAGFGHIRHHWSERWVDVDENHEMSAFCFYCDEPCGVPFVKASPTWDCRWCQRLIHVKCHNKLTRDSGDFCDLGPLRRIILSPLCVKQVDEDKQGGRLSSIITSSVNGQIRKRRNRNKSLGGYNANGKSDGSSITDATLLEYVLNGLHWNKFGDEKLFDLVNNGRVLGNGLTATPNQIKKYTLVGLPQDASPLLVFINARSGGQLGPSLHRRLNMLLNPVQGMLF

SEQ ID NO: 94545 - protein, 914 aa, Glycine max
  Coding DNA Sequence Number=SeqID_2860
  Gene Ontology: Mol. function=metal ion transmembrane transporter activity; Cellular component=mitochondrion; Biological process=metal ion transport
  Homolog annotation: Hit_ID=A7PKP7; Match level="QueryCoverage=69%, HitCoverage=88%, E-value=0.0, Identity=66%"; Hit description =Chromosome chr7 scaffold_20, whole genome shotgun sequence
  Pfam annotation: Domain name=Polyketide_cyc; Domain location=210-345; Score=73.9; E_value=5.4e-19; Accession=PF03364.11; Description =Streptomyces cyclasedehydrase
  Pfam annotation: Domain name=Polyketide_cyc; Domain location=453-584; Score=83.7; E_value=5.8e-22; Accession=PF03364.11; Description =Streptomyces cyclasedehydrase
  Pfam module annotation: Pfam domain module=Polyketide_cyc::Polyketide_ cyc; Domain location=210-345::453-584
MGGGNEAKTSSDGGEDSQNDSPVKTSEEDSDAFQTSTLEEEAYPALDALASQLSTLNLERVIHIKSRLVAFSGRVQKGGLLCDFMQTLVLDCILQTCKLSSEQVFSGFIVLTSSTTNLGGAQPLSLRFLSKPAPPFLSLSLFFPSHSTNNGIAVSSTQCKPRIRCDKEVGNGNSNGVEEEAKDEEGEREVQCEVQVVSWRERRVKAEISVNADIESVWNALTDYEHLADFIPNLVWSGKIPCPYPGRIWLEQRGFQRSMYWHIEARVVLDLQEFINSAWDRELHFSMVDGDFKKFEGKWSVKSGTRSSSTNLSYEVNVIPRFNFPAIFLERIIRSDLPVNLRALAYRVERNISGNQKLSLPENHLDKTSSDIYESSAQKINSALCENREYLVSSIPGTLPMPSSEVNINNWGAFGKTCRLDRPCVVDEIHLRRFDGLLENGGVHRCVFATITVKASVRDVWNVMSSYETLPEIVPNLAISKILSRDNNKVRILQEGCKGLLYMVLHARVVLDLCEYLEQEISFEQVEGDFDSFHGKWTFEQLGNHHTLLKYSVESKMRKDTFLSEAIMEEVIYEDLPSNLCAIRDYIENRTASNMFEACKQNTDLGQQTVPSGFEDDDSYCSAEDLFDCNAQSSSQQRPRVPGLQRDIEVLKSELLKFIAEHGQEGFMPMRKQLRLHGRVDIEKAINRMGGFRKIATIMNLSLAYKHRKPKGYWDNLENLHYEQQTIGLLTFKSSKERWMKVVTSQLMAVTLSHSQFEVSRLLSLKVRRQRSRQDNLAKDKKVDDDVASPDVDSEIKTPSRPTVSQDPQNWLTELKQLDINWVEDAIPGLRGRSVSIAKMVPTAAAKELGSLALGVEKGYPRRPVKLLDLSEPALIHREEGDDASLYGLRVNQRTSVAVAGVQVQLITTRTTAA

SEQ ID NO: 94546 - protein, 289 aa, Glycine max
  Coding DNA Sequence Number=SeqID_2861
  Gene Ontology: Mol. function=receptor activity; Cellular component =mitochondrion; Biological process=protein amino acid phosphorylation
  Homolog annotation: Hit_ID=A7QN12; Match level="QueryCoverage=100%, HitCoverage=97%, E-value=3e-79, Identity=56%"; Hit description =Chromosome undetermined scaffold_129, whole genome shotgun sequence
MGGLCSKSAKGDKVFAKSDGHSDKHKSDGKNHKSTSMPSNLTSAGEHGVDKKKQEGSAAAAGNGSDDFYDGIPRFTDSFSHKSRSVKSRHAVAKVSEVSLRLGRAGIDVLDTLGSSMTNLSAGGFVSGAVTKGNEIGILAFEVANTIVKGFSLMESLSTKSIKHLKEEVLPLEAVQDLVSKDMDELLRIVAADKRDELKVFSDEVIRFGNRSKDPQWHNLDRYFEKVSRELNSQRQPKEEAELLMQQLMTLVQLTAELYHELHALDRFAQDYQHKREEDDNSGAAQSGN

SEQ ID NO: 94547 - protein, 371 aa, Glycine max
  Coding DNA Sequence Number=SeqID_2862
  Gene Ontology: Mol. function=receptor activity; Cellular component =mitochondrion; Biological process=protein amino acid phosphorylation
  Homolog annotation: Hit_ID=A7QN13; Match level="QueryCoverage=90%, HitCoverage=91%, E-value=1e-86, Identity=52%"; Hit description =Chromosome undetermined scaffold_129, whole genome shotgun sequence
  Pfam annotation: Domain name=DUF668; Domain location=106-191; Score =161.8; E_value=1.9e-45; Accession=PF05003.3; Description=Protein of unknown function (DUF668)
MCMKAQWIGYCIMHFQRKSHSDLEVLTVTLCNISIGDGLSILRAELKSQKKQVKHLKKKSLWSRSLEEIMEKLVEIVHFLHLEINNAFGTEDDHKPLIQTISSRQKLGPAGLALHYANIVLQIDTLVARSSSMPANTRDALYQSLPPNIKSALRSKLPSFHVVKQLTISNIKEEMEKTLHWLVLIATNTAKAHHGFGWVGEWASTGSELNKKTMKADVMRIETLHHADKAKVENYILELLIWLHRLAIKSKDGIDTGETRSTLKSHVGTAIQTTSQQSTKALLPLLTTDEQKMLQDVSNKIHIRRISKSLDFDSLKTDNDRLTKSSSYSYSSTSRSKELSFNRILSKLPVIDFGIDKKRALDVIDRLDVAR

SEQ ID NO: 94548 - protein, 410 aa, Glycine max
  Coding DNA Sequence Number=SeqID_2863
  Homolog annotation: Hit_ID=Q1SKW8; Match level="QueryCoverage=99%, HitCoverage=98%, E-value=3e-60, Identity=46%"; Hit description =Membrane attack complex component/perforin/complement C9
MAPRVSSLEAAQKAINSIGLGFDITQDIAFDNCKKGSRLIFVNEKQCRNLEIPGGMLEHFNQEMCLGGQTASGHFCASFGLSCRNIKDLASIKSLAYDGWFIKRYAVELERYQGELLDHVKEAVPSSWDPEALASMGGKDVLYLRQGDTSYLGPTSIQKLLKDTANMKFKDSADNHCLASEDLCNQKEVDVGNRPVVGLRLQLEGRTSNRLAIHLQHLASLPKSLPLSDNANTYLSCDSYSCNLHKKVKWNSFSYVCTAPVESDDSVSIVTGAQLQVEKKCLLLRLRFSKVIGAILQKEPEWDQSSSLGQFSNKSGGILAFISKEGQRGHPKPGDKTIGSNTYSSARPAPVHTPKLQRFVDTTEMMRGPEDTPGYWVVSGARLSVEHGKIYLLVKYSLLSFVMQSESEAS

SEQ ID NO: 94549 - protein, 927 aa, Glycine max
  Coding DNA Sequence Number=SeqID_2864
  Gene Ontology: Mol. function=oxidoreductase activity; Cellular component=integral to membrane; Biological process=electron transport
  Homolog annotation: Hit_ID=Q5ENY4; Match level="QueryCoverage=98%, HitCoverage=99%, E-value=0.0, Identity=72%"; Hit description =Respiratory burst oxidase 1
  Pfam annotation: Domain name=FAD_binding_8; Domain location=587-734; Score=160.6; E_value=4.1e-45; Accession=PF08022.3; Description=FAD -binding domain
  Pfam annotation: Domain name=Ferric_reduct; Domain location=389-546; Score=163.7; E_value=5e-46; Accession=PF01794.10; Description=Ferric reductase like transmembrane component
  Pfam annotation: Domain name=NADPH_Ox; Domain location=130-231; Score= 208.4; E_value=1.7e-59; Accession=PF08414.1; Description=Respiratory burst NADPH oxidase
  Pfam annotation: Domain name=NAD_binding_6; Domain location=740-908; Score=243.1; E_value=6.2e-70; Accession=PF08030.3; Description =Ferric reductase NAD binding domain
  Pfam annotation: Domain name=efhand; Domain location=232-260; Score =26.1; E_value=0.00013; Accession=PF00036.23; Description=EF hand
  Pfam module annotation: Pfam domain module=FAD_binding_8::Ferric _reduct::NADPH_Ox::NAD_binding_6::efhand; Domain location=587 -734::389-546::130-231::740-908::232-260
MGGTSADLHHHESDIELTDAERTDTKLGASDSKAGNDVGLDSGTKSQAEAEGQHYVEVTMDIHRDSVALHSVKTVAAGVDMVEEEGDKLGLMGKRLEKKTTFGASVVQSAANRMKQLKRLASFSKPAPKHFERTKSAVGHALTGLKFISKTDGGAGWGEVEKQFNKLTATTGGYLPRALFAQCLGLNKESEAYAEKLFDTLARQRGIQGGSINKIQLKEFWDHISDQSFDTRLKTFFDMVDKDADGRITEEEIKEIICLSATANKLSNIQKQAEEYAALIMEELDPADTGYIMIDNLETLLLHEPEETTRGESKYLSQMLSQKLKSTFADSAIMRWCRDAKYFLLDNWQRSWVLALWIGVMLGLFAYKFVQYRRKAAYEVMGHCVCMAKGAAETLKLNMALILLPVCRNTITWLRNKTKLGVVVPLDDNINFHKVIAVAIAVAVAVHSIYHLTCDFPRLLHASDEKYKLMQPFFGDRPSDYWYFVKSWEGVTGIIIVVLMAIAFTLANPRFRRGRAKLPKPFNKFTGFNAFWYSHHLFVIVYALLVVHGIKLYLTKEWYKKTTWMYLAIPITIYALERLVRAFRSSIKSVRILKVTLYPGNVLSLKMSKPHGFSYKSGQYMFVNCAAVSPFEWHPFSITSAPDDDYLSVHIKILGDWTRSLKAKFTQACQQPLNGQSGLLRAECLKGDNSPRLAARIGVDHTWIATKPFNYALIDKKQGSFPKVLVDGPYGAPAQDYREYEVVLLVGLGIGATPMISILKDMVNNFKAIDEEEGIGGAKSPTRLSDFKTSRAYFYWVTREQGSFDWFKGVMNEVAEEDRRKVIELHSYCTSVYEEGDARSALIAMLQSLNHAKNGVDIVSGTRVMSHFAKPNWRSVYKRIALNHPDARVGVFYCGPSALTHELRQLALDFSHNTSTKMMWNELRRPP

SEQ ID NO: 94550 - protein, 312 aa, Glycine max
  Coding DNA Sequence Number=SeqID_2865
  Gene Ontology: Mol. function=electron carrier activity; Cellular component=mitochondrion; Biological process=electron transport
  Homolog annotation: Hit_ID=A7PHS6; Match level="QueryCoverage=44%, HitCoverage=86%, E-value=5e-49, Identity=72%"; Hit description =Chromosome chr17 scaffold_16, whole genome shotgun sequence
  Pfam annotation: Domain name=Rubredoxin; Domain location=221-256; Score=50.2; E_value=7.3e-12; Accession=PF00301.11; Description =Rubredoxin
MASTATLVSSFNTALVFHYHYHAAFYISRVDATLDKKLEQIGTTEALDLKGKGAVSQAVLAYQLYQKKFSGTRWERLEKRGQALHAFIDHGILSRTLDAKVSEAQDIYNAIERSWGLIGVPLDHNWNMRCWILSQKALTMCLNACKRRLSLGISSAYKPLFQAPSFHIVNGNACLRRPLMNPFALKSSFFSGSLNLYLHPNHHHLTSAPPRISMRVASKQAYICRDCGYIYKDRTPFEKLPDNYFCPVCGAPKRRFRAYAPAVTKNDNDTAVRKARKAELQRDEAIGKAFPIAIVVGIAVLAGLYFYLNSQY

SEQ ID NO: 94551 - protein, 343 aa, Glycine max
  Coding DNA Sequence Number=SeqID_2866
  Subcellular localization annotation: CTP_CleavageSite=56; ConfidenceScore=5.20e-01
MKNLLVERREPSLNKKLTTIFLVCVHFKSFRVPLLSSTQNATVSPCGSLDRPLSPRPAREQAPLPSPLRRFPPQALHPQRRSSARPRRLHRHVSPRPRVQKKGDDFISWQWRRRRRRCASSRSLQRGSSERRRDSKGKGGVVFECGGEIDGLKTFAGHSQSGKGNKRVFAVTANDPRYEGVVGRARFLQDRCRDILLSNDPVSRILRDESKCAPGNAEVQSNLELIGESKVKNLDPKAVADEVPNTVRVLDSVGKDNCNPPSVGGDWWQGTIGGGGCNYPPPGKKFYLNRLEFMDHNSSVLDILQGAFIYQLQLHATILRCCSSKPDDGVFMPYQDYPNLVVV

SEQ ID NO: 94552 - protein, 77 aa, Glycine max
  Coding DNA Sequence Number=SeqID_2867
  Homolog annotation: Hit_ID=A7PHR4; Match level="QueryCoverage=55%, HitCoverage=4%, E-value=3e-09, Identity=60%"; Hit description =Chromosome chr17 scaffold_16, whole genome shotgun sequence
MVASLVLSRAPPLVALLGFLCVRKEKGTEEPFPMGANIRLRPGKSRTAGNEENRSQGSPSTLSSGEDANGIDSSKNT

SEQ ID NO: 94553 - protein, 585 aa, Glycine max
  Coding DNA Sequence Number=SeqID_2868
  Homolog annotation: Hit_ID=A7PL45; Match level="QueryCoverage=82%, HitCoverage=93%, E-value=1e-117, Identity=51%"; Hit description =Chromosome chr7 scaffold_20, whole genome shotgun sequence
  Pfam annotation: Domain name=DUF618; Domain location=72-139; Score =116.0; E_value=1.1e-31; Accession=PF04818.4; Description=Protein of unknown function, DUF618
MASIAFLYVFFLRILLLLLSLSLFFYDLGPAVTPTIDQNNCHLEKALSHWCIFHRSKAELVVGTWNKQFHNSEKVQRVPLLYLANDILQNSKRKGNEFVTEFWKVLPTALKDVLEKGDDQEKRAVFRLVDIWEERRVFGSQAKSLKNVILGEEAPPQLEFNKKRSRSVRIVKKDSRSIKTKLSIGGTAEKIVSAFHTVLNEHSNEDAEMSKCKAAVHRVRKMEKNVDIACTVVKDPKRKTLSKELVEEENILKECIENLKLVEASRTSLVTRLKEALHEQASHYVHESELENVRTQIQVAQAQVEEASYMRKRLDDEDSSYKASTSTTSVTDVNTKSEAATKKSAAAIAAEVADKLTASTSSQLIMTSVLSTFAAEEAKSACLTSETMSKPEKSIPISDPNVFMTSQQLIATPNHSYPSVLVPQPTLQNPAAASQGQYQMLCNSSSQHYLQSTGGVISSYGYGSIAPLPLGPPPPHMVGPMVPLTHQTMQITQQLPTPIGQHQPIKMTQQAPAPPNFRPLQLPGMVYYGCRSTSTKQQSLCLSCGVTGKKVGTWRLYVDHRSSTKHAVRARLACMIVFDCRRSNI

SEQ ID NO: 94554 - protein, 39 aa, Glycine max
  Coding DNA Sequence Number=SeqID_2869
MMRRGHVEQHLSVRGAAIAAYHPVEVLVDANGSGHALRR

SEQ ID NO: 94555 - protein, 68 aa, Glycine max
  Coding DNA Sequence Number=SeqID_2870
MAIAEVLNGQMLEEDEDVVSLLVQSKDNNPKEDAHDSYQLSYPNFVRGPSVVGMRPSFDHFEVLGTHR

SEQ ID NO: 94556 - protein, 244 aa, Glycine max
  Coding DNA Sequence Number=SeqID_2871
  Homolog annotation: Hit_ID=Q2HTA0; Match level="QueryCoverage=49%, HitCoverage=19%, E-value=1e-18, Identity=46%"; Hit description=IMP dehydrogenase/GMP reductase, related
  Pfam annotation: Domain name=DUF1723; Domain location=141-190; Score =56.1; E_value=1.2e-13; Accession=PF08330.1; Description=Protein of unknown function (DUF1723)
MYVCGNFHIMVRIRGLGRVLGVIGRALEREREHNHHSDDIPQRRRPTASARRQREAAVAEDAPHVDDATEDGFPGGPCEPSMLIAYGDHVAVIVWNGEERPKLKLSSHGRKVQKFGRPATEIEGLVTATRLSPLIACSLDTGNQGLISAFVERWHKETSSFHLPIGEVTITLDDVTSLLHLPIIGEFHIFETLHVDEVVLMLVELLEVSGDEARAEIVQCHGHTYAYRGYERFIRVNVRSNIGL

SEQ ID NO: 94557 - protein, 24 aa, Glycine max
  Coding DNA Sequence Number=SeqID_2872
LVIAKERFKSADNHLGISACHVTP

SEQ ID NO: 94558 - protein, 204 aa, Glycine max
  Coding DNA Sequence Number=SeqID_2873
MGDQEEIQEQMKADMSALKEQMASMMEVMLGMRQLMEKNVAIAATVSSAAEADPTLLATVHHPPPNTLGRGRNTLGHNNNPHLGYNRPAYPYGLPPNYSPPVMQDDAGHISSPILEGEPPQQPEEVHEDPQDYARRDVEFYPPIPEGPAPNTLPQPNLMAQPIVLSMEGPLPATQERRKLDLLEERLRVVEGFGDYPFADMTDL

SEQ ID NO: 94559 - protein, 212 aa, Glycine max
  Coding DNA Sequence Number=SeqID_2874
  Homolog annotation: Hit_ID=Q84VH5; Match level="QueryCoverage=94%, HitCoverage=33%, E-value=1e-74, Identity=67%"; Hit description =Envelope-like protein
MSYQKVFVRGKCVRFSPAVINKYLGRPTEGVIDIDVSEHQIAKENHCQTSPALAKEREAFCREAKCEVCNLHRIGAANWVPTNHTSTVATESFAVKLPIAFPTVLCGIMLSQHPNILNNIDSVMKRESALSLHYKLFEGTHVPDIVSTSGKAAASGAVSKDALIAELKDTCKVLEATIKATTEKKMELERLIKRLSDSGIDDGEAAEEEEDR

SEQ ID NO: 94560 - protein, 71 aa, Glycine max
  Coding DNA Sequence Number=SeqID_2875
MHLRTREPEKSSLLLVHLGAQCPMCAVKKTIWIFRLPTTKDETHIQRMCDGMMQMRKSATGGCTEYGNIYK

SEQ ID NO: 94561 - protein, 439 aa, Glycine max
  Coding DNA Sequence Number=SeqID_2876
MQEEEERPLIRKRKLPSTSTKSAEQTGTGNSQAQMPKKKKKVKQVEPEPSVTVEGGEPARKKKKKTKSSKEQGDNQPVDVQPPSTDVDGTEAEATPSIAEMGNPVEQPNLPQEQPTIEVQQNVSVEEIPSCARTSPAPETDAVNVEEQGEGQGIGSSSPYGSSQKSSSEENFSDEEAIQEAEAGGSDIYPASSTSKLSASIGIAEDTFIKMQDEDPAAALRLLLNTSQANTSSEKIPGASSSSDADITSSVRQDCLLLKLSMEYARADVLKSIEENPSAAFGHLNFLKKLHNPLTSDEILGKVIQIESIIDQFASTVQKKRENGARLDAQKQAHILLLEKAQAAQHEVERLNKEAKEGSSEIKACDDNISSWEATITDLLSQVDDLRQKIVTEQAKRKELQEKAANSIQKLIAEKGREGLKAFSASQAVADEAKSYGEC

SEQ ID NO: 94562 - protein, 183 aa, Glycine max
  Coding DNA Sequence Number=SeqID_2877
MSWKRRHNFSMPPPRKTMILRGQDIYSSQDEATTSPSSSKSEEAKGEESSEEIYPQEEGQPLMVKEECKETLVSIASSLRLEFIPQVKELLDEGLVHKRLNPCALLVPKIGIIRHQIPKIGGVMNALGGATLFCKITRAPNIFMICVHRDSLGRNNQHENTEKGVPMNPKRIRVIPEWPAPPS

SEQ ID NO: 94563 - protein, 90 aa, Glycine max
  Coding DNA Sequence Number=SeqID_2878
  Gene Ontology: Mol. function=aspartic-type endopeptidase activity; Biological process=DNA integration
  Homolog annotation: Hit_ID=A5BKR3; Match level="QueryCoverage=97%, HitCoverage=15%, E-value=1e-18, Identity=42%"; Hit description =Putative uncharacterized protein
  Pfam annotation: Domain name=zf-CCHC; Domain location=49-66; Score =29.5; E_value=1.2e-05; Accession=PF00098.14; Description=Zinc knuckle
MKYKGKGNIREYIMEMSNLASKFKIRKCRRLGAAEGTSQQKKQKKDEKFTCYFCKKLGHMKKECPKYAAWRVKKDTWWVDSGATTHINGI

SEQ ID NO: 94564 - protein, 118 aa, Glycine max
  Coding DNA Sequence Number=SeqID_2879
DNDLHLHFEDDDVFSHCMLSKGDNDPHLHFEDDNVFNHCMLSKGDNDPHLYFKDDNVFSHCMLSKGNNDLHLHFEENNVFGHCMLSKGGNAVIYAFKDDNVFISKTPMSFVLVLHRTR

SEQ ID NO: 94565 - protein, 153 aa, Glycine max
  Coding DNA Sequence Number=SeqID_2880
  Homolog annotation: Hit_ID=Q2HW90; Match level="QueryCoverage=86%, HitCoverage=27%, E-value=3e-11, Identity=31%"; Hit description =Putative uncharacterized protein
MGTNQNGKRFYQVKIKGLDVTSHKELGRLMGPLQWQAFRKVYGKILDLTTAEVFTEAVVSLAQYYDQPLRCFTFRDFQIVPTVEEFEEILGCPLGRRKPYLFSGFPPSLSKIAAVVGDSARELDRMKQTRNGVVGLTRKYLEGKALGYGESRG

SEQ ID NO: 94566 - protein, 221 aa, Glycine max
  Coding DNA Sequence Number=SeqID_2881
  Homolog annotation: Hit_ID=A6BLN7; Match level="QueryCoverage=93%, HitCoverage=41%, E-value=3e-10, Identity=25%"; Hit description =Putative transposase
  Pfam annotation: Domain name=Rep_fac-A_C; Domain location=75-210; Score=-49.8; E_value=0.0031; Accession=PF08646.1; Description =Replication factor-A C terminal domain
SYPTSVSNSFKASKLMINDLVLEIQEFRESLLDLGIEVRSILTPIGQGSSQVSGSSQLSSKDVFLSKTKEFVCVTVAKITTIVMDNYSWCYPACGQCYKKDDMLTVPLTCPCVKENDQPVLRYRVEVMVNHKGEQTKFLIWDRECAQLIGQSADEVNRLKIDVIDGDVDLNASPQALDRLLGCFLAFKVKVQPRFRNSVVLKYSDESELINVVLDMIPDSE

SEQ ID NO: 94567 - protein, 348 aa, Glycine max
  Coding DNA Sequence Number=SeqID_2882
  Homolog annotation: Hit_ID=Q6WAY4; Match level="QueryCoverage=55%, HitCoverage=34%, E-value=7e-21, Identity=34%"; Hit description =Putative uncharacterized protein
MGPLQRQAFRKVYGKILDLAAAEVFTEAFVSLAQYYDQPLRCFTFGDFQMVPTIEEFEEILGCPLGGRKPYLFSSFLPSLSKIAAVVGDSAKELDRTKQTWKGVVGLPRKYLEGKARDMASQEKWGPFVDILALLIFGVVLFPNVDGLVDLAAIDAFLAYHHSKESSVVAILADLFDTFDRRCEKNSAQIVCCLPALCGLGGVLIIIPHSPIRQLGYPMRGAPTEESLLPFLVRNLGAQSLKAIQRVHKAWRSPLRKDKELRGIRNGVIGGYHGWLRIHTRGLDWLSKLKVIDDENFEAPEEDEEVRALKLELGKARLAKEKFIEFLQPGGSTSSRAAATAVELQFAL

SEQ ID NO: 94568 - protein, 156 aa, Glycine max
  Coding DNA Sequence Number=SeqID_2883
MLVRMIRTRLFAATRVESCPSMHSSYVIASLFGFARTVGRPPLSGCGPGTDKRKLLGPLTGSASLGEGACIPSKLRTCCPLKARACSPLKARTSSPLKARMSSPLKARKSSPLKVRACSPMKVRARSPLMARTCSPLKVRTCSPLMARTCIPLMAR

SEQ ID NO: 94569 - protein, 435 aa, Glycine max
  Coding DNA Sequence Number=SeqID_2884
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=96%, HitCoverage=87%, E-value=0.0, Identity=85%"; Hit description=ATP synthase subunit alpha
  Pfam annotation: Domain name=ATP-synt_ab; Domain location=101-290; Score=302.2; E_value=9.7e-88; Accession=PF00006.16; Description=ATP synthase alphabeta family, nucleotide-binding domain
  Pfam annotation: Domain name=ATP-synt_ab_C; Domain location=302-402; Score=128.1; E_value=2.5e-35; Accession=PF00306.18; Description=ATP synthase alphabeta chain, C terminal domain
  Pfam annotation: Domain name=ATP-synt_ab_N; Domain location=1-45; Score=10.2; E_value=0.022; Accession=PF02874.14; Description=ATP synthase alphabeta family, beta-barrel domain
  Pfam module annotation: Pfam domain module=ATP-synt_ab::ATP-synt_ab _C::ATP-synt_ab_N; Domain location=101-290::302-402::1-45
MAGELVEFEEGTIGIALNLESKNVGVVLMGDGLMIQEGSSVKATGRIAQIPVSEAYLGRVINALAKPIDGRGEISASESRLIESPAPGIISRRSVYEPLQTGLIAIDSMIPIGRGQRELIIGDRQTGKTAVATDTILNQQGQNVICVYVAIGQKASSVAQVVNTLQERGAMEYTIVVAETADSPATLQYLAPYTGAALAEYFMYRERHTLIIYDDLSKQAQAYRQMSLLLRRPPGREAYPGDVFYLHSRLLERAAKLSSQLGEGNGQIFLSADLFNAGIRPAINVGISVSRVGSAAQIKAMKQVAGKLKLELAQFAELEAFAQFASDLDKATQNQLARGQRLRELLKQSQSAPLTVEEQIITIYTGTNGYLDSLEIGQVRKFLVELRAYLNTNKPQFKEIISSTKTFTGEAEVLLKEAIQEQMELFLLQEQVEKN

SEQ ID NO: 94570 - protein, 82 aa, Glycine max
  Coding DNA Sequence Number=SeqID_2885
  Subcellular localization annotation: CTP_CleavageSite=44; ConfidenceScore=5.76e-01
MDTPFFSSSIDYSSSLQQVLPVPSPGPTSNPNQSVSGVPSHPPSLAEVAPPPFITYQRRTRQVSSTVLESSSRDSDPPPTDP

SEQ ID NO: 94571 - protein, 105 aa, Glycine max
  Coding DNA Sequence Number=SeqID_2886
MLAIISKFKEELNLATAHEHKVADKYARVYVEKEARGRVIDSLHQEATMWMDRFALTLNGSQELPQLLAKAKAMADAYSALEEIHWLLSYCQYMIDLMTHIIRNR

SEQ ID NO: 94572 - protein, 96 aa, Glycine max
  Coding DNA Sequence Number=SeqID_2887
MWKFGPRATPRHPNLFCPRYQDWVPTIKDPNETRPQTFFEPWPVKKGILILSPEAKDSEISSRESEWNAKTRFPKERDGEGKVKRKRRKKWKGGIL

SEQ ID NO: 94573 - protein, 129 aa, Glycine max
  Coding DNA Sequence Number=SeqID_2888
MSSVIACLQKATMTFVYISKTKMSSVIGCLQRQQCPHLHFEDDNVFSHYMPSKATISSSTFRRRQGLQSLHAFKRTRRPLFVRFKKKGSENENENELNEKRRNFNIFMPSQVLLLGFALVAGRVKIQLE

SEQ ID NO: 94574 - protein, 191 aa, Glycine max
  Coding DNA Sequence Number=SeqID_2889
MDTMMEAMMSMKKIMEANAVAVAATSAVAKVNPTSPSGINQMNHPTSDMVGKDLGSTSGPYYVKIQNKHAFPPYGLPPNYTPPNVAYTPKEETHEIPHHNLADFEPCLGYATEGQAVGGIPMPNTLKGPQFRPQPQPLHFAVGRSPPAIAQKGKLDHIEKRLKDIEGGEDYAFANLEELFLVPEHGHSQVQ

SEQ ID NO: 94575 - protein, 187 aa, Glycine max
  Coding DNA Sequence Number=SeqID_2890
MTLLLSNILPSDRNANLPLHKYQLVCVVPTWGSHPQRHPVDPKKSNRALGFTALVTGLYQSYRVPVPPRQGHVIIGIAPARHPVDPKKSNRVLELSSSNYGSLALGPLLIELSSRSTASPGQAQGETPQQHWDGRQRETDAPPPPLEFTSAHPQKRLERCLRHMADRQATKSKAKGKQSTRSMTDKS

SEQ ID NO: 94576 - protein, 338 aa, Glycine max
  Coding DNA Sequence Number=SeqID_2891
  Gene Ontology: Mol. function=transferase activity, transferring phosphorus-containing groups; Cellular component=membrane; Biological process=peptidyl-histidine phosphorylation
  Homolog annotation: Hit_ID=Q8ZPP6; Match level="QueryCoverage=51%, HitCoverage=29%, E-value=6e-67, Identity=70%"; Hit description =Sensor protein
MAAQAGEWSVGVLAMRGDAATERDWQPLIDRLNGSVGGERFRLRPLDLAQMREAVNRGSVQFVVTNPAQFVQLNSHYHLRWLASLRAANGDRATGNIIGSVILVRRDSGITTPQALMGKTVGAIDPQAFGGYLTGYKALSDAGIRPERDFHLRFTGFPADALLYLLRERAIQAAIVPSLADRTAPVSLPVGRTGLDQRGGSAAARRLSAPGTAAAMAGYQELADPASDGRRPVAGAAGAVDRQPYLDRAAGAPTRATTAPRRRATAAAGTGAGKRQAAERAGGDGLRLRARAQPAAGGHSPLCAGVPDPTAQHGRRASAAGAAGKYRPAGAARRRDDS

SEQ ID NO: 94577 - protein, 235 aa, Glycine max
  Coding DNA Sequence Number=SeqID_2892
KIERKEKGKERVEINQDERQQIREEERRKILKELRKEKHASYSSHDSCKILSEELHDYYEGRHRSHLIPHYHRREKERNPQEANINLPYIHGKDNVEAYLDWEIRVEQQLKRNSSSKSYGSHSYPKKDQGIVRHQIPKIGDMMNVLSGATLFCKITHAPNIFMIRVHRELLGSDQGVPTDPMRIKVIPQWPTPPSIRKIWGFHDLTNFYKRCREKKPIVSRTSGFEVKSFPRVRG

SEQ ID NO: 94578 - protein, 159 aa, Glycine max
  Coding DNA Sequence Number=SeqID_2893
MLLRMVRTRLFVAAWGKSCPGMHSRCVIASLSGCARTVGRPPISGGEDVQSSDGEDIWSSKASPYQLDLAPYASEPYNAQRNAPGLLRDKHTLRSSRILGEMEVDEPWLGLSRCKIHFLVGVLVYAKGMAFVDNWAVGKEKVCYWLSNDIVGLVGNLAV

SEQ ID NO: 94579 - protein, 175 aa, Glycine max
  Coding DNA Sequence Number=SeqID_2894
MKGTFHPELVKVFNSCARDDLEGNLLSIVNGVDMVIDAIVWKEVAGLDMGGVHKFDEMPDWYNKMQVYKGMLLDLALRNRLGVGIKMSWVLLIEDIMLKSHRVVEYEFPYVVLSSRFIEYFNVDVSNKIVDFTKASSEITERHLKKLEMMFVDHEWIMAREPTAGNIDQMEEDAE

SEQ ID NO: 94580 - protein, 466 aa, Glycine max
  Coding DNA Sequence Number=SeqID_2895
  Gene Ontology: Mol. function=DNA-directed RNA polymerase activity; Cellular component=mitochondrion; Biological process=transcription
  Homolog annotation: Hit_ID=A7PNA5; Match level="QueryCoverage=100%, HitCoverage=50%, E-value=1e-135, Identity=53%"; Hit description=DNA -directed RNA polymerase
  Subcellular localization annotation: CTP_CleavageSite=62; ConfidenceScore=5.51e-01
MWTNLAKRASSTLRNTFRVSSLYPRFCKPQTSKTINPYPFQAFPKAGVSRSKFLFYEGFSSVAEAIESTDTEDDYDEVQKLLQQMAKAEHKVDNSSSSSSYKYKLLKRRQIKSETEAWAEAAREYEELLEDMREQKLAPNLPYMKSLFLGWFEPLRNAILADQELCKDSKCRMSHAPYFNDLPADMMAVVTMHKLMALLMTNTNGVGTARVIQAACQIGEAVENEARIYQFMKREKENKSSHVVPVEQRGELTEENGEMDKKQSRLRKRVAALMKKQKKLQAMGIVRGQDDWKAWGQEAQVKVGSRLMQLLIETAYIQPPANLIGDGPPDIRPAFKHTLKTLSSESQKETRRYGVIECDPLVQNGLEKSARHMVIPYMPMLVPPINWTGYDKGAYLFLPSYVMRVHGAKQQREAVKRAPKSQLDPVFEALNTLGSTKWRVNKRVLCVIDQIWANGGRLADLVDREN

SEQ ID NO: 94581 - protein, 121 aa, Glycine max
  Coding DNA Sequence Number=SeqID_2896
  Subcellular localization annotation: CTP_CleavageSite=40; ConfidenceScore=5.09e-01
MCFREENPSRGASVTLPLAIMWKFFIVLHRSSSFFSLQPFCKNYVGLISSSQLRIHRSKSPAFVDHPKRSLMVQRLNISLLSKTKRSLMVQRLNVSLLLKTKRSLMVQHLNVSLLSKPRDR

SEQ ID NO: 94582 - protein, 68 aa, Glycine max
  Coding DNA Sequence Number=SeqID_2897
  Gene Ontology: Mol. function=DNA-directed RNA polymerase activity; Cellular component=mitochondrion; Biological process=transcription
  Homolog annotation: Hit_ID=A7PNA5; Match level="QueryCoverage=100%, HitCoverage=6%, E-value=4e-27, Identity=86%"; Hit description=DNA -directed RNA polymerase
MTSVYGVTYIGARDQIKRRLKERCAIEDDVELFAASCYAARTTLTALEEMFEAARSIMSWLGDCAKLM

SEQ ID NO: 94583 - protein, 100 aa, Glycine max
  Coding DNA Sequence Number=SeqID_2898
MHDKCNNEIDMRHLKNHPFLANNVLGPLRPSRFFLQKAVASGGSNLARLGKLGGKLLPYFAKNRGRSEEERGSAFLALHIHLKLLKKIVSVKKIQAEALP

SEQ ID NO: 94584 - protein, 50 aa, Glycine max
  Coding DNA Sequence Number=SeqID_2899
MGPRTRLNSTKLKIKARTRQIYIYIKHGQNKTLSMAKNKTLSMAKNHIFQ

SEQ ID NO: 94585 - protein, 37 aa, Glycine max
  Coding DNA Sequence Number=SeqID_2900
HVILWHHQNIQLDPLSTSMILEDKLKACQRSKKGLTE

SEQ ID NO: 94586 - protein, 140 aa, Glycine max
  Coding DNA Sequence Number=SeqID_2901
AFIEKYCTQRQAQGDAPQAAGAPPPPHQAGPAGSFDMEQYLQHLVRQQAANHRAHVQTHDCLYQLSLSMQSQGFASFSCPTPDQFMAEVAWPGDWPEAQAGEAPPEAPDDGEEATRMRRWPICLTSWEGVELHDREIPRF

SEQ ID NO: 94587 - protein, 103 aa, Glycine max
  Coding DNA Sequence Number=SeqID_2902
ASTSSLTLSTLFALCFCAAFPTSSLKVERKDIELVEEEEPRIGVDCSSATSNKSDIYKEEARNAAQKHKAKRPRVSMLMQKPLVITGKVQIALCILNLKHYNI

SEQ ID NO: 94588 - protein, 253 aa, Glycine max
  Coding DNA Sequence Number=SeqID_2903
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLDSADTTLVNHHNSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 94589 - protein, 241 aa, Glycine max
  Coding DNA Sequence Number=SeqID_2904
  Gene Ontology: Mol. function=hydrolase activity; Cellular component =molybdopterin synthase complex; Biological process=Mo-molybdopterin cofactor biosynthetic process
  Homolog annotation: Hit_ID=A7CFF3; Match level="QueryCoverage=64%, HitCoverage=98%, E-value=1e-57, Identity=70%"; Hit description =Molybdenum cofactor biosynthesis protein C
  Pfam annotation: Domain name=MoaC; Domain location=19-154; Score =268.5; E_value=1.4e-77; Accession=PF01967.12; Description=MoaC family
MTKQTSGLTHFNAQGHAHMVDIGDKAHTKRVAIAEGRIEMQAATLQTILQGNAKKGDVLGIARIAAIQASKKTSDLIPLCHPLSLSRVDVSFMADETQHSITCRVQCETTGQTGVEMEALTAVQVGLLTIYDMCKAIDRGMTIQGVRVLEKHGGKSGDWASSLSVACPTESNQRRGHPAITAYGYLALLNKVSGHETRPSSLLTPASCRGAQTVAPLFLTLFPLLSVMEWDLSRQTYSVKD

SEQ ID NO: 94590 - protein, 145 aa, Glycine max
  Coding DNA Sequence Number=SeqID_2905
MTEKTMTMIVDTLPVFYYEKMVDYTPSSFDDMVFTDERIKVSLKRDKSDYHTLINAKKTRASEEDEKKGETYVVTAILIQPSFPPTQQCHYSANNKPSPYPPPSYPQRSSLKSTTKPTYRTSNTNTTFSVNQNTNQEMNFAARKP

SEQ ID NO: 94591 - protein, 147 aa, Glycine max
  Coding DNA Sequence Number=SeqID_2906
  Gene Ontology: Mol. function=chloramphenicol O-acetyltransferase activity; Biological process=response to antibiotic
  Homolog annotation: Hit_ID=P62577; Match level="QueryCoverage=68%, HitCoverage=46%, E-value=3e-49, Identity=94%"; Hit description =Chloramphenicol acetyltransferase
  Pfam annotation: Domain name=CAT; Domain location=6-134; Score=54.9; E_value=3.1e-17; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVTLVHRFHEQTETFHRSGVIPRRFRSSTLFRRWRYVKLAIPKGYEICFAHHPGDSQLLTA

SEQ ID NO: 94592 - protein, 298 aa, Glycine max
  Coding DNA Sequence Number=SeqID_2907
  Gene Ontology: Mol. function=electron-transferring-flavoprotein dehydrogenase activity; Cellular component=mitochondrial inner membrane; Biological process=electron transport
  Homolog annotation: Hit_ID=Q1H3E4; Match level="QueryCoverage=86%, HitCoverage=47%, E-value=7e-93, Identity=62%"; Hit description =Electron-transferring-flavoprotein dehydrogenase
  Pfam annotation: Domain name=ETF_QO; Domain location=115-226; Score =221.6; E_value=1.8e-63; Accession=PF05187.4; Description=Electron transfer flavoprotein-ubiquinone ox
  Pfam annotation: Domain name=Fer4; Domain location=231-254; Score =5.0; E_value=0.063; Accession=PF00037.18; Description=4Fe-4S binding domain
  Pfam module annotation: Pfam domain module=ETF_QO::Fer4; Domain location=115-226::231-254
TYKTHPKLKTLLEGGQRISYGARAISEGGIQALPEMAFPGGALLGCSAGLVNVPKIKGTHYAMKSGMLAAESVFEAVQQGAPELLTSYPQKMRTSWIWQDLTAVRNVKPYLSRWGTWVGTVLGGIEMWLSGWGITMPWTLKHTTADHATLAEAKQSRQPSYAKPDGVLTFDKLSSVSLCNIGHDDQQPCHLKLSVADIPERVNLPKYAGPEQRYCPAGVYEFVEQAGKEVLQINAQNCIHCKTCDIKDPTQNITWVPPEAWASSETRPSGLHTAQATAELKQPLADPIHADYATRRVR

SEQ ID NO: 94593 - protein, 375 aa, Glycine max
  Coding DNA Sequence Number=SeqID_2908
MTKKIVETSRADVRPKKPTGVKIQEWKQEEKEEEERPLVRKRKSPETSTKSAVQTEAGDSQAQMPKKKKKVKQIEPEPSVTVEGGEPIRKKKKKTKSSKEQGENQPVDVQPPSTDVGGAETETTPSIAEMGNLVEQPDLPQEHPTVEVQQNVSVEEIPSCARTSPAPETDAVNVEEQGEGQGIGPSSPQGSSQRSSSEEHFSDEEAIQEAEAGGSDIFPASSTSKLSASIGIAEDTFIQMQDEDPAAALRLLLNTSQANTSSEKNPGASSSSDADITSTVRQDCLLLKLSMEYARADVLKSIEENPSAAFGHLNFLKKLHNPLTSDEILGKVIQIESIIDQFANTVQKKRENGARLDAQKQAHILLLRESPSGST

SEQ ID NO: 94594 - protein, 161 aa, Glycine max
  Coding DNA Sequence Number=SeqID_2909
  Homolog annotation: Hit_ID=A6VH24; Match level="QueryCoverage=45%, HitCoverage=22%, E-value=3e-08, Identity=50%"; Hit description=SCP -like extracellular precursor
MTDPLDESISCFLIRVNPWVLVPSPPKDYMSSPSEDYTSSTSEGPTPSPSEDYTSSPSEGRMPSPSENYTSSPSEDFTSSPLEDYTSSPLEDYTSSPSKGHVPSTSEDYTSSPLEDYTSSPSEDFLSPIFKGRHALTFKGLHVLAIIGLHSLAFKRRHILF

SEQ ID NO: 94595 - protein, 123 aa, Glycine max
  Coding DNA Sequence Number=SeqID_2910
MAPTRHPLDPDKFNRALGFPALITGLCQSFGVPVAPSKAANHRAHAQTHDCLYQLSLSLQSQGFTSFPCPTPDQFRVEVAWPGDWPEARVGEAPAEAPDDADEAREDEEMTDLLDFLGGSGAT

SEQ ID NO: 94596 - protein, 69 aa, Glycine max
  Coding DNA Sequence Number=SeqID_2911
MARTKKTGQMTFEIAKEIAYKIEQASQGSFVPHGRQDLLTTAIGRPEHPGRVHSAEAGVTIKKYFGSAP

SEQ ID NO: 94597 - protein, 162 aa, Glycine max
  Coding DNA Sequence Number=SeqID_2912
  Homolog annotation: Hit_ID=Q6UUU1; Match level="QueryCoverage=53%, HitCoverage=55%, E-value=8e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSFRSKLDCMHEPPVQSDRCALSGNYRLESTRKDMQSTTAAAT

SEQ ID NO: 94598 - protein, 128 aa, Glycine max
  Coding DNA Sequence Number=SeqID_2913
  Gene Ontology: Biological process=transposition, DNA-mediated
  Homolog annotation: Hit_ID=Q1J7G7; Match level="QueryCoverage=23%, HitCoverage=42%, E-value=2e-10, Identity=100%"; Hit description =Transposase
GHQDLFILRSDLPSQWLLFLSAVPPVQLLTGWCVTAKAPPDISAGKCSGHAARRVPFAIQAAQLLGRAIGAGLFAITPAGERGMCCKAIKLGIRSSRTGHARGAASHDRSRGRDRIKLIDTVDLEGGP

SEQ ID NO: 94599 - protein, 184 aa, Glycine max
  Coding DNA Sequence Number=SeqID_2914
MPSPLGRDFFFSEDEIVVGGDVIDELSKAFYGDTFTGTFSFRVGLVLSFWSFAIFVFPLMLAGCVGRSEGANTRPLRVTPLSPVILVTLANNELISVAIPWHDSTHRYFIVQVIEVSSSAEDPEELPPEPVVDALDLPEDDEDPLLDVDFPEDIMSVSEADSTKESGPGGTANSGDSSSKQMAP

SEQ ID NO: 94600 - protein, 45 aa, Glycine max
  Coding DNA Sequence Number=SeqID_2915
MHLRDQGGLVRARALSAILNRLAHISEFRLSACISPSADGLKRCT

SEQ ID NO: 94601 - protein, 162 aa, Glycine max
  Coding DNA Sequence Number=SeqID_2916
  Homolog annotation: Hit_ID=O52175; Match level="QueryCoverage=50%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQKHHWQQPLVIDLEELVLSHAPVKAKLKGQFGDCALQPVTSVKEL

SEQ ID NO: 94602 - protein, 118 aa, Glycine max
  Coding DNA Sequence Number=SeqID_2917
MHERNCNSWGTEKRGREWRIALSNHYAWLQTRGCRMHERKRNSWGSEKRGREWRIAISNHYAWLQTRGLKMHEQKCNSSGYKKGREWRIALSNHNAWLQTRGWRMHERKCNSWGSEKK

SEQ ID NO: 94603 - protein, 54 aa, Glycine max
  Coding DNA Sequence Number=SeqID_2918
  Gene Ontology: Mol. function=RNA-directed DNA polymerase activity; Biological process=RNA-dependent DNA replication
  Homolog annotation: Hit_ID=Q2QTE3; Match level="QueryCoverage=100%, HitCoverage=8%, E-value=5e-09, Identity=56%"; Hit description =Retrotransposon protein, putative, Ty3-gypsy subclass
LKYLLKKAESKPRLIRWMLWLQEFDLEFLDWSSAQNLIAERLSRIERTSEDSPI

SEQ ID NO: 94604 - protein, 54 aa, Glycine max
  Coding DNA Sequence Number=SeqID_2919
LRSLDFLEEATKRRIEEVFSTESLSNDGSWSPPMVVGGGEGDVRVWVPFGEEER

SEQ ID NO: 94605 - protein, 105 aa, Glycine max
  Coding DNA Sequence Number=SeqID_2920
MHIPCYQRYSPALKPIKQIAPSIFFVQHSLRFLFCETKEQNHIIADTYQGNPCGVYPDLSSFTGSGVYPDLSSFTGSGVIQTFVACIKRSAPTQVRIIWYQSFGS

SEQ ID NO: 94606 - protein, 348 aa, Glycine max
  Coding DNA Sequence Number=SeqID_2921
  Gene Ontology: Mol. function=ATP-dependent DNA helicase activity; Cellular component=intracellular; Biological process=DNA recombination
  Homolog annotation: Hit_ID=UPI000034EEF8; Match level="QueryCoverage =60%, HitCoverage=21%, E-value=9e-76, Identity=68%"; Hit description =ATP-dependent DNA helicase, putative
  Pfam annotation: Domain name=DEAD; Domain location=40-215; Score =70.0; E_value=8.1e-18; Accession=PF00270.20; Description=DEADDEAH box helicase
MEKDVLLDKYRRPVNNAVCTEQWSSLTKKVLDVLPYTLTTSQQLAVSEIIWDLQRPVPMNRLLQGDVGCGKTVVAFLACIEVIGSGYQAAFMVPTELLAIQHYEHLLKLLENLDEVVFKPTVALLTGSTPLKQSRMIRKGIQTGEISMVIGTHSLIADSVEFAALRITVVDEQHRFGVIQRGRFNSKVWMVEEVGGDGDSNLRRTLPSDAWSDEVTSEEGGDDVDADDDSDTTFSFSPELSLKKSILRSNHWSEDTTSGYGRQTTHQPRPMGNNLSDDTCREGTEDRVKSIQSPNTANVDSGSRSAEKAEANGCLKEAILNMDKAASREHKGDPVGNNLNCGDKVSDV

SEQ ID NO: 94607 - protein, 73 aa, Glycine max
  Coding DNA Sequence Number=SeqID_2922
MVFGGLKTNVNVPKFGRAKNGEPQTAKGGRTEARQPQKGKKRLVPEQDIRNEGADRLIQATKVLGDATSDEGR

SEQ ID NO: 94608 - protein, 79 aa, Glycine max
  Coding DNA Sequence Number=SeqID_2923
MAAEWRRRRVERRRHFKEKMSQEEAHHHRKPWIRAWRDKWAHTYLMGLKSAVRLMRTLGPSLASLSQSTWSLLSNSLPG

SEQ ID NO: 94609 - protein, 396 aa, Glycine max
  Coding DNA Sequence Number=SeqID_2924
  Gene Ontology: Mol. function=ATP-dependent DNA helicase activity; Biological process=DNA recombination
  Homolog annotation: Hit_ID=A7P3L6; Match level="QueryCoverage=84%, HitCoverage=84%, E-value=2e-84, Identity=52%"; Hit description =Chromosome chr1 scaffold_5, whole genome shotgun sequence
MRYCSFVPSKMCYRLKHKLAEKKVARGVGSGSKLRNKVVALMDYNLPDLIGNGSGEKKSKMSPKDALDDLDISLICKRFPSITLGYAPRVDLYDGTRSCSETMNSLATENFENSFSDSLEASWVQSTLSEERPSLYASHSSLTSSTLGEEDSCPSPLPPDLTPSIYEEKLDQITREDSQMKVRMESQSNSTPSELFLDKSVSCIPGLSKRHYQQLDNYGFHTLRKLLLHFPRSYANLQNAHAKIDDGQYLIFVGKVLSSRGVKANFSFSFLEVVVGCQVAESESAPEHVTIDVQKTVYLHLKKFFRGSRFTFKAFLKNLAEKYQEGDIVCVSGKVRTMRAKDHYEMREYNIDVLEDGKDLSFFAKERPYPIYPSKGRLNPIFLRDTIARFVLQIPD

SEQ ID NO: 94610 - protein, 77 aa, Glycine max
  Coding DNA Sequence Number=SeqID_2925
MDLEIEATLRRNRVERRRKLLQDRTGNLFQGLPNEDPYAHLATFIEICNTVKIVGVPDEAIRLSLFVHGRQVYQIAQ

SEQ ID NO: 94611 - protein, 110 aa, Glycine max
  Coding DNA Sequence Number=SeqID_2926
MGFPLPTIIYLAENLSGFSIRYLLSLEEIPLSFASGERMRILFIGQGSKQSKVGSQRGLLSWEPNLDIWDKTNSWVRCRSRIELPYYFRKARATMMIWKQRAKLVMATAR

SEQ ID NO: 94612 - protein, 45 aa, Glycine max
  Coding DNA Sequence Number=SeqID_2927
MLMMLKMHCDVVMLCMYLGGAVTLLDIPVTLLDIPGGGNRVVKEF

SEQ ID NO: 94613 - protein, 123 aa, Glycine max
  Coding DNA Sequence Number=SeqID_2928
MAKQEEREVKPHREETEVVNLGIAEREKRSRSALDMPGLSSDIMQHKLPLNPEYSPVSYPNFVREPCSMTCDHSLVLVRCLAPIIRQFVKFQDMPKNQKNIDAQSVSFRDTPEIKWKHRCIIK

SEQ ID NO: 94614 - protein, 154 aa, Glycine max
  Coding DNA Sequence Number=SeqID_2929
  Homolog annotation: Hit_ID=Q6UUU1; Match level="QueryCoverage=42%, HitCoverage=45%, E-value=5e-20, Identity=77%"; Hit description =Putative uncharacterized protein
  Subcellular localization annotation: CTP_CleavageSite=44; ConfidenceScore=5.18e-01
MVKVGTSYVPINVSFSPKVAVDRGARYQLLFPLVRVNFELGVIMVIAVPSFGKPVVPTALMNRPTRGERRFAYWALAECILAYYVGTDEGVSEVLHVAGEKRLHRCVSRICDTGYIPLPRSLTRYARSFDCGERKWLTTGRNFLEDGPGRYLTG

SEQ ID NO: 94615 - protein, 250 aa, Glycine max
  Coding DNA Sequence Number=SeqID_2930
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLKWKGFYIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 94616 - protein, 130 aa, Glycine max
  Coding DNA Sequence Number=SeqID_2931
MGEAKEVQEKMKADMEAMKVQMATMMEAMMSMKKIMEANTVIVAATSVVAKVNPMLRSGLNQMNHPTSNMAHISQTMGETHEIPHHNLADFEPCLGYVAEGQAVGGIPPAKHFGGPSISSTSTTCMFHSG

SEQ ID NO: 94617 - protein, 152 aa, Glycine max
  Coding DNA Sequence Number=SeqID_2932
  Pfam annotation: Domain name=zf-CCHC; Domain location=58-75; Score =13.3; E_value=0.015; Accession=PF00098.14; Description=Zinc knuckle
MGLRYEVHMWGNKVETQYAHPVPPHKRVQRGRPKKNRRRSVDEDNVTRHRVRRKLVDFTCGKCGQTNHNIRSCKNIGVHIRPKKYVAPPTSNEDDHLLSQDEQALNKAEEAAAHVQQDPVEINLSQPNLSQDSPYNITRAKQRKVADKDDAV

SEQ ID NO: 94618 - protein, 93 aa, Glycine max
  Coding DNA Sequence Number=SeqID_2933
MLFECFLISEVVIIKKGEIVEAKLHDESKNNSRLQDKNREEFKTQEESLESRIKIQGSRSQESRSRSRFKTQDSRIKRRLNQDKYEKFFSKIE

SEQ ID NO: 94619 - protein, 68 aa, Glycine max
  Coding DNA Sequence Number=SeqID_2934
NETTSGRTDLPENSRNTSSGMFPEDVLVPETFRKRVLPDDLSVVPEALSGRAFFRNCSGRSTSSGSSF

SEQ ID NO: 94620 - protein, 143 aa, Glycine max
  Coding DNA Sequence Number=SeqID_2935
  Homolog annotation: Hit_ID=Q6WAY3; Match level="QueryCoverage=74%, HitCoverage=5%, E-value=8e-08, Identity=33%"; Hit description =Gag/pol polyprotein
MVAFVRQYQYNFDMVPDRMQLQNICKKGDGSFKEHAQKVEGSGGPGGTPNDGKGDDDRDGYTPSSFTDLVFASKKIEVGLKRGKFNHPAWTNEKTGANEEGEDEGETHAKTAIPVRRSFPPTQQCHYPILLLTYYPFVHKGYP

SEQ ID NO: 94621 - protein, 111 aa, Glycine max
  Coding DNA Sequence Number=SeqID_2936
AKYSLKAQVEKDKTPEWRRMKAQVEKDEGPEAETLSRLLILNQSQTYQGNPYGVCPDLSSFTGSGVYPDLSSFTGSGVYPDLSSFTGSGVYPDLSTFTGSGVIQIFVACIK

SEQ ID NO: 94622 - protein, 95 aa, Glycine max
  Coding DNA Sequence Number=SeqID_2937
MSSMMDAMLGMRQLMENNAATVTAVSLAAEADATLPATTHHPIPNVSDEVHEDHREHAQGDIDSYSTFPAEGPTPNADMTELCLVPDVVIPPKFK

SEQ ID NO: 94623 - protein, 172 aa, Glycine max
  Coding DNA Sequence Number=SeqID_2938
  Homolog annotation: Hit_ID=Q6WAY6; Match level="QueryCoverage=96%, HitCoverage=26%, E-value=3e-17, Identity=37%"; Hit description =Putative uncharacterized protein
MELCQDLAAIDAFLAYHHSKESPLVVVLADAYDTFDRRCEKSGARIICCTLTLYVWLVSHLFLHESRPVCPLQGHRTCTEKGKANWEQLLASIVGTSVNWFPRWKEGRVGVLSSCEGFSNVPLMGTRGCINYNPILAIRQLGYPMRGAPLEESTTRFIARGFRDPNARIFQR

SEQ ID NO: 94624 - protein, 80 aa, Glycine max
  Coding DNA Sequence Number=SeqID_2939
MSPILSDLKRPYVSGCAEKGTGHPEAKHFPPPHVLSCGGYEYLEQKLMAEKTKKRLEEDPQSGSTEGVIDPPSPIKRHVK

SEQ ID NO: 94625 - protein, 38 aa, Glycine max
  Coding DNA Sequence Number=SeqID_2940
MAPSLYSDVLCLSSAGKGRRSISRDPIPHLRLFLSTFK

SEQ ID NO: 94626 - protein, 99 aa, Glycine max
  Coding DNA Sequence Number=SeqID_2941
DGDLDLNASPKALDKLLGHLLAFKVKIQPQYKNSTVLKCSSDLALINDVLDMFPDAETCSKIKATTPFDSNDPVHDECQSISITVDHDPLIGLPLTPTK

SEQ ID NO: 94627 - protein, 174 aa, Glycine max
  Coding DNA Sequence Number=SeqID_2942
MVKEECKEVSVSSKRLAKKEKHFEIKTNIKEISPLKQPPHFLLCKKTLVCIATPLRLEFIPQVKELLDEGLVRKSLNPCALLVPKIGIIRHQIPKIGGMMNALGGATLICKITCAPNIFMICVHWDSLGRNNQHENTEKGVEEKSPDFQEPQDLSSNPFQGGGNDAILPLKGIG

SEQ ID NO: 94628 - protein, 201 aa, Glycine max
  Coding DNA Sequence Number=SeqID_2943
MEGLVDLAVIDAFLAFQHGKESPVVAILAMYDTFDRGCEKSGARIVCCALALYVWLVSHPFLQEGRPVYPLQGHRSCVEKGKANWDQLLANMEGRLGCINYNPVLAIRQLGYPMRGVPSDESITPFIARGFSDHNARVLQGVRKAWDAAPDTRIGLAPKSKDCGDDEVKASEESDEVQALKAKLERARVVKEKFKSIAIKV

SEQ ID NO: 94629 - protein, 94 aa, Glycine max
  Coding DNA Sequence Number=SeqID_2944
MEPSSKLESGGHMNSLSNSFMWLRKRMRMDDCLEGPLLGNHETQLQTEKWRTHESQCNSFMWLRKRMRMENCLEGPLLGNHGTQLQTRKWRTHE

SEQ ID NO: 94630 - protein, 35 aa, Glycine max
  Coding DNA Sequence Number=SeqID_2945
GRLRRGARECVFQERKMHEVATNVYSRKTSEKPER

SEQ ID NO: 94631 - protein, 46 aa, Glycine max
  Coding DNA Sequence Number=SeqID_2946
MSAGKYQSRLYNDRCRLKAQVEKDEGPSGEGRRPKWRRTKPPSGEG

SEQ ID NO: 94632 - protein, 40 aa, Glycine max
  Coding DNA Sequence Number=SeqID_2947
MVSPLCHCVAPPLLCSCVGVNVKGVNPHSHFCLCHVATSK

SEQ ID NO: 94633 - protein, 423 aa, Glycine max
  Coding DNA Sequence Number=SeqID_2948
  Homolog annotation: Hit_ID=A7QPQ0; Match level="QueryCoverage=95%, HitCoverage=94%, E-value=1e-158, Identity=66%"; Hit description =Chromosome chr10 scaffold_138, whole genome shotgun sequence
MKKVITVISGSSRQDLKFCDEENFQEQLQFARKESRTIDAALLEEQVHQMLREWKAELNEPSPASSLQQGGSLGSFSTDVYRLLQLCEEEDDATSPLVAPKPEPNDQIMQAGAKVIVQEQFGYLSNSNEFLGLTINQGFCEEGRVPHISSYLPSVCPPPSAFLGPKCALWDCPRPVQGLDWCQDYCSSFHAALALNEGPPGMTPVLRPGGIGLKDNLLFAALSAKAQGKVVGIPECEGAATAKSPWNAPELFDICVLEGETIREWLFFDKPRRAFESGNRKQRSLPDYSGRGWHESRKQVMNEFGGLKRSYYMDPQPLNLFEWHLYEYEISKCDVCALYRLELKLVDGKKSSKAKIVTGDSVADLQKHMGSLSAKGSRTKLGIGGGVYSASNRVALLNAPYQYGLTSPYDDYVVHNTLDYYVT

SEQ ID NO: 94634 - protein, 55 aa, Glycine max
  Coding DNA Sequence Number=SeqID_2949
MDEEQRKYNTIMYEEVDMNVENEKDASVKIEHIDCSNAFNTSELFATRDKVLHWA

SEQ ID NO: 94635 - protein, 95 aa, Glycine max
  Coding DNA Sequence Number=SeqID_2950
MPLPEAEQVFGDVAGELRFIREKLRLHCEGTGLKGEGNFYKTEQLNPFLRRRLISLTYYHLIHHHKGNLPLNYLKSLPWQKSMTRGLPLRITQVV

SEQ ID NO: 94636 - protein, 92 aa, Glycine max
  Coding DNA Sequence Number=SeqID_2951
MYIKYGPKYVMKHSQQNKLSNETKTPHTYSQNNSKAPKFLKDMDASTRIKPRLLCKQSMGQNTPNDYDDGWLNSHKGKLITFKLSFQNYHDM

SEQ ID NO: 94637 - protein, 295 aa, Glycine max
  Coding DNA Sequence Number=SeqID_2952
  Homolog annotation: Hit_ID=Q6WAY6; Match level="QueryCoverage=63%, HitCoverage=31%, E-value=3e-17, Identity=32%"; Hit description =Putative uncharacterized protein
MSSRGKKTISFLRVSPLFEQNCNCGQGFRKRFGPHKTDSERHSGPTTEVPRRQSEGYGQSRRMGPVYGCLAAIDAFLAYHHSKESPVVAVLADLFDTFDRRCEKSSARIICCLPALCVWLVSHLFQQDTRHPCPLLSHRSCTEKRRIDWDQLLAGIGGRTISWFPRWKEGKEGVLFSCGRYPNIPLVGTRGCINYNPALAIRQLGYPMRGAPTEESMSPFLVRDFGAQNSKTIQRIHKAWETPLRKDQELRGIRNGIIGGYHEWLKVHIRGLDWLAKLKVVSEESFEAPEEDEEV

SEQ ID NO: 94638 - protein, 132 aa, Glycine max
  Coding DNA Sequence Number=SeqID_2953
MRKGKSEENIDKKKDTTPNEGKEVPYPLVPSRKEKERHLTRFLDIFKKLEITLPFGEALQQMPLYAKFLKGFAMNALSALAALSLFIATIKIFQISDDCAKWTRSSWLLNQNDANAKRACALRINGILGYPV

SEQ ID NO: 94639 - protein, 150 aa, Glycine max
  Coding DNA Sequence Number=SeqID_2954
  Homolog annotation: Hit_ID=Q84VH5; Match level="QueryCoverage=32%, HitCoverage=7%, E-value=5e-21, Identity=100%"; Hit description =Envelope-like protein
EITAKQVQHWPKKGKLSAGKLSVKYAILHRIGAANWVPTNHTSTVATGTHVPDIVSTSGKAAASGHMQGAGSNHQSHHRKKMELERMITRLSESGIDDEEAAEEEEEAAEEDKEAAEEEEEAAEEEEEAAEEEEDAAEETESDDDSEATP

SEQ ID NO: 94640 - protein, 138 aa, Glycine max
  Coding DNA Sequence Number=SeqID_2955
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=UPI0000ECC20B; Match level="QueryCoverage =44%, HitCoverage=68%, E-value=4e-25, Identity=91%"; Hit description =UPI0000ECC20B related cluster
MTMITPSSKLTLTKGNKKSPGDPLVLERPPPRWSSHSPYSESYYNSLAVVLQRRDWENPGVTQLNRLAAHPPFASWRNSEKARTDRPSQQLRSLNGEWDAPCSGALSAAGVVVTRSVTATLASADVRRCFCRYAPPRQ

SEQ ID NO: 94641 - protein, 99 aa, Glycine max
  Coding DNA Sequence Number=SeqID_2956
MAPTRHPLDPDKSNRALGFAALITGLYAPPPHQAGPARSFDSEQYLRHLVRQQAANHRAHVLTHDCLYQLSLNLQSQGFTSFPCPTPDQFRAEVAWPGD

SEQ ID NO: 94642 - protein, 53 aa, Glycine max
  Coding DNA Sequence Number=SeqID_2957
MARTCSPLRARTCSPLKIDCPFERGDSPCNLILSFANLSGNSLRVYVLFDLVT

SEQ ID NO: 94643 - protein, 77 aa, Glycine max
  Coding DNA Sequence Number=SeqID_2958
MWAIIDKCKEKLNLAATNEQRLEDEYTKISAEMGKRKGPGPLKEVLDFDKYKGTTCLKNHPKMYCRKIRAYAKMRNC

SEQ ID NO: 94644 - protein, 67 aa, Glycine max
  Coding DNA Sequence Number=SeqID_2959
MQAHSRDIIKDNTGLRVDIGLVRRQTKFREDPTVPAGCSVFLPRRRHVASSKRFLKRVIQEQSPWLL

SEQ ID NO: 94645 - protein, 194 aa, Glycine max
  Coding DNA Sequence Number=SeqID_2960
EYNKMKPCKVSYQNIKQKMKFGNQELLVLTNEFHYPGREAVNDKFNCLIDNIWNIPKNTNNNEQFVCSVKKGIICALYNFCIADDQGVPLLTKASPSGKGYTAFVLLSGPHKGVYTNFKDLCLAKEGIQSPIYKGFYSREEAEKALELNTTDINKIKRSLEPENPNHNHKCWPNQDQPKDLQRHSQPKCPRLNK

SEQ ID NO: 94646 - protein, 105 aa, Glycine max
  Coding DNA Sequence Number=SeqID_2961
  Homolog annotation: Hit_ID=A7QB13; Match level="QueryCoverage=41%, HitCoverage=13%, E-value=2e-12, Identity=77%"; Hit description =Chromosome chr5 scaffold_72, whole genome shotgun sequence
NGNLNPTVEVNIFGYSEAADVVFTSGVDVLAVGINVTHQVVLTEFMHKAPVPPQSLIVTVFGVSSTSSASRPSRDGLSTGRGVSSSGKTTILTSREISLADIGHD

SEQ ID NO: 94647 - protein, 113 aa, Glycine max
  Coding DNA Sequence Number=SeqID_2962
MAKRFGMTIICLRMSLGSPPLDGKMVWNDHNLSPHVIGLVASGLKKDQNDHNLSLRAIGHDRLRMAKRCGMTIICLRMSLGSPPLDDKRCRITIVCLCVPSDTIVSKWRRGLE

SEQ ID NO: 94648 - protein, 395 aa, Glycine max
  Coding DNA Sequence Number=SeqID_2963
HLADREQGDHHHHEIDAIGQVHGVEGIAVYARVRIHADHRDRQADHRRQHTLDGLLAEQAGEAAEGEDHQHEVLGRPERQCPFRQQRRQQDNAHHRHDGAEERRPCRQRQGHVGQALARQRIAVQRGHDGAGLARHVQQDRGDAAAVFRADVHRRQQDQRGLGRQVHGEGNRDQHRHAVDRPQARQHADHGAEKRTDRGHQDVGPRRTPRQSRSIDDRGFRSYQVLQQPAGQDHVQHLVEQHVEESAHDDAANRALDPAAAEQAADEDRHQRGGDDETQPLEQERIRGGEHHHQRDAAVGAGGVRLDRVAALVGQAQTAQADDQRQQQREGARAHRFIGERRFDAPPRPGHEGRQRKRRDAQDSIVHDQLSVGRRTGRRKPAPASGWEPAAQGAR

SEQ ID NO: 94649 - protein, 59 aa, Glycine max
  Coding DNA Sequence Number=SeqID_2964
MAHGGQSLTFYEVELIKIGGIVSDNLLGQPVSADYLLMNLTTTLFVTLASKAASTHLVK

SEQ ID NO: 94650 - protein, 360 aa, Glycine max
  Coding DNA Sequence Number=SeqID_2965
  Gene Ontology: Mol. function=transporter activity; Cellular component= periplasmic space; Biological process=transport
  Homolog annotation: Hit_ID=A9CK59; Match level="QueryCoverage=100%, HitCoverage=79%, E-value=0.0, Identity=96%"; Hit description=ABC transporter, substrate binding protein
QIVIDTQAGSPPNIAILPQPGLLADLAAKGFLVPLGDDTAKWVEENYGAGKSWVDLGSYKGKDGNKAYFAFPFKADVKSLVWYVPENFEEAGYKVPESMEDLLKLTDQIVADGGTPWCIGLGSGGATGWPATDWVEDLMLRTQPLDVYQKWTTNEVKFTDPAVVAAINEFGKFAKNEKYVSGGVAAVASTDFRDSPKGLFDIPPKCYLHHQASFIPSFFPEGTKVGTDADFFYMPTYASKPDLGKPVLGAGTLVTITKEAPAAKAFVQFLQTPIAHEVWMAQSSFLTPYKGCERRNLCHEQMKRQGEILTTATTFGFDGSDLMPGKIGAGAFWTGMIDFVGGKSADQVAADIQKAWDGLK

SEQ ID NO: 94651 - protein, 180 aa, Glycine max
  Coding DNA Sequence Number=SeqID_2966
HLTETCMRAGNSDIYGFLEPQSIQRSGQSQFESESYIKSWMQSSQRDVYLRAYLNGFHCSGHWQMVVILPKEHLVVWFCSLHNRPDNYLKGIIDSAIKGLDDAPQPKSKAPARWIVVKVRHLHKTYTSCLINICRNLPFGGRATRDSRDACSMKGIRAESPPTFIWENVGKTGKDVIYEL

SEQ ID NO: 94652 - protein, 118 aa, Glycine max
  Coding DNA Sequence Number=SeqID_2967
MSGFTRNSPQISASPHQLDLAPYASEPYHAQWNAPGLLRDKHTLRSSRILGEMEVDEPWLGYGIKSGIGHWNWGEFYRLSRCKIHFLVDVFGIAVTAWVSPSSSPSLFAPVFSVVLVG

SEQ ID NO: 94653 - protein, 125 aa, Glycine max
  Coding DNA Sequence Number=SeqID_2968
MAPKKLSTKRSRRDVAVEASSVAPKFDSHRFRSAEHQQRFEAIKGWLFHRERRVHLREDEYTDFQEEIACRHWTSLVTTMAKFDPKVVLEFYANAWPTEEGVRDMCSWVRDQWIKFDTEALSQFL

SEQ ID NO: 94654 - protein, 210 aa, Glycine max
  Coding DNA Sequence Number=SeqID_2969
  Homolog annotation: Hit_ID=A0ST23; Match level="QueryCoverage=12%, HitCoverage=55%, E-value=3e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLDCTYETPSGPEEIQQGTGISCSDYRPLSILWSAGPGATVASGGPAAGNCRSIVTTTMVADISRIKLIDTVDLEGGPVGKPVVPAALMNRPTRGERRFAYWALAECILAYYVGTDEGVSEVLHVAGEKRLH

SEQ ID NO: 94655 - protein, 143 aa, Glycine max
  Coding DNA Sequence Number=SeqID_2970
MATLAQTWSVLSFSNLIPTSHTSDVTLDKAKLIYGIIMKIDMNLGYLISHQISLIAQHDTSRLGFPTLRVTFRGPRKARGKRSEAPSTSASEAPTPSSSTVPSSSSTQIPVIPPVPLQTPLPAPLSAGPSDFIFTPQMLHSML

SEQ ID NO: 94656 - protein, 84 aa, Glycine max
  Coding DNA Sequence Number=SeqID_2971
MKATIRSFQEWTREGSRLVYQVTAAPEVVFSPQNTRGVVVGDTKDPPKCLAGVCHQMPTPQWHIRGKAQSRLEYGLGVLHMSPP

SEQ ID NO: 94657 - protein, 75 aa, Glycine max
  Coding DNA Sequence Number=SeqID_2972
  Subcellular localization annotation: CTP_CleavageSite=40; ConfidenceScore=5.20e-01
MAAKRVSLAKPPCLYCLNKLGLSESVSLSPRQFSCSEFCSCTERVMLAKRNFFYCVALSKPVSLCAISSLLENKA

SEQ ID NO: 94658 - protein, 113 aa, Glycine max
  Coding DNA Sequence Number=SeqID_2973
MESGDMRRYRMVTRTFRQPGAKEPVDAERLTSSSALFGHPGTASRVAGFYSHRLETFKPDDTRDSSLLGGDDKVQWRREVSWLSRFIAFEDTEVIREVPQHSGSRKEALLRNP

SEQ ID NO: 94659 - protein, 37 aa, Glycine max
  Coding DNA Sequence Number=SeqID_2974
MGVVLRSSKAPGEVSVSKSVKVFLRYSSFFVFFSLQR

SEQ ID NO: 94660 - protein, 100 aa, Glycine max
  Coding DNA Sequence Number=SeqID_2975
MRRHSVVFRYCRTFYEGEDGGVGGGVRCRGADRDDVRLGVTSEVDRAKVVCGAASDLKEHGEELEEDVIMKDVDKGIQEEVVADNEVDDGDDENGKGGVV

SEQ ID NO: 94661 - protein, 98 aa, Glycine max
  Coding DNA Sequence Number=SeqID_2976
MGDSLEDMIHDLGQEFFQIKINFKLHEKKSRRFKIQEKFDFKIQEKMNSRFKRRNQEDFTREGTSTWVVVTENKRGYISCGSVQVEGTSTWLFKENKG

SEQ ID NO: 94662 - protein, 112 aa, Glycine max
  Coding DNA Sequence Number=SeqID_2977
GISFVVQVEGTSTWVFVTENKRGYISCGSVQVEGTSTWLFKENRGGYIPCGPLLVKDITRLKRNLKDCGSLGDWMFVIIKKGEIVEASFMMLNQVDSSSFDDDKDDDKKPKE

SEQ ID NO: 94663 - protein, 88 aa, Glycine max
  Coding DNA Sequence Number=SeqID_2978
MRSFNGDFPPWRCSGRQRRRGERRRHPLGNKPWKKELHHQDEPWIRSLEGCFNGGKERGRERERGEHEIEGIKEGEKWNFEELMKHWA

SEQ ID NO: 94664 - protein, 77 aa, Glycine max
  Coding DNA Sequence Number=SeqID_2979
  Subcellular localization annotation: CTP_CleavageSite=29; ConfidenceScore=5.45e-01
MMLDIVLNTGNGAHKMLSNHANFSAAPLRAFSGGTSPSLHRSTNAVINARSILHCLIRTICWNPVDDNNGIIYGSGS

SEQ ID NO: 94665 - protein, 88 aa, Glycine max
  Coding DNA Sequence Number=SeqID_2980
  Homolog annotation: Hit_ID=UPI0000ECBAF8; Match level="QueryCoverage =46%, HitCoverage=48%, E-value=1e-16, Identity=100%"; Hit description= UPI0000ECBAF8 related cluster
SSLSETDNTIAATQYDYATHKAPAIAIFTESATRCRMQAWHWPSFYNVVTGKTLALPNLIALQHIPLSPAGVIAKRPAPIALPNSCAA

SEQ ID NO: 94666 - protein, 72 aa, Glycine max
  Coding DNA Sequence Number=SeqID_2981
MQGVSQRALLRASEGEAHGCAFQRRKDARSRHQLLFVENVGKTEGNRKVLAPLTFVSKDNNLFFRIVEIVLP

SEQ ID NO: 94667 - protein, 160 aa, Glycine max
  Coding DNA Sequence Number=SeqID_2982
  Gene Ontology: Mol. function=endonuclease activity
  Homolog annotation: Hit_ID=A5BKB8; Match level="QueryCoverage=62%, HitCoverage=30%, E-value=1e-19, Identity=56%"; Hit description =Putative uncharacterized protein
IIAIVGLQRGIPSKRESSARVDYVPALCTHRPSLLPIEWSGEVFGLRRREPAEGSLSMPHNQIDPRTCLFIYRREGGDDHGAPNSNLLSATPGGPETVSRGSRHDTTFTYNDSRQADVAFRTPLAPYEKSKSLGSGGSMVARLKLKGIDGRAPPGVEPAA

SEQ ID NO: 94668 - protein, 56 aa, Glycine max
  Coding DNA Sequence Number=SeqID_2983
MLLACGGNEGSQENTWYLDIGVSNHMCGKRSTFMDLHESRLKFAIKGEDGERTTLY

SEQ ID NO: 94669 - protein, 59 aa, Glycine max
  Coding DNA Sequence Number=SeqID_2984
MKKKWNKKQLQGKSNKVQTCIKELDGAGENSEGHTYVFLEDNDSKPVIISSSLKITEED

SEQ ID NO: 94670 - protein, 77 aa, Glycine max
  Coding DNA Sequence Number=SeqID_2985
MWAWERCMTLAPKRTSLVIENKPLGHSWLRRGNQHIGNDDLRLFRRKLDLMKRHEFVWEPYTPTMMAALGGRVGFYG

SEQ ID NO: 94671 - protein, 173 aa, Glycine max
  Coding DNA Sequence Number=SeqID_2986
MLYFNGRVYEDNDGVIFEGSKKAIQIKRGISFNALKIKFETRFLVSEKYIALQICDDEDVETMLESFKQQQEMSVLELYIEKDVAGGSMFHYANSVTSCGNYLSNDDTQPPTNMSNLHLDEDDDDDYLVSNSYVEESLDEEDSVDGIFDTDNEVTEMISPVRIVHPTEGIISS

SEQ ID NO: 94672 - protein, 283 aa, Glycine max
  Coding DNA Sequence Number=SeqID_2987
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDKSCLSNARVKLASVKGNAKEFVLSVYGNPTGSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 94673 - protein, 208 aa, Glycine max
  Coding DNA Sequence Number=SeqID_2988
  Subcellular localization annotation: CTP_CleavageSite=38; ConfidenceScore=5.24e-01
MVSKRVFQRKHKNIQWWFQSKKRCKDKLNLTRNKRRIMVTSKKTMKVRLGFVLYRNRETSLEDSAPIEGFLSVWGFNGEQQRSVVATGGCGCWRRSLGCWGRVLEERRRKEWLFSKVTRKIRLETLKCFCSREKKSFSHTRRHITDHNGQFMDICPMNLQTKFRKDPTVNECRRALLPRWLQASSLRSFLVRLLCEASLRGFFEKLKS

SEQ ID NO: 94674 - protein, 275 aa, Glycine max
  Coding DNA Sequence Number=SeqID_2989
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSISPEVRFKMQNDSQDPVDVGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 94675 - protein, 361 aa, Glycine max
  Coding DNA Sequence Number=SeqID_2990
  Homolog annotation: Hit_ID=Q6UUU1; Match level="QueryCoverage=23%, HitCoverage=55%, E-value=4e-18, Identity=61%"; Hit description =Putative uncharacterized protein
MVKVGTSYVPINVSFSPKVGPGLPGINRDTRIYLFCEVIFRHRCSQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSISKHLEMSAFKTYLGLARIALNMALSAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSVPAFRFTGVIPLYGRVCLIPRLTLSS

SEQ ID NO: 94676 - protein, 148 aa, Glycine max
  Coding DNA Sequence Number=SeqID_2991
LGRIDGDPVLRETRIWATWEYVSSVGGGQQGMETLGTSGGVPLPKTKLDQSRPNSGIVSHCESCVIYELWPLVIDYQGWVIDYQGWVIDYQGLENEVRKLGELLVIDYQGRNGSLVIDYQIVMAAQLIHDRVEMECLEEAWETLEGNT

SEQ ID NO: 94677 - protein, 123 aa, Glycine max
  Coding DNA Sequence Number=SeqID_2992
MAPRKLASKRSRKDKAAEGTSSAPEYDSHHFRSAVHQQRFEAIKGWDDEYADFQEEIGCRRWASLVTPMAKFDPEIVLEFYSNAWPTKEGVRDMRSWVRGQWIPFDADAIGQLLGYPLVLEEG

SEQ ID NO: 94678 - protein, 76 aa, Glycine max
  Coding DNA Sequence Number=SeqID_2993
MAAEWRRKRERRRHFKEKMSLEEAHHHRRPWIRAWRKKKMNEGRGREEHEILCSKRALKSDPINSRSSPRFSTKCA

SEQ ID NO: 94679 - protein, 189 aa, Glycine max
  Coding DNA Sequence Number=SeqID_2994
MANQEEWVPFVDVLALLIFGVVLFPNVDGLVDLVAIDAFLAYHHSKESPVVAILADLFDTFDRRVDWDQHLAGIGGKTINWFPRWKEGKEGVLFSCGDYPNIPGAPAEESLSPFLVRDFGAQSFKIVQRVHKALESPLRKDKELRGIRNGIIGGYHEWLKVRTQGLDWLSKLKIINEENFDAPEEDEEV

SEQ ID NO: 94680 - protein, 291 aa, Glycine max
  Coding DNA Sequence Number=SeqID_2995
  Gene Ontology: Mol. function=oxidoreductase activity; Cellular component=cytosol; Biological process=metabolic process
  Homolog annotation: Hit_ID=Q6ADA9; Match level="QueryCoverage=100%, HitCoverage=81%, E-value=2e-95, Identity=60%"; Hit description=NADH -dependent flavin oxidoreductase
  Pfam annotation: Domain name=Oxidored_FMN; Domain location=1-286; Score=160.5; E_value=4.4e-45; Accession=PF00724.11; Description =NADH:flavin oxidoreductase  NADH oxi
ATAVVPEGRISPRDVGLWNDAQRDALAPIVEAIHDRGAHAGIQLAHAGRKASTWWPWAPERGSVPTADGGWTTTAPSAVAFDGFDEPVALDLAGIDRVVEAFASSTRRAVDAGFDVVEIHGAHGYLLHQFLSPLSNRRDDEYGGSLENRARLLLRVVDAVRESAGDEVPVFVRISATDHADGGFTADEAAVVGAWATQHGADLIDVSSGGLVAHQRISVFPGYQVPLAETVRQGGRIPVSAVGLITAATQAEQVLVDGAADAIFAGREWLRDPHFALRAAHELGADVAWAP

SEQ ID NO: 94681 - protein, 302 aa, Glycine max
  Coding DNA Sequence Number=SeqID_2996
MSVPHFKCCRQSRQAARQHAGVAEDEETADADGQQRPARPPVRRPPHQQRSQRAGGAHKHQHRCTVEIVGNGADNQRGNHAGQVDHRRDDQSGAERIQRETAQRLADQAGRPGPVTEQFPAVGDIPDQQQQGRIGDSIAFTFRLPPQRTRLRLPITDQGQRTGQRPQQRTGGTQGKRHAGPPAHGAPTGDENRQKIPQRTGRQHHADGVTAPRRAVHPHRQQQRRRIGAALRQADEGHQHQRAGIRMGKHGEQHQRSGAQPGKQQVNPARPPSNHTTRKSTSSASALVQAKHRLHRAGGGGV

SEQ ID NO: 94682 - protein, 420 aa, Glycine max
  Coding DNA Sequence Number=SeqID_2997
  Gene Ontology: Mol. function=phosphopyruvate hydratase activity; Cellular component=phosphopyruvate hydratase complex; Biological process=cell division
  Homolog annotation: Hit_ID=Q1GZ06; Match level="QueryCoverage=97%, HitCoverage=99%, E-value=0.0, Identity=82%"; Hit description=Cell division protein FtsA
  Pfam annotation: Domain name=FtsA; Domain location=11-197; Score =282.2; E_value=1.1e-81; Accession=PF02491.11; Description=Cell division protein FtsA
  Pfam annotation: Domain name=FtsA; Domain location=207-376; Score =258.4; E_value=1.5e-74; Accession=PF02491.11; Description=Cell division protein FtsA
  Pfam annotation: Domain name=MreB_Mbl; Domain location=145-366; Score= -223.6; E_value=1.4e-05; Accession=PF06723.4; Description=MreBMbl protein
  Pfam module annotation: Pfam domain module=FtsA::FtsA::MreB_Mbl; Domain location=11-197::207-376::145-366
MSRVREDKNLIVGLDIGTSKIVAIAAEILPEGTLKVIGVGQHASRGLKKGVVVNIDSTMQAIQRAIEEVELMADCKINTVYSGIAGSHIKSLNSHGMVKIKESEVSQMDIDRVVETARAIALPADQQILHILTQEFIIDGQEDVREPLGMSGIRLEVRVHIVTGAIAAAQNIVKCIKRCGLEVSDLILQPLASSESVLTDDEKELGVCLVDIGGGTTDLAVFKNGAIRHTAVIPIAGDQITNDIAVALRTPTQSAEEIKVKHGCALRQLADPREVVEVPAVDGREPRQLSCQALTEVIEDRVEEIYEFVQQELRRSGMESMIASGIVITGGAAQMRGMVELGEEIFHTPVRLGVPRGVEGLSEVVGNPRYATGIGLLLMAKQQVEKQMVGNLQSGSVGRLLERMKSWFTGRVCGANQSLK

SEQ ID NO: 94683 - protein, 194 aa, Glycine max
  Coding DNA Sequence Number=SeqID_2998
  Gene Ontology: Mol. function=UDP-N-acetylmuramoylalanine-D-glutamate ligase activity; Cellular component=cytoplasm; Biological process =peptidoglycan-based cell wall biogenesis
  Homolog annotation: Hit_ID=Q1GYZ9; Match level="QueryCoverage=94%, HitCoverage=41%, E-value=7e-45, Identity=52%"; Hit description=UDP-N- acetylmuramoylalanine--D-glutamate ligase
  Pfam annotation: Domain name=Mur_ligase_M; Domain location=1-131; Score=62.8; E_value=1.2e-15; Accession=PF08245.3; Description=Mur ligase middle domain
MTAPDVYVLELSSFQLETTYSLQADAATILNLSEDHMDRYDGMEDYAHAKARIYQQARIAVVNRDDAPSAALAGQLPQVSFGVNPSPTINDYGLNDAGWLCAGNRHYIEADSLQIRGKHNIANALAAIALTQSIGIDKVSILHTVQSFSGLPHRVEWVANIDDVDFYDDSKGTNVGATCAAISGMLKQGETTKS

SEQ ID NO: 94684 - protein, 370 aa, Glycine max
  Coding DNA Sequence Number=SeqID_2999
  Gene Ontology: Mol. function=hydrolase activity, acting on ester bonds; Cellular component=cytoplasm; Biological process=response to DNA damage stimulus
  Homolog annotation: Hit_ID=A7ZUL4; Match level="QueryCoverage=52%, HitCoverage=100%, E-value=6e-92, Identity=78%"; Hit description =Endonuclease V
  Pfam annotation: Domain name=DUF416; Domain location=184-370; Score =433.2; E_value=3.6e-127; Accession=PF04222.3; Description=Protein of unknown function, DUF
  Pfam annotation: Domain name=Endonuclease_5; Domain location=9-180; Score=265.6; E_value=1e-76; Accession=PF04493.5; Description =Endonuclease V
  Pfam module annotation: Pfam domain module=DUF416::Endonuclease_5; Domain location=184-370::9-180
MDLASLRAQQIELASSVIREDRLDKDPPQYIGGADVGFEKGGEVTRAAMVVLKYPSLELVEYKVARIATTMPYIPGFLSFREYPALLAAWEQLSQKPDLLFVDGHGISHPRRLGVASHFGLLVDMPTIGVAKKRLCGAFEPLSAEPGALAPLIHKGEQLAWRCMKGYRLPEQTRWADAVASSRPAFVRWQEIQPMIQHVTFMACLCERMYPNYAAFCKQTGFGDGHIYRRILDLIWETLTVKDAKVNFDSQLEKLEEAIPAADDFDLYGVYPAIDACVALSELIHSRLSGETLEHAIEVSKASITTVAMLEMTQEGREMTDEELRANPAVEQEWDIQWEIFRLLAECEERDIELIKGLRADLRESGESNI

SEQ ID NO: 94685 - protein, 64 aa, Glycine max
  Coding DNA Sequence Number=SeqID_3000
MKKQQWKRSRRQRRRGERRRHPLGNKPWKKELHHQDEPWIRSLERMLQWRKRKRERKSGRNKSR

SEQ ID NO: 94686 - protein, 67 aa, Glycine max
  Coding DNA Sequence Number=SeqID_3001
MVVPCSVFEVLLVAVLPISSEAQQEEGPERPLPEVTKAYSGRSASGRPSSGKGLSNFRKNFFRNVKI

SEQ ID NO: 94687 - protein, 425 aa, Glycine max
  Coding DNA Sequence Number=SeqID_3002
MGDVEEAPEQMKASMSALKDQMASMMEAMLGMKRLIESNAATATAASTAAEADPVLPSTANLAHQLTLDMVGQGRDTLGNSSSPLLGYNRRKPPQPVGGAHEEPREHAQGDVDSYPPVPIEGPAPNALPQPNIAGVFQPRPMQPLLFSVGGPPPTVEGREKLDLIEERLRAVEGFGDYLFADMTDLCLVPRPTHNANPSMNPNMGRNPPVKKSSAIFPNLNDIWRPIAFTDRQPIGSGHLVEQCMTLKHKVQSLIEAGWLTFQEDGPNMKTNPLANHEVGVVPLGGHNRDPCLMHPDQGRHEIGNEDEKEIHVYMHKAVPWRYAPQKPSERKEKATDTDSLSTKVTNITMLSGVTSSGCIFAAPDLPANEANPTPDEDVPVGRFIEKGEGLGRKEVSLEEANEFLRIIQQSEFKIIEQLNKTLAR

SEQ ID NO: 94688 - protein, 83 aa, Glycine max
  Coding DNA Sequence Number=SeqID_3003
METYPFLDQKQNGHTNKYNKICKDHLPKKDFVALKSRETSSIREEKKSSSKALKVQMANSDGLDNSSGDSTDDEVALMFRKFK

SEQ ID NO: 94689 - protein, 164 aa, Glycine max
  Coding DNA Sequence Number=SeqID_3004
MKQANVTQLKKTLKKFIIWEINSSKGILQEDFQVSSKVLIVNKDNGGHTLAISSTKIKVGQLAKQITDKLSNSFVANTEKNPKEECKAVMTRSKRFVENEEEKSVGLKKKVVEEKGIDGRKNDVRGENNQEKEKQIMVNKKELNDQKKKRVEKKRNKKVEKMKK

SEQ ID NO: 94690 - protein, 122 aa, Glycine max
  Coding DNA Sequence Number=SeqID_3005
MLHSIHQGHIIPLQSLQVVEPPGFIPSVEQFREMVAWPGTQPSLHREDEGPTAKVPTHMEDESFEATIPEPFTAGEEAGDTQMTQVAAATLERSLEATSEPPASAVDLPSPQHATDPSTPVL

SEQ ID NO: 94691 - protein, 184 aa, Glycine max
  Coding DNA Sequence Number=SeqID_3006
MSEIWTKVIWTWYGKARGVDRKSGHPIMSILNCFKEGGVPEVIFHHNLSCWAWWWPVQTHTDRGRGGGGGSGGGGGSNDGGYNVTEHVKEKMGTTMGVVAALERYGRVMWCYKLPCSVSAAVAEAAADAMKAPIVMDAEVPGVLEKASNNKIATNILTEKAYSQQNHPRAQSNNISSAILLLFC

SEQ ID NO: 94692 - protein, 248 aa, Glycine max
  Coding DNA Sequence Number=SeqID_3007
  Gene Ontology: Mol. function=helicase activity; Cellular component =chromatin; Biological process=viral genome replication
  Homolog annotation: Hit_ID=Q9C925; Match level="QueryCoverage=97%, HitCoverage=25%, E-value=9e-73, Identity=52%"; Hit description =Putative uncharacterized protein F14G24.23
  Pfam annotation: Domain name=DUF889; Domain location=147-248; Score= -76.4; E_value=2.7e-06; Accession=PF05970.5; Description=Eukaryotic protein of unknown function (DUF889)
MDILEYVWEQTWQWMTDDIVFNLRRQGGVYFLYGYGGTRKTFIWKTLSSTIRSNGGIVLTVASSGIASLLLPGGRTTHSKFAIPVPATQNSTCNMHQGSDLAELLKITKLIIWDEAPMCHKFIFQALDKSLKDIMHNDRPFGGKVIVFCGDFSQILPVVPRGNRFDIIHASLNASYIWDHCQILKLTKKLHLQTNVVDSSNHDLKQFFDWLLDIGDGKLREPNDGYVEISIPNEFLIKHFNDPTQAIV

SEQ ID NO: 94693 - protein, 318 aa, Glycine max
  Coding DNA Sequence Number=SeqID_3008
  Homolog annotation: Hit_ID=Q5XM22; Match level="QueryCoverage=42%, HitCoverage=91%, E-value=4e-21, Identity=39%"; Hit description =Resistance-like protein HAAS-2
  Subcellular localization annotation: CTP_CleavageSite=34; ConfidenceScore=5.61e-01
MYALLLRFLLPPSLFVLTVPPPLSASVRTLPLVPATAVAFTIAIMVRIRGLSQTLGRVIGRALGREVSGDADEAPQGRRMTTFAPKKREVVPIVEDVEHVDHATNKVHEQHEEAVANDVVVDALGCASEPHDTSILMDYVHHVIVTIWNGEWIVAAPTYSLHLVGCILFANKSATHVPVIFLDAFHDLSQTGSYAWGAIALVDMYENLNDVSMRSARKLVGYITLLQCWIYEHFPIVASSIAAEDYHERKPHACRWKFGKSLLVLTYHISDEVHLFSYTDRRGLCDSLVGQICVAPGQCAADYMEWFYMISHPLMSPT

SEQ ID NO: 94694 - protein, 149 aa, Glycine max
  Coding DNA Sequence Number=SeqID_3009
  Subcellular localization annotation: CTP_CleavageSite=36; ConfidenceScore=5.10e-01
MHANGGLSRMSACLVHASSSSFFQILPCTQPQECASCMRGNPLVGNLVPLDLEIKATCRRNNAERRRKKILERTAQPSLEETQSSKSSSTFPDFRESKVGASEAHIDVSSIGACRPRIFFINGFLYFLEDEWQRNGEGRERGDATSRRR

SEQ ID NO: 94695 - protein, 219 aa, Glycine max
  Coding DNA Sequence Number=SeqID_3010
HLKKHGMGYVDHEWVIAGEPPVAENINKMEDQVEEEAQQELAQQWNPFESLMNQKLDVILHLHQEHQVEVHISLENITTRLENIETRLSLSNLLKPHEDEAETSLSTAIPLELEVIPQVKELLDEGLVRKSLNPCSLLVPKIGIIRHQIPMIGGIMNVLNGATLFCKITHAPNTFMICVHRDSLGVEERIHEFQEPLDLRSNPFQGGGNDAILPPKGNG

SEQ ID NO: 94696 - protein, 63 aa, Glycine max
  Coding DNA Sequence Number=SeqID_3011
MTLYISLASACRARFRAEVAWHGDWPEAQAAEAPAETPDEPDGAREDEEMSDLLGFLGGSGAT

SEQ ID NO: 94697 - protein, 120 aa, Glycine max
  Coding DNA Sequence Number=SeqID_3012
GPPINLRIIRRKHSKKTQKHKPKRVESVNADAEAFGDDWKNSDCSMHCEAEAVEHTNKKRYRPSKCGIWTMGDSAKVVIKQDMKGRRHKYGFNNNEREKAQKKRVVDDETADKHQLDEVL

SEQ ID NO: 94698 - protein, 93 aa, Glycine max
  Coding DNA Sequence Number=SeqID_3013
  Homolog annotation: Hit_ID=Q2A9Z4; Match level="QueryCoverage=91%, HitCoverage=14%, E-value=4e-08, Identity=39%"; Hit description=Zinc knuckle family protein
MTIEESIHVSFDESNAILPRKDFLDDISDSLEDTHIHGNESKEKDEGSNEDSQDNGARRNNELPREWKASRDHPLDNIIGDISKGKNLKIILS

SEQ ID NO: 94699 - protein, 169 aa, Glycine max
  Coding DNA Sequence Number=SeqID_3014
MTEGCGEGFCLANLPGDAFSLWGTSLRQKTMMADAKSGKPWLKFAPRSTSWFLPVVGLARVGGAGLWPRAKFRIGWPPPPPRDQFCCQDFANFGLRPGRIKATRAESQWIVAARPLCHLQYPVAYLSRLQRILPAARWELRFKASRRANPPHEGHQRHVPLGGRGPLLL

SEQ ID NO: 94700 - protein, 111 aa, Glycine max
  Coding DNA Sequence Number=SeqID_3015
MEVGNRGWWVYARFVDVENLLCTIARPPPSTTCDGVKLPAFIVDHRVVPGDMSRGSGDLGDVRRAPGSQQIKGTKTTKQGGLWWLANCEFCVICDYGLWLENEVRKLREPL

SEQ ID NO: 94701 - protein, 422 aa, Glycine max
  Coding DNA Sequence Number=SeqID_3016
  Gene Ontology: Mol. function=siderophore-iron transmembrane transporter activity; Cellular component=cell outer membrane; Biological process=siderophore transport
  Homolog annotation: Hit_ID=A1FU97; Match level="QueryCoverage=54%, HitCoverage=30%, E-value=1e-122, Identity=96%"; Hit description=TonB- dependent siderophore receptor precursor
  Pfam annotation: Domain name=Plug; Domain location=232-332; Score =58.0; E_value=3.3e-14; Accession=PF07715.6; Description=TonB -dependent Receptor Plug Domain
HRAGFRPGLAHQRTVRPRHRDRAQRGGVAGAGARHGGGAHRYRAGPARRLPPGTAAVGGTRAPAGRPAADGPFRLRTVRSGVLRRCHRLDRECRRGVAALHAGAPGVVPQRAGTGTAAGPARGSLKGAGSQIRTIWSFEPQPHPRHGPVHLRAVASSPLLSEDESNEPLPSPHPALPRPLRRAAAARQRGRGPTDAAAIGAERSPTELAAVRVQAGKPKADTSRVNAFGGGSWKDTPASVNVLESDYLDRRQLRSLSELASNDASLGDAYAPVGYYQNVAIRGFALDAATGYRFNGLSIAGEQRLALENVQSVEILKGEAGLAAGVMAPGGIINYIGKRPAEVRTATLGTDSEGSRYVAVDVGHWITPRFGLRLNAAWDSSNSYVEHADGRRNFYSLAADWLIGERGKLEVDANYQTSSQRS

SEQ ID NO: 94702 - protein, 21 aa, Glycine max
  Coding DNA Sequence Number=SeqID_3017
MGRRQRTKLSVDELRALEVAA

SEQ ID NO: 94703 - protein, 650 aa, Glycine max
  Coding DNA Sequence Number=SeqID_3018
  Gene Ontology: Mol. function=citrate transmembrane transporter activity; Cellular component=integral to membrane; Biological process=citrate transport
  Homolog annotation: Hit_ID=A8G9B0; Match level="QueryCoverage=60%, HitCoverage=84%, E-value=1e-175, Identity=82%"; Hit description =Citrate transporter precursor
  Pfam annotation: Domain name=ADH_zinc_N; Domain location=398-551; Score=-14.2; E_value=0.012; Accession=PF00107.17; Description=Zinc -binding dehydrogenase
  Pfam annotation: Domain name=CitMHS; Domain location=1-349; Score =253.5; E_value=4.6e-73; Accession=PF03600.7; Description=Citrate transporter
  Pfam annotation: Domain name=KR; Domain location=401-568; Score= -82.3; E_value=0.014; Accession=PF08659.1; Description=KR domain
  Pfam annotation: Domain name=Voltage_CLC; Domain location=7-331; Score=-180.3; E_value=0.055; Accession=PF00654.11; Description =Voltage gated chloride channel
  Pfam annotation: Domain name=adh_short; Domain location=400-565; Score=111.2; E_value=3.1e-30; Accession=PF00106.16; Description =short chain dehydrogenase
  Pfam module annotation: Pfam domain module=ADH_zinc_N::CitMHS::KR::Vol tage_CLC::adh_short; Domain location=398-551::1-349::401-568::7 -331::400-565
LYFPVFLLGAVFGKLIELSGFSRSIVAAAIRILGRRHAIPVIVLVCALLTYGGVSLFVVAFAVYPFAAELFRQSGIPKRLIPATVALGAFSFTMDALPGTPQIQNIIPTSFFGTNAWAAPWLGLIGSLFIIAVGLLYLERQRRKAQLKGEGYGTDLLNEPETPDDINLPNPLIAILPLILVGVFNLGFTHWIPQGYGPSHKLTLPGLAKPIATDVAKITAIWAVEAALVSGILLVGVFGFRNIRGRLAEGSKTAVGGAILAAMNTASKYGFGAVIAALPGFLVLSQALSAIPNPLLNKAISVTLLAGITGSASGGMSIALAAMADNFVAAAHAAHIPLEVLHRVASMASGGMDTLPHNGAVITLLAITGLSHRQAYGGIFAITLIKSAAVLSDTMSVQGKTALVTGSTSGIGLGIASVLAAAGARVILNGFCDLAHAQAQVAQLGAAPGYHGADLGDAAHIADMMQYAESEFGGVDILVNNAGIQHVAPLDQFPVEKWNAILAINLSAVFHTCRLALPGMRERNWGRIINVASVHGLVASKDKSAYVAAKHGVVGLTKTLALETARTPVTCNAICPGWVLTPLVQQQIDKRIAAGTDPQRARDELLAEKQPSQEFVTPEQLGELALFLCSDAAAQVRGAAWNMDGGWLAQ

SEQ ID NO: 94704 - protein, 67 aa, Glycine max
  Coding DNA Sequence Number=SeqID_3019
MVQLISDTIYCLQESHPQRHLVDPEKSNRALGFPALGARSPRQGHVIIGIAPARHPVDPKKSNRALE

SEQ ID NO: 94705 - protein, 42 aa, Glycine max
  Coding DNA Sequence Number=SeqID_3020
MRAFAKRNTHGLRARKTLKEDELYRFTKRTASVNPLSEKGMR

SEQ ID NO: 94706 - protein, 61 aa, Glycine max
  Coding DNA Sequence Number=SeqID_3021
MDAPPSPLEFTSAHPQKGRKIPWICMYVAKYFTRMYVCLGSKIPHGKKESEQEKNKKEEKK

SEQ ID NO: 94707 - protein, 57 aa, Glycine max
  Coding DNA Sequence Number=SeqID_3022
MGAKYLEVVKQGSHPNNGWSPDENRAHNISRCSKLNMEAQGKFKQPQLLTRMSDLDQ

SEQ ID NO: 94708 - protein, 237 aa, Glycine max
  Coding DNA Sequence Number=SeqID_3023
  Homolog annotation: Hit_ID=A0ST23; Match level="QueryCoverage=10%, HitCoverage=51%, E-value=8e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLNSILTFRGLHVLIFRGLHVLAFRGLHTLAFRGLHVLSFRGLHALTFRGLHVLAFKGLHVLAFGGLHVLAFIGLYICTFRELNLLFPLVRVNFELGVIMVIAVSFGKPVVPAALMNRPTRGERRFAYWALAECILAYYVGTDEGVSEVLHVAEKKGCT

SEQ ID NO: 94709 - protein, 215 aa, Glycine max
  Coding DNA Sequence Number=SeqID_3024
MAPPKEIVIVIYHNGHIADDPVQGSVYTCANPIFIYVSRSITLTQLIQKINNRLPTRATAKVAQLLFCGPISFHQGQTRYISSQLLDNDDLGGAMEIILQNPQLNSAEFYVVTDLIPQPQPSSPQPSCPQLQLPPPQQLTYNNLNLNDPMSSYNNLETQDTSFDQQNHPSSPFRSPSQQPQTQTSNRNEYLIANEDPIIRSHKENMDDFSEDKDQ

SEQ ID NO: 94710 - protein, 95 aa, Glycine max
  Coding DNA Sequence Number=SeqID_3025
MYKDNWTQPWPMGSEIYPKVHENPKAFFSSSSPIFLEPLAHGSSDWSLPREDCIRFRNITEGKQEVPPEGGAFGRKQPSSPGRAGWQASPSFPYK

SEQ ID NO: 94711 - protein, 25 aa, Glycine max
  Coding DNA Sequence Number=SeqID_3026
MEKEEREEMPLQVEDESRSYTEELH

SEQ ID NO: 94712 - protein, 278 aa, Glycine max
  Coding DNA Sequence Number=SeqID_3027
  Homolog annotation: Hit_ID=Q84VI1; Match level="QueryCoverage=100%, HitCoverage=50%, E-value=8e-50, Identity=67%"; Hit description =Envelope-like protein
MATSPKETSASGSPAVPSSPHQEQPEFNIQPIQIIPGQASVPEKLIPRRQQGVKIAENPSPATSPREVDTEMDKKIRGIMSSILKDASVPDAEKDVPTSSTPDVSVPDVNKDVPTSSAPNAEALPSPSEEESTEEEDQASEETPAPRAPEPAPGNLIDLEEVESDEEPIANRCLDIKEDQDIREKVPENVPDAPLDNISFHSIGNAERWKFVYQRRLALERELGRAALDCKEIMDLITAAGLLKTVTKLGDYYESLVREFIVNIPSDITNRKSDEYQK

SEQ ID NO: 94713 - protein, 80 aa, Glycine max
  Coding DNA Sequence Number=SeqID_3028
ITPARHPVDPEKFNRVLGFRAVITGLCQFYEVPDAPNKVIRLPLTGLSSISTAPPGRRRARHHCSLGMADSGQQAHCHHL

SEQ ID NO: 94714 - protein, 94 aa, Glycine max
  Coding DNA Sequence Number=SeqID_3029
  Subcellular localization annotation: CTP_CleavageSite=21; ConfidenceScore=5.47e-01
MASSPASPPPPPPPSPPPPPSDASASPPVVHVDPTTSKVDGPRRKKLRTYLGIVARDKVDVTYENWKEVPTAQKGFIWEDIQVEFEIPEASDSR

SEQ ID NO: 94715 - protein, 53 aa, Glycine max
  Coding DNA Sequence Number=SeqID_3030
MDDEELSSPVNYDIVKCVLSFAFFIVLKNVHSRSCSLIPEPFGTFNSGVISVK

SEQ ID NO: 94716 - protein, 251 aa, Glycine max
  Coding DNA Sequence Number=SeqID_3031
MAKYGPEIVMELYANAWPTEEGVMDKRSWVRGQWIPYDEDAINQFLGHPLVLEEGQHYEYTERRSQVRIMHTSMTTLTQIWMTFLLSNILPNDHNSDLLLPKCQLVYANLTQISVHVAELISDAICQFFYGVPITPTKLIWPPINRYFIEKYCMPRQAQQLGQDQQQQPAIDAPPPPLPQPPSLESISTHMQRMELYMQHLAYHLYPWPTLEQFRTTVAWLGDRPNFQAGASPIEAPGDEDGAEEDGDIAD

SEQ ID NO: 94717 - protein, 164 aa, Glycine max
  Coding DNA Sequence Number=SeqID_3032
MGGEEAFLAYERTFFRKRKCLKMLRTEEGSSISCYGRTFFRKNLWKKIMFRTRGLGRALASVRGRGMGQDEHHADVPWQRRPTASARRQQIHVEVTEDVPHMDEDIPERTADVDVADVEGIAIDGAEGSPADHVKGFPGGPRDPSVLTLFAVHEAHSIWSGEVF

SEQ ID NO: 94718 - protein, 102 aa, Glycine max
  Coding DNA Sequence Number=SeqID_3033
MLGYKCEVKSHIGSPYVVTRGPQVYPSNLPNNWYQIRWFKLVTDSDEYARQVPQVAMAILVDDKDFRFPLEGETTMWKRLTLEGEMCWVTSVRSPYVVTRGP

SEQ ID NO: 94719 - protein, 178 aa, Glycine max
  Coding DNA Sequence Number=SeqID_3034
GFRDLGQAGGYAWGAAALVHMYDQLNEACQTPTRQMVGYLTLLQTIPPPPISASLSLEEIDDRWMHFSDHVAPAGEICVVPGQISHMFVTPTQAGDQPRHPPAPQDEEYVEPHIPEVPVASDLPRHSVDACEGCEAIAERLERVLNLRMITEGTELHEIMQDCLRIARGDASNGSLRA

SEQ ID NO: 94720 - protein, 112 aa, Glycine max
  Coding DNA Sequence Number=SeqID_3035
MVIDQSLFHNLTQLSSDGVPFEGTLNDDWKFDFSAHDARQLVCTNHADMTERLLAACLDFKDCHHQKGGDCRQRIKLNVLMMPKDHMDHMLLKALFKTKKLKIFKMDDQDSL

SEQ ID NO: 94721 - protein, 127 aa, Glycine max
  Coding DNA Sequence Number=SeqID_3036
  Subcellular localization annotation: CTP_CleavageSite=84; ConfidenceScore=5.21e-01
MCTCAIFGSQNALSMHVCKFSQGNACDVGSTPWKRLYAIFVLRVAFLGKTNFPNVCLRRKWPRGSLPQRGPGRIRRPKELVPLLSMTVTALGAQYTSSASRPSRDGRFSESDASSSETTSILISRRR

SEQ ID NO: 94722 - protein, 54 aa, Glycine max
  Coding DNA Sequence Number=SeqID_3037
MDFYKVERNLKDRRSLGDWRKGPITRAMSKRLQEDWARAAEEGPRVLMNLRVDF

SEQ ID NO: 94723 - protein, 144 aa, Glycine max
  Coding DNA Sequence Number=SeqID_3038
MYNMMRIMKLAKYRLKAQVEKDKAPEWRRIKVQVEKDEDPSGEGQSPQVEKDEGPSNPCGVYPDLSSFTGSGVYPDLSSFTGSGVYPDLFSFTGSGVYPDLSSFTGSGVIQKIYSLYQVIRPVRFTSSGIRAFLCYGSTNVAFV

SEQ ID NO: 94724 - protein, 79 aa, Glycine max
  Coding DNA Sequence Number=SeqID_3039
PLGPSRIFLQKAVASGGSNLARLGELGGNHLPYFAINRGGSEEGRAEALPKRFRNVFREDSRKGFNRFFDVLHRSSIFN

SEQ ID NO: 94725 - protein, 151 aa, Glycine max
  Coding DNA Sequence Number=SeqID_3040
MPPTWHPLDPDKFNRALGFPALITGLCQSFGVPVAPSKVIRSPITRAFIEKYCTQRQAQGGDPQAPDAPPPPPQADPAGSFDTERYLRHLLSLSLQSQGFASFPCPTPDQFRAEVAWPGDWPEAQAAEAPAETLGEPDEAREDEEMSDLLG

SEQ ID NO: 94726 - protein, 176 aa, Glycine max
  Coding DNA Sequence Number=SeqID_3041
MSHHSSSVNGEGTSHKDPLSRILDELSSLKLWKEKQERKEKGKKRVEEKSQDERKKIREEERRKIMKEMKREKHASYSSHNSCKSLSEELRDYYEGRHRSHLRPHSHRREKGHITSQCPSTKTMIMRGQDIYSSQDEATTSPSSSESEKAKGEESSEEIYPHEEGQPLVVKEKCKE

SEQ ID NO: 94727 - protein, 160 aa, Glycine max
  Coding DNA Sequence Number=SeqID_3042
DEPDDMRGYRMVIHTFCHPEAVSPMTYGETNVVFYTFCHLEAASPMTCGETYIVFCTFCHLETTSPMTRRGAVWLSASFIDQGKTSPLTCRDLHHLLHFLLSRDGKPDDKRGGDTQVIIRANGFCHLDPCSQVFTLVIRRHSIPTMHEILLCWAGAIECD

SEQ ID NO: 94728 - protein, 140 aa, Glycine max
  Coding DNA Sequence Number=SeqID_3043
QAKRALCAKPECLSVEAELSASMLASLLRLALEQNFIRFAKMASKNRKAPFTPIQARFDRSRFTSLEAWERYTDIVVPRKLLPERNVVVYYIEFDEFKEELERRHWDEKLADFSDSSIDIAIVKEFYENLYDPDDKSPKQ

SEQ ID NO: 94729 - protein, 51 aa, Glycine max
  Coding DNA Sequence Number=SeqID_3044
MRAAAPKPPLLSFCFPFHALVHSPQGMALGLRCILKQWGMPYCPHSLAIHA

SEQ ID NO: 94730 - protein, 270 aa, Glycine max
  Coding DNA Sequence Number=SeqID_3045
  Gene Ontology: Mol. function=transcription elongation regulator activity; Cellular component=intracellular; Biological process =regulation of transcription, DNA-dependent
  Homolog annotation: Hit_ID=P64274; Match level="QueryCoverage=54%, HitCoverage=93%, E-value=2e-76, Identity=94%"; Hit description =Transcription elongation factor greB
  Pfam annotation: Domain name=FCD; Domain location=1-123; Score=94.3; E_value=3.9e-25; Accession=PF07729.3; Description=FCD domain
  Pfam annotation: Domain name=GreA_GreB; Domain location=203-270; Score=119.4; E_value=1.1e-32; Accession=PF01272.10; Description =Prokaryotic transcription elongation factor, GreAGreB, C-terminal domain
  Pfam annotation: Domain name=GreA_GreB_N; Domain location=124-197; Score=156.6; E_value=6.8e-44; Accession=PF03449.6; Description =Prokaryotic transcription elongation factor, GreAGreB, N-terminal domain
  Pfam module annotation: Pfam domain module=FCD::GreA_GreB::GreA_GreB _N; Domain location=1-123::203-270::124-197
ARLLIEPETAALAARHASPEELAAIREAFEQNCRDNRAGSTTHPGDRLFHIRIAQASGNPAYAFIIGHLLGHRYGSMFRMLQRHYTPDDMPHRSEQEHRAILEAIEAHDVRAAKKAMKNHIDQMKTPLITREGYEKLKQEMDYLWRTERPEVTKKVTWAASLGDRSENADYQYNKKRLREIDRRVRYLTKCLENLKIVDYSPQQEGKVFFGAWVEIENDDGDTKRFRIVGYDEIFGRKDYISIDSPMARALLKKEVGDLAIVNTPAGEAS

SEQ ID NO: 94731 - protein, 164 aa, Glycine max
  Coding DNA Sequence Number=SeqID_3046
  Gene Ontology: Mol. function=protein dimerization activity; Biological process=DNA integration
  Homolog annotation: Hit_ID=A3B418; Match level="QueryCoverage=100%, HitCoverage=24%, E-value=1e-38, Identity=49%"; Hit description =Putative uncharacterized protein
  Subcellular localization annotation: CTP_CleavageSite=44; ConfidenceScore=5.13e-01
MSYSMRLSIFNSFNSLKLLSIAPTRFASTIVMLKRFKQLKKGLQEMVISDQWSSYKEDDVAKAKFMKDTLLDDKWWDKVDYILSFTSPIYDVLRRTNTEASSLHLVYEMWDSMIEKVKNVIYQYERKEESEGSTFYEVVHSILIDHWTKSSTPLHCLAHSLNPR

SEQ ID NO: 94732 - protein, 58 aa, Glycine max
  Coding DNA Sequence Number=SeqID_3047
  Subcellular localization annotation: CTP_CleavageSite=38; ConfidenceScore=5.00e-01
MLQPYGISIGLKEHSNPVTLKAYTPKSPSGPLPPDSASDSSISSGSLRFLQLFLRLIR

SEQ ID NO: 94733 - protein, 267 aa, Glycine max
  Coding DNA Sequence Number=SeqID_3048
AIGQLLGYPLVLEEGQECEYGQRRNQSDGFDEEAIAHLLCMLGPDFARTIAGRRVRIMRTNMTTLTQIWMTLLLSNIQPSDHNSDLPLPKCQLVYAILTRMSIHVAQLIADAIYLFAGMTPTRHPLDPDKSNRALGFPALITGLCQSFGVPVAPSKVIRPPITQAFVEKYCTQRQAQGDAPQAADAPPPHQAGPAGSFDTEYLQSQGFTSFLCPTPDQFRAEVAWPGDWPEARAGEAPAEAPDEADEAREDEEMADLLDFLGGSGAT

SEQ ID NO: 94734 - protein, 130 aa, Glycine max
  Coding DNA Sequence Number=SeqID_3049
MMIWEQRAKFVMATTRWVLKHPIYGIVILRLGIYTSRPNVSKLCSFIGSMNPSILISDNVPKGKLYEVPEQTLSTNNKKQDNIQMINDGTYEFGDATVMWLHMPPDSWVTVTKVGWSTKAGLLLLRILNL

SEQ ID NO: 94735 - protein, 168 aa, Glycine max
  Coding DNA Sequence Number=SeqID_3050
  Homolog annotation: Hit_ID=A8GJ25; Match level="QueryCoverage=30%, HitCoverage=14%, E-value=9e-14, Identity=71%"; Hit description =Putative uncharacterized protein
MGSQRNSAKRKARLSAIAELTPAQLQRIHAPVGLDIGSKTPAEIALAIMADIRLNDHITHPTKNPDVPGRQQTGKRLCQIFAPQIINKLCFMFHDVINACALPRRYRITTQGFALRFAAYKSATFGKSVMLLFEIRMAAEHALAGFTALMHDFKHHGVTGDEAELLKG

SEQ ID NO: 94736 - protein, 194 aa, Glycine max
  Coding DNA Sequence Number=SeqID_3051
LPWKLLRKDLSTLAQTWSVLSYSNLALTSHTSDLNLDRARLVYGLVMKMNMNLGSLIPGQISLIAQSNSSWLGFPALIIALCKARGVTSDSLTYESLGPAINLAYIKKNYWNLDDLSVTFPRTQKSRARRSEAPSPLAAPAPPTSAPSTSTLPSPPAAPVLPEPTPGPAPDYAELAGCGLAAGSYEPGGVCSEG

SEQ ID NO: 94737 - protein, 111 aa, Glycine max
  Coding DNA Sequence Number=SeqID_3052
  Subcellular localization annotation: CTP_CleavageSite=58; ConfidenceScore=5.19e-01
MTLLLSNILPSDRNANLPLQKDRTHKTPSGPGKVQQGPGVSSSGYGPLSVLQGARIVPARHPVDPKKSNRFYGVPVTSNKGIRPPTNRAFIKKYCVSRQAQGETPHQHWDG

SEQ ID NO: 94738 - protein, 67 aa, Glycine max
  Coding DNA Sequence Number=SeqID_3053
  Homolog annotation: Hit_ID=B0H6W1; Match level="QueryCoverage=56%, HitCoverage=90%, E-value=2e-12, Identity=97%"; Hit description =Putative uncharacterized protein
MAASYMVGDKLEDMLAAQAAGVGTKVLVRSEEAPANSVPAAAVIRRVQALIGITGRKAHAGGLLSQM

SEQ ID NO: 94739 - protein, 67 aa, Glycine max
  Coding DNA Sequence Number=SeqID_3054
MGSGKVCPHPSSGSGTLSFKGGSGDFDFPLGVGVLEREVDHEIFNKKLKCILPVPGSMPERLMGDGL

SEQ ID NO: 94740 - protein, 202 aa, Glycine max
  Coding DNA Sequence Number=SeqID_3055
  Pfam annotation: Domain name=zf-CCHC; Domain location=130-147; Score =31.2; E_value=3.8e-06; Accession=PF00098.14; Description=Zinc knuckle
MPKSSPNMHVKQEVSTRVKPRLLCKQSMGQNTPNKINDDGSNSHQGEWQSKENEMELQRLNQNEETDKRKRSIALKASSSIQEEEEDEESEDEEGLSLFVKFHKFVKKRRIERRQNFNHGKRFQEDSPTLRCYKCNQLGHIKANCPSNEQWPERNEKKSHEERRSKKAYIAWDDNDSSDGLEKEINLLSKDYESDENISQED

SEQ ID NO: 94741 - protein, 218 aa, Glycine max
  Coding DNA Sequence Number=SeqID_3056
MAGRRVRIMRTSMTTITQIWMTLLLSNTLPSDHNSDLPLSKCQLVYTILTQVSVHVAQLISDAIYQFVGIIPPRHPVDPEKSNRALRFPALITGLCQFYGVAVTPTKLIRPPINKAFIEKYCMPRQMYRYMHHVTSQHAANHKGQVRLNETFYRYNMRHQSQDPNRFPWPTPEQFEATVAWPGDETDFEIRAGPTGAPGDDGGAQEDDDMADVLDFFT

SEQ ID NO: 94742 - protein, 269 aa, Glycine max
  Coding DNA Sequence Number=SeqID_3057
MTTLAKTWSIFSFSNLIPTSHTSDVTLDRAKLIYGIIMKMDMNVGYLISHQISITTQHDSSRLGFPALITALCKARGVTSDSRSLESLSPTINVAYIKKNCWNLDDPTVTFRGPRKARGKRSESPTTSAAPSSSTPPAPSSSTPSTQIPLPAPSSFELKFFVYSRDASFYAPELTQRAAQEPEAVEEKIQVDEDELTPPEPFEFVSNSVLDQEEVPSPEPIQKPSPAPIPEYTMLAEDTQPSALVLEHEQLNIQDSSVAPVLDMNEDQP

SEQ ID NO: 94743 - protein, 62 aa, Glycine max
  Coding DNA Sequence Number=SeqID_3058
MKEIQGLQAPHGAMSILLLQSSMMQSYPARALDRKLQVDWARDAREGPRVLMSLRVDFGHMG

SEQ ID NO: 94744 - protein, 157 aa, Glycine max
  Coding DNA Sequence Number=SeqID_3059
  Homolog annotation: Hit_ID=A9PAY2; Match level="QueryCoverage=48%, HitCoverage=49%, E-value=2e-16, Identity=52%"; Hit description =Putative uncharacterized protein
  Pfam annotation: Domain name=DUF1195; Domain location=23-150; Score =47.0; E_value=6.8e-11; Accession=PF06708.2; Description=Protein of unknown function (DUF1195)
VLESTQGEEKPSTSYLPLPLPLPLPLHPITKKTTIHIISRSDSDDDDDRSHEEGKHGFEFVWEMELRWSATLNSLSNDIDTPIHDDVDVPEMEEKEKVVRHMWDVYTNSHCRRSSRMPMDLTSDVAELRDAAVTEIADVALLELVGLGSSSMEFCAS

SEQ ID NO: 94745 - protein, 156 aa, Glycine max
  Coding DNA Sequence Number=SeqID_3060
MKIKTNKTRNELKISDSNTYWLKNQERTKNEEERRKIFIDLLTETSQKRYRSTSTRFFFTETGKWRCLPPRGFLKKISKRTPITKFTPLFVLYGKVTEALRKCFGFDFHLFFSSISPILSEICLPKVFGNFMEATEAPETSFHQNVEELAAQLLPL

SEQ ID NO: 94746 - protein, 98 aa, Glycine max
  Coding DNA Sequence Number=SeqID_3061
MGVADVPQCDSFSSYHVWDWCAVVGRVGSASTAELTAAAVAALFSISCLIPSMASIMEAICSFKVDIHHPRFGSGVIGMSWGTLSYGVFPKKTNVRST

SEQ ID NO: 94747 - protein, 108 aa, Glycine max
  Coding DNA Sequence Number=SeqID_3062
MDPEKSNMVLGFPALITGLCQFYGVLVDPSKAGAGRDTTIAWGWLVVGNRRTAATSRAPQLIYKSWSVAYNPWPTSRRPSPNPKVSKSTRSVTDKSSRVQFKTLKKRY

SEQ ID NO: 94748 - protein, 51 aa, Glycine max
  Coding DNA Sequence Number=SeqID_3063
MVIPKFKVPDFGKYKGTTRSKNHLKMTTVAWYTNLGTFLSPFLEGPNGCLH

SEQ ID NO: 94749 - protein, 173 aa, Glycine max
  Coding DNA Sequence Number=SeqID_3064
MVPHQLNEWCYKCPCRNLRFGGRATRDSWVRVPRKEYARSRHQRLFEENIRKTGKDVAYELYVKGSGVVFMHGEGKRRRSLPPSSPRQARLLPLEGTAFWWNLLEGPSGPDGPRMKLGYDTMKSFQGLTQRFIGKLVKRRGGNFAFYSLRLREIFLQKFLHNFIPCLKTITYE

SEQ ID NO: 94750 - protein, 68 aa, Glycine max
  Coding DNA Sequence Number=SeqID_3065
  Subcellular localization annotation: CTP_CleavageSite=22; ConfidenceScore=5.11e-01
MNLTSLSLSSFLSQRALRGRARARLTGALSKGGKVDKSGAFAPTYPPLERKSDLRSSHLCVNQVILFT

SEQ ID NO: 94751 - protein, 105 aa, Glycine max
  Coding DNA Sequence Number=SeqID_3066
  Subcellular localization annotation: CTP_CleavageSite=44; ConfidenceScore=5.07e-01
MAFLVICNSLLLLRIRKRPHSPAPSALLPIGGCLSACAMPLRCVATYPSAGGRRVTRGIRVPRKEYARSRHQRLFEENVGKTEKDAIYEFLSERFGSCIYARGRY

SEQ ID NO: 94752 - protein, 175 aa, Glycine max
  Coding DNA Sequence Number=SeqID_3067
  Gene Ontology: Cellular component=mitochondrion
  Homolog annotation: Hit_ID=Q6R9L5; Match level="QueryCoverage=45%, HitCoverage=66%, E-value=4e-28, Identity=77%"; Hit description =Putative uncharacterized protein orf121-a-ct
MDVDKILPSSSTLGWHSLKVKGEVQTKKGLWWIPRHPETRKGVVSDEMLRGVENKRRSGDSRYRSTFRTAAESTGRQETTCPVAESITSLRSDPSSMGHVESRVNQQGPPCKAKYSWVTDSEVVPETTGAVAKASLHRAIVTAYGPEPGSEPTDVEESADELWLGVKCHSNPELA

SEQ ID NO: 94753 - protein, 41 aa, Glycine max
  Coding DNA Sequence Number=SeqID_3068
MVQKGTLSDIRVKSYCRLNLLNDFVINYKRLDILRDTIGPE

SEQ ID NO: 94754 - protein, 92 aa, Glycine max
  Coding DNA Sequence Number=SeqID_3069
  Homolog annotation: Hit_ID=Q40538; Match level="QueryCoverage=39%, HitCoverage=64%, E-value=1e-09, Identity=86%"; Hit description =Nicotiana tabacum (clone 5) activating factor DNA sequence
MKHFTDTLISANIETAMTMITPSSKLTLIKGTKAGTGPPLEVDGIDKLEPHECYCLALFMCPPPSSLGAMFHDCLSADPQGNPPFSPFFGAP

SEQ ID NO: 94755 - protein, 69 aa, Glycine max
  Coding DNA Sequence Number=SeqID_3070
  Subcellular localization annotation: CTP_CleavageSite=36; ConfidenceScore=5.12e-01
MKKIQAEALSQCFRDVFVSDFVKIFHRSSSFFVVLRSSTVLEELRRSDFLTTIEEYVRARETPLSTTER

SEQ ID NO: 94756 - protein, 295 aa, Glycine max
  Coding DNA Sequence Number=SeqID_3071
  Gene Ontology: Mol. function=3,4-dihydroxy-2-butanone-4-phosphate synthase activity; Cellular component=chloroplast; Biological process=riboflavin biosynthetic process
  Homolog annotation: Hit_ID=Q1GZH2; Match level="QueryCoverage=99%, HitCoverage=81%, E-value=1e-104, Identity=64%"; Hit description=3,4 -dihydroxy-2-butanone 4-phosphate synthase / GTP cyclohydrolase II
  Pfam annotation: Domain name=DHBP_synthase; Domain location=1-184; Score=351.6; E_value=1.4e-102; Accession=PF00926.10; Description=3,4- dihydroxy-2-butanone 4-phosphate synthase
MVILVDDEHRENEGDFVIAAEFVTAEHINFMAKYGRGLICLTLTEQRCRQLDLPPMVQKNGTRLGTNFTVSIEAAEGVTTGISAADRATTIRAAIAKQANAGSIVSPGHIFPLSAMNGGVLVRAGHTEAGCDLAQLAGCEPASVICEILKDDGEMARLPDLMQVAAEHDIKIGTIADLIHYRAAHETLIERSAERNIETVFGPMRLIAYRDNIAQETHLVLIKGDPQTSDEALVRVHEPLSMIDLLDSSHQAHSWNLLHAMRTISTAPCGVIVLINHDEDGLGLTDRILRADQKM

SEQ ID NO: 94757 - protein, 50 aa, Glycine max
  Coding DNA Sequence Number=SeqID_3072
MTKARQKGVRKEKEGDACHPARPSELGCFLQKQPPSGGTSWKAQVGLVAI

SEQ ID NO: 94758 - protein, 112 aa, Glycine max
  Coding DNA Sequence Number=SeqID_3073
MEVEEPWMGLWLPLHYRVDMGQVGFVADLGVAFADDWAFLTGRGFVTFRKELCKILKRGGKWSLWGHFSAPGPTRKLRDEVTSSPGRARLLLEEASSSPGRAVMQPPPLTFL

SEQ ID NO: 94759 - protein, 141 aa, Glycine max
  Coding DNA Sequence Number=SeqID_3074
MKKILHQLLSKNPQLRILAFHGKEAPFTLKKRNQERLLAYKGVRMSPPSLGISQSLKNSLISLKDENLAPCSALHSLKFTIFRPLMTPLALSVNYVQIRLKKGFLISTSRLAPFSCLARMPFQIPLYSPSALVLSFAVDAH

SEQ ID NO: 94760 - protein, 261 aa, Glycine max
  Coding DNA Sequence Number=SeqID_3075
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
ASGDAAQLTDLVYDGVFEVLQWLLFLSAVPPVQLLTGWCVTAKAPPDISAGKCSGRVPFAIQAAQLLGRAIGAGLFAITPAGERGMCCKAIKLGNARVFPEFDHVHHIKFLGHDTIEINKDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 94761 - protein, 112 aa, Glycine max
  Coding DNA Sequence Number=SeqID_3076
MAVDQHKALVSGSSSGLCLCWDWCFRWVETVRETNFVGETIVVEWAIFVGRTPDWEGFQRWLNNLADARNIGRWVVKGLLGFWACGSRSYDMGVSLRLLGPIHSEPPIACTC

SEQ ID NO: 94762 - protein, 60 aa, Glycine max
  Coding DNA Sequence Number=SeqID_3077
  Subcellular localization annotation: CTP_CleavageSite=43; ConfidenceScore=5.30e-01
MAGTPQYPSLSAALTRLVQRTICQVPSARLSSTLALSPISLTRAKHKGGAKCSVTISEPI

SEQ ID NO: 94763 - protein, 127 aa, Glycine max
  Coding DNA Sequence Number=SeqID_3078
MHKKLSPPPHGNQPESQGSSRPSDMPPSTSIPPNEKLQDIQQDDDKGDDKKLKDQSKNNPSNQVRIKNNSRVQDRIKRRIQDSRGKLRVKNQDSRFKISRIKIKIQDSREGLIKISMKSFSQKLSST

SEQ ID NO: 94764 - protein, 80 aa, Glycine max
  Coding DNA Sequence Number=SeqID_3079
MEELINKIQLSPKIMSTSSRRFGGSSPESYSFHPATVILLPRTRKISMQQGQADILIARFPDPNYVVKMVNFIINSPHLL

SEQ ID NO: 94765 - protein, 170 aa, Glycine max
  Coding DNA Sequence Number=SeqID_3080
MLEFDSNVFCRFKDRFFKVKETNIVVERFSLMLDGNREPRFLFYWQSDPTRFKSFDVSGAPEVRTNKDILKRLSTLMDVQAILSLPLTNNPLTILDGKMGDFEWQPFVKQVSSAGDGVPPLSTIILMSSGRERGQARVDLHRAFEDDKDKVVEVTPDVLPDAILPPKGIG

SEQ ID NO: 94766 - protein, 198 aa, Glycine max
  Coding DNA Sequence Number=SeqID_3081
MAICSGYWWLWVMEKELGMLEMVLEERRRGKWHFSKATRKAKAETLKCFCLRERKRSSHVRRRIEDCNELGYNFNKSPRHKIPQHTTVPIFGKELWRQQEEQLLQRYLGFNLNEAELKLSLMEAKLSKFILMMPKTQVKNQESNKSRIKSQTSFKNQSVVQSTIKIQVKIQEKTQDMQELHEKHQDKYKNIFSKEKIE

SEQ ID NO: 94767 - protein, 58 aa, Glycine max
  Coding DNA Sequence Number=SeqID_3082
MTTILAANVVAIDDGNGGDGDNHGGGSDDNKVVMVVIIMVVAAAVGRVVVAIIMMVMG

SEQ ID NO: 94768 - protein, 17 aa, Glycine max
  Coding DNA Sequence Number=SeqID_3083
MAHNQGWWHNTSRDRFL

SEQ ID NO: 94769 - protein, 148 aa, Glycine max
  Coding DNA Sequence Number=SeqID_3084
MTLAVRMAKALLFSSEKEACVVARQRRSMLLKVYLMEEDQSNKQHNEESESERSRTRDSLKESKLEAAKEKEANKKLEEELLMFKKQVVQQHEKGFFKAIKQVEFFTEGLDLGPFYPFKDVKVLSINLVMFTFHFVELLTQGRKDLLE

SEQ ID NO: 94770 - protein, 184 aa, Glycine max
  Coding DNA Sequence Number=SeqID_3085
GTSFVVQVEGTSTWVVVTENKRGYISCGLVLVEDTSTRLFKENKGGYIPCGSLLVKDFTRLKRNLKDRRSFGDWMPLDPTCPRFVDPLKIRPGTYLSFLPMAKGSPRANIGFDEPSKIRPKTGTALLDKDLGHHEVGDDNGDDHGVILVDGVKAFEIFVGECYGREASGDYCSLLTSISLMAWR

SEQ ID NO: 94771 - protein, 232 aa, Glycine max
  Coding DNA Sequence Number=SeqID_3086
MRGAPMEESMSPFLVRDFGARNFKAIQRIHKAWETPLRKDQELRGIRNGIIGGYHEWLKVHIRGLDWLAKLKVVSEESFEAPEEDKEVQALKSDLGKAKLAKEKFKLAATHIWKECAGLREENATTARALEQEAKRARKEEYGRNKFRGALWGSNNELKLRREERDEARAHSMGWKEELVACSRSKRSLSQRLCETETNMLAIIAKYQEELGLATAHEHRVADKCAQIYAEK

SEQ ID NO: 94772 - protein, 64 aa, Glycine max
  Coding DNA Sequence Number=SeqID_3087
MLTSPERAQMTILASAHQSHLGSLNDEVQITARCLRGLPALGSWQQKVEPLKGNYWSLNRECKS

SEQ ID NO: 94773 - protein, 299 aa, Glycine max
  Coding DNA Sequence Number=SeqID_3088
  Gene Ontology: Mol. function=helicase activity; Biological process =viral genome replication
  Homolog annotation: Hit_ID=Q9LTU4; Match level="QueryCoverage=99%, HitCoverage=23%, E-value=5e-81, Identity=45%"; Hit description =Helicase-like protein
MVESERFNYIRNNQKKLRVDKYCSLQNSLDVGTSQGLNKDKRVILPSTFVGSPRYMDRLYFDVMAICSHVGFPNLFITLTCNPNWPEIHRLLAPLNLKLADRPDIISRVFKLKYEEMLSYLTKNHQRGKTVAYSKYPTSDEIDLIISVEIPSKEDDQELYALVQNHMVHGPCGIIRSESPCMKEGKSSRFYPKMFQPRTLLDANGYPVYRRRNDGRTISKNGVIIDNRHIVPYNPKLLKKYQAHVNIEWCNQSTSIKYLFKYINKGYNRVTAVMLYDGNDEIQNATNQKDEIKEYIDCR

SEQ ID NO: 94774 - protein, 111 aa, Glycine max
  Coding DNA Sequence Number=SeqID_3089
GPPGFIYLRSDLPVTAVPPVQLLTGWCVTPKAPPDISAGKCSGRVPFAIQAAQLLGRAIGAGLFAITPAGERGMCSKAIKLGNARVFPEFDTAFSSNVKCRYVGTSLGHDS

SEQ ID NO: 94775 - protein, 33 aa, Glycine max
  Coding DNA Sequence Number=SeqID_3090
MEAPPVEDALSSVHFLSSDFLQTSSMGRCNRTP

SEQ ID NO: 94776 - protein, 114 aa, Glycine max
  Coding DNA Sequence Number=SeqID_3091
RFLEIPPVIPPTVPIEFPNIRETEKRLKPPLVLSSSDSFFSLHRYYLANSNGESTILDFCGKRESYGAKGISLSSVMILQFPTVLRATGKRKGFGEENRENENEGQKRHRQCEN

SEQ ID NO: 94777 - protein, 188 aa, Glycine max
  Coding DNA Sequence Number=SeqID_3092
MVFLGESSSQTIVNSRLTFIFPNGAVIHNECGVYFQSSTPVPMREQNLCDFSTLKSRIHNTLQLNNNQVVNEIHYRRPLKDTSNNIHFQCMQLKHDMDVNTMLMCNDQFSCVGPIELLCTVGRTPDAILNLLERPSIPTHDAVLYYNGRWNMPRQKNFVGYTFTRINPKKFDIPKGCTIDELKDLIKQ

SEQ ID NO: 94778 - protein, 113 aa, Glycine max
  Coding DNA Sequence Number=SeqID_3093
  Homolog annotation: Hit_ID=A5C4I3; Match level="QueryCoverage=46%, HitCoverage=20%, E-value=2e-11, Identity=67%"; Hit description =Putative uncharacterized protein
MVAQARAVDMLVETSSSRLWMAARALGVPRHLRAPGVGLWAPHSARLETRTKESDMCASQRASKPHTCRDPKDGELCLSGAKPEETLVEARSDTDVQIIAGARGRVLSGKAND

SEQ ID NO: 94779 - protein, 52 aa, Glycine max
  Coding DNA Sequence Number=SeqID_3094
MVHDIFVKVKLEVTRTLTVLNVFGSRRSSDKWVYDPNMVGSWYLTHAIKNVV

SEQ ID NO: 94780 - protein, 46 aa, Glycine max
  Coding DNA Sequence Number=SeqID_3095
MNVEEQSRIFTKLGEELATQLAQASKVASSRSNSLLEEESGGPKWA

SEQ ID NO: 94781 - protein, 38 aa, Glycine max
  Coding DNA Sequence Number=SeqID_3096
MALYRILSYLVATFSTCPAPGRDDDLSVVTLSSICIRL

SEQ ID NO: 94782 - protein, 70 aa, Glycine max
  Coding DNA Sequence Number=SeqID_3097
MSSSYRPQSNGQTENLNKTIEMYLSLGMTPFQAVFGRPPPAVMHYEVDPKDPDPLKALLQLRDQLLSKLK

SEQ ID NO: 94783 - protein, 188 aa, Glycine max
  Coding DNA Sequence Number=SeqID_3098
MGDFISRLSFPENTETFSSLRSYPELRRAEFLIGGYVGARASLLSTTPPFVVMIQELVAGGMSRETKFGHSASMIRGDTLRLSAPLCHSDTVVSVGTQRPKTKFGHSAHMIRGDTLRLSAPLCHSDTVVSVGTQRPKTKFGHSAHMIRGDTLRLSAPLCHSDTVVSVDKQRPKTKFGHSAYMIRGDTL

SEQ ID NO: 94784 - protein, 17 aa, Glycine max
  Coding DNA Sequence Number=SeqID_3099
MADQQATKSKAKGREIP

SEQ ID NO: 94785 - protein, 106 aa, Glycine max
  Coding DNA Sequence Number=SeqID_3100
  Subcellular localization annotation: CTP_CleavageSite=38; ConfidenceScore=5.63e-01
MHTQSFTNSQFLKIGLTHKKSPRWSRQLSQRALRGRARARLTGALPKGGKMRGVATNVYLWKRRETEGTGQNENSKFGSYITLEEGRQKRGFCSYVPSFGEEIRPT

SEQ ID NO: 94786 - protein, 122 aa, Glycine max
  Coding DNA Sequence Number=SeqID_3101
SFGVRITPSKVIRPPITRSFIEKYCTPRQAQGDAPQAADAPPPPHQADPAGSFGMERYLQHLVHQQAANHRGQFRAEITRPGDWPKAQAGEVPAEAPGDGEEARMDEEMTDLLGFLGGSGAT

SEQ ID NO: 94787 - protein, 198 aa, Glycine max
  Coding DNA Sequence Number=SeqID_3102
MDNEEGVQEQMKADLSALKDQMASITEAMLKLHKTIEDNATVAASNTAREAEPMLQPAINLGRDRNTTVFGRRYSPQAYPYAPTFEGQLPPYADYPLREDDEEDAHLGPLLPLKDPAPHELPQPNIVCHVPSPPTPVKESVPFAKDKGKIDLLEERLRAVEGLDNCPFSDLADLCLVPDIVIPPKFKVPDFDTYQGTT

SEQ ID NO: 94788 - protein, 194 aa, Glycine max
  Coding DNA Sequence Number=SeqID_3103
  Homolog annotation: Hit_ID=A4DID9; Match level="QueryCoverage=28%, HitCoverage=49%, E-value=4e-19, Identity=80%"; Hit description =Putative uncharacterized protein
EVGDLMTGEPTTEAPVNGGRNYNGPEVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDETHIDGKVWHLDVGSSPPGAVVCSKGWAVRPLKRYVSWVQNVVRQFGPYPDREGRTSGVPVIVPTVNAG

SEQ ID NO: 94789 - protein, 42 aa, Glycine max
  Coding DNA Sequence Number=SeqID_3104
MDRGMTLTDAPRSSMAFSNLLFPIMQGKTARKPHYKQNLEES

SEQ ID NO: 94790 - protein, 112 aa, Glycine max
  Coding DNA Sequence Number=SeqID_3105
MVMGDFINILSFPGGRIVFHSKKAYAALISWNICLFAKACLHFDGENTETFSSLTSYPELRRSEFLIGGYVGARASLLSTAPLFVTMTQKLVARGNTLRSIRTSSFSDPKCD

SEQ ID NO: 94791 - protein, 63 aa, Glycine max
  Coding DNA Sequence Number=SeqID_3106
MENRIATDQAPPLPSAKQAENVAARPAQYPLRSQFLLLLFVLNKLKLGKTLTHKRGETWLMHP

SEQ ID NO: 94792 - protein, 19 aa, Glycine max
  Coding DNA Sequence Number=SeqID_3107
GVMVGRNDRAIADALQALA

SEQ ID NO: 94793 - protein, 175 aa, Glycine max
  Coding DNA Sequence Number=SeqID_3108
MDLDIWDAIENDLFVPKNSIRDQIIDKTRDRWSGDDKRRLRKKGNQRRPNFNPEKNFKKDAKSSPIPRCYEFELRCSTPVIAQDEISFNVLIKNAKDTKRRGKRAFLLSFRDLGSPKIAYGSPGPLSYFSLKEPARLGEPTSGGSPLLFCAYSSPSSIIGNQLHRSEFLIAPEDT

SEQ ID NO: 94794 - protein, 178 aa, Glycine max
  Coding DNA Sequence Number=SeqID_3109
IPKQVRVRGHLVKFDEDTFNTFLKTPVVLEEGENLCTYSKFALLRPDPQKLATKLFIPGRGFKLNADGQPLKILMKNMTILAQTWSVLSFSNLIPTSHTSDVTLDRAKLIYGIIMKMDMNLGYLISHQISLIAQHDTSRLGLPALITTLCKARKVQSDSRSLENLSPAINLAYIKKNC

SEQ ID NO: 94795 - protein, 336 aa, Glycine max
  Coding DNA Sequence Number=SeqID_3110
MKCLEITCRLRSPAAKGDASYISPKSSELACGRKKLSNVKGDYRVPRPLEDQKVIPIGSSSSLKTRLGVFDSKSSSFERMVDSRCVGKSSSRFRRRDEVFRHCRDLLKERNDLEGRVEHTAKEKEGLVAIVAESTKEPELEATKEKEANKELEEELLTFKKEVMEQHEKGFYKVIRQAGFFTKCFYLGLFDPFMDVKDGELLNEEEVVVAKEDIDEEQDDGDRPSILMRSWQNKKQDVDRNAYQGRTLGRLTKGRPWVFRASWRFNQGRVRPIFWRDSPRVDLWLDEPLKKRPGMHLSRILALNLLHQWSHFILKDQSQQNGEGEKVIGDATSRRR

SEQ ID NO: 94796 - protein, 165 aa, Glycine max
  Coding DNA Sequence Number=SeqID_3111
MATRGGHRWSWVVEKEVLGRARLAGQNSLSAIPSRVGIALSTPLLAQRVEIVLSTPFSLSKTPEGVTFKSSMVRLWRNVLGSSRQNLKMIQRLTNPGSQFYKNRFRLIFSLKWSLQSPFLLLYSIAIDLQEVMDSIDEEDPRPISSTWSYIKTLKIFLKKISQKP

SEQ ID NO: 94797 - protein, 175 aa, Glycine max
  Coding DNA Sequence Number=SeqID_3112
MSASYLLLKICVLIIPEPDASLFVERPSFDGLEALLVLGAPETVAIKLGGGTGPFNYSVLPRSLRGKLFRSHFLRGQTFGKLIYKEIPIITNKSQTTLIWHENQGNGGNVACPITPEYNLGLRPSPTTPQFNENKQQSKDKSLTFFSKYMQLRAPKYTNGKLESPRMRYLLVGDE

SEQ ID NO: 94798 - protein, 210 aa, Glycine max
  Coding DNA Sequence Number=SeqID_3113
MGDQEETQEQMKADMSALKEQMASMMEAMLSMKQLIEKNAATAAAVSSAAEADPTHLATTHHPPSNIVGRGRDTLGHDGSPHLGYNRAAYPYGLPPNYSPPVLQEDAGHIASPVHEREPPQQPDEVHKDPQDYARRDVEFYPPIPEGPAPGTLPQPNIAASPIVLSMEGPPPATEERRKLDLLEERLRAVEGFGDYPFADMTDLCLVPDV

SEQ ID NO: 94799 - protein, 90 aa, Glycine max
  Coding DNA Sequence Number=SeqID_3114
MQSSQRDVYLGAYLNGPDNYLKGIINSAIKGLDDAPQPKSKASARWIVVKGTFRNNWEAYFNDPRPLEPERLKALRIQWAQFYLRVRHQA

SEQ ID NO: 94800 - protein, 106 aa, Glycine max
  Coding DNA Sequence Number=SeqID_3115
MISRLSQEQFKNQEKFDFKIQESRKDSIKIKGTSFVVQVDGISTWVVVTENKRWYISCGSVLGEGTSTRLFKENKGGYIPCGSLLVKDFTRLKRNLNDRRSLGEWM

SEQ ID NO: 94801 - protein, 262 aa, Glycine max
  Coding DNA Sequence Number=SeqID_3116
MARRDQLWSFCALLSSRGVGPDDMRRQIMVIPHTFLPFRHSCVRWHAETNYGHSAPFCHPEVAGPMTCGDKLWSFRTPFAIQIQSCPMARRDKLWSFCALLSSGGGGPDDMRRQIMVILHTPFAIQTQSCPMARRDKLWSFCALLSSGGGGPDDMRRQIMVIPHTLLPFRHSCVRWHAETNYGHYAPFCHPEAADPMTCGDKLWSFCTPFCHSDTFVSNGTQRQIMVILCPSSIAADKPVDTRRFTSSSVLTRSVNRGRQAR

SEQ ID NO: 94802 - protein, 98 aa, Glycine max
  Coding DNA Sequence Number=SeqID_3117
  Homolog annotation: Hit_ID=A5AY58; Match level="QueryCoverage=91%, HitCoverage=17%, E-value=2e-10, Identity=45%"; Hit description =Putative uncharacterized protein
  Subcellular localization annotation: CTP_CleavageSite=54; ConfidenceScore=5.30e-01
MDHSSSIQNVLPIPSLCPLGTSNQNVSEVPSSPPHPTEVAPPPLLTYQRRTQPVGSTALEHSGTRELVPLPPDKKTVGCRWVYTVKVGSNGEIDRLKA

SEQ ID NO: 94803 - protein, 146 aa, Glycine max
  Coding DNA Sequence Number=SeqID_3118
  Gene Ontology: Cellular component=mitochondrion
  Homolog annotation: Hit_ID=Q6R9L5; Match level="QueryCoverage=58%, HitCoverage=71%, E-value=8e-32, Identity=76%"; Hit description =Putative uncharacterized protein orf121-a-ct
MWQKEKESMDRPHRLHPVGNYEITPRTPSASRGSRTDHRTLFKKRKRISYPLSGWTFDLCYDLSFMDVDKILPSSSTLGWHSLKVKGEVQTKKGLWWIPRHPETRKGVVSDEMLRGVENKRRSGDSRYRSTFRTAAESTGRQETTW

SEQ ID NO: 94804 - protein, 296 aa, Glycine max
  Coding DNA Sequence Number=SeqID_3119
  Gene Ontology: Mol. function=transcription factor activity; Cellular component=intracellular; Biological process=regulation of transcription, DNA-dependent
  Homolog annotation: Hit_ID=Q7CV45; Match level="QueryCoverage=47%, HitCoverage=84%, E-value=2e-68, Identity=94%"; Hit description =Transcriptional regulator, MarR family
  Pfam annotation: Domain name=Fe_dep_repress; Domain location=195-243; Score=2.4; E_value=0.046; Accession=PF01325.10; Description=Iron dependent repressor, N-terminal DNA binding domain
  Pfam annotation: Domain name=MarR; Domain location=188-257; Score =63.4; E_value=7.8e-16; Accession=PF01047.13; Description=MarR family
  Pfam annotation: Domain name=TrmB; Domain location=183-254; Score= -9.1; E_value=0.034; Accession=PF01978.10; Description=Sugar-specific transcriptional regula
  Pfam module annotation: Pfam domain module=Fe_dep_repress::MarR::TrmB; Domain location=195-243::188-257::183-254
MGVQHHEFAHPSFMFQLGDAEPALDGLIVSQRLRARHIHVFDGISDRLRWQEGDGQMTGQGGGKAGDDAFSNQSIGLEGQVGAMLFMRAERQHGNCACCVKMRSARAFGKDFQQHISVPPQGKRHSRMSKDKSGNKDKSAKKDKGGKKVKDAKKRDENFNPEELAQSITQAARSMRTALSHSLAESGLYAGQDGVILALAQEGSLTPGQIAQKLGVKAPTMTRTIGRMEAQGFVERSGDDGDGRVTLVKLTEAGLKSVEHINVSIANCGAKAVEGLSAKDIRNIVKLLKAIDANLQ

SEQ ID NO: 94805 - protein, 142 aa, Glycine max
  Coding DNA Sequence Number=SeqID_3120
MGCTGPYLAHGPKIYPKTHKNPRAFSCISGPIYLESSIQYPCGVGLHHGIYSTWFASAANHRGQVQIHECLYQLSLSQQGQGFVPFACPTPDQFRAEVAWLGDWPEAQAGEAPTGSPGDAEKARMDEEMTDLLGFLGGSGAT

SEQ ID NO: 94806 - protein, 121 aa, Glycine max
  Coding DNA Sequence Number=SeqID_3121
RPSKKSLLELTSHDALLAQYKLPSKPLEILTVVPCVVKLMTQANASPLKKALKKFISWGISRGKGIPKEDFQAFSKVLIISKDNGGHTLATSSIKTRVDPQTGQFNKGLTSFKGRLSWKRP

SEQ ID NO: 94807 - protein, 98 aa, Glycine max
  Coding DNA Sequence Number=SeqID_3122
MTNFWSFGDPNRLKPIVTVWEICSTTNACIIIVVLIPGAKVMAVLSFAKNKFPKFLSLSNTATPSAYEDQAECFDDAKVSHASQSFIQDKEIKDIQDG

SEQ ID NO: 94808 - protein, 318 aa, Glycine max
  Coding DNA Sequence Number=SeqID_3123
ENAATARALEQETKSARKEEYGREKFRGALWGSNNELKLRREERDRSRVHGMILKEELVACTRSKRSLAQHLEATEQSMLAIIGQYKEELNQFVAHEQKLVADFAQVYAEKEARGRVIDALHQEATMWMDRFALILNGSQDLPRLLAKAKAMAEEQMKADLLALKDQMASISEVMLKLQKTIEDKATATASSTAREAEPVLQPILNPGRDRNTTVFGRRYSLQAYPYGLPPDFTPRATPEDLSQAPTFEGQLPPYDDYPGQDDEKGDTHLGPLLHLKDPSPHELPQPNIVRHIPASPTPVKESVPFAEDNGKIEALEE

SEQ ID NO: 94809 - protein, 65 aa, Glycine max
  Coding DNA Sequence Number=SeqID_3124
MMKEERRRFLLSPCRNLPFGGRATQGSRVRLPWEENAQSRHQRLFEENIRKTGKGVSLAPTYPQL

SEQ ID NO: 94810 - protein, 71 aa, Glycine max
  Coding DNA Sequence Number=SeqID_3125
MRVYDQGLPMDPKRIKVISEWATPPSIREIWDFNILTNFYKSSIGACRPMIFFINGFLCFLEDEWKRNGEG

SEQ ID NO: 94811 - protein, 67 aa, Glycine max
  Coding DNA Sequence Number=SeqID_3126
  Homolog annotation: Hit_ID=A4WAQ3; Match level="QueryCoverage=53%, HitCoverage=7%, E-value=1e-11, Identity=97%"; Hit description=SsrAB activated gene
MPQEIGAFSVSSSVCLLPRFVQAVGGGGQAVFESALQIREALRLRKQQAIVDCLAIPQVNDSGDRVD

SEQ ID NO: 94812 - protein, 392 aa, Glycine max
  Coding DNA Sequence Number=SeqID_3127
  Gene Ontology: Mol. function=molecular_function; Cellular component =membrane; Biological process=auxin mediated signaling pathway
  Homolog annotation: Hit_ID=A7QBC8; Match level="QueryCoverage=87%, HitCoverage=97%, E-value=6e-93, Identity=49%"; Hit description =Chromosome chr4 scaffold_73, whole genome shotgun sequence
  Pfam annotation: Domain name=DUF6; Domain location=179-308; Score =37.1; E_value=6.2e-08; Accession=PF00892.11; Description=Integral membrane protein DUF6
  Pfam annotation: Domain name=DUF6; Domain location=21-133; Score=9.6; E_value=0.019; Accession=PF00892.11; Description=Integral membrane protein DUF6
  Pfam annotation: Domain name=TPT; Domain location=170-308; Score= -18.3; E_value=0.0067; Accession=PF03151.7; Description=Triose -phosphate Transporter family
  Pfam module annotation: Pfam domain module=DUF6::DUF6::TPT; Domain location=179-308::21-133::170-308
MDMCNVVHALKPILLMVLVQVANAWVNVLYKLALNDGMNLSIIVAYRYVFATAFIAPLAFIVESGALPQNLNMEAIALTSVTFTTAISNLIPAITFIISLSFGLERLNLRRAGGKAKIIGTITGISGAMLLTFIKGPEVKMLSFHVNLFNHRNGHVVHPHATSGLMTIFGALASVASNVSYAMWLIIQAKMSERYPCPYSSTALMSLMGAVLSISFAFCVERDLSQWRLGWNIRLLTVAYAGIVVSGVMVAVISWCVRTRGPLFVSIFSPLMLVVVAFAGSTILDEKLYLGSIIGSMLIICGLYVVLWGKSKEMKKNQSGQSESTHKSDTIEIMVKPRVEDKSNNKSNTLINSVNVTGDNKDSWKNGRESNVSHIHCCKVQEEVTSQNVSRT

SEQ ID NO: 94813 - protein, 81 aa, Glycine max
  Coding DNA Sequence Number=SeqID_3128
MLGNFSAFIEELWGVFEGLKLAAASISDFWSFILIQNLLLVASLRSLKVVRTCDTGCESKYLNIKSAIMIAEGFLKACSGD

SEQ ID NO: 94814 - protein, 188 aa, Glycine max
  Coding DNA Sequence Number=SeqID_3129
  Gene Ontology: Mol. function=binding
  Homolog annotation: Hit_ID=A7PWT2; Match level="QueryCoverage=39%, HitCoverage=17%, E-value=2e-21, Identity=59%"; Hit description =Chromosome chr19 scaffold_35, whole genome shotgun sequence
MGQRVLARPLNRYCKRIKIHISRDIYREISDVHPEKCPMPVQLLREVHVVCPSPKKKIGHRKNVSDTVSAACPSCVGVGNVSNTWTWHSSEVSVFPSLEAVAKCNCIIIIINHSEVIKVDISWEALIKLVQWFYSDDLPNPPSGCLWDNKDDEEKLFNLQPYVELCWLVEFWILENIQEACWNVIVLS

SEQ ID NO: 94815 - protein, 1875 aa, Glycine max
  Coding DNA Sequence Number=SeqID_3130
  Gene Ontology: Mol. function=peptidase activity; Cellular component =nucleus; Biological process=proteolysis
  Homolog annotation: Hit_ID=A2Q484; Match level="QueryCoverage=30%, HitCoverage=76%, E-value=0.0, Identity=73%"; Hit description =Peptidase C50, separase
  Pfam annotation: Domain name=Peptidase_C50; Domain location=1334 -1768; Score=438.0; E_value=1.3e-128; Accession=PF03568.8; Description=Peptidase family C50
DVNLESTTLQGKQDQHKLFPFNLHYTLLQPPPQGKGDHDSLRLQLNVTTHVGNRVRMASDAISVTVDKEFVPLNFVLPKAKTPSPAEEISPKSGETSSFAGESEFLWIVGALLSACSWIGSIELFPLRMASPSESSLISKLQSSDSPGIHALVSDYLRPLSDLKPTKKPNPDQTLIRSLAKRFLSFLNASLSLLPKRLPEVSKSNDSDAVFLLELLRVYRLCLDCLDVVASQLASKPFSVELQRLRLIHCLESCGLLEEAQSEGFGVLEKLRPAKTKGKLLPEIDKGSGDDKELCYLVVDIVVSLVRCAAAGLAKEDGHFRKVLQLVEEVNPWLRTPFLDRDFVTLFWCTTLTEYVKSPIKDQVYKITLRICSSLFALRDNNSLYIMDILDSILRECKVEEGNTGKDFVELVYYCANKCQTANASFCSTFAAYLNKIAEHFKQVSTPINSILRLYAAGLLLVSCNLRSRTGDVASSGYAKFECLLGTLLENEKILQNSPPLLGSLHICIKSNCMSSSVEDQCFAGPPCILSGFDAEASMTYLSVYLEALKFLCQPLAKSINSERKQLVTEVDDASAMTMMSTVQDAFHILCHLILSSASSMPKNNGDGFDEKSKTVLNLVVAAFTLSIRTNLKVQYLAFFPFMFRFASSLSLIVVWYGNDMQIVCRRATQVDETIDSLTLYSLLSSSTELSKRNNAMILEQELTAYEEMGFKYPEFCQKMQMKITDILLQDIYITPDSRFQKAQTLVRKGKAIRVRGIGGLRDCIQCLSEAITILKEISGEICTDNNPIDHQLCVTYCLRAICTQEAEANSKQIFEDVKAALDLWLNISHLNHFEEGDCSALSDNIMILLYNVVDLLQLKGFMELFNDASRLVIKMFKRKNVPIEKWLPLMWESRSLSHALCVSPGNQSSLIGFQQNFSFLFASSHKNSCSHGSSFQTDITIAEVQKAALDLISNVPVPSHSTFLAGCLFYDLCPRLVANGQLIEALSSAKEAHRLHAKLFQRKFTHSVQQQNEEQNVIADSSKNLMDGIENIGLNLSVAREVLLFDSISWDLEDNYLSAWKVMQCYLESTLQVGIIHEMVGDGAEAETYFKWGKAISCSLNLPFFLIVFSSSLGKLYVKKRLWDLAEKELRSAEQILKESNTLFCCSKCKLKLEVTLYEYLGDLCQSKFDTCDGVMSEETAKNWYTSALDKLNLSEWKNPLSCPEVGSDGTATDIKCPAGKTCTCFIMNEAAKVLPKEPNLVVENTSRLTRSRYRSLQNQDTSIHRKLEVHESLEGNHVSDSSDMLSQNGSVFSNIGCPFPSRLVPDTTVDLAEYVKRFLAGLPSTTIISISLLGRDYTSLLQELLSYPTCVQAWMLVSRLSFKNEPVVMLLPLDSILQASGEGDLSTGSDTFPKCEEHSEKWRCPWGFTVVDDVAPAFKTILEENYLSTISPLEDTTQNRMLWWKRRKNLDHCLDKLLRNLEESCFGSWKCLLLGEWLNCKNFDLVLKNLVNDLRSKCKLDVNEGLLKIILGGSKYVCDGKTLVSQLCSKKDCYIAKVGYCNEARRGILNSADGIGVSSEVAFELLSEALNVLEVDDSMYREPIILVLDYEVQMLPWENLPILRNQEVYRMPSVSCISAVLHKDSNHKEQVGRNLGPFPLIDPLDAFYLLNPDGDLGGTQIEFENYFRDQNLEGKAGLRPTIKELASALESHDLFIYFGHGSGGQYIPRHEIQKLDKCAATLLMGCSSGSLTLPGQYAPQGIPLSYLLAGSPAIVGNLWEVTDKDIDRFGKAMLDAWLKERSDMPTECLQCNLLSEEFEAMNLKGCKGRAKRKAPRKKLLELAESESPKNCGHRRKIGAFMGQAREVCTLPFLTGASPVCYGVPTGIWRKTNV

SEQ ID NO: 94816 - protein, 53 aa, Glycine max
  Coding DNA Sequence Number=SeqID_3131
MGESFVRQERRKGKRKGRKEERLVEGWVPIMRGKGEKNGGAKLHTTSPKTVGP

SEQ ID NO: 94817 - protein, 611 aa, Glycine max
  Coding DNA Sequence Number=SeqID_3132
  Homolog annotation: Hit_ID=A2Q480; Match level="QueryCoverage=91%, HitCoverage=91%, E-value=1e-140, Identity=48%"; Hit description=Emr1, related
  Pfam annotation: Domain name=XS; Domain location=293-410; Score=-2.3; E_value=7.8e-06; Accession=PF03468.5; Description=XS domain
  Pfam annotation: Domain name=zf-XS; Domain location=223-261; Score =18.4; E_value=0.001; Accession=PF03470.5; Description=XS zinc finger domain
  Pfam module annotation: Pfam domain module=XS::zf-XS; Domain location= 293-410::223-261
  Subcellular localization annotation: CTP_CleavageSite=79; ConfidenceScore=5.66e-01
MADDGADPFPKLTSVYRVSGSKNNKLSWNVANSQQSVDSSVNNSRQLQSISDGSASRSWFSQNSRPNAWEVPSVIQKLRLGKRGNDGLTNNSNLQDKSNSPDALALTGSGILNDSKLPPESAISPTSETCLNSSVDVVDTTTSKDLKNVECKDERIPEPHCEDNGSDIVFDSDDDCFLDNIDLDTGERSHEQCKKSKWLRNFFDKLNALTNEEISSLDRQWHCPACQGGSGAIDWYKGLQPLLDHSRTIQTTRARLHRMFAETLEEECFRRRAPLTTVGEVHNIWEGLDKKVKDHEIVWPPMVIIMNTRYEQDESNKWNGMGNQELVDCFSDYAALKARHSYGPQGHRGMSALIFEETTAGYLEAVRLHKHFKEQGRDREAWDCCQNPFLPGGKRQLYGYLASKEDLDIFNKHSGGKTKLKFEMRSYQEMVERKIKHINDDSRKLDYYKSMVAKEQIKSQVGADSLCKSSEKLSMTTEKNRVDQQDKEMDALEKNFQSQIQDIQQAIAAKEDKFVKLQLQAMQEKVKESCKESSEKEDKVENISSFLKPQDKEMKQFEAEREKIKKIHEEKKLALKKKQWQEQVELEKELENELTQLMDKYNCNQSQEKNC

SEQ ID NO: 94818 - protein, 414 aa, Glycine max
  Coding DNA Sequence Number=SeqID_3133
  Homolog annotation: Hit_ID=A7PYS2; Match level="QueryCoverage=70%, HitCoverage=70%, E-value=1e-85, Identity=58%"; Hit description =Chromosome chr12 scaffold_38, whole genome shotgun sequence
VERESVVVIPDALEMGKNEQQHVQEEGQVETSFRLEKPVSQLIPYIETLEHDMHDEIALPNTEVALLSMHQSIPPNCTDVVFGVLSDPMNSSINPVSLSVLKSSLIELFLKQINLTLTSSIFGNASIFEILKFPGGLTVIPVQSAYIWQMPEILFNFTLNNSISEVLENFDDFKDELKFGLRLNSDENVYVQITNANGSSITPPVVVQASVMPGFGSLLPQRLKQLAQTITGSAGKNLGLDNSVFGRVKEVRLSSFLKNTLHASSPSPAPAPSPQLIDHSEPSTSPHRASPYTPISPAAAEQPPCFDCEVPSPAPSMVPAHPPDPCLYSGFLHHPIPSPKSYSKPSFPPDYSPAAAPTSNSASHTSEEASDPSREAEVSHGSKLRQGEETSNKLNFGNCLVCDGMLLKPRLGFF

SEQ ID NO: 94819 - protein, 292 aa, Glycine max
  Coding DNA Sequence Number=SeqID_3134
  Gene Ontology: Mol. function=hydrolase activity; Cellular component =integral to membrane
  Homolog annotation: Hit_ID=A9PBE1; Match level="QueryCoverage=88%, HitCoverage=87%, E-value=4e-72, Identity=49%"; Hit description =Putative uncharacterized protein
  Pfam annotation: Domain name=Rhomboid; Domain location=105-260; Score= 91.3; E_value=3e-24; Accession=PF01694.13; Description=Rhomboid family
MWASGHVTSPERGPQLLMLHRIIFPDSVVPFAEQKLAPLTHIFRLNDKWCQRCFQLNGLNYLQLSTGDLTSSWSTSFSFFNGGGDGGRRYGKAGMSNSKMSGKDPFNGRKWTEILLAANVLFYIAQLATQGKLLLWGAKVNCYSLNSVGPTVESFSGPRRFLAVYFISAIASSATSYWFCRMPAVGASGAIFGLVGSVAVFVLRHKDLVGGGKKDLQHIAQVIALNMVIGLLSTGIDNWGHLGGLVGGVAASWFIGPAWKHESTSSDGRRLFIDTAPMYKLFKIKRVPKQWK

SEQ ID NO: 94820 - protein, 93 aa, Glycine max
  Coding DNA Sequence Number=SeqID_3135
MEGGEVFMRGMSFIFIYMVEGPKKGDQLLGISFPRLFLNSNKKNDMVANMGGWEGLTWRWKFEWHREWFEREMEQVNFGGLVQNEILDRGEGD

SEQ ID NO: 94821 - protein, 381 aa, Glycine max
  Coding DNA Sequence Number=SeqID_3136
  Gene Ontology: Mol. function=molecular_function; Cellular component =cellular_component; Biological process=biological_process
  Homolog annotation: Hit_ID=A2Q3T8; Match level="QueryCoverage=42%, HitCoverage=58%, E-value=3e-40, Identity=60%"; Hit description =Ribosomal protein S7
MGSEGYEQVMGADRVFFHCSIVTFASSCDKRWSTQWLFLAISEVTVHVFVFSVLDGGKHLYSLKIAFLLLRFIAYDHVSSYRRKSRSISPRGHRSPSTTPRRRRSRTPSAKRYRRHRSRSSSLSPTRKSSSPSLGSVEHKSATEKLKKEEEKKSGVFGSLLIPLDVLMLYAFFFQPMNISFEPCREVGAYMVMDLVFIAHPLRKDWPDPLNHLQGGLVIRRQLEAELKLIEEETAKRVEEAIRKRVEESLKSEEVQVEIERRLEEGRKRLNDEVAAQLEKEKEAAIIEAKQKEEQARKEKEDLERMLEENRRKVEEAQRREALEQQRREEERYKELEEMQRQKEEAMRRKKHEEEQERLNQIKLLGKNKSRPKLSFALGSK

SEQ ID NO: 94822 - protein, 382 aa, Glycine max
  Coding DNA Sequence Number=SeqID_3137
MSKVKGVLNGWWCEMGVEKLVSEKGRKVDGSRTKSNVKIFTRVVGLVQSLELRRNAIKNKLHAQVVIIGQHWSECFEPLNAKHNVSVAQWKYMEVHCEGVALYKQIQGFHEAFLHEIMCATAVHQEHDIPMRDPTHHARVGWILAKLRVKLVFGLGRVINIGVRRLRGRGGGLTGDDKRGRVEVGVGTRTGNGGGKLVVEGGRGREPGPPGESRGRARRRSSSGEMRVPERFDPSNLGTSSFIRGGLLMVVLGVGVAEDEDGASLAIASSRCSKFDLERVDSAMRVNESTDVGDETILHWLRDCIKTVVVWNALRCLATGGHGIIFSPLRAGSSGSARSCDTTKPALQLVLQGNGVADILAKHGAMDSTSLVTYPSPPLEML

SEQ ID NO: 94823 - protein, 748 aa, Glycine max
  Coding DNA Sequence Number=SeqID_3138
  Gene Ontology: Mol. function=nucleoside-triphosphatase activity; Cellular component=cytoskeleton; Biological process=protein transport
  Homolog annotation: Hit_ID=A7QBR7; Match level="QueryCoverage=76%, HitCoverage=89%, E-value=0.0, Identity=76%"; Hit description =Chromosome chr1 scaffold_75, whole genome shotgun sequence
  Pfam annotation: Domain name=AAA; Domain location=249-449; Score =256.6; E_value=5.3e-74; Accession=PF00004.20; Description=ATPase family associated with various cellular activities (AAA)
  Pfam annotation: Domain name=AAA; Domain location=552-738; Score =271.8; E_value=1.4e-78; Accession=PF00004.20; Description=ATPase family associated with various cellular activities (AAA)
  Pfam annotation: Domain name=AAA_2; Domain location=245-390; Score= -46.3; E_value=0.037; Accession=PF07724.5; Description=ATPase family associated with various c
  Pfam annotation: Domain name=AAA_3; Domain location=249-377; Score= -20.3; E_value=0.056; Accession=PF07726.2; Description=ATPase family associated with various
  Pfam annotation: Domain name=AAA_5; Domain location=249-397; Score =0.1; E_value=0.0028; Accession=PF07728.5; Description=ATPase family associated with various
  Pfam annotation: Domain name=AAA_5; Domain location=552-683; Score =2.0; E_value=0.002; Accession=PF07728.5; Description=ATPase family associated with various
  Pfam module annotation: Pfam domain module=AAA::AAA::AAA_2::AAA _3::AAA_5::AAA_5; Domain location=249-449::552-738::245-390::249 -377::249-397::552-683
MGRRNGGRSLQETLRRRLESCKSKYSTAEEFANHLRSTYPDYHRTKHQTLIRFVQEALHSTAKLNHTPTPKHCDGDDDDDEEGEAQSASRKRRKKIDGSEERLQRMEALHVRSKVQRSSSSSSASESDDEDEEETVSTSEDAIYGEKVEPEFDLMKTMLRKSYTPKKVAAEEKNVELEVGNSSKDTLVNEERKEVKGSSSGSVSNRKDGPRFKDLGGMKEVLEELKMEVIVPLFHPQLPRQLGVRPMAGILLHGPPGCGKTKLAHAIAHETGLPFYQISATEVVSGVSGASEENIRELFAKAYRSAPAIVFIDEIDAIASKRENLQREMEKRIVTQLMTCMDQSNRLLQPADDVESSGDDHHPGYVLVIGATNRPDAVDPALRRPGRFDREIIIGNPDESAREEILSVLTCDLRLEGLFDLRKIARATSGFVGADLAALVDKAGNLAMKRIIDERKRELSQDLTSEHAEDWWREPWSVEEINKLAIKMSDFEEAANKVQPSLRREGFSSIPNVKWDDVGGLDLLRKEFERYIVRRIKYPEDYEELGVDLETGFLLYGPPGCGKTLIAKAVANEAGATFIHIKGPELLNKYVGESELAVRTMFSRARTCAPCILFFDEIDALTTKRGKEGGWVVERLLNQLLVELDGAEQRKGVFVIGATNRPEVMDRAVLRPGRFGKLLYVPLPSPDERVLILKALARKKAVDASVDLSAIAKMEACENLSGADLAALLQMSVEESYPLAYNEELYLA

SEQ ID NO: 94824 - protein, 252 aa, Glycine max
  Coding DNA Sequence Number=SeqID_3139
  Gene Ontology: Cellular component=integral to membrane
  Homolog annotation: Hit_ID=A7PYI8; Match level="QueryCoverage=100%, HitCoverage=76%, E-value=9e-76, Identity=62%"; Hit description =Chromosome chr12 scaffold_38, whole genome shotgun sequence
MDESSRLWDACHVLKSAISGMENYYLAASNIASSLDAYHYFTPQLSRQVIRAINVCQREILGLEEENRSLMETRIEPLSQCLIQNISMESKLNGFSGFRGVLYAMRSVSSLLLMILLSGLAYCWSSSCFHQGYDGHMVFGSTGFMVSMAILQQKVAEEIDQNIEGGQPGILLFEFQKAKNAMEELKLELERIAISCYEEGHADHEIQEKIHNVKSCFGLLRCGVETITGQLDDFFDEIVEGRKKLLDMCSHR

SEQ ID NO: 94825 - protein, 1207 aa, Glycine max
  Coding DNA Sequence Number=SeqID_3140
  Gene Ontology: Mol. function=ATP-dependent helicase activity; Cellular component=intracellular; Biological process=double-strand break repair via homologous recombination
  Homolog annotation: Hit_ID=Q8L840; Match level="QueryCoverage=94%, HitCoverage=95%, E-value=0.0, Identity=55%"; Hit description=DNA helicase isolog
  Pfam annotation: Domain name=DEAD; Domain location=452-628; Score =122.4; E_value=1.4e-33; Accession=PF00270.20; Description=DEADDEAH box helicase
  Pfam annotation: Domain name=HRDC; Domain location=1027-1098; Score =81.5; E_value=2.8e-21; Accession=PF00570.14; Description=HRDC domain
  Pfam annotation: Domain name=Helicase_C; Domain location=693-766; Score=60.1; E_value=7.4e-15; Accession=PF00271.22; Description =Helicase conserved C-terminal domain
  Pfam annotation: Domain name=RQC; Domain location=869-980; Score =101.6; E_value=2.4e-27; Accession=PF09382.1; Description=RQC domain
  Pfam annotation: Domain name=ResIII; Domain location=448-622; Score= -25.5; E_value=0.0067; Accession=PF04851.6; Description=Type III restriction enzyme, res subunit
  Pfam module annotation: Pfam domain module=DEAD::HRDC::Helicase _C::RQC::ResIII; Domain location=452-628::1027-1098::693-766::869 -980::448-622
MGICCLVATEMRQGEANSTQGPKVNLLQHANALENFSSQAKFLSSTFLFSVPPKKPPHHAEPNPGTAGFVFRRSETIQGSHRVQVEKALTAHSSLQNSSRIYVQLGKTQVTPQLHEDRRTTSFHGRYENDSRICPDVTVTPIVNNHSSRGLDGLVNNHTNYTGQIIKSSNCMAVDIDDDDDAILAPLLKCILTVYIHVDADFSLFVSVLLLTVFKNIDVDQIVEEHQSTCTPKPSISKFPPITPTADKDNFARQGDNVLPPELCLDCIHGYKLGFCPEAASHLQEMKDNLIAISNELLDNGENLNSTQIAKLRHDRSQLNKQIQQLEKYIHSGNLNEERQKSHFSASTAPPTSFVYETPQQTVLCNGSKRYDTQAYMGNETYGSSFQSLPSFSVDNCNMPLGSVGREAFIPKIIEVNYIEGSGDKRWSSYDFPWTKELEVNNKKVFGNHSFRPNQREIINASMSGCDVFVLMPTGGGKSLTYQLPALIRPGITLVISPLVSLIQDQIMHLLQANIPAAYLSANMEWAEQQEILRELNSDYCKYKLLYVTPEKVARSDNLLRHLDNLHFRELLARIVIDEAHCVSQWGHDFRPDYQVGALGLGILKQKFPNTPVLALTATATASVKEDVVQALGLVNCIIFRQSFNRPNLWYSVVPKTKKCLEDIDKFIRVNHFDECGIIYCLSRMDCEKVAEKLQECGHKCAFYHGSMDPAQRASVQKQWSKDEINIICATVAFGMGINKPDVRFVIHHSLPKSIEGYHQVLLLLAYMYDIYFPFRNVDELIRVKHMLSQGAIEQSSMTSGYNRSNMINSGRILETNTENLVRMVSYCENDVDCRRLLQLAHFGEKFNSSTCQKTCDNCLKITSFIEKDVTEIANQLVELVKLTGQRFSSSHILEVYRGSLSQMVKKHRHETVSLHGAGKHLAKGEASRILHHLVVEDFLGEEVKKSDFYGSVSSILKVNEPKVRNLFAGQRIILRFPSSVKASKPGKSDATPAKGSLTSEKLNVMQIDPPSPQTEVDHTNLLQILSAKLYNALRLLRKSLVTEAGEGVMPHHIFGNATLLLISKRVPRTKEELLDINGIGKAKVSKYGDQLLETIEKTVNEHYKLDNIGSGSKGSADSTKKRRVPNGNSDTNVEDDDAPTKSTGRSKKRTVKRQNRKGVIYDSPEEDYFQGCPDEDLDFDIIEIDALDQVTCKNTAGRVLPQWTAS

SEQ ID NO: 94826 - protein, 947 aa, Glycine max
  Coding DNA Sequence Number=SeqID_3141
  Gene Ontology: Mol. function=UDP-glucose:glycoprotein glucosyltransfer ase activity; Cellular component=endoplasmic reticulum; Biological process=protein amino acid glycosylation
  Homolog annotation: Hit_ID=Q9FVU8; Match level="QueryCoverage=95%, HitCoverage=57%, E-value=0.0, Identity=54%"; Hit description =Putative UDP-glucose:glycoprotein glucosyltransferase; 101200-91134
MGDLIELSERVRVYVMGYRSACLVLILFLILGIGTGIASSETPRPKNVQASLGAKWSGTPLLLEAGELLSKEDPRLFWDFIDIWLNAAADDQSHSAKACVIEILHHARPLLRQPLASLFEFSLILRSASPALVLYRQLAHDSLASFPLQDARAHAEITKLDPLRLGISLKSPGGKCCWVHTSQNLFFDVSQLLSWLQTQTPVGDSSQRPQLFDFDHVHFDSSAGGPVAILYGALGTGCFKDFHAALAEAAKQGKVNYVLRPVLPAGCETNFGHCGSVGASDSVNLGGYGVELAFKNMEYKAMDDSAIKKGWNNWHAVECRLLLKERKPELASEIMTFRDYLLSSTVSDTLDVWELKDLGHQTVQRIVRASDPLQSMHDINQNFPNIVSSLSRMKLDDSVQDEIMANQRMIPPGKSLMAINGALVNVEDIDLYLLIDLVHQDLLLADQFSKLKIPHSTVRKLLSTSPPSESSMFRVDFRTTHVHYLNNLEEDAKYKRWRSNLNEILMPVFPGQLRHIRKNLFHAVFVLDPATICGLEAMKSLIFGTLQSIDTIISLYENNFPVRFGIVLYSSKSITRLENHSAKEDGDKFEEDISDMIIRLFSYIKGNHGIQLAFEFLSNVNKLRIESDDHIDDAHLELHHVEGAFVETILPKVKSPPQEILLKLQKEPELKELSQESSMLVFKLGLSKIHCSLLMNGLVIDPTEEALLNALNDETQRIQEQVYFGQIKSHTDVLDKFLSEAGIQRYNPRIISDNKPRFISLSKFIFGEASILNDIDYLHSPGTMDDLKPVTHLLAVDITSGSGLHLLRQGLNYLKYLLSSAVEADSIQAFIDKVCELAEANGLPSDGYRSALPEFSADEVRRHLSKVENFFHRVLGSESSANAVFTNGRVTYPIDESTFLSPDLLLLESIEFKQRTKHILEIIEEVKWQDVDPDMLTRFLDLCSKCF

SEQ ID NO: 94827 - protein, 520 aa, Glycine max
  Coding DNA Sequence Number=SeqID_3142
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P14856; Match level="QueryCoverage=98%, HitCoverage=60%, E-value=0.0, Identity=66%"; Hit description=Seed lipoxygenase-2
  Pfam annotation: Domain name=Lipoxygenase; Domain location=176-520; Score=321.7; E_value=1.3e-93; Accession=PF00305.10; Description =Lipoxygenase
  Pfam annotation: Domain name=PLAT; Domain location=61-164; Score =141.6; E_value=2.2e-39; Accession=PF01477.14; Description=PLATLH2 domain
  Pfam module annotation: Pfam domain module=Lipoxygenase::PLAT; Domain location=176-520::61-164
MYSGVKGLFNRSQKVKGTVVLMRKNVLDINSITSVRGLIGTGINIIGSTIDGLTSFLGRSVCLQLISATKADGNGNGVVGKKTYLEGIITSIPTLGAGQSAFTIHFEWDADMGIPGAFLIKNYMQVELFLVSLTLEDIPNQGSMHFVCNSWVYNSKVYEKDRIFFASETYVPSETPGPLVTYREAELQALRGNGTGKRKEWDRVYDYDVYNDLGNPDSGENFARPVLGGSLTHPYPRRGRTGRKPTKKDPNSEKPGEAYIPRDENFGHLKSSDFLTYGLKSLTRSFLPALKTVFDINFTPNEFDSFEEVRALCEGGIKLPTDILSKISPLPVLKEIFRTDGESVLKFSVPDLIKVSKSAWMTDEEFAREMIAGVNPCVIRRLQEFPPQSKLDPSVYGDQTSVYIAFVEQAIKDQRLFILDHHDTFMPFLRRIDESKSSKAYATRTILFLKDDGTLKPLAIELSLPHPGQQQLGAYSKVILPANQGVESTIWLLAKAHVIVNDSCYHQLISHWSELSHSDH

SEQ ID NO: 94828 - protein, 861 aa, Glycine max
  Coding DNA Sequence Number=SeqID_3143
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P24095; Match level="QueryCoverage=99%, HitCoverage=98%, E-value=0.0, Identity=59%"; Hit description=Seed lipoxygenase
  Pfam annotation: Domain name=Lipoxygenase; Domain location=173-845; Score=1309.3; E_value=0; Accession=PF00305.10; Description =Lipoxygenase
  Pfam annotation: Domain name=PLAT; Domain location=47-160; Score =58.5; E_value=2.3e-14; Accession=PF01477.14; Description=PLATLH2 domain
  Pfam module annotation: Pfam domain module=Lipoxygenase::PLAT; Domain location=173-845::47-160
MSSMMVKGKVVLIRKYVLQTISNAKELVGNGFNLIGSSVEYDITKSVFFNLISRTKSSKDNYSKDGKEACLENNASVLRSLGGKEEEFDIYFEWDATEMGIPGAFYVKNHMKDEFFLVSMTLEYPLPTCDRHKDKNSIIHFLCNSWVHNHGCYKTHHRIFFDNNPYLPGNQTPEALRKYREEELDNLRGDGTGERKEWDRIYDYDVYNDLGYLDSDEKDDHPILGGTLYPYPRRVRTGRKLLNDKNINGGKYEKPADNVIYVPRDENFSLEKTTDFLEFGKKSLSGKVEPLLLSLYLKLTPNEFNGFEEVQRLYDQEGGIKLPISTTMGTENVLKFPTPHVIQASTFAWMTDEEFAREMIAGVNPNVIRLLKREDLAPRRRLDCKCNHSTITKEKLEINMGGVTVDEAFCNKRLFILDYYDAFMPYLRKINELDSAKAYATRTFLFLKDDGTLKPLAIELSKPHQCVYVLPHPPHMRPSPFLHYYFPSQVVLPADKGDDGTIWLLAKAYVVVNDTNYHQLISHWLHTHAVMEPFSIATHRQLSVLHPIYKLLHPHFRDTININALARQSLINAGSIIEQTFLPGKYSMEMSSAVYKNWVFTDQALPTDLIKRGLAVKDHTSPHGLRLMIKDYPYAVDGLEIWDAIKTWVQEYVNLYYSNDKAVEEDTELQAWWKEVVEKGHGDLKDNEWPKMKTCQELIDSCTIIIWIGSALHAAVNFGQYPYGGYILNRPTQSRRLLPEPKTKEYDEMVKNPQEAFLRTITPKFQTVIDLTVMEILSSHSSDEIYLGQRDTPNWTSDQNAKDVFETFTKTLAEIEKKISERNNNQELKNRTGPAKFPYTVLLPTSEPGLTFRGIPNSVSI

SEQ ID NO: 94829 - protein, 867 aa, Glycine max
  Coding DNA Sequence Number=SeqID_3144
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P24095; Match level="QueryCoverage=100%, HitCoverage=100%, E-value=0.0, Identity=76%"; Hit description=Seed lipoxygenase
  Pfam annotation: Domain name=Lipoxygenase; Domain location=182-851; Score=1634.8; E_value=0; Accession=PF00305.10; Description =Lipoxygenase
  Pfam annotation: Domain name=PLAT; Domain location=66-170; Score =141.0; E_value=3.3e-39; Accession=PF01477.14; Description=PLATLH2 domain
  Pfam module annotation: Pfam domain module=Lipoxygenase::PLAT; Domain location=182-851::66-170
MLGLFDKSHKIKGTVVLMPKSVLDINDLNSVKNGGVGGVVSGIFGAVADVTGQIVDTATAIFSRNVSFKLISATSTDAKGNGKVGNETFLEKHLPTLPTLGDRRDAYDIHFEWDANFGIPGAFYIRNYTYDEFFLVSVTLEDIPNHGTIHFVCNSWVYNFKDYDKKDRIFFANKTYLPSATPGPLVKYREEELKILRGDGTGERKEHERIYDYDVYNDLGNPDEDVKLARPVLGGSSTYPYPRRVRTGRKATKKDPKSERPASELYMPRDEKFGHLKSSDFLTYGIKSLSQKLLPSLENVFDSDLTWNEFDSFEEVRDLYEGGIKVPTGVLSDISPIPIFKEIFRTDGESVLQFPPPHVVQVTKSAWMTDDEFAREMIAGVNPNVIRLLKEFPPQSKLDPSLYGDQSSTITKEHLEINMDGVTVEEALNGQRLFILDYQDAFMPYLTRINALPSAKAYATRTILLLKDDGTLKPLAIELSKPHPSGDNLGAESKVVLPADQGVESTIWLLAKAHVIVNDSGYHQLMSHWLNTHAVTEPFIIATNRRLSVLHPIYKLLYPHYRDTININGLARNALINAGGVIEESFLPGRYSIEMSSAVYKNWVFTDQALPVDLIKRGMAVEDPSSPHGLRLAVEDYPYAVDGLEIWDAIKSWVQEYVSLYYPTDLAIQQDTELQAWWKEVVEKGHGDLKDKPWWPKMQTRQELIQSCSTIIWIASALHAAVNFGQYPYGGFILNRPTLSRRWIPEPGTKEYDEMVESPQTAYLRTITPKRQTIIDLTVIEILSRHASDEIYLGERDNPNWTSDSKALEAFKKFGSKLAEIEGKITARNKDSNKKNRYGPVQLPYTLLLPTSEEGLTFRGIPNSISI

SEQ ID NO: 94830 - protein, 405 aa, Glycine max
  Coding DNA Sequence Number=SeqID_3145
MGSTPHLETICPRYSTWAVANEHFESLRKKWLAQRTSNVVCKWSKCSGKVELGEPGGTAQLIEELVNCRVRETVFNGQSIEGSVVNTESPGAISLFDQEHRRRERARARANDALLKHHRDLGLNFLFLRIRISIGLDVDWGWGVETNMEEITDGISLDHAAELWGRDSFEVTVADQAVLHEVVRAAAVDQDDDGMGCYSADKAVFVCDKNEKTRGTMMPSRGGFGGVGNKGSGEGAREGGERGLGGVTTEWPASVYQLLLLESCEPDGVDNEANNAVSQGLELRQVLSDCPFLRELEEDPGRVLVWRMRKTGLNGFQKAWPGGELVVTGEPLKPCQCWALHVGGDGVRAIKAWDIKLHFVSMVGLATRRSRSSSLLATWIWVAANLAMASSIRSRLALSGSAMGG

SEQ ID NO: 94831 - protein, 1667 aa, Glycine max
  Coding DNA Sequence Number=SeqID_3146
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=A7LCD6; Match level="QueryCoverage=97%, HitCoverage=98%, E-value=0.0, Identity=73%"; Hit description =Lipoxygenase-10
  Pfam annotation: Domain name=Lipoxygenase; Domain location=34-577; Score=969.7; E_value=1.1e-288; Accession=PF00305.10; Description =Lipoxygenase
  Pfam annotation: Domain name=Lipoxygenase; Domain location=757-1427; Score=1638.5; E_value=0; Accession=PF00305.10; Description =Lipoxygenase
  Pfam annotation: Domain name=PLAT; Domain location=642-745; Score =150.7; E_value=3.9e-42; Accession=PF01477.14; Description=PLATLH2 domain
  Pfam module annotation: Pfam domain module=Lipoxygenase::Lipoxygenase: :PLAT; Domain location=34-577::757-1427::642-745
MGIPGVFYIQNFMHVEFYLVSLTLEDTYLPSEILGPLVEYREEELNTLRGDGTEERQEHYRIYDYDVYNDLGDPDTNDRLGRPVLGGSDTLPYPRRCRTGRKPSKKDPKSESRSNFVYIPRDESFGHLKLSDFLPEFTSFDDVHGLYEVGIKLPTDALSKLSPITLFKELFQTEGEQALKFPKPKVNQAEQSAWMTDEEFVREMLAGVNPTVIMASESKLDRQLYGDNTSTITREHLEPNLGGLSVEKAMENRKLFHLDHHDTIFPYLRRINETDTKAYAARTILFLQDNGTLKPLAIELSRPHPEGDKFGPVSNLNLPFGYLPRLMWLHTHAVVEPFIIATNRHLSVVHPIHKLLLPHYRDTMNINAVARNVLVNAEGIIESTFLGGKHALEMSAVAYKDWDFLWSSLPNDLVKRGRADADPSSLHGVVRLLIEDYPYAADGLEIWSAIHSWVEEYVSFYYKSDVAIAQDTELQAFWKEVREVGHADQKINARWPKMQTCSTLIWTASDLHAAVNFGHASDELYLGQRDSEFWTCDAQPLEAFKRFGKKLAEIEQKLIQRNNDETLKMSYTLLYPSSEEGLINRGHKVKGTVVLMQKNVLDVNALTSAKSVGGIAGGALGVVGGVIGTAVDTLTSFLGRSVALRLISATSSDGSGKGKVGKQTFLEGIVTSLPTLGAGQSAFNVHFEWDTDMGIPGAFYIENFMQVEFFLVSLTLEDIPNHGSIHFLCNSWVYNSKKYKSDRIFFANKTYLPSETPGPLVKYREEELKTLRGDGTGERQEHERIYDYDVYNDLGDPDSNARLARPVLGGSTTLPYPRRGRTGRKKSKKDPKSESRSDFVYLPRDESFGHLKSSDFLVYILKSASQNVIPKLQSALRLQFNQPEFNSFDDVRGLYDGGIKLPTDTLSQLSPIPLFKELFRTDGEQALKFPTPKVVQAVEQSAWMTDEEFTREMIAGVNPHIIKRLQEFPPKSKLDSQLYGDNTSTIAKQHLEPNLGGLTVEQAIQHNRLFILDHHDTIFPYLRKINATDTKAYATRTIIFLQDNGTLKPLAIELSKPHPRGDNYGPVSNVYLPANQGVEASIWLLAKAYAVVNDSCFHQLVSHWLNTHAVVEPFIIATNRHLSVVHPIHKLLLPHYRDTMNINSLARNVLVNAEGIIESTFLWGGYSLEMSAVVYKDWVFTEQALPADLVKRGVAVKDSSSPHGLRLLIEDYPYAADGLEIWATIKSWVQEYVSFYYKSDAAIAQDAELQAFWKELVEVGHGDKKNEPWWGKMKTRQELIDSCTILIWTASALHAAVNFGQYPYGGYILNRPTLSRRFMPEKGSPEYDELAKNPQKAYLKTITGKNETLTDLTIIEVLSRHASDELYLGQRDGGNGWTSDAQIIQAFKRFGNKLAEIEQKLIQRNNDETLRNRYGPVKMPYTLLYPSSEEGKIDAKIGRKKALKKNWKNWTACLTRNPGLARTLAKRKSSRLSTKKANEEAQRLDTHADVEPFVIATNRHISVVHPIHKLLPQYRDTMNINSLARLVLDNEESRGVAVEDSASSHGIRLLIEDYHYASDSELQAFWKELVEVGHANKKNEPWWPKMQTREELIELCTTLIRQYPYGGYVLNRSTLSRGFIPEKGSPEGKESDPYTHRGVVIYQCMLLIIYTLDKEMAVVIVGLLMHR

SEQ ID NO: 94832 - protein, 137 aa, Glycine max
  Coding DNA Sequence Number=SeqID_3147
YGQRYVHDVIDKRVQVNDIVDIEGPKSGVLERMEIVVGVVEFSGTIESYNNYENMSTDFSHATIKSTRTEYSFNNLESGLQTFRGAEILYVDRSSAKQIAFSLPCWKPDRAVAHSGTLSSFNNSGTGSQTFDGLKFN

SEQ ID NO: 94833 - protein, 792 aa, Glycine max
  Coding DNA Sequence Number=SeqID_3148
  Gene Ontology: Mol. function=ATPase activity, coupled to transmembrane movement of substances; Cellular component=integral to membrane; Biological process=transport
  Homolog annotation: Hit_ID=A7P6T6; Match level="QueryCoverage=98%, HitCoverage=96%, E-value=0.0, Identity=52%"; Hit description =Chromosome chr9 scaffold_7, whole genome shotgun sequence
  Pfam annotation: Domain name=ABC_membrane; Domain location=282-551; Score=91.7; E_value=2.3e-24; Accession=PF00664.14; Description=ABC transporter transmembrane region
  Pfam annotation: Domain name=ABC_tran; Domain location=626-792; Score= 139.1; E_value=1.2e-38; Accession=PF00005.18; Description=ABC transporter
  Pfam module annotation: Pfam domain module=ABC_membrane::ABC_tran; Domain location=282-551::626-792
MTYFGINIADFSWTCLRDFDLTSLCSQTSIIDILKLLFIAVFYTSLLVSLIRRHSECGSNRKNWVFLVVSVCCALISIAHFCNGLKLWNQKSWLASTFRAFVWLSLTISLHVQRNKWIKSLNSIWWASSCVLASALNIEIMFKEHTVELFEMVQWLVHFSLLFCAFQNLPYFATSEGIQDTTSLSEPLIAPRVETKQTQLGHATLLSKLTFSWVNSLLRLGYSKPLALEEIPFLLPEDEANSAYQDFVHAWESLLSENNNNNNNNKNLVLWSVVRTFSKENILIALYALIRSICMIISPLILYAFVNYSNSTEADLKEGFSILGFMIISKVVESLCQRHFGFGSRRSGMKIRSALMVAVYQKLLKLSSSARRRHSTGEVVNYIAVDAYRLGEFPWWFHITWTSAVQLVLSIVLLFGVVGAGALPGLVPLLICGVLNVPFAKMIQNSQSQFMMAQDERLRATSEILNSMKIIKLQSWEDKFKNLVLSLRAKEFIWLSKAQIIKAYGSFLYWMTPTIVPSVVFMGCSLFDSAPLNAGIIFTVLTTLRIMGEPVRLIPEALSIMIQVKVSFDRLNTFLLDEELDSINGYGRNIKQSSVNAVEIQAGNFIWDHESVSPTLRDVNLEIKWGQKIAVCGPVGAGKSSLLYAVLGEIPKISGTVNVGGTIAYVSQTSWIQSGTVRDNILFGKPMDKTRYENATKVCALDMDINDFSHGDLTEIGQRGINMSGGQRQRIQLARAVYNDADIYLLDDPFSAVDAHTAAILFNDCVMTALREKTVILVTHQVEFLTEVDTIL

SEQ ID NO: 94834 - protein, 158 aa, Glycine max
  Coding DNA Sequence Number=SeqID_3149
  Gene Ontology: Mol. function=RNA binding
  Homolog annotation: Hit_ID=A7Q8H8; Match level="QueryCoverage=88%, HitCoverage=15%, E-value=4e-30, Identity=54%"; Hit description =Chromosome chr5 scaffold_64, whole genome shotgun sequence
MKGKIPEIVGSHILSRVLQTCVKHCSQAERDAVFEELWPHFLTLAYNAYPVHSVKKMLNNRSPFLLIGHSPFSASQKQLAGFISTLRGHVAPLLRHMVGVKNLNVQLLAKVVNFPNKFCVSTYYAVLEHAYELANTAQKQELLSELYSTLLLLQVIYI

SEQ ID NO: 94835 - protein, 414 aa, Glycine max
  Coding DNA Sequence Number=SeqID_3150
  Gene Ontology: Mol. function=calmodulin binding; Cellular component =nucleus; Biological process=glucosinolate biosynthetic process
  Homolog annotation: Hit_ID=Q2HVD0; Match level="QueryCoverage=96%, HitCoverage=91%, E-value=4e-72, Identity=44%"; Hit description=IQ calmodulin-binding region
  Pfam annotation: Domain name=IQ; Domain location=102-122; Score=20.8; E_value=0.005; Accession=PF00612.18; Description=IQ calmodulin -binding motif
  Pfam annotation: Domain name=IQ; Domain location=80-100; Score=31.4; E_value=3.3e-06; Accession=PF00612.18; Description=IQ calmodulin -binding motif
  Pfam module annotation: Pfam domain module=IQ::IQ; Domain location =102-122::80-100
MSVLFRVRIHDRSTTEKGGGKSKRQWKLWKSTSEGFGIGSSMHKGQGGGGSFVVDGGAFAAALAAVVRTPLKDFMVIKQEWAAIRIQAVFRGFLARRALRALKAVVRLQAIFRGWQVRKQAAVTLRCMQALVRVQARVKARNVGNSQEGKYARCNEADPVKQAEQGWCDIPRTAEEAKLQMRQEGAIKRDRTKAYSQSKKKLTASPNSRASKSVIPLKNRKLDRKSSGWNMLDRWMAAKPWESRSMVEMYLDSPVMTPVTSKSDHLVLPFNSNQQIGTVKARRNGVTTRISTKSLTTSQSTPSSSAISSECMYDDSPMSTSCTSGSPARPSNNNVTVEPTEETNACKPSYMNLTASTKAKLKPCRCFSQNSKTIFMDDCVSLSGVTRSSSGSYPSANTWKNLYATPLRTSYQRQ

SEQ ID NO: 94836 - protein, 389 aa, Glycine max
  Coding DNA Sequence Number=SeqID_3151
  Gene Ontology: Mol. function=hydrolase activity; Cellular component =cytoplasm
  Homolog annotation: Hit_ID=A7P6M1; Match level="QueryCoverage=100%, HitCoverage=100%, E-value=1e-128, Identity=62%"; Hit description =Chromosome chr9 scaffold_7, whole genome shotgun sequence
  Pfam annotation: Domain name=SurE; Domain location=56-262; Score =52.7; E_value=8.1e-14; Accession=PF01975.8; Description=Survival protein SurE
MTTSSGSLKNTIPPGLQEVLLNRKRPQQEPNNNAGPSSSTEDAAIADDCSSSNSKLIVLVTNSDSIESPGLTFLVEALVRQGLYDVHVCVPQSWVPPFLSQMDKSASGHSVTRGETVEACSVQINGATAFEVSGTPVDCVSLALSGALFSWSKPVLVISGINQGSSCGHHMFYSGAVAGAREALLCGVPSLSISLNRKKDESQETDFKDAVVLCLPLINAAIRDVVNGTFLKNCFLNIEIPKSPLTSKGFKLTKQSMWRSTPNWQAVSTSRYPPGHFLASKQGFGLQFAQIGRDASAAGAARRLTTQKKNLEIVESIGAAGKADSNRVKKYFRLEFLDKQQEDIDDDLDYMALENGFVAVTPLSLSLHTETDIQMAASDWISSVLSGEQ

SEQ ID NO: 94837 - protein, 82 aa, Glycine max
  Coding DNA Sequence Number=SeqID_3152
MSYKVEWQGGAGSGCWVGILENADCSLLFEQSDGLCDDQSSCQLAGIDNCVTEEATREGILCRGGLAHAEVKVNPNTWILMI

SEQ ID NO: 94838 - protein, 530 aa, Glycine max
  Coding DNA Sequence Number=SeqID_3153
  Gene Ontology: Mol. function=nucleic acid binding; Cellular component= intracellular; Biological process=regulation of transcription
  Homolog annotation: Hit_ID=A7P6S4; Match level="QueryCoverage=89%, HitCoverage=94%, E-value=1e-139, Identity=55%"; Hit description =Chromosome chr9 scaffold_7, whole genome shotgun sequence
  Pfam annotation: Domain name=RS4NT; Domain location=149-186; Score =17.0; E_value=0.015; Accession=PF08071.3; Description=RS4NT (NUC023) domain
  Pfam annotation: Domain name=zf-C2H2; Domain location=164-186; Score =20.5; E_value=0.0063; Accession=PF00096.17; Description=Zinc finger, C2H2 type
  Pfam annotation: Domain name=zf-C2H2; Domain location=191-212; Score =15.8; E_value=0.17; Accession=PF00096.17; Description=Zinc finger, C2H2 type
  Pfam annotation: Domain name=zf-C2H2; Domain location=88-110; Score =25.6; E_value=0.00018; Accession=PF00096.17; Description=Zinc finger, C2H2 type
  Pfam module annotation: Pfam domain module=RS4NT::zf-C2H2::zf -C2H2::zf-C2H2; Domain location=149-186::164-186::191-212::88-110
MEMKGFMFHHQQQQQVVVEENMSNLTSASGEASAASSGNRTEIGTSYMAPPPSQTQQSKKKRNLPGNPDPDAEVIALSPKSLLATNRFICEICNKGFQRDQNLQLHRRGHNLPWKLKQRTSKEVRKKVYVCPEPSCVHHDPSRALGDLTGIKKHFCRKHGEKKWKCDKCSKKYAVQSDWKAHSKTCGTREYRCDCGTLFSRRDSFITHRAFCDALAEESARAITNPLLPPQQQQQQPSSSSHHQMSTLQTQFNPQNNLHAFPLKKEQQSFNVRTEMPPWLGPPAATVVVDHHHHHLSSSSSSIMFSPPHQENPNPNPSLGPTLAAYKTVANPPHMSATALLQKAAQMGATMSRSGSSPAMTGPHHHAHVSYSADSASAHFGLNLSSREDTTTSTTTTTTTKTATVFSHGLLSSPLGNKAGAAVSSSAPSLLHDVINSFSVSPSAFEGTPFEDAFIQSSKKLDDDDHHNLYLHDTFSKTSSSTGAAGNINEGLTRDFLGLRPLSHTDILTIAGIGNCIHDHQNQSQKPWQG

SEQ ID NO: 94839 - protein, 1137 aa, Glycine max
  Coding DNA Sequence Number=SeqID_3154
  Gene Ontology: Mol. function=nucleotide binding; Cellular component =intrinsic to membrane; Biological process=defense response
  Homolog annotation: Hit_ID=Q2HVE0; Match level="QueryCoverage=79%, HitCoverage=92%, E-value=1e-155, Identity=38%"; Hit description =Leucine-rich repeat; Leucine-rich
  Pfam annotation: Domain name=LRR_1; Domain location=594-612; Score =0.1; E_value=3e+02; Accession=PF00560.24; Description=Leucine Rich Repeat
  Pfam annotation: Domain name=LRR_1; Domain location=616-637; Score =5.1; E_value=35; Accession=PF00560.24; Description=Leucine Rich Repeat
  Pfam annotation: Domain name=LRR_1; Domain location=662-684; Score =6.8; E_value=17; Accession=PF00560.24; Description=Leucine Rich Repeat
  Pfam annotation: Domain name=LRR_1; Domain location=686-705; Score =7.7; E_value=11; Accession=PF00560.24; Description=Leucine Rich Repeat
  Pfam annotation: Domain name=LRR_1; Domain location=709-730; Score =9.7; E_value=4.9; Accession=PF00560.24; Description=Leucine Rich Repeat
  Pfam annotation: Domain name=LRR_1; Domain location=782-804; Score =6.0; E_value=23; Accession=PF00560.24; Description=Leucine Rich Repeat
  Pfam annotation: Domain name=LRR_1; Domain location=806-827; Score =2.3; E_value=1.2e+02; Accession=PF00560.24; Description=Leucine Rich Repeat
  Pfam annotation: Domain name=LRR_1; Domain location=829-850; Score =1.9; E_value=1.4e+02; Accession=PF00560.24; Description=Leucine Rich Repeat
  Pfam annotation: Domain name=LRR_3; Domain location=616-635; Score =37.0; E_value=6.9e-08; Accession=PF07725.3; Description=Leucine Rich Repeat
  Pfam annotation: Domain name=NACHT; Domain location=211-364; Score= -20.4; E_value=0.0023; Accession=PF05729.3; Description=NACHT domain
  Pfam annotation: Domain name=NB-ARC; Domain location=185-465; Score =110.5; E_value=5.1e-30; Accession=PF00931.13; Description=NB-ARC domain
  Pfam annotation: Domain name=TIR; Domain location=27-148; Score =143.3; E_value=6.7e-40; Accession=PF01582.11; Description=TIR domain
  Pfam module annotation: Pfam domain module=LRR_1::LRR_1::LRR_1::LRR _1::LRR_1::LRR_1::LRR_1::LRR_1::LRR_3::NACHT::NB-ARC::TIR; Domain location=594-612::616-637::662-684::686-705::709-730::782-804::806 -827::829-850::...
  Pfam module annotation: Domain location=616-635::211-364::185-465::27- 148
MAASNSAAVVGNASSSLSLSVTKKYDVFISFRGEDTRGDFTSHLHAALGRSSIETYIDYRIQKGEEVWVELVKAIKGSTLFLVIFSENYANSSWCLNELVELMECRKQEEEVHVIPVFYKIDPSQVRKQTGSYRAAVANQKWKDALYEAANLSGFHSHTYRTETDLIEDIIKVVLQKLNHKYTYDFRGLFISDENYTSIESLLKIDSMEVRVIGIWGKGGIGKTTLAAAIFHKVSFQYEGTCFLENVAEESKRHGLNYACNKLFSKLLREDINIDTNKVIPSNVPKRLRRKKVFIVLDDVNTPQLLENLVGAGAEWLGAGSRVIVTTRDRHVLKSRGVEKIHEVKEMNFHNSLKLFSLNAFGKTYPTEEYEELSKRVMVYAKGIPLALKVLGSFLRSKSENEWDSALTKLKKIPNQEIQTVLRLSYDGLDDGDKNIFLDIACFFKGQKGDSVTKVLNACGFSADIGIKNLLDKALITTTTDMHDSTTDSCIDMHDLIQEMGRGIVREESIDNPGQRSRLWDPEEVNDVLTNNTGTGAIQGIWLEMSQIQDIKLSSKSFRKMPNLRLLAFQSLNGNFKRINSVYLPKGLEFLPKKLRYLGWNGCPLESLPSTFCPEKLVELSMRYSNVQKLWHGVQNLPNLEKIDLFGCINLMECPNLSLAPKLKQVSISHCESLSYVDPSILSLPKLEILNVSGCTSLKSLGSNTWSQSLQHLYLEGSGLNELPPSVLHIKDLKIFASSINYGLMDLPENFSNDIVLSAPREHDRDTFFTLHKILYSSGFQSVTGLTFYNCQSLGEIPDSISLLSSLLFLSFLHSNIISLPESLKYLPRLHRLCVGECKMLRRIPALPQSIQCFLVWNCQSLQTVLSSTIEPLESPNGTFLLANCIKLDEHSFDAIIGEPPPSEVLEDAFTDNYIYQTAKLCYSLPARSGKVREWFHCHFTQSLVTVEIPPNLLGFIFYLVVSQVKLCHIGCCGSIGCECSLETSQNERISITSFVLDKNSMLIHPLPFEFMTDHVFVWYDGRICKQIMELVKERRAISSGDPKLRFKFFIQTRHNQEAVNIKECGFRWICSFEEGGCKPERSREIHEVEANVVTNKVEGSESNEQKETSHLKAEETEDLSYRLEEIMHIGFGGDRM

SEQ ID NO: 94840 - protein, 777 aa, Glycine max
  Coding DNA Sequence Number=SeqID_3155
  Gene Ontology: Mol. function=nucleotide binding; Cellular component =endoplasmic reticulum; Biological process=membrane organization and biogenesis
  Homolog annotation: Hit_ID=P93042; Match level="QueryCoverage=97%, HitCoverage=98%, E-value=0.0, Identity=70%"; Hit description=Root hair defective 3
  Pfam annotation: Domain name=GBP; Domain location=20-253; Score= -76.1; E_value=0.023; Accession=PF02263.10; Description=Guanylate -binding protein, N-terminal domain
  Pfam annotation: Domain name=MMR_HSR1; Domain location=45-138; Score=- 16.9; E_value=0.038; Accession=PF01926.14; Description=GTPase of unknown function
  Pfam annotation: Domain name=RHD3; Domain location=50-758; Score =1357.8; E_value=0; Accession=PF05879.3; Description=Root hair defective 3 GTP-binding protein (RHD3)
  Pfam module annotation: Pfam domain module=GBP::MMR_HSR1::RHD3; Domain location=20-253::45-138::50-758
MVLSEANSETCCSTQLIDGDGTFNVSGLESFMKEVKLAECGLSYAVVSIMGPQSSGKSTLLNNLFGTNFREMDAFKGRSQTTKGIWMARCADIEPCTLVMDLEGTDGRERGEDDTAFEKQSALFALAVSDIVLINMWCHDIGREQAANKPLLKTVFQVMMRLFSPRKTTLLFVIRDKTRTPLENLEPVLREDIQKIWDSVPKPQAHKETPLSEFFNVEVVALSSYEEKEEQFKEQVASLQKRFHHSIAPGGLAGDRRGVVPASGFSFSSEHIWKVIKENKDLDLPAHKVMVATVRCEEIANEKYASFVANEDWCQLEEAVQSGPIPGFGKKLSSLLDTCFSEYDAEATYFDEGVRSSKQKQLQEKLFQLVQPAFQSALGHIRSGTLDKFKEAFDKALKGGEGFSVAANNCIGSGLVQFDEACTDVVIEQTNWDTSKVREKLLRDIDAYVATVRATKISELTSSYEEKLKQALSGPVEALLDGANRDTWPSIRNLLRRETESAVSGFSAALTGFDMDEETRQKMILSLEAYARGLVEGKAREEAGRVLMRMKDRFTMLFSHDSDSMPRVWTGKEDIRAITKTARSSSLKLLSVMAAIRLDDDDTDNIEKVLAVALVDSSPSSNATRSITMVDPLASSSWEQEANKRNNNWLPPPWAIVALVILGFNEFMTLLRNPLYLGVIFVGFLLIKALWVQLDVSGEFRNGALPGIISLSSKFIPTIMNLMRKLAEEGQNPAANNPQRTPSKNSYNDGHAVSSSASSNLTALDNGTEYASPLKDE

SEQ ID NO: 94841 - protein, 191 aa, Glycine max
  Coding DNA Sequence Number=SeqID_3156
  Gene Ontology: Mol. function=protein serine/threonine kinase activity; Biological process=protein amino acid phosphorylation
  Homolog annotation: Hit_ID=A7P6R6; Match level="QueryCoverage=69%, HitCoverage=17%, E-value=9e-31, Identity=51%"; Hit description =Chromosome chr9 scaffold_7, whole genome shotgun sequence
MTSPPPEWVVFKNLFGFNLTGLNSKATLDAQGQESWSKAACCRKFWQTEILNDASDFGDYEVLYVHYPGLPPSPPSNVHGIDVASYPGHGNNGTIVKPLGVDISGKKKEGGGGRMVIMIELSSFTAFVLFIGVAWLCLLKCGSCTLEPEQIPDDKISSSSKQSGYRWLVGCGSEDSQKRGLAWSPSILCRS

SEQ ID NO: 94842 - protein, 95 aa, Glycine max
  Coding DNA Sequence Number=SeqID_3157
MAVDVQWPTTAPWPDRRLAQPWDLGRSTVTVWHRGGGWGKKRGAVRKGDEEIPNIGVSRGAHSDFDIYLQTRRYMYQEGSSTTSNKLSKAYLRMF

SEQ ID NO: 94843 - protein, 199 aa, Glycine max
  Coding DNA Sequence Number=SeqID_3158
MDPCRGVMICRPYSLQDNHTFFLLSKHDNNHLWHDPNLAASQPRVYLTREAADQGRAGDAAAVEGNVQLPVAEGSRRRLAGGTIADSDQCVVFPHELRNGGAADSVSEPLVAPDLADRVPRPHGGVAVPLLPPRRAARGAGPPRRRPPRAGRHGGAHGGAAAAHRCHREHPRGGGGRGGGGGGARRVQEDGGFILGRSC

SEQ ID NO: 94844 - protein, 515 aa, Glycine max
  Coding DNA Sequence Number=SeqID_3159
  Gene Ontology: Mol. function=pyridoxal phosphate binding; Biological process=carboxylic acid metabolic process
  Homolog annotation: Hit_ID=Q4H1G0; Match level="QueryCoverage=96%, HitCoverage=95%, E-value=0.0, Identity=73%"; Hit description =Putative serine decarboxylase
  Pfam annotation: Domain name=Pyridoxal_deC; Domain location=105-444; Score=-118.9; E_value=1.5e-07; Accession=PF00282.10; Description =Pyridoxal-dependent decarboxylase conse
MVVDALNEDLRINGAVEPLPEDFDATAVIIDPVPLAVVDNGIVKEEAQIIKGKEKREIVLGRNIHTSCLEVTEPEADDEVTGDREAHMASVLARYKRALTERTKHHLGYPYNLDFDYGALTQLQHFSINNLGDPFIESNYGVHSRQFEVGVLDWFARLWELEKNEYWGYITNCGTEGNLHGILVGREVFPDGILYASRESHYSVFKAARMYRMECEKVDTLWSGEIDCDDFKAKLLSHQDKPAIINVNIGKFLHHCFSLSHPMSPLLFILLILAHPTETIAGTTVKGAVDDLDLVIKKLEEAGFSHDRFYIHCDGALFGLMMPFVKRAPKVTFKKPVGSVSVSGHKFVGCPMPCGVQITRLEYVNALARDVEYLASRDATIMGSRNGHAPIFLWYTLNRKGYRGFQKEVQKCLRNAHYFKGRLVEAGIGAMLNELSSTVVFERPHDEEFIRKWQLACKGNIAHVVVMPNITIEKLDDFLNELLEKRATWFQDGKDQPYCISSDVGEKNCLCALHK

SEQ ID NO: 94845 - protein, 354 aa, Glycine max
  Coding DNA Sequence Number=SeqID_3160
  Gene Ontology: Mol. function=phosphatidylserine decarboxylase activity; Cellular component=ribonucleoprotein complex; Biological process=phospholipid biosynthetic process
  Homolog annotation: Hit_ID=Q9LU67; Match level="QueryCoverage=61%, HitCoverage=30%, E-value=8e-78, Identity=67%"; Hit description =Phosphatidylserine decarboxylase
  Pfam annotation: Domain name=PS_Dcarbxylase; Domain location=37-273; Score=156.3; E_value=8.3e-44; Accession=PF02666.6; Description =Phosphatidylserine decarboxylase
  Pfam annotation: Domain name=Ribosomal_L44; Domain location=268-344; Score=167.4; E_value=3.7e-47; Accession=PF00935.10; Description =Ribosomal protein L44
  Pfam module annotation: Pfam domain module=PS_Dcarbxylase::Ribosomal _L44; Domain location=37-273::268-344
MEVRAVVGILSVRAAVAEIGRIIAHCGSEELTIFRTFNEFFIRELKPGSRPIASAERDDVAVCAADCRLTAFKSVDDSTRFWIKTSISQKLETVSDFQDRGVGGGNGFAIMRVRSGGRKFSVQGLLGKEMCSSAFVDGPMVIFRLAPQDYHRFHFPVSGIIEQSVDIPGCLYTVNPIAVNSKYCNVFTENKRVVSIVSTVDFGKVAFVAIGATMVGSITFTKKKGDYVKKGDEFGYFSFGGSTVICVFEEVNVPKTKKTYCKSKECRKHTLHKVTQYKKGKDSIAAQGKRRYDRKQSGYGGQTKPVFHKKAKTTKKIVLRLQCQGCKHVSQHAIKRCKHFEIGGDKKGKGTSLF

SEQ ID NO: 94846 - protein, 431 aa, Glycine max
  Coding DNA Sequence Number=SeqID_3161
  Pfam annotation: Domain name=C1_3; Domain location=37-70; Score=6.2; E_value=0.1; Accession=PF07649.3; Description=C1-like domain
  Pfam annotation: Domain name=Rubredoxin; Domain location=36-70; Score= -0.4; E_value=0.069; Accession=PF00301.11; Description=Rubredoxin
  Pfam module annotation: Pfam domain module=C1_3::Rubredoxin; Domain location=37-70::36-70
MKLLESKKRAEAWPESSENPSDTGPPHKKTRDLLNMTECHVCGFKVDVCTASPESFRCNQCLHSVHKSCFLKYRNAAPWSYACLGSEFSVCVDCWIPKHLAISRRRNKIGVKNGKHVRVIPDKGSSRVFGGGNLVRSMEDLVEDAKRTVEVKVEAASRAREEAMKKALVARSSVEIANNALSLVAKNREESSCLNLPPKVDDAVKVLDGSEFTFELHPCFDRGLPRISKSCCLLNASYFDTSKRWTSSVDLSCKISKSRNASDRDKHEVVSNNSVGAALDSGSLTDLNLLYMGTSGMETGLGTAEFDSEGIGEEELLKEGEGSCSDRLINFSEDSGMELDHKQADSALHGEEQCNGQPDRYLFKYSRRCNGQPDSALHTEERCNGQPDRYFFKYSRRCNGQPDHYFFKYMDILEAILEKNGYKQVSDSCFG

SEQ ID NO: 94847 - protein, 1240 aa, Glycine max
  Coding DNA Sequence Number=SeqID_3162
  Gene Ontology: Mol. function=ATPase activity, coupled to transmembrane movement of substances; Cellular component=integral to membrane; Biological process=transport
  Homolog annotation: Hit_ID=Q8LGU1; Match level="QueryCoverage=99%, HitCoverage=99%, E-value=0.0, Identity=56%"; Hit description =Multidrug resistance-associated protein 6 precursor
  Pfam annotation: Domain name=ABC_membrane; Domain location=126-396; Score=84.7; E_value=2.9e-22; Accession=PF00664.14; Description=ABC transporter transmembrane region
  Pfam annotation: Domain name=ABC_tran; Domain location=1020-1203; Score=154.7; E_value=2.5e-43; Accession=PF00005.18; Description=ABC transporter
  Pfam annotation: Domain name=ABC_tran; Domain location=472-643; Score= 157.7; E_value=3.2e-44; Accession=PF00005.18; Description=ABC transporter
  Pfam annotation: Domain name=MMR_HSR1; Domain location=1021-1157; Score=-18.7; E_value=0.055; Accession=PF01926.14; Description=GTPase of unknown function
  Pfam annotation: Domain name=SMC_N; Domain location=461-647; Score= -116.0; E_value=0.0041; Accession=PF02463.10; Description=RecFRecNSMC N terminal domain
  Pfam module annotation: Pfam domain module=ABC_membrane::ABC _tran::ABC_tran::MMR_HSR1::SMC_N; Domain location=126-396::1020 -1203::472-643::1021-1157::461-647
MAIWPVHILTIFCAFQNHGFFVPQETPDASLCEPLLVHKDMHKQTELGHASFCSRFSFSWMNALLSLGYSKPLALEDIPSLASEDKADFAYQKFVHAWDSLLRERGRNNSRNLVLWSIARVYLNENIFIAICAFLRTICAVVSPLLVYAFVNYSSSIEEELKQGIAIVGCLIFAKVVESVSQRHWSFNSRRLGMKMRSALMAAVYQKQLKLSALGRRRHSTGEIVNYIAVDAYRMGEFPWWFHTLMFSALQVFLALGVLFGVVGLGALPGLVPLIICGFLNVPFAKILQKCRSEFMIAQDERLRSTSEILSSMKIIKLQSWEDNFKKFVESLRAKEFKCLAEAQFMRAYGTFIYWMSPAIISSVIFVGCALFQSSPLNAATIFSVLAALRSMGEPVTLIPEALSVLIQVKVSFDRINTFLLDDEIKSDDIRRTSKQDSCSKSVEILAGNFSWDQQQSVPPTLRKVNFEIKWGQTVAVCGPVGAGKTSLLYAILGEIPKISGIVSVCGTLAYVSQTPWIQSGTIRDNILYGKPMDETRYGYTIKVCALDKDIDGFRHGDLTEIGQRGINMSGGQKQRIQLARAVYNDADIYLLDDPFSAVDAHTASILFNDCVRVALRRKTVILVTHQVEFLSKVDKILVMERGKITQLGNYEDLLTAGTAFEQLLSAHREAITGIEKSSAYKREVENLVAVQLEDSHVCNLTKGGSDGDISTKIQLTQEEEKESGDVGWKPFCDYIFFPKGSLLLCLSILAQFAFVGFQAASTYWLALAIEMQKASSDLSILDFDIPFTTIFVTSEIAELLTMIGIMVSVTWQVLIVAVLAMVASKYVQGYYQASAREIIRINGTTKAPLMNFTAETSLGAVTIRAFNMTDRFFKNYLNLVDTDATMFFHSNAAIEWLILRIELLQNLTLFTAALLLVLLPKGYVAPGLVGLSLSYAFSLTATVVYLTRMFCNLSNYVISVERIKQFIHIPAEPSAIVEDNRPPPSWPSKGRIDLQSLEIRYRPNAPLVLKGISCRFEEGSRVGVVGRTGSGKTTLISALFRLVEPTRGDILIDGINICSIGLKDLRTKLSIIPQEPTLFKGSIRKNLDPLCLYSDDEIWKALEKCQLKATISSLPNLLDTSVSDEGENWSVGQRQLICLGRVLLKRNRILVLDEATASIDSATDVILQQVIRQEFSECTVITVAHRVPTVIDSDMVMVLSYGKVVEYDKPSKLMGTNSSFSMLVAEYWSNCNRNSLPKD

SEQ ID NO: 94848 - protein, 239 aa, Glycine max
  Coding DNA Sequence Number=SeqID_3163
  Gene Ontology: Mol. function=phosphoric monoester hydrolase activity; Biological process=metabolic process
  Homolog annotation: Hit_ID=A7P6T8; Match level="QueryCoverage=99%, HitCoverage=99%, E-value=8e-74, Identity=53%"; Hit description =Chromosome chr9 scaffold_7, whole genome shotgun sequence
  Pfam annotation: Domain name=Put_Phosphatase; Domain location=4-197; Score=267.4; E_value=3e-77; Accession=PF06888.3; Description =Putative Phosphatase
MAGIVVIFDFDSTIIECDSDNWVLDETGLTEKFYQLLPSMAWNPLMDKMMNELHSQGKTIQDIVEILNRTPMHPRTVPAIEAAYSLGCHLKIVSDANIFFIETILKHHGVWNCFSEGLVIERIQNSLAAAGKKKIIYLGDGNGDFCPSLRLKDSDYLMPRKDFPLCDLVSKNSNKIKAEVHGWRDGKELEHVLLHVINKAIGEGSNINNSTQKVSVDCKMGPIPIDTLQPLPKALSVPQ

SEQ ID NO: 94849 - protein, 240 aa, Glycine max
  Coding DNA Sequence Number=SeqID_3164
  Gene Ontology: Mol. function=zinc ion binding; Cellular component =nucleus; Biological process=regulation of transcription
  Homolog annotation: Hit_ID=Q0GLE2; Match level="QueryCoverage=65%, HitCoverage=100%, E-value=2e-63, Identity=75%"; Hit description=Dof10
  Pfam annotation: Domain name=zf-Dof; Domain location=17-79; Score =138.4; E_value=2e-38; Accession=PF02701.6; Description=Dof domain, zinc finger
MQHPTIFPGVKPPPHFPEQEQLQCPRCNSNNTKFCYYNNYNLSQPRHFCKNCRRYWTKGGALRNIPVGGGSRKTTKRSSSTSKRSSAPSSSSSAVSDPDPTRNCTNPVDQDQRVLNIGGGSFSSLLASSGHFGTLLEGLNPTGSSLKMGEFGEGVSSDPGLNLVSGQNPGLQKSLGEFDPGKFIQGFTVQKALNPMDSMLWRIIHTTRMSLKQHPLGILSQYMACQESRSLQRLYQFIYN

SEQ ID NO: 94850 - protein, 186 aa, Glycine max
  Coding DNA Sequence Number=SeqID_3165
  Homolog annotation: Hit_ID=A5B7P0; Match level="QueryCoverage=37%, HitCoverage=36%, E-value=2e-09, Identity=45%"; Hit description =Putative uncharacterized protein
  Pfam annotation: Domain name=zf-C2H2; Domain location=26-48; Score =19.1; E_value=0.017; Accession=PF00096.17; Description=Zinc finger, C2H2 type
MESNHGKVVVTAALSNKSVPLMKKEFSCKYCNKKFSSYQALGGHHNAHKAEREAEKQNKILSNASAYYKKSFVGCHSLFLSDGIHTFMTDGSASYQQYKSHQPLISSTVGEGPTNSGSKSHSSHPSLCDKGNFGQATASSMIHQKAIIEGSDLNVKTSRDLLNSAQENSSCSVNGAVENLDLTLKL

SEQ ID NO: 94851 - protein, 225 aa, Glycine max
  Coding DNA Sequence Number=SeqID_3166
  Homolog annotation: Hit_ID=A5BLP6; Match level="QueryCoverage=51%, HitCoverage=39%, E-value=3e-11, Identity=38%"; Hit description =Putative uncharacterized protein
  Pfam annotation: Domain name=zf-C2H2; Domain location=32-54; Score =18.6; E_value=0.023; Accession=PF00096.17; Description=Zinc finger, C2H2 type
MMESNVEAKSNHGKVSASASASNKSPPMKKDLICKYCNKKFNNYQALGGHQNAHKNERAAAQKQKILSMASAYNKNSYADGFVNSNQSYGFGGKILGVSPLSMTRFKPHYYSNWPHNHMSHVAWPRHQILNSVQPTIHQLQTLMMADQGSGFYRHHKSYQQPLSFPILREGAVLNSASNSSIIPQNGIIEGSEDLNIKTSGEAKNSFSSMLANGDVMELDLTLKI

SEQ ID NO: 94852 - protein, 784 aa, Glycine max
  Coding DNA Sequence Number=SeqID_3167
  Gene Ontology: Mol. function=ATP binding; Cellular component=nucleus; Biological process=regulation of transcription, DNA-dependent
  Homolog annotation: Hit_ID=A5C7R5; Match level="QueryCoverage=100%, HitCoverage=100%, E-value=0.0, Identity=60%"; Hit description =Putative uncharacterized protein
MGSSGESNLNGIDASVGGLVWVRRRNGSWWPGRIMGLHELSESCLVSPRSGTPVKLLGREDASVDWYNLEKSKRVKAFRCGEYNECIEKAKASAANSSKKAVKYARREDAILHALELESAHLDKESLSLCSRLDKPGSEHGGSAGELPLMSGEDNEDVADDLSDSDDNSNAAPELSQSGISFEEPNHNGTLKMQSVQGRRRRTPNDSEDDGFEGVKRMRGLEDLGIGVVSKRKVQGTGATEIVQHISASLNNSTAGNCLANGTSVNGGKGYSSTLKRKRSQVANAHELLKRKNRHRPLTKVLESTAMVSVPVICDQLPSSSGSPLCGVTDGRISGLDSNGSKKTFPTPTHNSDSTEATCENGTSLIGHDHGSDDASQINHKVKENEASGLPGLVGKDSPDELFDVPFVGVLGEEKHTLDFSPILVSCSSGKPQVSPLGEQSCNASQCEAVSLRNESKNEPGCTSSVAGHSIVGHRADKGSSKWQSKGKRNSRNTSKNIKHASRKYVDTDRQSSAYFPGIGNSDGIYQGACQKVDWNGMGEPNTSYNCTSQVNCKPVAEGQLEGLRDLNKHVKVTTTEAKLLPDGSLTPQRLLPYRHSRFTVNSRYQTADFPGRNYCSDASLYDVKLEVKSSYRPQHVPLVSLVSKLNGKAFIGHPLAVEVMVEGHCDKMLSDIGCDLEVGDVYCVAKPNSVTGRIHSKNSTRFSPSKSSKMKKTGLLNKKIRKLSSLTGHRQSEEERKEKKPVVDKKGPVIACIPLQVVFSRINEAVSGQARSTHRALPTSSNP

SEQ ID NO: 94853 - protein, 544 aa, Glycine max
  Coding DNA Sequence Number=SeqID_3168
  Homolog annotation: Hit_ID=A7P6P7; Match level="QueryCoverage=63%, HitCoverage=71%, E-value=1e-16, Identity=27%"; Hit description =Chromosome chr9 scaffold_7, whole genome shotgun sequence
  Pfam annotation: Domain name=F-box; Domain location=19-66; Score =37.6; E_value=4.5e-08; Accession=PF00646.24; Description=F-box domain
  Pfam annotation: Domain name=LRR_2; Domain location=183-208; Score =19.3; E_value=0.015; Accession=PF07723.4; Description=Leucine Rich Repeat
  Pfam annotation: Domain name=LRR_2; Domain location=283-307; Score =4.0; E_value=5.1; Accession=PF07723.4; Description=Leucine Rich Repeat
  Pfam module annotation: Pfam domain module=F-box::LRR_2::LRR_2; Domain location=19-66::183-208::283-307
MELVERAKGIEVSTVEKDPLISTMPEHIIHEILSRLSMLDVARTSCLSKQWNNFCVSFPCLNIDQSDFNHLPFHHFKNTMLHKVMSIKEEEERLVIHKFRLRMHFEYVQNATKEIEECTRLVLQTSTVKEFDFQIMHHCLYATKGNWCQLFHHIYNAKTFVVLRLSGLTLIQPSDRDIIKFSHLEILRLENVWVKRENVIDWLFTSCPLIREISLVRCNGLKHLKVCGNLGHLKQLEVVFCQMLESVEIQVPSLEKLVLSEIERRRGTEFCMALRIDSETSETLRELTLCNSTIGGLTFTRLFSRCSKVESLVLERCIRFFKIKIASQKLRKLVVKRCYDLVVTDIEATNLTSFMFCNYVPNKVYQDFAVDKQIQYCEEISQLQECLLDFNKVLMSKNIWTYLWFDKFNYSADQKMIIYPLKNYKGYDVVVLEDWSSMAELTLMTQISESSSRTTITTMSFLDLASYVFGDCGKGLKGVLAISISGKSMLHEVLNNKPKLSCTQCSSVVITEILMDEFLSTTCWPSFSRAGATLKATSFSVSSV

SEQ ID NO: 94854 - protein, 1803 aa, Glycine max
  Coding DNA Sequence Number=SeqID_3169
  Gene Ontology: Mol. function=oxidoreductase activity; Cellular component=chloroplast; Biological process=amino acid metabolic process
  Homolog annotation: Hit_ID=A5APE0; Match level="QueryCoverage=62%, HitCoverage=87%, E-value=0.0, Identity=46%"; Hit description =Putative uncharacterized protein
  Pfam annotation: Domain name=ELFV_dehydrog; Domain location=1557 -1801; Score=240.7; E_value=3.2e-69; Accession=PF00208.12; Description=GlutamateLeucinePhenylalanineValin
  Pfam annotation: Domain name=ELFV_dehydrog_N; Domain location=1437 -1541; Score=65.2; E_value=2.2e-16; Accession=PF02812.9; Description =GluLeuPheVal dehydrogenase, dimeri
  Pfam annotation: Domain name=Occludin_ELL; Domain location=1094-1167; Score=-27.3; E_value=0.08; Accession=PF07303.4; Description=Occludin homology domain
  Pfam module annotation: Pfam domain module=ELFV_dehydrog::ELFV _dehydrog_N::Occludin_ELL; Domain location=1557-1801::1437-1541::1094- 1167
  Subcellular localization annotation: CTP_CleavageSite=42; ConfidenceScore=5.71e-01
MYGGASSKLGRGAPNRRSFPPPPAPHRSSAPGGRLSLGSSARNAAKETAAPAVEETFSLISGSNPLAFSMIIRLAPDLVEEIRRVEAQGGTARVKFGPNPHNPTGNIIDVGGKEFRFTWSKDGDLCDIYEEHRSRDDGNGLLVESGCAWRKLNVQRVLDESTKNHVKRRSEEAERKMKSRKAIVLEPGNPSMKSQIKALAAVEATPWKNYNKKKEAALKKRKVETLQDHFAASSSPMGAVNMSKSFEDAVPAQMTGKQDTNAVSEKEIPTRTNNAMRNTPGGKGKNGSKPVDLQGMLISLLKDKPNGMTLKALEKAVGDPLPNSMKKIEPIIKKIAKYQAPGRYILKPGGDLESLNKPQTESGSSPDDNHSQIPAREEFHDQTSAPQEGSEERVPNIDLEEMVKENSKVEEESNTLEKVDAQHTSPDILGDKKGSDHSEGQAGSSSDSGSDTDSDSDSSDSGSDSGSHSRSRSRSPTGTGSGSSSDSESDASSSSKEGQEGSDEEIDIMTSDDEKESKQKTEVSDQRMPLPIPVKSPDGRSMQNVVDEKQDGNESDAVEIEKDLPEEQGTEMALPPATISNRGGKYAEETRPFPLDYQQLQERQNYIGSLFDERENEVKDSSRHEQNDSSNRFSKGKHKRGSDVKKNIEEKSERAKRLKAENLTREPFSPGIDVQTLDNSRNLSPFELTEDTGKGSNVQVLNRAERQGNSSVGLQKGSNRAFPGKSSSDFPQIGQRSSVQTPSENPPYPLEKSDKQVESVRHGKKHSGKDFHTREASSVQKDKSSRDSLNEDIHAIEKKVPRNSRDGSNGSKQSLSMDSYYQKQGEMVGKLKEGRQSTQSHLGTSPKDNNRIGFDESPVTNGRGISLQRELSDLELGEFRESTPDETHVAKQFEQKGSFKLLENKANTSEDRNSDITKVKPSLKATSDSGKPSSAFVNSGFPSNLDNTNKKNSDNHFEDSTKSRSRVMQAHLQHLRADHAEVGSQNKLAEMSSKYRNSESGVSQDFDLEGRSESNRRVPANASKPQDSKRGNVSYPVKEIKRQTPNSVEEMADGGKDSVADRNHSDQKKRESSSDENSCSYSKYEKDEPELKGPIRTFSQYKEYVQEFQDKYDSYCSLNKILEGYRDEFQKLGNDLEHAKGRDMDRYYDIVEQLKESYRRCGPLVDSGFMYCEDSEVYDVPSGVNDCQFKWYLVNVGLREVLRGTEDWPRQCHFFCFYLSGSGVGMNSAMDDMNLIQQTQRHHLVVREIGEEIDLEIGAGEDDPSFGNATLIGAPMRESSVEEHGESKQTGMISQLPNDAQDMSKTQQGKRRKKVVKRWREEWADTYKWAYVDMKDGTPRIFCSVCREYGRKHRRNPYGNEGSRNMQMSALEEHNNSLLHKEALRLQMASKDKIVVDKPVYVKGWPSQHALITAMVKSDYRIWILDSLGEFKPRKVPERVPVTNFFLVCTVNSAISQDLVLNPRPEDTLKNALSPYKLGGAAGGSDFDPKGKSDNEIMRFCQSFMSEMYRYLGPDKDLPSEEMGVGTREMGYLFGQYRRLAGHFQGSFTGPRIFWSGSSLRPEATGYGLVFFAQLMLADMNKELKGLRCVVSGSGKIAMHVLEKLIAYGALPISVSGYLVDEDGFDYMKISFLRDIKAQQRSLRDYSKTYARSKYYDEAKPWSERCDVAFACASQNEIDQSDAINLVNSGCRILVEGSNMPCTPEAVQILRKASVLIAPAMAAGAGGVVAGELELNHECSLMHWSPEDFESKLQEAMKQTYQRAMKAATDFGYQKESPEALVHGAVISAFLTIAQAMTDQGSI

SEQ ID NO: 94855 - protein, 158 aa, Glycine max
  Coding DNA Sequence Number=SeqID_3170
MALTKQLKKKSEWDTLEEAIKAKLEDIKSHKRRVAASIGGAMSAEAETGTMGRGCQVLMVEASLVMVFLVCATEERKQPAVLEISFQPCKNPFTSKDPQGMYPPLFSLNNLADVPSTSTDPQEMYPLLFSVNNPSRCTFYLYHEGCTLQCVKTKFSGG

SEQ ID NO: 94856 - protein, 263 aa, Glycine max
  Coding DNA Sequence Number=SeqID_3171
  Gene Ontology: Mol. function=protein dimerization activity; Cellular component=endoplasmic reticulum lumen; Biological process=proteolysis
  Homolog annotation: Hit_ID=A7P6V5; Match level="QueryCoverage=100%, HitCoverage=54%, E-value=2e-95, Identity=68%"; Hit description =Chromosome chr9 scaffold_7, whole genome shotgun sequence
  Pfam annotation: Domain name=M20_dimer; Domain location=8-113; Score =29.3; E_value=1.4e-05; Accession=PF07687.5; Description=Peptidase dimerisation domain
  Pfam annotation: Domain name=Peptidase_M20; Domain location=58-243; Score=-9.1; E_value=0.0059; Accession=PF01546.19; Description =Peptidase family M20M25M40
  Pfam module annotation: Pfam domain module=M20_dimer::Peptidase_M20; Domain location=8-113::58-243
EVASRSGPLLAGSGFFEAIISGKGGHAAIPQQSIDPILATSNVIISLQHLVSREADPLDSQVVTVGKFQGGNAFNVIPDSVTIGGTFRAFSKESFQQLRQRIEQEGEARFEGAFSKKGKRVGVATKVYVVIAQAAVLRCNATVNFFEGEKPFFPATINNNDLHEHFGTVAVNLLGINKVNDMPPLMGAEDFSFYQEVMPGYFAFIGIQNPSHEKLEQVHSPYFKINEDVLPYGAALHASLAVSYLLKHPQDVPSAEGKHHDEL

SEQ ID NO: 94857 - protein, 462 aa, Glycine max
  Coding DNA Sequence Number=SeqID_3172
  Gene Ontology: Mol. function=protein dimerization activity; Cellular component=endoplasmic reticulum lumen; Biological process=proteolysis
  Homolog annotation: Hit_ID=Q0GXX4; Match level="QueryCoverage=97%, HitCoverage=96%, E-value=1e-172, Identity=68%"; Hit description =Auxin conjugate hydrolase
  Pfam annotation: Domain name=M20_dimer; Domain location=233-337; Score=36.6; E_value=9e-08; Accession=PF07687.5; Description =Peptidase dimerisation domain
  Pfam annotation: Domain name=Peptidase_M20; Domain location=107-442; Score=194.5; E_value=2.6e-55; Accession=PF01546.19; Description =Peptidase family M20M25M40
  Pfam module annotation: Pfam domain module=M20_dimer::Peptidase_M20; Domain location=233-337::107-442
MCSFKKWFNLYIIFHVLASTPIFSLSDHSSNQLSTNFLEIAKKPDVFDWMVKIRRKIHENPELRYEEFETSKLIREELDKLGIPYKHPVAVTGVIGFIGTGGSPFVAVRADMDALPIQDFDIFLIIDGWFIWVTGLKEMVEWEHKSKVPGKMHGCGHDAHLTMLLGAAKILKQYEKEIQGTVVLVFQPAEEGGAGAKKIIDSGALDNVTAIFGLHVVPELRVGEVASRSGPVLAGSGIFEAKISGKGGHAAIPQHSIDPLLAASNVIISLQHLVSREADPLEPQVVTVSKFQGGAAFNVIPDYVTIGGTFRAFSGETLQHLKQRIEQVIIGQAAVQRCNASVNFFDEEKPLYPPTVNHGELHKLFLDVAGNLIGINNVIIDESPSMGSEDFAFYQEVIPGYYFMLGVKSSPEPNQSLHSPYLKINENGLPYGASLHASLAANYLIKYQHDVAKVAGKYHDKL

SEQ ID NO: 94858 - protein, 302 aa, Glycine max
  Coding DNA Sequence Number=SeqID_3173
  Gene Ontology: Mol. function=protein dimerization activity; Cellular component=endoplasmic reticulum lumen; Biological process=proteolysis
  Homolog annotation: Hit_ID=Q0GXX4; Match level="QueryCoverage=98%, HitCoverage=63%, E-value=5e-85, Identity=55%"; Hit description=Auxin conjugate hydrolase
  Pfam annotation: Domain name=M20_dimer; Domain location=32-142; Score= 17.8; E_value=0.0052; Accession=PF07687.5; Description=Peptidase dimerisation domain
  Pfam annotation: Domain name=Peptidase_M20; Domain location=5-282; Score=22.9; E_value=5.8e-05; Accession=PF01546.19; Description =Peptidase family M20M25M40
  Pfam module annotation: Pfam domain module=M20_dimer::Peptidase_M20; Domain location=32-142::5-282
MTKIPLILFQPAEEGGARAKKILDAGALDNVIAIFGLHVKPEIPIAIIRGKGGHAALPQLSIDPVMAATNGIISLQNLVSRKAGPLDPQVLTVAKLQGGAAFDVIPDYVIIGGTFRALSREALKHLKQRIEQDYDYEFKGDPIHNCNVAFKFITVVGAKADSYMQVIIGQAAVLRCNASVNFLDEEKPLYPPTIKNDDLHKVFVDVAGNLIGIYNVNIDMQTDMAAEDFAFYQEAIPGYYFTLGMKNASSIETVAPLHSPYLVINEDGLPYGAALHASLATDYLTKYKQDVARVVGKYHGQL

SEQ ID NO: 94859 - protein, 86 aa, Glycine max
  Coding DNA Sequence Number=SeqID_3174
MAKKKKFEEQSAESLHTFSPLLLNCARFQWKWELCYPCNLYSFILIITVQKACQVVAAVALGLVGFGPHHCRCFLLLSVNANAWTL

SEQ ID NO: 94860 - protein, 103 aa, Glycine max
  Coding DNA Sequence Number=SeqID_3175
  Gene Ontology: Mol. function=ATP-dependent helicase activity; Cellular component=nucleus; Biological process=ribosome biogenesis and assembly
  Homolog annotation: Hit_ID=A7PGM3; Match level="QueryCoverage=69%, HitCoverage=13%, E-value=7e-20, Identity=69%"; Hit description =Chromosome chr17 scaffold_16, whole genome shotgun sequence
MVLQRHPRGSIQHTDIDSYFCTSAKRGSNHTSRRFRRVQAKHRDWIVQYDPPDEPNEYIHRVGRIARGEGGKGNALLFLIPEELQFLRYLKGDQNSPGIIPWL

SEQ ID NO: 94861 - protein, 117 aa, Glycine max
  Coding DNA Sequence Number=SeqID_3176
  Gene Ontology: Mol. function=phosphoric ester hydrolase activity; Cellular component=cytoplasm; Biological process=carbohydrate metabolic process
  Homolog annotation: Hit_ID=Q9MA79; Match level="QueryCoverage=58%, HitCoverage=20%, E-value=1e-30, Identity=94%"; Hit description =Fructose-1,6-bisphosphatase, cytosolic
MDHQADTNRTDLMTITRFVLNEQSKYPESRGDFTILLSHIVLGCKFVCSAVNKAGLAKLIGLAGETNVQAAFVVAELGPNSNFNMVSKSFLKIVIRLIETFTIRLISAYTRSYILHA

SEQ ID NO: 94862 - protein, 66 aa, Glycine max
  Coding DNA Sequence Number=SeqID_3177
  Gene Ontology: Cellular component=protein complex
  Homolog annotation: Hit_ID=Q9FGF7; Match level="QueryCoverage=75%, HitCoverage=9%, E-value=5e-15, Identity=78%"; Hit description =Proteasome regulatory subunit-like
MQSSLINSTLEDKNLSEIRNFKLLLKQLVTMEVIQCTTLWDSYKDEFENESVVHDDGVVSYLKIQF

SEQ ID NO: 94863 - protein, 53 aa, Glycine max
  Coding DNA Sequence Number=SeqID_3178
MNEEYSWVWLQESNGGYLMNLAYLAISELKEGSPPWDSLNAFYVAEKIVEEPC

SEQ ID NO: 94864 - protein, 330 aa, Glycine max
  Coding DNA Sequence Number=SeqID_3179
  Homolog annotation: Hit_ID=A7NST2; Match level="QueryCoverage=16%, HitCoverage=9%, E-value=4e-07, Identity=54%"; Hit description =Chromosome chr18 scaffold_1, whole genome shotgun sequence
MADHGTRKTTTNRLEEAIVRLSNSQASLHDKYAELSGKLDSTLDHLHLRSPNHNHLNSNTQLHQRNVAKLDISRFSITHQSSMTASTSTPGHAITHHPQPPLQEPSLPSLYVHPAQSIGIDFASTQHRHSMAASTSTPGHAITHHPQPSLQEPSLPSLYVHPAQSIGIDFASTQHRLLSLFSTTALQTMPPSMDSTAPTALLEHHHTMDPNTSPWCPGTITVPRRAHVTLQTMPQSFHLPKIAPFPNEDVLSTAQAPETYGGFLRVFSSNSSQFQVYKRMLKPLVEEFLRGSNGMLAAIANGLHKKTISFGAKNALIFFIPEEAIATNKA

SEQ ID NO: 94865 - protein, 157 aa, Glycine max
  Coding DNA Sequence Number=SeqID_3180
SERRFPPQEFHMLQSSVETRGFDRRREIVQAEDFSQHMEQRGHGMYYTPPTFAQYPSQMYQYPFEGHDTDMSASEHSFGGVAETQPHFSWPTMTPSQQHDAPMATPNAPLGQQWDVPGAIPPMGDLLGVDLRHEFSAEAEEQGRRQRARRNPDRQAR

SEQ ID NO: 94866 - protein, 74 aa, Glycine max
  Coding DNA Sequence Number=SeqID_3181
MNICNFGHNTLSMREMAPRKLASKRSRKDKAAEGTSSAPEYDSHRLRSAVHQQRFEAIKGWSFLRERRVPAQGR

SEQ ID NO: 94867 - protein, 292 aa, Glycine max
  Coding DNA Sequence Number=SeqID_3182
  Gene Ontology: Mol. function=chlorophyll binding; Cellular component =integral to membrane; Biological process=photosynthetic electron transport
  Homolog annotation: Hit_ID=Q2MI75; Match level="QueryCoverage=100%, HitCoverage=67%, E-value=1e-141, Identity=73%"; Hit description =Photosystem II P680 chlorophyll A apoprotein
  Pfam annotation: Domain name=PSII; Domain location=1-292; Score =423.5; E_value=3e-124; Accession=PF00421.10; Description=Photosystem II protein
MGLPWYRVHTVVLNDPGRLLSVHIMHTALVAGWAGSMALYELAVFDPSDPVLDPMWRQGMFVIPFMTRLGITNSWGGWNITGGTITNPGIWSYEGVACFGFGAFHVTGLYGHGIWVSDPYGLTGRIQSVNPAWGVEGFDPFVPGGVASHHIAAGTLGILAGLFHLSVRPPQRLYKGLRMGNIETVLSSSIAAVFFAAFVVAGTMWYGSATTPIELFGPTRYQWDQGYFQQEIYRRVGAGLAENQSLSEAWSKIPEKLASYDYIGNNPAKGGLFRAGSMDNGDGIAVGWLGHP

SEQ ID NO: 94868 - protein, 52 aa, Glycine max
  Coding DNA Sequence Number=SeqID_3183
MFKIIMLKIRMFKITSNRMLKIIKRIKGLSAILVAKSVAKHYSQQNTKTETG

SEQ ID NO: 94869 - protein, 42 aa, Glycine max
  Coding DNA Sequence Number=SeqID_3184
MVDALATLSSMFKVSPHGDLPYIKFRCRVDPAHCCLIEEEKD

SEQ ID NO: 94870 - protein, 67 aa, Glycine max
  Coding DNA Sequence Number=SeqID_3185
MNHSFPNKGSPPIEGIPLKAKGSQWNYSLFTNMMANKELFNLHFPMAPVATYPSAGGRRVTRGMRVP

SEQ ID NO: 94871 - protein, 312 aa, Glycine max
  Coding DNA Sequence Number=SeqID_3186
MISRLESGFTQPTVENIRSNLQARGKTIMTKKIAETSRADVRPKKPTGVKIQEWKQEEKSKKKDDSTETTTTSKRSKRVVIEFDEEKDANAGNSQAQMPKKKKKVKQVEPEPSVTVEGGEPARKKKKKTKSSKKQGHHQPVDVTPPSTEVDGTEAEATPSIAEMGNPIEQPDSPQEQPPVEVQNVSVEEIPSCARTSPAPETDAVNVEEQGEGQGIRSSSPHGLSQKSSSEEHFSDEAAIQEAEAGGSDIFPASSTSKLSASIGMTEDTFIQLQDEDPAAALRLLLNTSQANTSSEKIPGASSSSDADITSS

SEQ ID NO: 94872 - protein, 388 aa, Glycine max
  Coding DNA Sequence Number=SeqID_3187
  Homolog annotation: Hit_ID=A1FWF6; Match level="QueryCoverage=15%, HitCoverage=14%, E-value=2e-14, Identity=72%"; Hit description=Major facilitator superfamily MFS_1
MSGHAIDAAGPAGEATRLPWAGLLALAGGGFITLLTETLPAGVLRPMGESLGRVRARLGDGRTADDRTDPAPAATSLAARRDCRLRGGQYADRIEQQLPADPGRALPGRRVWWPAVVAGGRLRRAHGGALAAGPGDCGGDGRIAVGAVAGRTGRHVAGPADRLALGIRADERAGSRAAGLRALGIARVAGGGGRSAYVVGYGVAHAGRAQCVGGDGAVRAGAQRALHLHRTTGGGGRCRPVAGPPAAGLRPGRHRRHWHCRLGCGPSSAHAGVGRGDRFHRAGADPAVVAGRRDRAAAGDDPVGRCLRRGTYVVPDRIGAACRCRRGSGAVDAGDRLEPGHRRRRCCRGCAAAGGRPEPVGMAAAAAAVGERGVAAGTAEGLGVGGDQ

SEQ ID NO: 94873 - protein, 258 aa, Glycine max
  Coding DNA Sequence Number=SeqID_3188
  Gene Ontology: Mol. function=hydrolase activity, acting on glycosyl bonds; Cellular component=outer membrane-bounded periplasmic space; Biological process=metabolic process
  Homolog annotation: Hit_ID=A1G2A9; Match level="QueryCoverage=91%, HitCoverage=91%, E-value=1e-123, Identity=92%"; Hit description =Lytic transglycosylase, catalytic precursor
  Pfam annotation: Domain name=SLT; Domain location=125-235; Score =106.7; E_value=7e-29; Accession=PF01464.11; Description =Transglycosylase SLT domain
MPRRPLLLALLLLPSLWPGLAAARTVYRCVQGNTVSLATAPEPGSRCTPKEIDDNAIQTPNLWGNMGVFSGVLYEREQDGALVYSTRNLPGSRVFLKFTMATPPGEPAHEGLGKVGKPQLAQHAKQFRAAAKATGVDDAWLRAIAHAESNFDALAVSSKGAQGVMQLMPDTAQEYGVNDPFSPQQSIDGGARYMRALLRRYNGDRPLAAAAYNAGIGAVTRYKGVPPYAETLAYVDKVMALYARYREAMGIRTEVPAR

SEQ ID NO: 94874 - protein, 144 aa, Glycine max
  Coding DNA Sequence Number=SeqID_3189
  Subcellular localization annotation: CTP_CleavageSite=41; ConfidenceScore=5.25e-01
MTEPSKKRKGSSSIAAAAAHHRHGPSEAPTTPIHPSLSSPRSSTLFSSDDQRLRVSKFGLVDFMSLKLPYYPELIKVFYCNLKIQDGIISSKVHGIPIIIDQSLFFSLTHLPSQGAPFEGTIVDDWKFDYSSHDARRMVCNDQA

SEQ ID NO: 94875 - protein, 105 aa, Glycine max
  Coding DNA Sequence Number=SeqID_3190
PFWGGFKAIPLLSPLVLSPQPIYADITIQVRTSEKNGNNGMNEGKSTPTRGWEHPAIASFPEPSTLCSFFQSNARKGVNNKWWVFVIIRTSGSVDTGSELALIPS

SEQ ID NO: 94876 - protein, 76 aa, Glycine max
  Coding DNA Sequence Number=SeqID_3191
MGEVEEIQEKMKVDMEAMKERMATMMALMSMRKIMEANVVTIAATSTVAKVKPDAPIWPQPNESSNLRYGRQRFGK

SEQ ID NO: 94877 - protein, 241 aa, Glycine max
  Coding DNA Sequence Number=SeqID_3192
  Gene Ontology: Mol. function=acetylesterase activity; Biological process=xylan catabolic process
  Homolog annotation: Hit_ID=Q9A5Y4; Match level="QueryCoverage=58%, HitCoverage=47%, E-value=3e-17, Identity=41%"; Hit description =Putative uncharacterized protein
LEGLDVANVLSQQGYASFVLIYRLPHDGSAQYRQQAFADTQRALRLIRANAQQYQVAPDRIGVMGFSAGAFLAANLSNTPDEANYQAVDAQDKRPHLSGAVAETGRDPPRHARGAVRKRSQCPANGAAFAGRSRQRTHAADFSGAGAERWHRLTAKRAGHVQRPAAEQGQRGAASVPAGRSRLWHRPEATSAGAKLAHPVPRLAKQPGEAVSGKRRGNADAAEETEFLPGQLYGVCQHTVG

SEQ ID NO: 94878 - protein, 118 aa, Glycine max
  Coding DNA Sequence Number=SeqID_3193
MTFPHAIKLDRPRLAEKNLVRHRASMSLNDESVDNQKVSPACHRTHCPWMTKGAEDDVSLCASTGSFASGPLRVPTNSQVTIVKGQGWEFSLWVKVYGELGFWIKACRTAGHDICQAV

SEQ ID NO: 94879 - protein, 242 aa, Glycine max
  Coding DNA Sequence Number=SeqID_3194
  Homolog annotation: Hit_ID=A5BSR3; Match level="QueryCoverage=26%, HitCoverage=20%, E-value=3e-08, Identity=50%"; Hit description =Putative uncharacterized protein
  Pfam annotation: Domain name=Transposase_23; Domain location=157-227; Score=7.0; E_value=0.0002; Accession=PF03017.5; Description=TNP1ENSPM transposase
MARTKKTREMMTEAAKEIAVKIDSFKEQVTQGSFIPHGRQDVLTTAIGRPEHPGRVCAVGTGVTIKQYFGSAPRTSRSSSSLPPEELQQLTQQIRDQLEESITERVTRQLMASFSQMQSQMQSQGLALPPEPLVGPSAPRVSTKGSCVDPSGNDLEMGDSDRCGLYIEGDHARLVSLGRVYEGSTVVHNTPLLPGQVKVGVEEVTDADAPVPVPTDEVSLMGQTLHTFLAWPTHLVKSLSQQ

SEQ ID NO: 94880 - protein, 183 aa, Glycine max
  Coding DNA Sequence Number=SeqID_3195
  Homolog annotation: Hit_ID=A5C4I3; Match level="QueryCoverage=23%, HitCoverage=17%, E-value=1e-12, Identity=83%"; Hit description =Putative uncharacterized protein
MAARALGVPRHLRAPGVGLWAPHSARLETRTKESDMCASQRASKPVRRKEADWWIPLWVHRRPTLIFCKGSSESIPVREPEKNGELCLSGAKPEETLVEARSDTDVQFVRLTWVGRCGCSVEPRHGIESSKWTIFGKQNWRCGMNRKLGYGAQLRANLDPTKGVGRLRQQDGGHGSRNPLRSV

SEQ ID NO: 94881 - protein, 69 aa, Glycine max
  Coding DNA Sequence Number=SeqID_3196
MLTSPERVQMTTLASACQSNLGSLNDEVRITVRCLCMLPDSWVMIAKGGVVDKSGAFAPTYPQFVTRPT

SEQ ID NO: 94882 - protein, 73 aa, Glycine max
  Coding DNA Sequence Number=SeqID_3197
MIHLDEARWGHRVHFSNSADSGNCNRIIFFMLIMASIIVVIFSLMASMSAFICSCTSFTSPITLALARIRTWG

SEQ ID NO: 94883 - protein, 171 aa, Glycine max
  Coding DNA Sequence Number=SeqID_3198
MIMRGQDIYSSQDEATTSPFSSESEKAKREESSEEIYPQEEGQPLMKNIKEISPLRQPPNLLLCKKTLVSTATPLGLDIIPQVKELLDEGLVCIIRHQIPKIGYMMNVLSGATIFCKITHTPNIFKIRVDRESLGVEERTPEFQEPLDFRSNPFQGGMMQSYSPMALDRGL

SEQ ID NO: 94884 - protein, 271 aa, Glycine max
  Coding DNA Sequence Number=SeqID_3199
MASRKRKSIVTRPTSQYDTRRFSSLDAWTRYIDNVLGRNILPERKVEMYHTKLDDFKAELERHNFYKCLTNLADGSIDLALDRPPKQSRVRGHLVKIDADSLNTFLETPVVLAEGETLPAYSRYYRLPTDFREIEVALCIPGRGFILNSEGHPGRILKKDLTTLAQVWSVLLYSNLAPTSHTSNLSVDRARLIFGLVSHLDMNIEALISGQMTSIVQSNTSRLGFPALINALCRARGVVSDSLTFERLSLVTNLAYIRKNYWNPEDLTVSI

SEQ ID NO: 94885 - protein, 105 aa, Glycine max
  Coding DNA Sequence Number=SeqID_3200
MAITFAPIIRIAIIIYAFGHSITCESVHSVIGDFEHPDLEHYNFEHSDSEHSDFAHSENMEQPPPRERTLREMAAPDFTYESLCIQYPDEDVPYVLKTGLIHLLP

SEQ ID NO: 94886 - protein, 43 aa, Glycine max
  Coding DNA Sequence Number=SeqID_3201
MTKQTFTKGIEGKSPEFKEPLDLRSNPFEGGGNDTILPPKGIR

SEQ ID NO: 94887 - protein, 159 aa, Glycine max
  Coding DNA Sequence Number=SeqID_3202
MTRGNPGDLQPFDLETDRTFHRLVRHSVHPDHSVHFEHSEYSVASDSEYSDFEHSTTNFHNENMAQPPPRERTLREMAAPDFTYECLCTQYPDEGVPYVLKTGLIHLLPKFHCLAGEDPRKHLKEFHIVCSTLKPPDVQEDHIFSKGFSSFSGGSGKRL

SEQ ID NO: 94888 - protein, 54 aa, Glycine max
  Coding DNA Sequence Number=SeqID_3203
MSPLHCQSDDEGMASPGFGLYVEPFGGLQKERVEKEVGARNGSVREGVKRGERS

SEQ ID NO: 94889 - protein, 154 aa, Glycine max
  Coding DNA Sequence Number=SeqID_3204
MSQPNPLQDLPGDSSFNFERFDILWVSNGHSYQKLQPFEVYLPQTLTKVSAVLVLVLNAEVGLQRTPAITNPNGGHEPRRRSLTLTAVTNPSDNNGEEETIGIRPPTNRAFIKKYRVPRQAQGEIPQQPGDGRQRATDAPPSPLEFTSAHPQKG

SEQ ID NO: 94890 - protein, 109 aa, Glycine max
  Coding DNA Sequence Number=SeqID_3205
  Subcellular localization annotation: CTP_CleavageSite=51; ConfidenceScore=5.04e-01
MMITKDDDKGDDKKLKDQSKNNSSESKINQRTTQGTSFVVQVEGTSTWVVVTENKRGYISCGSIQVEGTSTWLFKENKGGYILCGSLLVKDFTRLKRNLKDRRSLGDWM

SEQ ID NO: 94891 - protein, 48 aa, Glycine max
  Coding DNA Sequence Number=SeqID_3206
METLTHAHRYHIPLVKKVIFYKGKSACNRDRKIFSERGSLTLTMVSRR

SEQ ID NO: 94892 - protein, 100 aa, Glycine max
  Coding DNA Sequence Number=SeqID_3207
MASTSGDATTPSPKTARLMVEMIKLGDQMRIISYEDEEMMERMRKENEESLGRIHRSSEALSARIENIERRREDKSSNSSHGEDEGYEEDEGGMRGIRRE

SEQ ID NO: 94893 - protein, 105 aa, Glycine max
  Coding DNA Sequence Number=SeqID_3208
MKTPEEAMDLIESMAASDIAILRDRAHILTKKILLELTSQDALLAQNKLLSKQLETLTETLKCTICGRAHESGCCIPNEEQITHEANYMGNQPRGNFNTSGFPGF

SEQ ID NO: 94894 - protein, 189 aa, Glycine max
  Coding DNA Sequence Number=SeqID_3209
MEAMKEQMATMMEAMMSMKKIMEANVVAIAATSAVAKVNPMPPSGLNQMYHPTSYMVGKDLGSIGGPHYAQIQNKHAFPPYGLPPNYTPPNTAYTPSENVNNSTPILIESRQPQTDHAHVSQTVGETHEIPYHNLADFEPCLSYATKGQVVGGILLQKTLEGLQFLPQPQPLHSTIGKIPYIMEGMGKV

SEQ ID NO: 94895 - protein, 162 aa, Glycine max
  Coding DNA Sequence Number=SeqID_3210
MTPVVLSGNHDEHAKGAELSAPCSTKPNFPTVIESLVIRLSTNLCAKPMFTSQEAWERYTDIVVPWKQLPGRNVVVYYTEFDEFKEELERRHWDEELTDFIDSSIDVAIVKEFYANLYDPEDKSPKQVRVRGHLVKFDEDTLNTFLKTPVILEEGEICVPIP

SEQ ID NO: 94896 - protein, 153 aa, Glycine max
  Coding DNA Sequence Number=SeqID_3211
MSNLHVDEDDDDDDYYYLVSNSYVEESLDEDDSVDGIFDTDDEVTDMIQPVRIVHPAEGVQGIQNPFWNDALHYNNINWSHLDEEDICGLEMPSSFNVGQELYVGMDFDSKDAVKNAVKQYVMKVHQSFKVVESKWDKHDQRRSINQNFFDSR

SEQ ID NO: 94897 - protein, 381 aa, Glycine max
  Coding DNA Sequence Number=SeqID_3212
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=74%, HitCoverage=99%, E-value=1e-150, Identity=94%"; Hit description=Beta- lactamase TEM precursor
  Pfam annotation: Domain name=Beta-lactamase; Domain location=31-280; Score=186.5; E_value=6.7e-53; Accession=PF00144.15; Description=Beta- lactamase
  Pfam annotation: Domain name=Peptidase_S11; Domain location=29-263; Score=-122.5; E_value=0.033; Accession=PF00768.11; Description=D -alanyl-D-alanine carboxypeptidase
  Pfam module annotation: Pfam domain module=Beta-lactamase::Peptidase _S11; Domain location=31-280::29-263
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHCVRPRRKDQRIFLRSFCSARNLLLANKKTTATSGGLFAGSRATNSFSEGNWLQQSADTKYCSSSVAVVRPPLQELCSTAYIPRSANPVTSGCCQWR

SEQ ID NO: 94898 - protein, 217 aa, Glycine max
  Coding DNA Sequence Number=SeqID_3213
MALLLSNVLASDHNSDLPLPKCQLVYAILTRMSIHVAQLIADAIYLFEGMPPTRHPLDSDKSNRALGFPALITGLCQSFGVPVTPSKVIRPPITRAFIEKYCTPRQAQGNAPQAADAPPPPHQADPAGSLGTKRYYGTWFASRRPTTGGSLSQQGQGFAPFACPTPDQFRVEVAWPGDWPKDQTEEAPAGAPDNAEDAHMDEEMTDLFGFLGGSRAT

SEQ ID NO: 94899 - protein, 163 aa, Glycine max
  Coding DNA Sequence Number=SeqID_3214
  Homolog annotation: Hit_ID=O52175; Match level="QueryCoverage=50%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQKHHWQQPLVIDLEELVLSHAPVKAKLKGQFGDCAPPASYLGSKSW

SEQ ID NO: 94900 - protein, 356 aa, Glycine max
  Coding DNA Sequence Number=SeqID_3215
  Gene Ontology: Mol. function=ATP-dependent DNA helicase activity; Cellular component=cytoplasm; Biological process=DNA repair
  Homolog annotation: Hit_ID=A2XJ40; Match level="QueryCoverage=92%, HitCoverage=21%, E-value=1e-163, Identity=89%"; Hit description =Putative uncharacterized protein
  Pfam annotation: Domain name=UvrD-helicase; Domain location=1-322; Score=-76.9; E_value=6.8e-06; Accession=PF00580.12; Description =UvrDREP helicase
MIDEFQDTDPQQYRIFQKLYVGRPDCGLLLIGDPKQAIYAFRGADIFTYMRARSEVSAHYTLETNWRSSPSMVASVNHLFSQVEKPFLFGQIPFIEVSAAEKNQGLAFDLHGKPQPAMQFWLQQGEGAGVSDYQQLMARLCATQIRDWLSAGQQGQAWLQGGKEPRPVQASDITVLVRSRNEAALVRDALSALSIPSVYLSNRDSVFDTPEAKDLLWLLQAVLAPEQERTLRSAMATGLMGLDAPTLDGLSRDERAWDELVNEFDDYRTLWLRRGVLPMLSEVMKARQLAENLLASAGGERRLTDVLHLGELCKRRRRNSTANMRWCAGWHSRSPSLIASPIISNCGWRATGIWCR

SEQ ID NO: 94901 - protein, 137 aa, Glycine max
  Coding DNA Sequence Number=SeqID_3216
  Homolog annotation: Hit_ID=UPI0000ECC274; Match level="QueryCoverage =48%, HitCoverage=96%, E-value=5e-21, Identity=66%"; Hit description =UPI0000ECC274 related cluster
  Subcellular localization annotation: CTP_CleavageSite=86; ConfidenceScore=5.32e-01
GKPVVPAALMNRPTRGERRFAPVLGALPLPRSLTRCARSFGCGERYQLTQRRSFAPSWAVCTNPPFSPTAAPYPVTIVLSPTRISRARYVGGATEFLKWWPNYGYTRRTVFGICALLKPVTFGKELVALDPANKPPL

SEQ ID NO: 94902 - protein, 91 aa, Glycine max
  Coding DNA Sequence Number=SeqID_3217
  Homolog annotation: Hit_ID=Q84VH5; Match level="QueryCoverage=48%, HitCoverage=6%, E-value=3e-15, Identity=97%"; Hit description =Envelope-like protein
AVSKDALIAELKDTCKVLEATIKATTEKKMELERLIKRLSESGIDDEEAAEEEEEAAEEDKEAAEEEEEAAEEEEDAAEETESDDDSEATP

SEQ ID NO: 94903 - protein, 84 aa, Glycine max
  Coding DNA Sequence Number=SeqID_3218
MSAEKDQSGLLDEDITKGKDHEALEGPMTRGRLKQAQHVIETRLTYQGNPSPQVASTLTYLPSPEVASTLTYLPSPEVASSKPP

SEQ ID NO: 94904 - protein, 87 aa, Glycine max
  Coding DNA Sequence Number=SeqID_3219
MGEVHLPVMPYAYGNEQDGPSQFDGQFLVPITKSNLPQRLAQVRERGEERDGFGGARESMEAPWRRWLAVVVEKDEPLRFFDDSTIW

SEQ ID NO: 94905 - protein, 107 aa, Glycine max
  Coding DNA Sequence Number=SeqID_3220
HVCILVEKTPRLLQSLTSYPERRRFEFLIGGYIGAGASLLSTAPLFVTMTQKLVARGDTLRLSAPRHSVTPSVIDERRPMWSSAPFPEVSAFSGGDFLKSYKLSRTT

SEQ ID NO: 94906 - protein, 179 aa, Glycine max
  Coding DNA Sequence Number=SeqID_3221
  Homolog annotation: Hit_ID=A5BEV8; Match level="QueryCoverage=55%, HitCoverage=12%, E-value=5e-13, Identity=42%"; Hit description =Putative uncharacterized protein
MNNMMTLQHTQIKASFETSTHMVGHVFKVTLYKKVLGMVSRKGEDQGCSKKIIDQTTKVNNVIRLIGSMLMHYTLCKIDSIENIINVKTDGNCGYRAIAILLGMGEESWSLVCNHLHKELTSWLEEYINLLGGIERFKELKHSLLVDELSMVTMDKWMNITDMRYVIASRYNVLVVSLS

SEQ ID NO: 94907 - protein, 47 aa, Glycine max
  Coding DNA Sequence Number=SeqID_3222
MSASFFFESSEFGVALPPATSKCEFPRRTTIPLPKSQRVAAIESYQH

SEQ ID NO: 94908 - protein, 77 aa, Glycine max
  Coding DNA Sequence Number=SeqID_3223
  Gene Ontology: Mol. function=structural constituent of ribosome; Cellular component=ribonucleoprotein complex; Biological process =translation
  Homolog annotation: Hit_ID=Q2PMQ2; Match level="QueryCoverage=88%, HitCoverage=69%, E-value=6e-27, Identity=70%"; Hit description =Chloroplast 30S ribosomal protein S11
  Pfam annotation: Domain name=Ribosomal_S11; Domain location=6-76; Score=23.7; E_value=5.8e-07; Accession=PF00411.10; Description =Ribosomal protein S11
  Subcellular localization annotation: CTP_CleavageSite=43; ConfidenceScore=5.16e-01
MAKPISKKGSRKNVRIDVRGRVISWSSAGTCGFKGTRRGTPFAAQTAAGNAIRTVSDQGMQRAEVMIKVLVSEEMRH

SEQ ID NO: 94909 - protein, 201 aa, Glycine max
  Coding DNA Sequence Number=SeqID_3224
MHTATTPIFPCRSVNWDHAHKTPSGPGEVEQGPGVSSFGYGPLSVLPGARPPQQECSSPPTKSSCPLLTGLSSRSTAPPRQAQGETPQQPGDGQQRAIDAPPPPPEPLISSTKAGALPMTRGRPASDQARDRQVITRPAQEVKEALLGGNLELVMKKLPAKQSRKGTIEEGSSAAPQADTGFDKHRFQSVEHQLRFEAIEG

SEQ ID NO: 94910 - protein, 141 aa, Glycine max
  Coding DNA Sequence Number=SeqID_3225
MGNTLVDRKKIKNKKSRLFRFFRRFPQINVGGDSARIPFLEHAPAITRRPPAEGKIIYNGLTNEITLTHLGTKFLLHPQTPSQVAKDQLTMKDKRDEEEKLEKQKKKKDSKALSSKAKGKEKEEKDSSEKIVNKENHFATK

SEQ ID NO: 94911 - protein, 174 aa, Glycine max
  Coding DNA Sequence Number=SeqID_3226
FKAHLEHTISCSSVPLPSFIVLLPPSSYPWPLMVESIDEEDPRPTSSNGAYIKIYHQRLKPSKTSLIRGLHTYMLLFTPLIADFQSASVYHLLQQGLVDTPPGGRHVLQRLGPALPIHLDDINCSPSMIGKRVRFHVWAGSLKTSAIRLRQGYTTLGKEASRSSQELSQPSDWR

SEQ ID NO: 94912 - protein, 81 aa, Glycine max
  Coding DNA Sequence Number=SeqID_3227
MDIPERCAVPTLVDIGIYCYEDASDDSFEAMFGARILLADERMWLTLRQTMPFVPIFVQPFLEQGHDVLIREFLDAWAGSR

SEQ ID NO: 94913 - protein, 78 aa, Glycine max
  Coding DNA Sequence Number=SeqID_3228
MTKGAEDDISLCASTGMLPPWLTKGCVRVIVGCLYMPPDSWVIETKGGVVDKSRAFAPTYPQFVMRNSDLRSSCLCDV

SEQ ID NO: 94914 - protein, 87 aa, Glycine max
  Coding DNA Sequence Number=SeqID_3229
MTSTRCVRVVSSKKWRLRKPSRVYGYHCIIEWTWNQVNIGHRNLGEFYRFFFAAKLISWRVFLDCAKGMAFVDNWAVGKEKVCLLAE

SEQ ID NO: 94915 - protein, 33 aa, Glycine max
  Coding DNA Sequence Number=SeqID_3230
NVRSASSDDASFIDPDRSSFLADVNCHLYGINI

SEQ ID NO: 94916 - protein, 94 aa, Glycine max
  Coding DNA Sequence Number=SeqID_3231
MTRGNPGDLQSFGPEIDRTFHRLVSHSVHPDHSMHFEHFEHFVAGDSEYSDFEHSTVNFHTENMAQPPPRERTLREMAAPDFTYESLCIQYPDE

SEQ ID NO: 94917 - protein, 34 aa, Glycine max
  Coding DNA Sequence Number=SeqID_3232
MALQHRDSSNNWMQHLLVNAPSERILAFDTTGKI

SEQ ID NO: 94918 - protein, 95 aa, Glycine max
  Coding DNA Sequence Number=SeqID_3233
MVEALLVSIDSSREVMQASGSCEEVHERQLAQVTPHHHQQQQHAHHHQISNSAFHISRSSHPISTIISPPLHHTSIILDDNSYHVSSIMLQNENF

SEQ ID NO: 94919 - protein, 295 aa, Glycine max
  Coding DNA Sequence Number=SeqID_3234
  Homolog annotation: Hit_ID=Q5XM22; Match level="QueryCoverage=44%, HitCoverage=89%, E-value=9e-42, Identity=59%"; Hit description =Resistance-like protein HAAS-2
FEALSVDEAVFLLTVLLEVSGEEARAETVRARGAYVRLSWVRDIYEMRCQARRRIVAARAYLLHPVGCTLFSNKSATNVHVVHLEAFRDLGQSGGYAWGAAALVHMYDQLDEASRITTRQIGGHLTLLQCWIYEHFLSVHQCVTDDAYEEMSPRASRWLTMKAHMKGIIGAPYWACCDALTVIDVCWLPYSDHRGRVLRQFGYIQSILLPPVSASLSYDDIDDRHAPAPDHEDYMQPDIPQDDYEGYEAIAERLECVLNLRLVTAGTELHDIIQDCLRIARGGASVDGSVRARQR

SEQ ID NO: 94920 - protein, 56 aa, Glycine max
  Coding DNA Sequence Number=SeqID_3235
MMSTRSKEVGGVALPQVQKRKVIAPQFDARASWWTQGPDAIMQLVSLDICGHLHVA

SEQ ID NO: 94921 - protein, 103 aa, Glycine max
  Coding DNA Sequence Number=SeqID_3236
KHPFLSDLHTCHSLCIEFESEFECDPVSDFYAEAESEFESGSDFLGVVPLDVDFLELECTNHVAGSTYAFDLLYEVQAEEPSSPTMVPPTVQPLPTPCCRMIF

SEQ ID NO: 94922 - protein, 68 aa, Glycine max
  Coding DNA Sequence Number=SeqID_3237
MEMGGDLHDHINKLNQLALLLLALLPRSFKALVQMLLVERSTLKLDEVIVALRINERMMRTENVDDEH

SEQ ID NO: 94923 - protein, 375 aa, Glycine max
  Coding DNA Sequence Number=SeqID_3238
  Gene Ontology: Mol. function=oxidoreductase activity; Cellular component=mitochondrial nucleoid; Biological process=metabolic process
  Homolog annotation: Hit_ID=A4VQQ1; Match level="QueryCoverage=100%, HitCoverage=74%, E-value=1e-163, Identity=73%"; Hit description =Aldehyde dehydrogenase family protein
  Pfam annotation: Domain name=Aldedh; Domain location=27-375; Score =339.7; E_value=5e-99; Accession=PF00171.13; Description=Aldehyde dehydrogenase family
MRYAAPGETGSLIHLQSRYGNFINGEFVPPVNGNYFVNTTPINGSTIGEFPRSDKQDIDNAVAAAQAAADAWGKTSPQARSLLLLKIADRLEANLEVIAVNETWDNGKPVRETLAADLPLAVDHFRYFAGCVRAQEGTAAEIDEFTAAYHFHEPLGVVGQIIPWNFPLLMAAWKLAPALGAGNCVVLKPAEQTPLSITLLMELIKDLVPPGVINVVHGYGKEAGEALASHPGIAKIAFTGSTATGGHILELAAKSLIPSTVELGGKSPNIFFEDIMQAEESFIEKAAEGVVLGFLNQGEVCTCPSRALVQESIFEPFMAAVMKRIQTIKRGDPLDTETMIGAQASQQQFDKILSYLEIAQQEGAQVLHGGGVEKI

SEQ ID NO: 94924 - protein, 185 aa, Glycine max
  Coding DNA Sequence Number=SeqID_3239
MTPRKLASKRSRKDKAAEGTSSTPEYDSHRFRSVVHQQRFKAIKGWSFLRERRVQLRDDEYIDFQEEIGHRRWASLVIPMAKFDPEIVLEFYANAWPTEEGVRDMRSWVRGQWIPFDADAIGQLLGYPLVLEEGQECEYGQRRNRSDGFCPDYCRETSADHAYQHDHPDSDMDDFAAQQHPAHRS

SEQ ID NO: 94925 - protein, 637 aa, Glycine max
  Coding DNA Sequence Number=SeqID_3240
  Gene Ontology: Mol. function=protein binding; Cellular component =integral to membrane
  Homolog annotation: Hit_ID=A1FTW0; Match level="QueryCoverage=41%, HitCoverage=75%, E-value=1e-110, Identity=81%"; Hit description =Putative uncharacterized protein
  Pfam annotation: Domain name=DUF808; Domain location=55-367; Score =479.7; E_value=3.8e-141; Accession=PF05661.3; Description=Protein of unknown function (DUF808)
MAVAHQQAQDLAAPVHAFDQRGIAIGGGRIAQAELPCGKDGRAGRWPAMSGFRSVAGGRLFALLDDIATLLDDVSVLTKVAAKKTAGVLGDDLALNAQQVTGVNANRELPVVWAVAKGSLVNKVILVPAALAISALEAWLHSRGWNVPLIVPLMMIGGAFLCFEGVEKLAHRFLHSAEDDAEHQAERRKALADTQVDMVAWEKDKVKGAIRTDFILSAEIIVLTLGVVATASFTNQVVTLAVVALAMTVFVYGLVAGIVKLDDVGLYLSRKGGAIAAFGRGLVASAPWLMKFLSVAGTIAMFLVGGGILCCGQHGGRHHRRRHRAGGGDRVPEAAREVICRAEPTLGCSTALRAAARAWARALQRLHAGSSARLHPVLALPLGRIQRVIGAAQQGLGIVTGLPLRQPGAEMHRHPPVLHGQHAYQNELVAAQPCDAVGGAQQQLAHGHQVLQQSIATRVTVRLVGQVEIIQIDHRHAQRRVVAHGTRQLTLQQFVQAAAVQCLGQRIDTRQVTSSTQFLLQLGNALLCAFHFLPRAGQMIAGLRGLLLHLAGIAHHLLQQLVEVGDAARLTQLQRVAADAVVVFTGAGGHAIHALDELAHQPAHRRLRIINALAQQSLLVDHFAQFGAGALDRFGFQ

SEQ ID NO: 94926 - protein, 61 aa, Glycine max
  Coding DNA Sequence Number=SeqID_3241
MAFIILRFMHSFHNSKIHAKVITQYPTPVQLVDPEQWADQALMLVQMAMDHQELELEMTEE

SEQ ID NO: 94927 - protein, 154 aa, Glycine max
  Coding DNA Sequence Number=SeqID_3242
  Gene Ontology: Cellular component=integral to membrane
  Homolog annotation: Hit_ID=Q1H2N3; Match level="QueryCoverage=85%, HitCoverage=32%, E-value=4e-38, Identity=55%"; Hit description =Uncharacterized lipoprotein
MSHVWLQRVVLASLVTVLAACDSIPFIDNSSDYKGAGRSKPLEVPPDLTAVRTSSTYNVPGSTSYSAYSQGQEAQEQNGPQPVLADMKNVRMVKAGQQRWLVVNAPPEKIWPIVRDFWLDQGFAVRVENPELGVIETEWLQSDAIKPKEDTVLW

SEQ ID NO: 94928 - protein, 54 aa, Glycine max
  Coding DNA Sequence Number=SeqID_3243
MNLYCIDDAHVSYFILHGNGTNFFIWDSLETQADHRGGRGELPVHDRVTSTLTA

SEQ ID NO: 94929 - protein, 333 aa, Glycine max
  Coding DNA Sequence Number=SeqID_3244
  Homolog annotation: Hit_ID=Q9C105; Match level="QueryCoverage=96%, HitCoverage=26%, E-value=3e-07, Identity=24%"; Hit description =Chitinase-like protein PB1E7.04c precursor
  Subcellular localization annotation: CTP_CleavageSite=45; ConfidenceScore=5.64e-01
MNLLPSAFHVSSTFESGAPRIHCLAKFANSPFSSFIRSPMNSLPSAVHVSSTFESGAPRIDCLALFANSPFSTFIRSPMNSLPSAVHVSSTFESGAPRIDCLALFANSPFSTFIRSSMNSLPNAVHVSSTFESGAPRIHCLAKFASSPFSTFIRSPMNLLPSAVHVSSTFESGAPRIHCLAKFANSPFSTFIRSPMNSLPSAVHVSSTFESGAPRIDCLALFANSPFSTFIRSPMNSLPNAVHVSSTFESGAARIDCLALFANSPFSTFIRSPMNSLPSAVHVSSTFETGVPRIDRLALFANSPFSTFIRSPLNLFFSTVHASSTIESGSPAK

SEQ ID NO: 94930 - protein, 415 aa, Glycine max
  Coding DNA Sequence Number=SeqID_3245
  Gene Ontology: Mol. function=motor activity; Cellular component=cell projection
  Homolog annotation: Hit_ID=P15305; Match level="QueryCoverage=90%, HitCoverage=98%, E-value=3e-23, Identity=21%"; Hit description =Dynein heavy chain
MGKLDHLEERLRAIEGGEDYVFANLEELFLVPNIITPPKFKRLHTLTFRGLHALTFRGLHVLIFRGLHTLTFRGLHALTFRGLHVLALKGLHALSFRGLHALAFRGLHILLFRGPHALPFRGLDILAFRGLHVLSFRGLLALSFQGLHVLAFKGLHVLALRGLHALAFRGLHVLILRGLHVLAFEDYTGLHALACKGLHVLAIRGLHSLAIRGLHILTFSGLHVLTFQGLHVLAFRGLPALTFRGLPALAFRGLHVLAFRGLHALAFRGLHVLAFGGLHVHTFRGVHVLAFRWLHTLAFKGQHVLTFTLLHVLAFRGQYALLFRGLHALPIKGLHVLDFRGLHAFTFRGLHALAFRGLHILVFRGLHSITFKGLHVIAFRWLHALSFRELHALSFRELHALSYRGLHVLAFRGLH

SEQ ID NO: 94931 - protein, 63 aa, Glycine max
  Coding DNA Sequence Number=SeqID_3246
  Gene Ontology: Mol. function=structural constituent of ribosome; Cellular component=ribonucleoprotein complex; Biological process =translation
  Homolog annotation: Hit_ID=A4GG85; Match level="QueryCoverage=88%, HitCoverage=41%, E-value=2e-25, Identity=96%"; Hit description=50S ribosomal protein L16
  Pfam annotation: Domain name=Ribosomal_L16; Domain location=1-60; Score=6.8; E_value=2.5e-06; Accession=PF00252.9; Description =Ribosomal protein L16
MSRNVRRGGQIWVRIFPDKPVTVRPTETRMGSGKGSPEYWVAVVKPGKILYEMGGLIIAEHAN

SEQ ID NO: 94932 - protein, 96 aa, Glycine max
  Coding DNA Sequence Number=SeqID_3247
MEGGIGQILNITPKEEKRKEGLKRVCPQGLDWLPKLRAVREEETEALKESKEVQALKAELEKAQAVKEKFKSTAVKVQKEYDELKDINMAIAEALE

SEQ ID NO: 94933 - protein, 169 aa, Glycine max
  Coding DNA Sequence Number=SeqID_3248
VDPWVLVPITFRGLHVLAIRGLHALTFRGLHVLALRGLHALTLEDFMSSPSEGYTPSPWVLVTLTVERTTRPRLERTTRPHHQRAAARTTRPHHQRAARPYLQRTTCPRLERATRPHLGGLHVLTIRGLHALTSRGLHVLALRGLHALTLGTSYPHRQRTTRPRLERTT

SEQ ID NO: 94934 - protein, 218 aa, Glycine max
  Coding DNA Sequence Number=SeqID_3249
  Homolog annotation: Hit_ID=A5C922; Match level="QueryCoverage=43%, HitCoverage=35%, E-value=4e-09, Identity=35%"; Hit description =Putative uncharacterized protein
  Pfam annotation: Domain name=Retrotrans_gag; Domain location=116-198; Score=3.3; E_value=0.026; Accession=PF03732.8; Description =Retrotransposon gag protein
NPSDLQPFDPEIDRTFHRLVRHHFIPFDHPEHSITGESVHSVIGDFEHPDLEHSDSEHSDFAHSENMAQPPPRERTLREMAAPDFTYESLCIQYPDEDVPYVLKTGLIHLLPKFHGLAVAKEWLYYLAPRSITSWDDLKRVFLEKNFPVSRTTTIRKDISGIRQLSGESLNMERSMIDAASGGALGDMTPAKARNLIEKMASNSQQFSARNDAIVIRG

SEQ ID NO: 94935 - protein, 116 aa, Glycine max
  Coding DNA Sequence Number=SeqID_3250
MVWHLQSPFLLLHSAAISLQEAKDSIGEEYPRTTSSTWSYINGGEIILQSVLLRVCLITSVATYPFVGKRGEAHGCVFQRRKMHGVATNVYLWKMSKKPKETGHEEYSRFGSCIYV

SEQ ID NO: 94936 - protein, 273 aa, Glycine max
  Coding DNA Sequence Number=SeqID_3251
  Gene Ontology: Mol. function=ATPase activity, coupled to transmembrane movement of substances; Cellular component=1-2nm peptidoglycan-based cell wall; Biological process=lipid transport
  Homolog annotation: Hit_ID=A8GCH6; Match level="QueryCoverage=97%, HitCoverage=45%, E-value=1e-123, Identity=86%"; Hit description =Lipid A ABC exporter, fused ATPase and inner membrane subunits MsbA precursor
  Pfam annotation: Domain name=ABC_membrane; Domain location=22-270; Score=138.2; E_value=2.4e-38; Accession=PF00664.14; Description=ABC transporter transmembrane region
MNDKDLSTWQTFRRLWPMITPFKTGLIVAAIALIMNAAGDTLMLSLLKPLLDDGFGKTDSSVLVWMPLAVIALMLMRGVTSFVSSYCISWVSGMVVMQMRRRLFGHMMRMPVAFFDQQSTGTLLSRITYDSEQVASSSSSALVTVVREGASIIGLFIMMFYYSWQLSVILIVLAPIVSIAIRLVSKRFRNISKNMQNTMGQVTTSAEQMLKGHKEGLIFGGQQVETERFNSVSNRMRQQGMKLVSASSISDPIIQLIASLALAFVHLPPASQA

SEQ ID NO: 94937 - protein, 144 aa, Glycine max
  Coding DNA Sequence Number=SeqID_3252
MVTSEEKRKVRLGFRSLSKPQGKLENFASVEGFLSVWGFNGEQRWFVLQTKFREEPTVNEGCEAFLPRQFHVASMRSFIKRLPQEASSWLLCEGSIILLAAGYKVCHLAKPINHHKDRVNTSLGSRKPKDKVHTNVYPRCIWDG

SEQ ID NO: 94938 - protein, 82 aa, Glycine max
  Coding DNA Sequence Number=SeqID_3253
MDSTSNSPQISASPHQLDFAPYASGSYNAKWNALGLLHDKHTLRSSRTLGEMEVDEPWLGLWIPLNYQVDMGASQHRTLELG

SEQ ID NO: 94939 - protein, 146 aa, Glycine max
  Coding DNA Sequence Number=SeqID_3254
  Homolog annotation: Hit_ID=A5AK77; Match level="QueryCoverage=43%, HitCoverage=7%, E-value=2e-07, Identity=42%"; Hit description =Putative uncharacterized protein
MTRGNPGDLQPFDPEIDRTFHRFVRHSVHPSHSVHFEHSEHSTEGDSEYSDFKHSITNFYIENMAQPPPRERTLREMAAPDFTYESLCIQYPDEGIPYVLKTGLIHLLPKFHGLVGEDPHKHLKEFHIVCSTMKPPDVQEDHIFLK

SEQ ID NO: 94940 - protein, 150 aa, Glycine max
  Coding DNA Sequence Number=SeqID_3255
MAEPSKKRKGSSSTAIAATAHPKHPQHLFILPCHLQDHQHCFHLTISVYVFQNSGLVDFMSLKLPYYPELVKVFYCNLKIQDGIIISEVHGIPMVIDQSLFFSLTNLPSQGAPFEGTIVDDWKFDYSSHDACRMVCNDQAEMTVDCWPGH

SEQ ID NO: 94941 - protein, 160 aa, Glycine max
  Coding DNA Sequence Number=SeqID_3256
MHRAIRIFESSPKASASALTLSTPLWFMLLCFLPCFHLIILRFIGGPTRRINTNPCLFLLYQLNIFPFTLAFENYTVIYKTKVERKDIDMIDEEEAQIGSDRSSATSNKAEIYNEEARKKTQKHKPKRVESVNELPFIVGKLCRAEQVGTNWGSEVLQVL

SEQ ID NO: 94942 - protein, 37 aa, Glycine max
  Coding DNA Sequence Number=SeqID_3257
MWINFWHQIVHVIAAYGCACLGRKIRIKDYKAKRAYR

SEQ ID NO: 94943 - protein, 48 aa, Glycine max
  Coding DNA Sequence Number=SeqID_3258
METPLQVEDESRRSSPPQEAMDKSLKGISVMVQPTNPRSSLRFSTKCA

SEQ ID NO: 94944 - protein, 140 aa, Glycine max
  Coding DNA Sequence Number=SeqID_3259
MSRNLTDYAIVPSLASEMLWNFTDCALTLPFNSRHVAELHGSPNDGCQVPRSGQAKVASHQTDGSRTKLGLKGMWRSMHKDLQAQTHIIKQLEDLNNTPGHDGERDDEHNGERNGEHGVRDGGSDDTEEVKVVTRVGLQD

SEQ ID NO: 94945 - protein, 87 aa, Glycine max
  Coding DNA Sequence Number=SeqID_3260
MDDNNQTLKELATRDVVYQPWCIQYPEIEVSYDIKSGLIHLLPKFHGLTGVCDAILPPRVLDRRLQEDWARVAKEDPRVLMNLRIDF

SEQ ID NO: 94946 - protein, 330 aa, Glycine max
  Coding DNA Sequence Number=SeqID_3261
AWERYTDIAMPRKLLPERNVVVYYTEFEEFKEELERRHWDEKLTDFADSSIDIAIVKEFYANLYDPEDKSPKQGENLCTYSRFALLRSDPQELAAKLYIPGRGFKLNVDGLRLKILQKNLTTLAQTWSKMDINLGYIISAQISLIAQHDSSRLGFPALITDLCKARGVIFDSLTLESLDPAINVAYAKGKRCKAPPSSEIPPSSAPAPIASAPSASTSVAWLGAHPSPSGGSGASTAQKPAPEEPAAAAAAVEGEDELTPPEPFYFDVDAHMAQGEGTSTYQIPKPSPAPVPEETQPSTPVTEPEQPIQDSSVAPALDLNEDQPQEQDMQ

SEQ ID NO: 94947 - protein, 120 aa, Glycine max
  Coding DNA Sequence Number=SeqID_3262
MANLWIQTCCFLLTPPPTLSKVCFQPKHRLQIPEMRNLEYLPRKLWWVATKALQRRPKLRVLIRKSKENQKRGREEMKREGEGEKWKGEKEVRNLREREGEGLGFSNEEGKALECHRVIT

SEQ ID NO: 94948 - protein, 450 aa, Glycine max
  Coding DNA Sequence Number=SeqID_3263
  Gene Ontology: Mol. function=transferase activity, transferring phosphorus-containing groups; Cellular component=integral to membrane; Biological process=two-component signal transduction system (phosphorelay)
  Homolog annotation: Hit_ID=A8GJZ5; Match level="QueryCoverage=37%, HitCoverage=89%, E-value=6e-61, Identity=66%"; Hit description =ThiJ/PfpI domain protein precursor
  Pfam annotation: Domain name=DJ-1_PfpI; Domain location=146-304; Score=61.7; E_value=2.5e-15; Accession=PF01965.15; Description=DJ -1PfpI family
  Pfam annotation: Domain name=Hpt; Domain location=24-100; Score=63.0; E_value=1e-15; Accession=PF01627.14; Description=Hpt domain
  Pfam annotation: Domain name=Transgly; Domain location=274-416; Score= 135.8; E_value=1.2e-37; Accession=PF00912.13; Description =Transglycosylase
  Pfam module annotation: Pfam domain module=DJ-1_PfpI::Hpt::Transgly; Domain location=146-304::24-100::274-416
YESLLDTAMLEQYMDLVGPQLIHQSLEMFEQMMPGYLAVLDSNMTARDQKGITEEGHKIKGAAGSVGLRHLQQLAQQIQTPTLPAWWDNVQDWVDELKQEWRNDVQCLSTPSTNQLTAATGVRVMKKVGVVLSGSGVYDGTEIHEAVLTLLALDRAGAQAVCFAPDNHNAMLLITYRAEAAQLDALIVPGGFGAAKNLSNFAEAGAECWVDEDLARLTREMHKANKPIGLMCIAPALLPKLLDQQARLTIGNDPDLGEVIDAMGGEPVICPVDDIVVDSDHKIVTTPAYMLAPSIAQAALGIDKLALSHNEKRPTRIRGASTLSQQTAKNLFLWDGRSWLRKGLEAGLTSGIELVWTKRRILTVYLNIVEFGDGVFGVEEASQRFFHKPAKRLSAAEAALLAAVLPNPHRFRADAPSGYVVQRQQWIMRQMRQLGRGSVFTRELAWIKRA

SEQ ID NO: 94949 - protein, 238 aa, Glycine max
  Coding DNA Sequence Number=SeqID_3264
WLAKLKIINEKNFEAPEEDEEVRALKTELGKARLAKEKFKLVATDVRKEYAGLREENAATAKALEQETKRAYKEEHGHDKFRGALWGSNSELKLRREERDRSRAHSMVLKEELAVCSRSKRNLSQRLRETETNMLAIITKYQEELSLATAHEHRVADEYAQVYAEKEARGRVIDSLHQEATMWINRFALTLNGSQELPRLLAKAKAMADTYSAPEEIHGLLDYCQHMIDLMAHIIRNR

SEQ ID NO: 94950 - protein, 100 aa, Glycine max
  Coding DNA Sequence Number=SeqID_3265
MYEYPRRTRALTHKHSFQNSCGYSCFVGKKEMAPKKLSTERSRRHATGEGSSAAPEFDSHRFRSAEHQQCFEAIRGWLFDRERRVQLREDEYTDFQEEIA

SEQ ID NO: 94951 - protein, 349 aa, Glycine max
  Coding DNA Sequence Number=SeqID_3266
  Homolog annotation: Hit_ID=Q6WAY6; Match level="QueryCoverage=94%, HitCoverage=57%, E-value=6e-33, Identity=31%"; Hit description =Putative uncharacterized protein
MGPLQRQAFRKVYGKILDLTAAEVFTEAVISLAQYYDQPLRCFTFGDFQMDALLGAENRIFSPDFLGALSKIAAVGGDLAKELDRMKQTRNGLVGLPWKYLEGKARDMASQEKWGPFADILALLIFWVVLFPNVDGLVDLATIDAFLAYHHSKECPVVAILADLFDTFDRRCEKNSARIVCCLPALCVWLISHLFQQDTRHPCPLQSYRSCAEKGRVDWDQHLAKIGGSAINWFSRWKEGKEGVLFSCGDYPNVPLIGTRGCINYNLVLAIRQLGYPMRGAPTEGSLSPFLVKDLGAQGLKVIQRIHKAWKSPLRKDKELRGIRNGVIGGYHGWLRIHTRGLDWLSKLK

SEQ ID NO: 94952 - protein, 87 aa, Glycine max
  Coding DNA Sequence Number=SeqID_3267
LKAQVEKDEGPSGEGQSPRVEKDEGPNLSSFIGSGVYPDLSSFTGSGVYPDLSSFTGSGVYPNFSSFTGSGVIQIFVACIKRSAPTQ

SEQ ID NO: 94953 - protein, 228 aa, Glycine max
  Coding DNA Sequence Number=SeqID_3268
  Gene Ontology: Mol. function=C-terminal processing peptidase activity; Cellular component=periplasmic space; Biological process =proteolysis
  Homolog annotation: Hit_ID=Q5PHP0; Match level="QueryCoverage=80%, HitCoverage=31%, E-value=1e-60, Identity=61%"; Hit description=Tail -specific protease
  Pfam annotation: Domain name=Peptidase_S41; Domain location=93-228; Score=19.8; E_value=8.6e-07; Accession=PF03572.9; Description =Peptidase family S41B
MVAGVPAAKSKSISVGRPHCGRRQPGKPMEDVIGWRLDDVVSKIKGPKGSKVRLEILPAGKGTKTRTVTLTREKIRLEDRAVKGTVHNVGKEKVGVLDIPGFYVGLTDDVKVQCRNCRSRTSTASSSICVPTAADSDNDGIVYYKGPLVVLVDRFSASASEIFAAAMQDYGRALIVGEPTFGKGRCSSIAHSTASTIRCCVRNGQRWAQSSTPFRSSTASTAAVLSGK

SEQ ID NO: 94954 - protein, 78 aa, Glycine max
  Coding DNA Sequence Number=SeqID_3269
MSHAVKDNRGKWAPDEDMTKSKGKDPLEGLGGPMTRARARKAKEALQQVLSILFEYKPKFQGEKSKVVSCIMAQMEED

SEQ ID NO: 94955 - protein, 660 aa, Glycine max
  Coding DNA Sequence Number=SeqID_3270
  Homolog annotation: Hit_ID=A0GQM3; Match level="QueryCoverage=29%, HitCoverage=46%, E-value=2e-17, Identity=33%"; Hit description =Putative uncharacterized protein
TDFRQRRALRIQHQLQRLARIIARRAERVRTGVQQHQRVEAGRHVALAKAIFRQLDEETVVAVLMAQVARLLIIADPIARGRLCRVQRAAHALVPAETVVFNAAENAPHVRVETVAGGEPESVLALERIRRVVALQQVFRVIKQQAGAGAALHIGQRQRATAAHDKRPVRPGGQQGLAEALFQIVGDHENGQLMLLPQLGDQLMHLAANTGIERAKRFIQQQNARLFHQRLRQGQTLLHAARQLMRIFALRLFQSDLRQHCLRALANRLTFASPDASQPACAAELVSQHHVAEHRQMRKHRVALKHHAAMGIRLVGNRCAIQQQLAFGRRFGAEQHIQKRGFAAAGGADNRHEFAALDLHIQPLQHHLIAVEGKGQQGDPRHVRQNHIHGQIAAHQEDAITEAFRGRNRFGSNQEQPRRTERQPHRIAQARHQLRQNHPPQNLRAMRTQRLRFDQLLLRDFLHLQLQIAGDQRRDADNDQHHFGDFAKAKADKQNGQNRQRRYQRKQRHQRCQHRAHHRQRAGEQADCQRQQRADSNAAQQTQQAGGGIAPQQILAGARAGLKRHPADGLAHSVKSRQQFVCRVQAETRIRREQIDQQHRQQRQNAKQQAAERQRLLTGGGQFGEGVGKAQFDVAGIAPVTGRGSDPYRIGPRRAFAQQT

SEQ ID NO: 94956 - protein, 292 aa, Glycine max
  Coding DNA Sequence Number=SeqID_3271
MSQSSDVSYFIGMSSVCHRRAARGDSAAGEALHGGLLEGLFVRDTGNQLGQRQHHGGAHHLQVALLLHGAQRGVVAGEIGLRRPGQHAVQFAERAEYFIVGKAVVAGVVIQLLTQRQQQLAVFVFVAIDHPQAVDELQAYRELAQRAVAQQQRFHRIFHRVVVFAKDLQHQQIDCFRQQFDSGDQEASHRTTGVQPLKHPVFKSLLLFHYCLHHSATVDGHAAAVPELTTKGRALCHSVKSPPAPPVGLSARSATPAPAPADRLRCDSASRRQCLAPGWRAAADTPACPASA

SEQ ID NO: 94957 - protein, 70 aa, Glycine max
  Coding DNA Sequence Number=SeqID_3272
MFYRRHLVTTSVELDFLMEFVEMDDLIHKAIQVEQQLKRKGVAKRSFTNFGSSSWKDKGKKDGGLLLLVI

SEQ ID NO: 94958 - protein, 101 aa, Glycine max
  Coding DNA Sequence Number=SeqID_3273
MQDITFTHSILPLCFGINDLLISKLLNPVSLPLWQHQQAKVHGRWWKVEAPTKITHIVFKLSDAGIHFFQSEHPRNQSVANIVQRPHNSERTSFIRAENHL

SEQ ID NO: 94959 - protein, 30 aa, Glycine max
  Coding DNA Sequence Number=SeqID_3274
MENLIVEKFEGNAKEESAMLNQEINFREIL

SEQ ID NO: 94960 - protein, 386 aa, Glycine max
  Coding DNA Sequence Number=SeqID_3275
  Gene Ontology: Mol. function=metal ion binding; Biological process =intracellular signaling cascade
  Homolog annotation: Hit_ID=A5B4T3; Match level="QueryCoverage=39%, HitCoverage=16%, E-value=1e-23, Identity=35%"; Hit description =Putative uncharacterized protein
MSHHEEETPKNESHKQEEHKMTENSGQGKPMQRMRTGRGKGGTIGANATHSGGTSVDTRISEGDNSGEHDTNTWIIDTGTSNHMIGNLNHMHELRDIQSCPVGLLNGQHTTTIKEGSVVLDGGLKFTNVLYDRISKTLIGVGEQRDELDFFRGVRNVRAYKIDGLHSIDLWHKRLGHPSLKITQLIPEVRKHKESQAVNKTLGVKSACGYPYDKKGWKLFDLETKEIFISRDVEFVETKYPFSIDVITRKDVPPKNWSCEEIVNDVTNGVEETDHTRGTKESDDMTMDDRGGEPDAGFDEQAEAGLLGAKPSNVSIEQNHHLALVASLPFPYPNQYRWLAPKETHWEANLHVVRYLKGNLDRVFCCIRIVTYNYLIDVTLIGLNVL

SEQ ID NO: 94961 - protein, 42 aa, Glycine max
  Coding DNA Sequence Number=SeqID_3276
MEHEQGEMIVNQQVKAWNILLGRPWQFDKEIIYNGLPHPSWH

SEQ ID NO: 94962 - protein, 73 aa, Glycine max
  Coding DNA Sequence Number=SeqID_3277
MGLKIYPKAHENPRVFPWISGPIYLESSINALAGDRACKTPGGPGEVQQGPGVSSSDYETLSVLRECPLPPTR

SEQ ID NO: 94963 - protein, 139 aa, Glycine max
  Coding DNA Sequence Number=SeqID_3278
  Gene Ontology: Mol. function=phosphoprotein phosphatase activity; Biological process=intracellular signaling cascade
  Homolog annotation: Hit_ID=A7PHV0; Match level="QueryCoverage=95%, HitCoverage=42%, E-value=9e-20, Identity=36%"; Hit description =Chromosome chr13 scaffold_17, whole genome shotgun sequence
MWAWERCTTLVPKRTPPIIENKPLGHMWLRRGNQHIGNDDLIVFRRKLDIMKRHEEPYTTTVMSMLPPICLVGSMAWCAMVPLICFHVVEWHQPDRVLRQFGMQQPIPESPSQPWNVHGLTLKDKQDENWFQLLAPFIS

SEQ ID NO: 94964 - protein, 141 aa, Glycine max
  Coding DNA Sequence Number=SeqID_3279
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
MVPGPPSSKGRDGGQEGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 94965 - protein, 266 aa, Glycine max
  Coding DNA Sequence Number=SeqID_3280
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSLLPSISPFALCPNVPSVVDLLHRLSPQETIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 94966 - protein, 48 aa, Glycine max
  Coding DNA Sequence Number=SeqID_3281
MSRNLTDYPIIPSLASGMLRNFMDCATMLPFDFRHVTELHGLPNDGCQ

SEQ ID NO: 94967 - protein, 110 aa, Glycine max
  Coding DNA Sequence Number=SeqID_3282
MPQNFMDCLTMGVKYLEVGSKDKALISFERNTIRPVNLHASGTCKNLENDQHRTTNIILILPNSFLSVDTRRRMTIICLYVPSDTIVFGWQKVPNDHNLSPHVIGLAASG

SEQ ID NO: 94968 - protein, 144 aa, Glycine max
  Coding DNA Sequence Number=SeqID_3283
MHETSGFSSPRDNIEHRNIVRSPTGNLVPLDLEIEATSRRNRAKRRRKLVQDKAVASILEEEAQSSDSVSSYSSSSRESTTDLPEASVMAEEHQHRVTLEDYSSSSVPQFFTSIARPEVQAHNINYPHSLIHLIQGNLFHGLPN

SEQ ID NO: 94969 - protein, 109 aa, Glycine max
  Coding DNA Sequence Number=SeqID_3284
MFVRSLGLYGSDHIYPPHGKGPRCGQYIQWQGWSVDIVCKRLAFVTLPYMEATIAFHGEPIIARPQDLPSHGLPVSMRTERALMDLLQHASSFLSVHASEQHYVMVSLV

SEQ ID NO: 94970 - protein, 54 aa, Glycine max
  Coding DNA Sequence Number=SeqID_3285
MTRIRAMYEYVSSVEEWYLEICRGGQETLGTSSGVLLPKTKLDQSRPNPGIVSQ

SEQ ID NO: 94971 - protein, 98 aa, Glycine max
  Coding DNA Sequence Number=SeqID_3286
AALHAPELTQGAVHHHAEPLAQEPEPEQPTVEATKGEDELTPPEPFYFDASVHMAQEEETSTDQIPEPSPAPIPDDAIPSSPTCELEKPTSQDLPVAQ

SEQ ID NO: 94972 - protein, 164 aa, Glycine max
  Coding DNA Sequence Number=SeqID_3287
MKADMEAMKEQMTTMMEAMMSMRKMMEVNTATVVAASTATEVDQTHPSGLNQLNPPVSDMNKHSFPPYGLPPNYTPSNVAHAPDETVNNSTPILIESQQPQSSQAQVPQLMGETHEVPRDHTLADSEPCLEYATEGQALGGAYPCQTLWGALSIADNHNPCILR

SEQ ID NO: 94973 - protein, 73 aa, Glycine max
  Coding DNA Sequence Number=SeqID_3288
  Homolog annotation: Hit_ID=A5B3J2; Match level="QueryCoverage=82%, HitCoverage=13%, E-value=1e-08, Identity=50%"; Hit description =Putative uncharacterized protein
MAEEHDQRITLKDYSRLSNEDPCAHLATFIEICNTVKIVGVPDEAIRLSLFSFSLAGEAKRWLHSFKGNNLKT

SEQ ID NO: 94974 - protein, 72 aa, Glycine max
  Coding DNA Sequence Number=SeqID_3289
  Gene Ontology: Biological process=transposition, DNA-mediated
  Homolog annotation: Hit_ID=Q1J7G7; Match level="QueryCoverage=47%, HitCoverage=48%, E-value=7e-12, Identity=97%"; Hit description =Transposase
MVKVGTSYVRSTSHFRQKLAQGFPVLQWLLFLSAVPPVQLLTGWCVTAKAPPDISAGKCSGHAARNHHTRRA

SEQ ID NO: 94975 - protein, 251 aa, Glycine max
  Coding DNA Sequence Number=SeqID_3290
  Gene Ontology: Biological process=transposition, DNA-mediated
  Homolog annotation: Hit_ID=Q1J7G7; Match level="QueryCoverage=16%, HitCoverage=71%, E-value=7e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPSHDVVKRRPEFDPGILTSATAALIDSTVFSGADQAYRYRRPRGGARYQLLFPLVRVNFELGVIMVIAVSFGKPVVPAALMNRPTRGERRFAYWALAECILAYYVGTDEGEKKGCTGASAEYVIQDIFRFLAH

SEQ ID NO: 94976 - protein, 123 aa, Glycine max
  Coding DNA Sequence Number=SeqID_3291
MNLRGRQVEISDPMCPLCNNSEESLSWVNSVGAFPKEQKDHYMQHSRRNATRTKDIRWSYWWIALTRTIWQHRNKVVFDNQTFNASKLMDEALLLVWSWLKAMEKDFYTHFNQWSSNLTNAFV

SEQ ID NO: 94977 - protein, 325 aa, Glycine max
  Coding DNA Sequence Number=SeqID_3292
MAKFDPDTVLEFYANAWPTQEGVQDMRSWVRGQWILIDVDALSQFLGYPLRRNRADGFDEEAIAQLLCIPGQDFAWTAAGRRVRIMRTNMTTLTQIWMTLLFSNIQPSDHNSDLPLPKYQLVYAILTRMSIHVAQLITDAIYLFAGMPPTRHPLDPDKSNRALGFPALITGLCLSFGVPVAPSKVIRPPITQAFIEKYCTARQAQGGDPQAPDAPPPPPQADPAGLFDTERYLRHLVRQQAANHRAHVQTHDSLYQLSLSLQSQGFVSFPCPTPDQFRAEVTWPGDWPEAQAAEAPTEAPGEANEAREDEEMTDLFDFLGGSGAT

SEQ ID NO: 94978 - protein, 75 aa, Glycine max
  Coding DNA Sequence Number=SeqID_3293
ERGTGWTIGVGHESHGLYYLKPNISWRRAFSISHLVLILLNRMALSKGIIGILLRLLGHYYFLPMYLSDIGVKQF

SEQ ID NO: 94979 - protein, 94 aa, Glycine max
  Coding DNA Sequence Number=SeqID_3294
SEFLIGGYVGARASLLSTIPPFVVMTQELVARGDTLRLSAPRHSVTPSVIDEQRPIWSFCALSGDVIIFRWRPLFKSHTAGPDDKKSKFGHSAP

SEQ ID NO: 94980 - protein, 140 aa, Glycine max
  Coding DNA Sequence Number=SeqID_3295
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=61%, HitCoverage=72%, E-value=3e-24, Identity=66%"; Hit description=LacZ protein
MQLARQVFPTGKRAVSATQLIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 94981 - protein, 171 aa, Glycine max
  Coding DNA Sequence Number=SeqID_3296
GSFVPHGCQDVLTAAIGRPEHPGRVRAAGAGVTIKQYFGSAPRTSRSSSSMPPEDLQQLTQKIRDQLEESIIEKGLALPPEPKVGPSGARVSTKESCVAPSGNDPETSDSDKYGLYIEENPSRLVALGRLYEGSTAVHNVPLLHGQVKVGVEEVKDAEAFVPIPTDEVTSV

SEQ ID NO: 94982 - protein, 27 aa, Glycine max
  Coding DNA Sequence Number=SeqID_3297
MSKRLHEDWARAAEEGPRVLMNLMNLR

SEQ ID NO: 94983 - protein, 95 aa, Glycine max
  Coding DNA Sequence Number=SeqID_3298
MGCLSAHLAVAMTNFARCFQIIMVTRALWSNMGVRPETDTLTPKFVLPQISRLGSHDKRPHCHTTLDFFEPWPIKRILILSPEAKDSVISSRESK

SEQ ID NO: 94984 - protein, 70 aa, Glycine max
  Coding DNA Sequence Number=SeqID_3299
MADFALINLDGGKNLAMNLSSTSSQVLRLLFGCDWSHVFTLPNGSLLEKLLWSHGVTAEDKEEVRGDAIH

SEQ ID NO: 94985 - protein, 149 aa, Glycine max
  Coding DNA Sequence Number=SeqID_3300
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
MTDIQHDSRIMVLIHHPEDTLKTLSQYQTSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 94986 - protein, 174 aa, Glycine max
  Coding DNA Sequence Number=SeqID_3301
  Homolog annotation: Hit_ID=Q1GY39; Match level="QueryCoverage=79%, HitCoverage=19%, E-value=4e-18, Identity=37%"; Hit description =Fusaric acid resistance protein conserved region
ATLVSELVLPQRLWENIQAVVRSKFRDFSVLLGTGAPAGLNQPFLKFMQDVYQLEAFRSSAQFETDDARVHSATINRLNVQFMAVSTTYVVLQRLIQRLHTRAASKEADALQVLMQPLSSAVLIERSSQASHAEKADYAGRSSSGELPQPGYQQPGILMMPDQRTGIAVTTKAF

SEQ ID NO: 94987 - protein, 179 aa, Glycine max
  Coding DNA Sequence Number=SeqID_3302
MDGVAAQQHPAQRSQLRPPSAEVSAGMPPTRHPLDPDKSNRALGFPALITGLYQSFGVPVTPSKAPNAPPPPHQADPAGSFDTERYLRHLVRQQAANHKGHVQTHECLYQLSLSLQSQGFAPFTCPTREQFRAEVAWLGDWPEAQAGEAPAEAPDDGEEACMDEEMTDLLDFLGGSGAT

SEQ ID NO: 94988 - protein, 124 aa, Glycine max
  Coding DNA Sequence Number=SeqID_3303
MVGYTPSSFADLVFVGEMIEVGLKRGNSDHHALVNAKTGVNEEGENEGETHVVIVIPIRPSFPPTQQCHYSTNNNPSPYQPPSYPQRPSLNQPQNPPTTQPMLNTTFSTNQNTNQGRNFAAKSL

SEQ ID NO: 94989 - protein, 67 aa, Glycine max
  Coding DNA Sequence Number=SeqID_3304
LKGEKVQAADVSLSEANALSEWHPLSEACSSLSVLGNPRRGSVRDVLAQSATSLPNESFVSSRAQHA

SEQ ID NO: 94990 - protein, 272 aa, Glycine max
  Coding DNA Sequence Number=SeqID_3305
  Homolog annotation: Hit_ID=Q6UUU1; Match level="QueryCoverage=22%, HitCoverage=40%, E-value=4e-18, Identity=78%"; Hit description =Putative uncharacterized protein
MVKVRTSYVPINVSFRQKLAQGFPWLLFLSAVPPVQLLTGWCVTAKAPPDISAGKCSGRVPFAIQAAQLLGRAIGAGLFAITPAGERGMCCKAIKLGIRSGNCWSVSRYCSGMIVKSYTTLAGALSIAAARDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 94991 - protein, 94 aa, Glycine max
  Coding DNA Sequence Number=SeqID_3306
MEKSEKKNFGEKKAKKAYITWDDNDLESSDDSEKEVINLCLMGKNYESDEEVTSSNKSISFDELQDAFVELHSESIKLAKLVSSSKKTISDLEK

SEQ ID NO: 94992 - protein, 109 aa, Glycine max
  Coding DNA Sequence Number=SeqID_3307
  Homolog annotation: Hit_ID=Q1J7G7; Match level="QueryCoverage=29%, HitCoverage=58%, E-value=6e-07, Identity=68%"; Hit description =Transposase
GPGLPGINRDTRIYLFCEVIFRHRYFSAQSASAVPPVQLLTGWCVTAKAPPDISAGKCSGRVPFAIQAAQLLGRAIGAGLFAITPAGERGMCCKAIKLGNARVFPVTTL

SEQ ID NO: 94993 - protein, 51 aa, Glycine max
  Coding DNA Sequence Number=SeqID_3308
MAEINQGMDASGDGVTTDQLMPFPGAKQAEDVAARQPSILCVHSFFYYCLL

SEQ ID NO: 94994 - protein, 75 aa, Glycine max
  Coding DNA Sequence Number=SeqID_3309
  Gene Ontology: Mol. function=hydrogen ion transmembrane transporter activity; Cellular component=proton-transporting two-sector ATPase complex; Biological process=ciliary or flagellar motility
  Homolog annotation: Hit_ID=P52612; Match level="QueryCoverage=100%, HitCoverage=16%, E-value=7e-33, Identity=93%"; Hit description =Flagellum-specific ATP synthase
MAQLPSVRRYGRLTRATGLVLEATGLQLPLGATCVIERQDGQETREVESEVVGFNGQRLFLMPLEEVEGILPGAR

SEQ ID NO: 94995 - protein, 179 aa, Glycine max
  Coding DNA Sequence Number=SeqID_3310
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=Q7HDI4; Match level="QueryCoverage=87%, HitCoverage=31%, E-value=8e-81, Identity=95%"; Hit description=ATP synthase subunit beta
  Pfam annotation: Domain name=ATP-synt_ab_N; Domain location=4-54; Score=14.0; E_value=0.0092; Accession=PF02874.14; Description=ATP synthase alphabeta family, beta-barrel domain
MGAKYLEVVKRGSHPNNGWSPDEIRQLLGNNRIRAVAMSATEGLMRGMEVIDTGAALSVPVGGATLGRIFNVLGEPIDNLGPVDTRTTSPIHRSAPAFIQLDTKLAIFETGIKVVDLLAPYRRGGKIGLFGGAGVGKTVLIMELINNIAKAHGGVSVFGGVGERTREGNDLYMEMKESG

SEQ ID NO: 94996 - protein, 110 aa, Glycine max
  Coding DNA Sequence Number=SeqID_3311
  Subcellular localization annotation: CTP_CleavageSite=32; ConfidenceScore=5.03e-01
MAEPSKKRKGTSSRSQRHSGSQEAPIPPSIPSGSLVSSEQRNMDRWIMGKEVSRNMDEEGHEGAIFISSFEDSVERFDGLQTFVERFAYFGTAKLISLCMMRFNQRIKND

SEQ ID NO: 94997 - protein, 175 aa, Glycine max
  Coding DNA Sequence Number=SeqID_3312
  Homolog annotation: Hit_ID=Q6WAY4; Match level="QueryCoverage=88%, HitCoverage=28%, E-value=5e-18, Identity=36%"; Hit description =Putative uncharacterized protein
MGTNQNGKRFYQVKIKGLDVTSLNELRRLMGSLQRQAFRKVYEKILDLTAMEVFTEVVVSLAQYYDQPLRCFTFGDFQMVPTVEEFEEILGCPLGGRKPYLFSGFLPSLSKIAAVVRDSAKELDRMKQTQNGIVGLPRKYLEGKARDMASQEKWVPFVDILALLIFGVVLFPNVD

SEQ ID NO: 94998 - protein, 108 aa, Glycine max
  Coding DNA Sequence Number=SeqID_3313
  Subcellular localization annotation: CTP_CleavageSite=17; ConfidenceScore=5.66e-01
MLCKKAVSSFGPPIVVRSKLAAVLSLMVMAALHNSLTVMPSVRCFSVTGVSRGPFVSRVSVMTVKPLTHAAPGDVTAVCKRCREQTAVRRVSGVGGVGLLTMRIRQIY

SEQ ID NO: 94999 - protein, 259 aa, Glycine max
  Coding DNA Sequence Number=SeqID_3314
  Gene Ontology: Mol. function=DNA-directed RNA polymerase activity; Cellular component=intracellular; Biological process=transcription, DNA-dependent
  Homolog annotation: Hit_ID=Q5PK93; Match level="QueryCoverage=83%, HitCoverage=21%, E-value=4e-74, Identity=60%"; Hit description=DNA -directed RNA polymerase subunit beta
  Pfam annotation: Domain name=RNA_pol_Rpb2_7; Domain location=184-259; Score=174.6; E_value=2.5e-49; Accession=PF04560.11; Description=RNA polymerase Rpb2, domain 7
HLHQPDALRVPVANQLNAATSWPTARPPTSVITQGAGWNGYNVRRLHPGIQEAGRHGNKGVISKITPDRIRTGVRHDAPTVRRDPPGYGCERYRRQDNAMLKQQQEVAKLREFIQRAYDLEPAQRYANCNAGFDGAKEAEIKELLQLGGLPTSGQITLFDGRTGEQLSVRLVTQQPLGGKAQFGGQRFGEMEVWALEAYGAAYTLQEMLTVKSDDVNGRTKMYKNIVDGNHQMEPGMPESFNVLLKEIRSLGINIELED

SEQ ID NO: 95000 - protein, 47 aa, Glycine max
  Coding DNA Sequence Number=SeqID_3315
MGAKDMSFIHKRFMQKPLLNACRSLTIKDHTLTGLWLMSTFTIKLSN

SEQ ID NO: 95001 - protein, 148 aa, Glycine max
  Coding DNA Sequence Number=SeqID_3316
QSKSLNEDPLEGKSGASSRVKKLVVGPWVGSIGPPPVCTGRLVPSAGDALLSLTGRVVPPDSDPIVLAFGIGVMINRDSRGHSYFIVRDTVLVSTINDADQGSADVAFRTPLALMRNQVFGFRGEYGRRLKLKELTEGHTRSGACGLI

SEQ ID NO: 95002 - protein, 72 aa, Glycine max
  Coding DNA Sequence Number=SeqID_3317
SLTGNLVPLDLEIEATLRRNKAKRRRKLLQDKTVASILEEETHFSDSSSSDSPSSRESVNYLPEAVSMADEH

SEQ ID NO: 95003 - protein, 87 aa, Glycine max
  Coding DNA Sequence Number=SeqID_3318
MERWKNIDFKDDEKVILDLENDSSNWSSPFSLLHSARVLPSKDSKGKTARKPHYKRNLKESWASSSKGNNTRKSSLPWIQTENANEI

SEQ ID NO: 95004 - protein, 77 aa, Glycine max
  Coding DNA Sequence Number=SeqID_3319
MARKDKYGHLLPLSKTQCLSTETLKVSLCYPETSESDSTRRQIVVIRTLYHLETIRGEVTSSPGQAELAWASKLLLE

SEQ ID NO: 95005 - protein, 98 aa, Glycine max
  Coding DNA Sequence Number=SeqID_3320
MVIFSFVEDSMSFYRDCYSLPLPSRDKQVRWHAETNYGHPHHFAIQRQKQASPMARRDKLWSSAPFCYPEIVESDSTRRQIWLSATCQPEASEPVDPQ

SEQ ID NO: 95006 - protein, 122 aa, Glycine max
  Coding DNA Sequence Number=SeqID_3321
MARTRGLGRAIARLIGRDRHDDHDATDVPERRRPTASARRQRVYQMTADALDMVEDVADMIEDVPDLAEEAPEMTADVQGVDGAEGSDADDVEGFPGGPHDPSVLTSFADHVAHAVWSGHVF

SEQ ID NO: 95007 - protein, 179 aa, Glycine max
  Coding DNA Sequence Number=SeqID_3322
MDNTIQLINNQYLDEIYYRRPFTDAGNQFLFQSMQLKNDDDVNTMLMCNHQFSCVGPIELLCIIGRIPDGILNLLQATMTPTHDALLYYNGRWNMPCQHDFVGYSFTGKNPKKFDIPSRCTIDELKDLIKQVAPQGIPPYGIHESQTVRQLFFRQLGHYEYSDKVIKFKIIELKTDDDV

SEQ ID NO: 95008 - protein, 24 aa, Glycine max
  Coding DNA Sequence Number=SeqID_3323
MKPKCALGAKVRTKRKVNVKTPEV

SEQ ID NO: 95009 - protein, 106 aa, Glycine max
  Coding DNA Sequence Number=SeqID_3324
  Subcellular localization annotation: CTP_CleavageSite=45; ConfidenceScore=5.23e-01
MASMDTSAMVNSKIFPRDQDRTHMQCLCKRHNAGMYTSPVESPTVATYRSAGGRRVTRGMRVPRKEYARSRHQRLFEENVGKTGKDAIYELLSERFGSCIYARGRY

SEQ ID NO: 95010 - protein, 62 aa, Glycine max
  Coding DNA Sequence Number=SeqID_3325
MEDRVTTDRSSSLPGAGQAENVAARQPRDGPRPTLHFEAMGHATLPPFSCYSCLNMRPPSVR

SEQ ID NO: 95011 - protein, 47 aa, Glycine max
  Coding DNA Sequence Number=SeqID_3326
MEEIHGEEDEEQGIKLQVELVGLGSSSSIKSFTSGISMATEMEKEER

SEQ ID NO: 95012 - protein, 32 aa, Glycine max
  Coding DNA Sequence Number=SeqID_3327
MHNCPTCGVSRYKVNDDECSNGAATTNSLPTK

SEQ ID NO: 95013 - protein, 46 aa, Glycine max
  Coding DNA Sequence Number=SeqID_3328
NRLPESNVEAMPSKIILMMPKNQESNKFQKSRSRFKNNQDQDSRFK

SEQ ID NO: 95014 - protein, 105 aa, Glycine max
  Coding DNA Sequence Number=SeqID_3329
  Homolog annotation: Hit_ID=A5BKB9; Match level="QueryCoverage=54%, HitCoverage=7%, E-value=6e-10, Identity=40%"; Hit description =Putative uncharacterized protein
GYIYLGLTENKRGYISCGSVLVEGTSTRFKENKGGYIPCGSLLVKGFLQGDEYYGRYDETGQHPGPFAKLVQKRAFMCNTQFPTLPVSLWMYALKTAMYLLNRVP

SEQ ID NO: 95015 - protein, 135 aa, Glycine max
  Coding DNA Sequence Number=SeqID_3330
KKEGVETRIVITERAGWTKSVSYLCFPLISDERYLAPFVAQYMKSRDVPKIKRKQAYAIRENSVMGVQIAIKPTWAFQILPPEGCCFWWKQPCSPGRAGKSKPRRFRNISVSNYAKIVDRSSTFVVRSSFSSVFN

SEQ ID NO: 95016 - protein, 55 aa, Glycine max
  Coding DNA Sequence Number=SeqID_3331
MGAKYLEVVKRGSHPNNRWSPDEIRVRSCSILKCTASLELDRARLGYRTTGHGVW

SEQ ID NO: 95017 - protein, 126 aa, Glycine max
  Coding DNA Sequence Number=SeqID_3332
MFLKELCTHKRKFKGNERISMGRNVSALIGKFVPHILEKCKDPGVVPLDVDFLESECTNHVAGSTYTSDLLYEPPTTLELKPLPTNLKYAYLEDKEKFPMIISASFTAEQEEKLLLVLKKHKKAIG

SEQ ID NO: 95018 - protein, 59 aa, Glycine max
  Coding DNA Sequence Number=SeqID_3333
MLMHNPRGGVLSKNGGANSTQAHLGPPEGGCFWRKQACSPGRAELAWASWAATTSPILL

SEQ ID NO: 95019 - protein, 204 aa, Glycine max
  Coding DNA Sequence Number=SeqID_3334
MTSEVTKEIAEKIASQGSFVPHGRQDLLTATIGRPEHPGHVRAAGAGVTIKQYFESALRTSRTSSSMAPEELEQLTQQIRDHLEELITKKVTRQRMLSFNQMQSQFQSQMQSQGLALPPEPEVGPSVARVITKGSCVDPSATDPNTGRVYEGSTVVHNIPLLHGQVKVGVEEVKDVDAPVPLPTDEVVVSLAKPADRPDPEAFD

SEQ ID NO: 95020 - protein, 45 aa, Glycine max
  Coding DNA Sequence Number=SeqID_3335
MWDVVEDDFGSLDDCDIKGTPETGLQTPGFHKQRNRSGGRAAQDR

SEQ ID NO: 95021 - protein, 89 aa, Glycine max
  Coding DNA Sequence Number=SeqID_3336
MRISFAATFRRNNAERKRKFLHDRTVASILEDAHFSESSSSNSPTSKESQTAEFEAKVMVEEQPRRVTLEDYSSTSVLQFFTSIAWPEV

SEQ ID NO: 95022 - protein, 182 aa, Glycine max
  Coding DNA Sequence Number=SeqID_3337
  Subcellular localization annotation: CTP_CleavageSite=26; ConfidenceScore=5.14e-01
MLKGNTCQEDATLGTSNHFHTISKPLSSPVKKRPPGPNSINATSFFDNDRKNLKTDFITNHVTYNMNLLLRQIKSSLSPSASRGNRWDNTTPMLKGNTCQEDATLGTSNHFHTISKPLSSPVKKRPPGPNSINATSFFDNDRKNLKTDFITNHVTYNSNIFIKAGEDYICWEEYKRMKLVFL

SEQ ID NO: 95023 - protein, 112 aa, Glycine max
  Coding DNA Sequence Number=SeqID_3338
  Homolog annotation: Hit_ID=UPI00016621D1; Match level="QueryCoverage =95%, HitCoverage=38%, E-value=3e-09, Identity=35%"; Hit description =UPI00016621D1 related cluster
MGTSTLTFRGLDVLAFRGLYALTFRGLHVLSIRGLHALTFKGIHALTFRGLHVLAIRGLHALTFRGLHILAFRGLDVLTFIGLHTLAFRGLRVLTFSGLHIHTLIEFKVLYP

SEQ ID NO: 95024 - protein, 75 aa, Glycine max
  Coding DNA Sequence Number=SeqID_3339
FDFGNLPVEDRRTTNNERRTMKNGGKSSRNRPRKRLESVREKREVVAAQLTQASWVASTRRHRLLLEHPGRPKWA

SEQ ID NO: 95025 - protein, 122 aa, Glycine max
  Coding DNA Sequence Number=SeqID_3340
MTETSIRARNASVYGFLEPQSIQRSGQSQFESKNYIKNWMLNSHRYVYLGAYLNGALKGFDDSQQSKSKPVARWILIKCNKKKGSTECEYYVMHWMSTIVLGNFKDNWKMYFTNQDHWTQRE

SEQ ID NO: 95026 - protein, 73 aa, Glycine max
  Coding DNA Sequence Number=SeqID_3341
MQVASGNDDLGQKWTRGMQHASWSSDFMHDRHMARAGGRARLIGDFRLPHWKLQAHWRFEPAMVTSCRSSAAA

SEQ ID NO: 95027 - protein, 92 aa, Glycine max
  Coding DNA Sequence Number=SeqID_3342
  Homolog annotation: Hit_ID=A5BMH4; Match level="QueryCoverage=91%, HitCoverage=12%, E-value=1e-12, Identity=40%"; Hit description =Putative uncharacterized protein
MEMLRKMNIRESMDKNEVLKVHQNIARFWYQAAIGQYGPHLPIPSYHDIRVPLLKKEVEYTENLMKGHREQWVKYGCTIMSNAWTDRKQDAH

SEQ ID NO: 95028 - protein, 74 aa, Glycine max
  Coding DNA Sequence Number=SeqID_3343
MKLYPLLAMNPKDDGLLCPVINQEANLASCNEPKERWSLVFIVCNQEYLLLKTFTKSRSLEKLFVRMEERKRIE

SEQ ID NO: 95029 - protein, 167 aa, Glycine max
  Coding DNA Sequence Number=SeqID_3344
  Subcellular localization annotation: CTP_CleavageSite=45; ConfidenceScore=5.51e-01
MFFVITILSDLNVPSTWVRARVFLDVSFIRTFFSPKTEVVMKSPRSVGGKSISIARKTLTSPERVQMTTLVSLTKGADNHKVCLRATGPLGLTTELRLFHGLGRKTLTSPGKVCPCATGPLGHDSKIETFLRSRPEDADIFGKGTDDHIGLCLSIELGSLNDEVQIT

SEQ ID NO: 95030 - protein, 127 aa, Glycine max
  Coding DNA Sequence Number=SeqID_3345
  Gene Ontology: Mol. function=transition metal ion binding; Cellular component=chloroplast thylakoid membrane
  Homolog annotation: Hit_ID=A5C997; Match level="QueryCoverage=82%, HitCoverage=45%, E-value=9e-25, Identity=59%"; Hit description =Putative uncharacterized protein
MGLYTSVMEEISFYTGLSPAAFFTILAMMVVVYRTVSGMFVSPEDYNKPPVVSARANSRLDESEPPREPVQLGEITDRELRAYDGSDPSKPLLMAIKGQIYDVSNGRPLIPFYEAPTPTWTPDTTRT

SEQ ID NO: 95031 - protein, 62 aa, Glycine max
  Coding DNA Sequence Number=SeqID_3346
MGHEGGFQKAICQIAFFAPEIDVNKFDVLKDAKDGELVREFEIGSYEEASNSETTSKAGDAE

SEQ ID NO: 95032 - protein, 96 aa, Glycine max
  Coding DNA Sequence Number=SeqID_3347
WQPTAVRGGHRWSWVVEKKFSKIAIPDSLTVGSSSNFFLELPKTCFHSLTIGILTITTFDLSLSENGVLSVIPTREGIALSDQRCAKRAVVQRGLR

SEQ ID NO: 95033 - protein, 132 aa, Glycine max
  Coding DNA Sequence Number=SeqID_3348
MTGRLLPGSLTFDNRIMHYIIVRILLPRSSNLAQAFEEDLILMWAHLVRYQMHKALRANAPLPYPQLVTFFLRHFQIPLDDEPFVQVKRSFAIGAGAVTSFGYRMDICLTQLEEDVGYIRQSFDLPPPPPPS

SEQ ID NO: 95034 - protein, 226 aa, Glycine max
  Coding DNA Sequence Number=SeqID_3349
  Homolog annotation: Hit_ID=UPI00016621D1; Match level="QueryCoverage =72%, HitCoverage=40%, E-value=4e-16, Identity=33%"; Hit description =UPI00016621D1 related cluster
GLHALTFRGLHVLAFRGLHALTFRGLHILAFRGLHALTFRGLHVLAIRGLRVLAIRGLHILAFRGLHILAIRGLHALTFRGLHVLAFRGSSTFIFRELHVLAFRELHALTFRGLHVLAFRELHVLTIKGLHALTFRGLHVLAFRGSCTFTFRGLHVLAFKGLHALTFRGWTPSPSKVLGPPPDIGGRPTMRAQPKEGYHAATVHTGARGRAHKTPSGPGEVQQGPG

SEQ ID NO: 95035 - protein, 288 aa, Glycine max
  Coding DNA Sequence Number=SeqID_3350
FYANLYVPEDKEPKQVRVRGHLIKFDADSLNTFLKTLVVLEQGESLPSYSRFCRLRPDPQELAARLCIPGRGFVLNTEGLPCKLLRKDLTTLAQTWSVLSYSNLAIISHTSDLNLDRAWLVYGLVMKMDMNIRALISEQISLIAQSNSSRLGFQALITALCKARGVTSYSLTYESLSPAINLAYIKKNCWNLNDPSVTFPGTQKSRARRSEAPSPSVDHAPPTSAPSTFALPSAPLRAFHVYAAEPAPGPAPDFAELAGCGLAMTSYERGGVSAEGCLVRSPTFSFGR

SEQ ID NO: 95036 - protein, 79 aa, Glycine max
  Coding DNA Sequence Number=SeqID_3351
  Homolog annotation: Hit_ID=Q84VH5; Match level="QueryCoverage=100%, HitCoverage=12%, E-value=2e-15, Identity=56%"; Hit description =Envelope-like protein
MATSPKETSASGSPSVPSSPHQEQPEFNIQPIQIIPGQAPVPEKLVPKRQQGVKISENPSLATSPREVDPEMDKKIRSI

SEQ ID NO: 95037 - protein, 65 aa, Glycine max
  Coding DNA Sequence Number=SeqID_3352
MRKLIKERMENKVANFVGLNKVVLGIKWMNEMNKGDDGKWKLWHKMEGKNHSFQRGQHTKVVKVL

SEQ ID NO: 95038 - protein, 58 aa, Glycine max
  Coding DNA Sequence Number=SeqID_3353
MSHACQKDLRILWTIDNLLKVIGDFESSVPGIKMGIVLQRLNGYKIFSHQKEQVKERL

SEQ ID NO: 95039 - protein, 40 aa, Glycine max
  Coding DNA Sequence Number=SeqID_3354
MGLRILRAKVRELFMCGKRREALRCWTFERMQVIFLWIKA

SEQ ID NO: 95040 - protein, 71 aa, Glycine max
  Coding DNA Sequence Number=SeqID_3355
MADRVPGNGHFDDGDGGHQCRGRFWVREEVAAIGFGRRDCGNGGVWFEGFEQLREGTKVFEGARGRTHQIE

SEQ ID NO: 95041 - protein, 294 aa, Glycine max
  Coding DNA Sequence Number=SeqID_3356
  Subcellular localization annotation: CTP_CleavageSite=12; ConfidenceScore=5.43e-01
MAESSKKHKGLSSSTTTTGQRRHGASGDFPAPPNPSLSSPCSLTLFSFDDQHQRYYSSFSNRAILDPKFLDFDFFEDETFDCYQVFQNSELVNFMTLKFPYYSELVQFFYNNLEICEGIIFSEVHKISIVVDQSLFYSLTKLSSQGVPFEGALVDDWKSIYSSHDARKIVCDENVDKTGCLLVGSFTFECRIMHYILCQVMFPRSTNLAQASEKVLILLWALQTGRQIDWAHLVHYRMHKALRKNTPLSYPHLVTLILQHFNIPLANEPFVKVQRSFAIGAAAVASFGYRKDLD

SEQ ID NO: 95042 - protein, 216 aa, Glycine max
  Coding DNA Sequence Number=SeqID_3357
MTGTSYPHRQRTTRPRLERTTRPHHQRVARPHIQRTTCPRLERATRPHLGGLHVLALRGLHVLALRGLHVLTIRGLHSLTSRGLHVLALRGLHALTLGTSYPHRQRTTRPCLERTTRPHDQRVARPHLQRTTCPCLERATRPHLGGLHILAIRGLHALTFRGLHALAIRGLHALTSRGLHILALRGLHALTFRGLRVLIFSVLHIRTLREFKVLCP

SEQ ID NO: 95043 - protein, 208 aa, Glycine max
  Coding DNA Sequence Number=SeqID_3358
PVVAILAMYDTSDRGCERAAQELFVVHWLSMCDWFHTFFSKKVGPSIRYKVTARRKNQDSIFMRRMPKCSLDGTRGCINNNPILAIRQLGYPMRGVPSDESITPFITRGFSDPNARDRELRGSSNGSIGGYHKWLRVRTQGLDWLPNLKTMRDDEVKASEESDEVQALKAELERARVVEEKFKSLAIKGSNSELKLRRGERNHHGSKA

SEQ ID NO: 95044 - protein, 89 aa, Glycine max
  Coding DNA Sequence Number=SeqID_3359
MKLGGRRRYPSGYSYKHYFAIRKTQSTIASRDERRLLHPLSIAANEPVDTRRFTSSSMLPVILTREVRRRCPSGDPYKSRLLSVRLKAR

SEQ ID NO: 95045 - protein, 41 aa, Glycine max
  Coding DNA Sequence Number=SeqID_3360
MEFTYDGSPEQMAHTEMKNLVGRLGVHDRTCLTMGKSGHSH

SEQ ID NO: 95046 - protein, 101 aa, Glycine max
  Coding DNA Sequence Number=SeqID_3361
  Homolog annotation: Hit_ID=A2Q4L6; Match level="QueryCoverage=61%, HitCoverage=60%, E-value=2e-08, Identity=48%"; Hit description =Ovarian tumour, otubain, related
TYKTNRYKLSLLDIVGVTPTGMTFFVGFAYLEGERLNNVFWALERFQGLFMRVDALPGIITIRNYTFNIDYFGHSTSALKPMLKVTMLNVSSVTSVLKNRC

SEQ ID NO: 95047 - protein, 264 aa, Glycine max
  Coding DNA Sequence Number=SeqID_3362
  Homolog annotation: Hit_ID=A1G1G7; Match level="QueryCoverage=91%, HitCoverage=76%, E-value=1e-121, Identity=89%"; Hit description =Putative uncharacterized protein precursor
MHLPLCLIAALLLPCAALAAPPQVVTDDIGRFWATYDAVRAEPDVERQVALVQERYIDPGSPGLHALMQVRNYTAREYAEAMRAWPRFWTSVRPLTANAQQASATLERDLSKFRALYPALRPATITYAVGVLRTGGTTLGDKVLIGAEMALGDERVDVSELPEKMRERLRIFYDSRPGANNAQNNLHEYVHTQQRETTGSLAQYAVREGVAEYVAERLSGRRPALPLYSYGPAHEADIRTRFIAEMDGGNLDNWLYNSARNPFG

SEQ ID NO: 95048 - protein, 32 aa, Glycine max
  Coding DNA Sequence Number=SeqID_3363
MLHPVRQTGLQGLGTGATSCRTTQSGRWEYSG

SEQ ID NO: 95049 - protein, 138 aa, Glycine max
  Coding DNA Sequence Number=SeqID_3364
MASNPFKSQKKAKSSKRKQGECSQATLNRLDTWFIDESKKNDFKMIYVVKNVRIPKYLDLERFSRQGFNFPCIDERNFLFEAGESLLSCAHADLEGNLFSTINGVKMVIDAEVQKAIARLDLGGVHKFEESTDGYSKM

SEQ ID NO: 95050 - protein, 189 aa, Glycine max
  Coding DNA Sequence Number=SeqID_3365
MAAQLIHDRVEMECREGVSETLEGNARCRFRGTIRLTATSLVHPEEPARTLQQIVEWILPTPTPYRLVEPVQVIEVSSSEEDPEEDPEELPPEPAVDALDFPEGDEDPLPDVDSPEDVMSASEANSTEESGPGGIRLVETLHHSRRLLLGDLLYRNFDDCIHVAEATTVDTFALDVTMYFAKLPYFGQL

SEQ ID NO: 95051 - protein, 270 aa, Glycine max
  Coding DNA Sequence Number=SeqID_3366
MASRKRKATTLASRDGYDRSRFVSQEAWDRYLDNVLARNILTETNVKLYINEFDDFRRELIRRNWHKKLTNLTERSIDVAIVMEFYENLYVPDDKFPKQVRVRGHLIKFDVNSLNTFLETPVVVEQGESLPFYSRRGFVLNAEGLLWKLLRKNLTTLVQTWSVLSYSNLAPTSHTSDLNLDKAKLVYGLVMKMNMNLGTQKSKARRSEAPSTSAGPAPPASAPSTSGLPSPPAAPILSGPSAQSLELSLSMLQSLHLGQLLIMQSLQDMV

SEQ ID NO: 95052 - protein, 91 aa, Glycine max
  Coding DNA Sequence Number=SeqID_3367
MVTWMAMENLMLEDAGTLYSDRIAKDIWDTLALTFEGSLKTVETTSDCTDNKKKGKKGFMSTREDLDDTSLEEEEEEEANLSLMDDIVTEG

SEQ ID NO: 95053 - protein, 75 aa, Glycine max
  Coding DNA Sequence Number=SeqID_3368
MDSFASWKMNGSGMEKEERERRCHFKEKVILEEAHNMMQSYPARALDRRLQVDWARDPREDPRVLMSLRVDFESM

SEQ ID NO: 95054 - protein, 109 aa, Glycine max
  Coding DNA Sequence Number=SeqID_3369
MEPIRTVWRTLSVRNTTLARKNGPSYARLAETLLGSHLKHYCVIFPRCAQKGTGHPEAEHCPPTFYLVGFMTIWSRSSWLRRPRRSWRKLYSKEALMVSSTLHPRLDAT

SEQ ID NO: 95055 - protein, 123 aa, Glycine max
  Coding DNA Sequence Number=SeqID_3370
GRGGRTTIGADCSSETSNKSEIYKEEAANAAQKHKPKRVESVNADAKAFGDHWKTGDSTVLKIGDSTKVVIKQDMKGGQHKYGFNNNKCEKPEKVFMSFLHHSTSSCHSFIIQRLHVIPSPTV

SEQ ID NO: 95056 - protein, 95 aa, Glycine max
  Coding DNA Sequence Number=SeqID_3371
MTGVQNQQFQEHRLLDKNGQVTEVSKVDHSKAKPQERNSENNNEWGTKSLLKERKAELDHSKTEAQGEEDPKKGYKFISRQLFFPNNSLALEPCT

SEQ ID NO: 95057 - protein, 78 aa, Glycine max
  Coding DNA Sequence Number=SeqID_3372
MIRGDTLRLSAPFCHPEAAGPMTSRDQVWSFCTLVSSRGGGPDDSVEIPYSYPYKHSFAIWNDKSWSPATLVNREERN

SEQ ID NO: 95058 - protein, 78 aa, Glycine max
  Coding DNA Sequence Number=SeqID_3373
GKEGRANGFSPSGIEKSLEINEKNCFREKNPSRGTSVTLSRRFCKRFREDSSPFFIVLHSFFGLQPKNLTDRSCCNLG

SEQ ID NO: 95059 - protein, 295 aa, Glycine max
  Coding DNA Sequence Number=SeqID_3374
  Gene Ontology: Mol. function=DNA-directed DNA polymerase activity; Cellular component=intracellular; Biological process=DNA repair
  Homolog annotation: Hit_ID=A7MEN4; Match level="QueryCoverage=100%, HitCoverage=84%, E-value=1e-116, Identity=70%"; Hit description =Putative uncharacterized protein
  Pfam annotation: Domain name=IMS; Domain location=1-285; Score=239.1; E_value=9.9e-69; Accession=PF00817.11; Description=impBmucBsamB family
MPTATALRLCPHLKLLPGRFDAYKEASQQIRAIFTRYTPLIEPLSLDEAYLDVTDSEHCQGSATLMAQAIRADILRETGLTASAGIAPIKFLAKIASDMNKPDGQYVITPQAMPDFLLTLPLSKIPGVGKVATKKLEEMGLRTCADVQQADLAQLLKRFGKFGRVLWERSNGIDDRDVVVERERKSLGVERTLGEDIHHWEQCLEIIDFLYAELDRRLSAIRPDKQIARQGVKLKFNDFQLTTQEHVWPVLNKDDMIAVARQAWDERRAGRGVRLVGLHVTLVNPQLERQLVLGL

SEQ ID NO: 95060 - protein, 287 aa, Glycine max
  Coding DNA Sequence Number=SeqID_3375
  Gene Ontology: Mol. function=transporter activity; Cellular component= integral to membrane; Biological process=ion transport
  Homolog annotation: Hit_ID=A7MEM9; Match level="QueryCoverage=92%, HitCoverage=72%, E-value=2e-97, Identity=65%"; Hit description =Putative uncharacterized protein
  Pfam annotation: Domain name=Porin_1; Domain location=27-287; Score =353.4; E_value=3.8e-103; Accession=PF00267.12; Description=Gram -negative porin
MKKSTLALIVSALALASTAQAAEVYNKDGNKLDLYGRVKGMHYFSDNAAADGDKTYIRLGFKGQTQINDLMTGYGQWEYQFQGNRAETNTDANIGNKTRLGFAGLKFGNYGSVDYGRNYGVVYDVLAWTDVLPEFGGDSAYTDTYMLGRTSGVATYRNSNFFGLVDGLRFAVQYQGKNDSTSANGRSEIPKQNGDGYGASLGYTLGDSGVSLMSAISSADRTNSQDVATRLGRGDKAEAWGAGIKYDANSIYLASTYSETRNMTPITGGVANKTQNFEVVAQYQFDF

SEQ ID NO: 95061 - protein, 77 aa, Glycine max
  Coding DNA Sequence Number=SeqID_3376
  Subcellular localization annotation: CTP_CleavageSite=18; ConfidenceScore=5.17e-01
MQVSSPGRAELAWASHPVATYPSAGGRRETRGMRVPRKESARSRHQRLFEENVGKTGKDAVYELFSERFGSCIYARG

SEQ ID NO: 95062 - protein, 44 aa, Glycine max
  Coding DNA Sequence Number=SeqID_3377
MKIKKEDMEKLITTEGFEFAINKEASMVSQTIHSIEAASAFQIR

SEQ ID NO: 95063 - protein, 94 aa, Glycine max
  Coding DNA Sequence Number=SeqID_3378
  Gene Ontology: Mol. function=oxidoreductase activity; Biological process=metabolic process
  Homolog annotation: Hit_ID=A6TGV9; Match level="QueryCoverage=100%, HitCoverage=28%, E-value=2e-30, Identity=76%"; Hit description =Quinone oxidoreductase
  Subcellular localization annotation: CTP_CleavageSite=29; ConfidenceScore=5.09e-01
MVSFGNSSGPVTGVNLGILNQKGSLYVTRPSLQGYITNREELTEASNELFSLIARRRDQSRCGGYIRNTPLRDARRAHEILESRVTEGSSLLLP

SEQ ID NO: 95064 - protein, 128 aa, Glycine max
  Coding DNA Sequence Number=SeqID_3379
MSTWHGLKDKLAACSRSKRSLDQHLEATEQSMLAIIGQYKEELNQSLTHEQKLVEDFAQAYAEKEARGRVIDVLHQEATMWMDRELTITKKAQRHPYNTRSRSKMDNEEGVQEQMKADLSALKDRGIL

SEQ ID NO: 95065 - protein, 56 aa, Glycine max
  Coding DNA Sequence Number=SeqID_3380
CNRQKGSTECDYYVMHWMSTIILGSFRNNWEAYFNDPRPLEPERLKALRIQWVWKQ

SEQ ID NO: 95066 - protein, 129 aa, Glycine max
  Coding DNA Sequence Number=SeqID_3381
MHKALRANAPLPYPHLITLFLCHFQIPLDDEPFVQVKRSFAIGAGAVTSFGYRKDRNGQWLKKDALPPQDEPLMNEVLSELRGLRSYVGYRFDSLDTRFSGMDIRLTQLEEDVGYIRQSFDLPPPPQPS

SEQ ID NO: 95067 - protein, 274 aa, Glycine max
  Coding DNA Sequence Number=SeqID_3382
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIIMLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 95068 - protein, 143 aa, Glycine max
  Coding DNA Sequence Number=SeqID_3383
  Homolog annotation: Hit_ID=Q5QJQ3; Match level="QueryCoverage=53%, HitCoverage=89%, E-value=5e-28, Identity=59%"; Hit description =Putative uncharacterized protein
MAYERGGDFLEDARKILNREVRGPRQSRFSIGSAPLTSITKSDAQISGGETRQDYKDTRRFPLAAPSQFAPSWTVCTNPPFSPTAAPYPVTIVLSPTRKDMQKHHWQQPLVIDLEELVLKSCAGKAKLKGQVLVTALLQPVTS

SEQ ID NO: 95069 - protein, 75 aa, Glycine max
  Coding DNA Sequence Number=SeqID_3384
MPSKIILMMPNDQESSKFQRIKSQASFMNQDQDSRFKNNQDQDSRIKRRLNQDKKFLPEFYSLVIDYQKAVIDYQ

SEQ ID NO: 95070 - protein, 49 aa, Glycine max
  Coding DNA Sequence Number=SeqID_3385
GDQSGSRCFGENAQIMRDRHRLKGALKLSVFTPKAYTPKSLLGSLPPDS

SEQ ID NO: 95071 - protein, 158 aa, Glycine max
  Coding DNA Sequence Number=SeqID_3386
MWAFHTGRQIDWAHLVRYRMHNALRLNSPLPYPHLFTLFLQHFNIPLDSEPYVPIKKSFLIGAAMVASFGYRKERDGSWVKKDTQPNDDEGQLPVEGDSSLLQSILDRFDELQTYVGERFDALEQQVDMRFDAMDSRITKVEEDVTIIGDCLDLPPPP

SEQ ID NO: 95072 - protein, 329 aa, Glycine max
  Coding DNA Sequence Number=SeqID_3387
  Homolog annotation: Hit_ID=Q1R4X5; Match level="QueryCoverage=82%, HitCoverage=79%, E-value=2e-48, Identity=39%"; Hit description =Putative uncharacterized protein
MASKPCWNSSIEKRWVMIGVKSRPDWISAAILYQPFEDDLVPVDRHIRRRNAQHGDASAVVHRIEQRAERRRRAGHFQTDVEPFGHAQLGHHVAEVFLADVHRAGHTHLARQFQAVFVNVGDHHMASADVFAHRRRHDADRAGAGHQHVFPNQIERQRGVHRVAERIEDRSQFVGDVIRDLEGIERRDHQVFRKAARTVHAHADGVAAQVRAAAAAVAAMAADDVAFGRDALADLVAGDAGAELGDAADEFVADDQARPDRALAPLVPQVDVQVGAADRGLLDLDQHLVRAGHGDGHVLHPDALAGVALHQRLHGLRHRGAGLAGSRLF

SEQ ID NO: 95073 - protein, 236 aa, Glycine max
  Coding DNA Sequence Number=SeqID_3388
  Gene Ontology: Mol. function=protein binding; Biological process =alkylphosphonate transport
  Homolog annotation: Hit_ID=A4TQR5; Match level="QueryCoverage=99%, HitCoverage=80%, E-value=1e-129, Identity=94%"; Hit description=PhnJ protein
  Pfam annotation: Domain name=PhnJ; Domain location=1-236; Score =624.4; E_value=1e-184; Accession=PF06007.2; Description=Phosphonate metabolism protein PhnJ
MIRRAILKAVAIPGYQVPFGGREMPMPYGWGTGGIQLTASVIGRADVLKVIDQGADDTTNAVSIRRFFQRVAGVETTERTPEATLIQTRHRIPETALREDQILIYQVPIPEPLRFIEPRETETRKMHALEEYGVMQVKLYEDIARYGHIATTYAYPVKVNDRYVMDPSPIPKFDNPKMHMMPALQLFGAGREKRIYALPPFTKVESLDFDDHPFSVQQWDEPCALCGSRHSYLDEV

SEQ ID NO: 95074 - protein, 94 aa, Glycine max
  Coding DNA Sequence Number=SeqID_3389
MEGSQQNTHYPKEKLPKIVTHKWKFGNLLEAPNTLLMKGLFVTKLESNEVLLSPIALKVVGPFLLDSNSSRDGTNPSSSSPFGNPQPRKRRDKQ

SEQ ID NO: 95075 - protein, 153 aa, Glycine max
  Coding DNA Sequence Number=SeqID_3390
ARREEHGQNKFRGALWGSNSELKLRREERDQSRVDSLILKDVLKVCLRSKRSLSERLRETETNMLAIVSKYQEELNLATAHEHKVADEYARVYAEKEARGRAIDSLHPEATMWMDRFALTLNGSQELPRLLAKAKAMADTYSAPEEIHGLLSY

SEQ ID NO: 95076 - protein, 108 aa, Glycine max
  Coding DNA Sequence Number=SeqID_3391
  Gene Ontology: Mol. function=nucleoside-triphosphatase activity; Cellular component=nucleus; Biological process=regulation of transcription, DNA-dependent
  Homolog annotation: Hit_ID=Q8H1A2; Match level="QueryCoverage=86%, HitCoverage=16%, E-value=2e-23, Identity=52%"; Hit description=Mini -chromosome maintenance protein MCM3
VCGIESFYFDDKFRYPVNSAPGQLPRTVDALEGKGSVNGVFRTVLIANNVSLLNKEDNAPIYSVEDVKNIKEIAARDDAFDLLSDSLAPSIYGHSWIKKGVVLLMLSG

SEQ ID NO: 95077 - protein, 105 aa, Glycine max
  Coding DNA Sequence Number=SeqID_3392
DSARIPFVEHASRKSRVALPPKGRLRQKGCPCVFRTCKRNLQDSGTLKRVAWGLDIGTRGYENFMEAPEAIFQQNRGGGCRPTCPGELRCFLLKQPRFQNVLEGP

SEQ ID NO: 95078 - protein, 146 aa, Glycine max
  Coding DNA Sequence Number=SeqID_3393
MVKKINKISISIPLHYFEFVSMETLPHRVDDRAVLTNIIGTLHALRNKEERGLLKLEDKDFPSYLSSLSKRLSTWMVRNEGSYPYLYYSISTMNGGDYLYPRMKINSLECSTHSRSLYTLLFPFILFHKVPAHTSPEYSRGFHILP

SEQ ID NO: 95079 - protein, 49 aa, Glycine max
  Coding DNA Sequence Number=SeqID_3394
MYDAIDRSFNVLTRPLAVICGLFHDSQWDLLGSGGKETKGGDGERDDEG

SEQ ID NO: 95080 - protein, 39 aa, Glycine max
  Coding DNA Sequence Number=SeqID_3395
MTVKKRLSHEVLKVTVELSSSVGLSAHPSLSVALARLVR

SEQ ID NO: 95081 - protein, 325 aa, Glycine max
  Coding DNA Sequence Number=SeqID_3396
  Homolog annotation: Hit_ID=Q6WAY6; Match level="QueryCoverage=84%, HitCoverage=60%, E-value=7e-19, Identity=26%"; Hit description =Putative uncharacterized protein
YYDQPLRRFTFEDFHLVPTVKEFEEILGCPLGGRKPYLFSGFYPSTTRVAKYQGSVWRKGQRPWKIKANGLSFIDILALLIFGVVLFPNMEGLVDLAVIDASLAFHHGKESPVVAILAMYDMFDRGCEKSGARIVCCALALYVWLEGRIRILSSCEGCPNVPLMGTRGCINYNPVLAIRQLGYPMRGVPSDESITPFIARGFSDHNARDRELRGSSNGIIGDYHKWLRVRTQGLDWLPNLKTVRDNEVKALEESDEVQALKAKLERARVVKEKFKSIAIKGSNSELKLRRGERNHHGETEGNMWAIIDELQEKLNLAANHEQRLE

SEQ ID NO: 95082 - protein, 122 aa, Glycine max
  Coding DNA Sequence Number=SeqID_3397
SHDSCKSLSEELCDYYEGEHRSHLRPHSHSREKERKPQEANTKLPYFHVKDNVEAYLDWEIRVEQQIKMKSTSKSYGSHSYPKKEQGQGILGVAPSKPKDDKGKTEEKQPLKASMQEKTSST

SEQ ID NO: 95083 - protein, 230 aa, Glycine max
  Coding DNA Sequence Number=SeqID_3398
  Gene Ontology: Biological process=transposition, DNA-mediated
  Homolog annotation: Hit_ID=Q6UUU1; Match level="QueryCoverage=26%, HitCoverage=40%, E-value=3e-18, Identity=78%"; Hit description =Putative uncharacterized protein
  Subcellular localization annotation: CTP_CleavageSite=56; ConfidenceScore=5.09e-01
MVKVGTSYVPINISFFAKSWPRAFPVLQWLLFLSAVPPVQLLTGWCVTAKAPPDISAGKCSGHAARRVPFAIQAAQLLGRAIGAGLFAITPAGERGMCCKAIKLVGDFSRFETIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 95084 - protein, 95 aa, Glycine max
  Coding DNA Sequence Number=SeqID_3399
MTNRLRYLLFPLTKIQRTNRLRILCANTLEGTSFVRGYISCGSVQVEGTSTWLFKENKGRYIPCGSLTCKGFYKVEKKSQELQVAWGLDVGTVCG

SEQ ID NO: 95085 - protein, 73 aa, Glycine max
  Coding DNA Sequence Number=SeqID_3400
MEDRIATDQAPPLPGTKQAENVAAGQPSSSGQTLTHKEGGDMVNVSLQPKKNGRLDRLGELSSPGRATPAFKI

SEQ ID NO: 95086 - protein, 127 aa, Glycine max
  Coding DNA Sequence Number=SeqID_3401
MMMEAMMSMRKMMEDNTATVVAVSTATEMDPIHPASFNQVNRPISYVVGQGGETHEVPQYHTLVVFGVYPGYTTEGEAFSGIPVLSALRISQCRLLSQPLHIVRGQESSTLLEKERIEHMEERLRRH

SEQ ID NO: 95087 - protein, 169 aa, Glycine max
  Coding DNA Sequence Number=SeqID_3402
  Gene Ontology: Mol. function=protein binding; Biological process =xylan catabolic process
  Homolog annotation: Hit_ID=Q9SDM7; Match level="QueryCoverage=86%, HitCoverage=26%, E-value=3e-41, Identity=65%"; Hit description =Putative uncharacterized protein
  Pfam annotation: Domain name=LRR_1; Domain location=127-149; Score =5.6; E_value=28; Accession=PF00560.24; Description=Leucine Rich Repeat
  Pfam annotation: Domain name=LRR_1; Domain location=37-58; Score=7.0; E_value=15; Accession=PF00560.24; Description=Leucine Rich Repeat
  Pfam annotation: Domain name=LRR_1; Domain location=9-28; Score=10.8; E_value=3; Accession=PF00560.24; Description=Leucine Rich Repeat
  Pfam module annotation: Pfam domain module=LRR_1::LRR_1::LRR_1; Domain location=127-149::37-58::9-28
GTLPSVSANVEVLNVANNSISGTISPFLCGKENATNKLSVLDFSNNVLSGDLVTVGASPGAAVKLCLGDLLVMGSNPETASLHMQGRQPLLWIYSFNTAKLLYNEFIDMGNNQLSDAIPDWMWEMQYLMVLRLRSNNFNGSITQKIVNFLPYSAGSGNTACQDPFQIVG

SEQ ID NO: 95088 - protein, 82 aa, Glycine max
  Coding DNA Sequence Number=SeqID_3403
MASYGEAKESIDQEEPRPTSSNGAYIIEDELTPLEPSSVVADTSIAQEEVSSPDPMPEPSPTPISEDTMPSEPTMEPEQPIL

SEQ ID NO: 95089 - protein, 146 aa, Glycine max
  Coding DNA Sequence Number=SeqID_3404
MVKEECNEVSVSSKRLAKKESHFAIKTNIKETSLPKQPPHLLLCKRTLVSTTIPLELEVIPQVKMLLDEGLVRKILNPCALLVPKIGIMRHQIPMIGGMVNVLSGATLFCKITHASNIFMIRIHRDSLGSDQGVPTDPKRIEVIPE

SEQ ID NO: 95090 - protein, 54 aa, Glycine max
  Coding DNA Sequence Number=SeqID_3405
MDMINAGMICPLRCHEEMHDAIKEQAKRYHPPRKYIMVIGTISDNASLKEENSR

SEQ ID NO: 95091 - protein, 179 aa, Glycine max
  Coding DNA Sequence Number=SeqID_3406
  Homolog annotation: Hit_ID=Q2HW90; Match level="QueryCoverage=31%, HitCoverage=11%, E-value=5e-08, Identity=45%"; Hit description =Putative uncharacterized protein
MGSVLIPTVNKPTEGPCRLLKNVRWGISLPLGVVSKKGTNSPDPRIPRLHLCHMHSIMHSSIPPMRYRSFDLHQLLSHFRRLMEPLQMQAFRKTYGKILELTIAEVSIEAIVSLTQYYDQPLRCFTFGDFQLVPTIEEFEEILGCPLGGRKTISFLRVSPLFEQNCNCGQRIQQEVWTA

SEQ ID NO: 95092 - protein, 51 aa, Glycine max
  Coding DNA Sequence Number=SeqID_3407
MIEDEWERLQLAVAEKPGGIEGAERELEKGIWESEGVEAATGGDRSGLRLK

SEQ ID NO: 95093 - protein, 97 aa, Glycine max
  Coding DNA Sequence Number=SeqID_3408
MRKEKYRIRRHSPFRLRNCWEGRSVRASSLLRQLAKGGCAARRLSWVTPGFSQSRRCKRRPVPSLHACRFVPVTHIQVSNPRNQIELPGRKLAVDPR

SEQ ID NO: 95094 - protein, 351 aa, Glycine max
  Coding DNA Sequence Number=SeqID_3409
  Gene Ontology: Mol. function=oxidoreductase activity, acting on the CH-OH group of donors, NAD or NADP as acceptor; Cellular component =chloroplast; Biological process=metabolic process
  Homolog annotation: Hit_ID=UPI0000E87C5F; Match level="QueryCoverage =99%, HitCoverage=88%, E-value=1e-125, Identity=66%"; Hit description= malate dehydrogenase (oxaloacetate-decarboxylating)
  Pfam annotation: Domain name=ADH_zinc_N; Domain location=185-329; Score=-16.4; E_value=0.018; Accession=PF00107.17; Description=Zinc -binding dehydrogenase
  Pfam annotation: Domain name=AlaDh_PNT_C; Domain location=166-312; Score=-62.4; E_value=0.096; Accession=PF01262.12; Description =Alanine dehydrogenasePNT, C-terminal domain
  Pfam annotation: Domain name=Malic_M; Domain location=162-351; Score =270.2; E_value=4.3e-78; Accession=PF03949.6; Description=Malic enzyme, NAD binding domain
  Pfam annotation: Domain name=ThiF; Domain location=185-335; Score= -43.3; E_value=0.009; Accession=PF00899.12; Description=ThiF family
  Pfam annotation: Domain name=malic; Domain location=17-160; Score =239.6; E_value=6.8e-69; Accession=PF00390.10; Description=Malic enzyme, N-terminal domain
  Pfam module annotation: Pfam domain module=ADH_zinc_N::AlaDh_PNT _C::Malic_M::ThiF::malic; Domain location=185-329::166-312::162 -351::185-335::17-160
MDDLKQRALDYHQFPKPGKLSVESSKPCATQQDLSLAYTPGVAEPVREIEADPANAYKYTNKGNLVAVITDGTAVLGLGNVGALAGKPVMEGKGVLFKRFADIDVFDIEVNAATPDDFIQTVVNIAPTFGGINLEDIAAPHCFYIENELKKRLDIPVFHDDQHGTAVIVAAALLNALDLQGKTLPRAKIVFLGAGAAGCSCAKLLKLMGATNITMVDRKGVLDSNRDDLHDNNRELAITAGSVKTLADAMHGADVFIGVSAKNGLPPELVATMAAKPVIFALANPDPEILPDQVFAVRDDVIMATGRSDFPNQVNNALCFPYLFRGALDAQAKRITEQMKVAAAKALSQLA

SEQ ID NO: 95095 - protein, 222 aa, Glycine max
  Coding DNA Sequence Number=SeqID_3410
  Gene Ontology: Mol. function=catalytic activity; Cellular component =cytoplasm; Biological process=carbohydrate metabolic process
  Homolog annotation: Hit_ID=A4CB65; Match level="QueryCoverage=96%, HitCoverage=46%, E-value=8e-64, Identity=50%"; Hit description=Alpha- amylase, putative
  Pfam annotation: Domain name=Alpha-amylase; Domain location=24-222; Score=-71.3; E_value=2.2e-05; Accession=PF00128.15; Description =Alpha amylase, catalytic domain
MDLPKDWKHSANIYEVNVRQYTQEGTFRAFEKEMPRLKFMGIKVLWFMPVTPIAQQNKKGSLGSPYAAADYTSVNPEFGTLDDFKHMVNEAHRLGFKVIIDWVANHTGWDHVWTKTHPEFYLKDPDGKFHIASGMDDIIELDYKNQEMRKEMIDAMKFWVKETNIDGFRCDLASWVEVDFWQQARPEVETLKPLFWLGEFDELENPEYGKIFDASYSWTLDA

SEQ ID NO: 95096 - protein, 170 aa, Glycine max
  Coding DNA Sequence Number=SeqID_3411
  Gene Ontology: Mol. function=tetracycline:hydrogen antiporter activity; Cellular component=integral to membrane; Biological process=response to antibiotic
  Homolog annotation: Hit_ID=O21999; Match level="QueryCoverage=35%, HitCoverage=48%, E-value=8e-21, Identity=77%"; Hit description=LacZ -alpha
MTMITPSSKLTLTKGNKSWYCCSRDKLGNAVSTGFPKGLCPKEHCESNSCSPGDPLVLERPPPRWSSNSPYSESYYNSLAVVLQRRDWENPGVTQLNRLAADPPFASWRNSEEARTDCPSQQLRSLNGERDAPCNGALSAAGVVVTRSVNATLASADVRRCFCRYPPPRP

SEQ ID NO: 95097 - protein, 201 aa, Glycine max
  Coding DNA Sequence Number=SeqID_3412
  Pfam annotation: Domain name=Transposase_23; Domain location=117-187; Score=-10.0; E_value=0.015; Accession=PF03017.5; Description =TNP1ENSPM transposase
MTFEATKEIAEKIDSLEEQASQGLFVPHGRLDVLIAAIRRPKHPSRVRAAEAGVTIKQYFGSAPRSSRNSSFIPPEELKHLTQQIRDQLEKSEVGPSASRVSTKGSCVNPSGNDPETGDSEKCGLYIEQNPSRLVALGNVYEGSTMVHNIPLLHGQVKVGVEEVKDAEAPIPVPTNEVILVGQTLNIFLARPTHLVKRVSE

SEQ ID NO: 95098 - protein, 232 aa, Glycine max
  Coding DNA Sequence Number=SeqID_3413
MAVGRPEHQCHVRVAWSGVTISQYFGQASRASSTLSPSINQQQLANIIGGIKDDIKKQLQDEIRNEVQDEIRKEVQQEHKQQQESAPIKALEIQALLARVSTKGSCARLEGSGLLKELLNGDDDLMGLFVVVVRTYMPHAEVPIPTSEVHYLEQVVGTFVAWSTHLVREVTNEVVVGPDKPPSKFVGEPNRLTSMATDDPLGELVKKSYVVYTKPMELPWDGAKFGLPNATN

SEQ ID NO: 95099 - protein, 56 aa, Glycine max
  Coding DNA Sequence Number=SeqID_3414
MVDFKGINLVNQDDPVVVSIIIANFMVSKVLIDQASWKLACGASMEAGSLSFNEVL

SEQ ID NO: 95100 - protein, 217 aa, Glycine max
  Coding DNA Sequence Number=SeqID_3415
  Subcellular localization annotation: CTP_CleavageSite=36; ConfidenceScore=5.08e-01
MEESSNKRKGSSSSTTATGHRHHGTSRDPPALVPPSLSSPRQGVPFEGTLVDDWKFDYSSHDARKMIDWAHLVRYRMHKALQANAPLPYSYLVTLILHHFYVPLDDEPYVKVKRSFSIGVIAVTSFGYRKDVDGQWVGKQDFPPPIPNERTSSPLPQRDDFTSLMTEVLTELRDLRAFVGEHFDAMDTRFDEMDTRITRLEDDISLIRRCFDPPADS

SEQ ID NO: 95101 - protein, 239 aa, Glycine max
  Coding DNA Sequence Number=SeqID_3416
MTTLTRIWMTLLLSNILPTDHNSDLPLPKCQLVYAILTRMSIHVAQLIADAIYIFAGMAPTRHPLDPDKSSRALGFPALITGLCQSFGVPVTPSKVIQPPITRAFIEKYCTQRQVQGDAPQAADEPPPHQAGPAGSFNTEQYLRHLVRQQAANHRAHVQTHDCLYQMSLSLQSQGFTSFSCPTPDQFRAEVAWPGDWPEAQAGEAPAGAPAEAPDEADEAREDEEMTDLLDFLGGSGAT

SEQ ID NO: 95102 - protein, 63 aa, Glycine max
  Coding DNA Sequence Number=SeqID_3417
MPHGLFPYKGRALMPLRHFTEHLVGARLARNGIKNAKNDDPRAATRKSRGLARPSELTCIFVF

SEQ ID NO: 95103 - protein, 518 aa, Glycine max
  Coding DNA Sequence Number=SeqID_3418
  Gene Ontology: Cellular component=chloroplast inner membrane
  Homolog annotation: Hit_ID=A7PYS5; Match level="QueryCoverage=81%, HitCoverage=77%, E-value=1e-170, Identity=72%"; Hit description =Chromosome chr12 scaffold_38, whole genome shotgun sequence
MKGGQYGAFGAVTLEKSKLDLSQKQTSFSPELDIGGGGGDIGKKINHGGGDGGDDDGDDDDYFDDFDDGDEGDEGGLFRRRILFEELFDRKFVDAVLNEWQKTMMDLPAGLRQAYEMGLVSSAQMVKFLAINARPTTSRFISRTLPQALSRSFIGRLLADPAFLYRFLLEEAATVGCSLWWEIKNRKDRIKQEWDLALMNVMTAAACNALVVWSLAPCRSYGNTFRFDLQNTLQKLPNNIFEKSYPLREFDMQKRIQCFLFKAAELCMVGLSAGAVQGALSNSLASKKEGRLSVTVPSVSSNALGYGAFLGIYANLRYQLLCGFDRAMMTHFDVIGVALFFSTTFRILNVQLGETSKRAWLGVEADPLAQSDDLLKVYNRTSENVEKSSSKWFISKNAVVSGLGLLGIKQRNTDGSGAESSAPKTRRKRIVRKKVAADGFNLPVTIKAVNGTGNSSTAGCDGDLRKNSPSQLASKNGDKVIAGRSACDVFNTDEYCLLQRHLWKPCSHMFVFKRFKHF

SEQ ID NO: 95104 - protein, 293 aa, Glycine max
  Coding DNA Sequence Number=SeqID_3419
  Gene Ontology: Mol. function=DNA binding; Cellular component=nucleus; Biological process=regulation of transcription, DNA-dependent
  Homolog annotation: Hit_ID=Q2HTS2; Match level="QueryCoverage=99%, HitCoverage=36%, E-value=1e-114, Identity=68%"; Hit description =Lissencephaly type-1-like homology motif; WD40-like
  Pfam annotation: Domain name=WD40; Domain location=134-169; Score =5.4; E_value=6.8; Accession=PF00400.23; Description=WD domain, G -beta repeat
  Pfam annotation: Domain name=WD40; Domain location=173-210; Score =32.1; E_value=2e-06; Accession=PF00400.23; Description=WD domain, G -beta repeat
  Pfam annotation: Domain name=WD40; Domain location=213-251; Score =9.6; E_value=2.1; Accession=PF00400.23; Description=WD domain, G -beta repeat
  Pfam annotation: Domain name=WD40; Domain location=255-293; Score =25.9; E_value=0.00015; Accession=PF00400.23; Description=WD domain, G-beta repeat
  Pfam annotation: Domain name=WD40; Domain location=48-86; Score=35.5; E_value=1.9e-07; Accession=PF00400.23; Description=WD domain, G-beta repeat
  Pfam annotation: Domain name=WD40; Domain location=6-44; Score=19.7; E_value=0.011; Accession=PF00400.23; Description=WD domain, G-beta repeat
  Pfam annotation: Domain name=WD40; Domain location=91-130; Score =23.3; E_value=0.00091; Accession=PF00400.23; Description=WD domain, G-beta repeat
  Pfam module annotation: Pfam domain module=WD40::WD40::WD40::WD40::WD4 0::WD40::WD40; Domain location=134-169::173-210::213-251::255-293::48- 86::6-44::91-130
MVGFSFEEVGCLHSSKSKVLSSHFSSDGKVLASAGHEKKVFIWNMENFDCVTTTETHSLLVTDVRFRSGSTIFATSSFDRSVRLWDAARPTSSLLKLTGHAEQVMSLDFHPRKVDLLCSCDSNDVIRLWNINQGVCMHISKGGSKQVRFQPCFGKFLATATGNNIKIFDVETDSLLYNLEGHVKDVRSICWDKNGNYVASVSEDSARIWSSDGQCISELHSTGNKFQSCIFHPEYHNLLVIGGYQSLELWSPAESSKTWAVHAHKGLIAGLADSPENEMVASASHDHCVKLWK

SEQ ID NO: 95105 - protein, 73 aa, Glycine max
  Coding DNA Sequence Number=SeqID_3420
MKGTKSHYLKNLGRPRFALKNLLLCSFFLLSHLVIKPLMGVSERDRERVGRVRRWSLEVQNHVVAAQLLRKRN

SEQ ID NO: 95106 - protein, 365 aa, Glycine max
  Coding DNA Sequence Number=SeqID_3421
  Gene Ontology: Mol. function=RNA-directed DNA polymerase activity; Cellular component=chromatin; Biological process=chromatin assembly or disassembly
  Homolog annotation: Hit_ID=A5B2I6; Match level="QueryCoverage=80%, HitCoverage=15%, E-value=1e-21, Identity=24%"; Hit description =Putative uncharacterized protein
MDARVEFLERGFEGMINTLEDVASLKRLFEEERIERAELKAQMAELMAEVRILSSTDRGRDNRDHVEQQNRDREVKWRKLEIPIFDGGDAFGWTNKVERYFEIKGVEEEDRIQAAMVAMEGKALTWYQWWEFCAKNPNWTDFKNAVIGPLRGTKPKYLKGIFLNGLKEVVRAELKLHPVNTLPELMDYAQWIDEKNSLMEKGNVGGNRGGPTRSYSFLRTVTWDPGNKGTTAKTRETSSSSESNSVKSTGAYKGRPFRRMSDAEFQERAEKGLCSRCDGKFGPGHMCPNKQFQVLIWEKDKMKKTKKQESVDVMKQQFPAFHLEDKVALLGGSIVRLPITQVYEGRTHDKYKRKSEQQPEPGLGS

SEQ ID NO: 95107 - protein, 134 aa, Glycine max
  Coding DNA Sequence Number=SeqID_3422
  Gene Ontology: Biological process=auxin mediated signaling pathway
  Homolog annotation: Hit_ID=A5JSU3; Match level="QueryCoverage=79%, HitCoverage=90%, E-value=7e-27, Identity=60%"; Hit description=Auxin- repressed protein
  Pfam annotation: Domain name=Auxin_repressed; Domain location=7-121; Score=170.3; E_value=5e-48; Accession=PF05564.3; Description =Dormancyauxin associated protein
MVLLEKLWDDVVAGPQPERGLGKLRKLTTLKTIDEGESSKLQKTLSMPSTPTTPMTPTTPTTPGSARKADNVWRSVFHPGSNSATKTIGAQMFDKPLPNTPTVYDWYIIAVQWGDQKQAPLKLKSLAKMTVGCM

SEQ ID NO: 95108 - protein, 635 aa, Glycine max
  Coding DNA Sequence Number=SeqID_3423
  Gene Ontology: Mol. function=protein binding; Cellular component =chromosome, pericentric region; Biological process=cell division
  Homolog annotation: Hit_ID=A7PBS9; Match level="QueryCoverage=91%, HitCoverage=97%, E-value=1e-147, Identity=48%"; Hit description =Chromosome chr16 scaffold_10, whole genome shotgun sequence
  Pfam annotation: Domain name=DUF593; Domain location=203-284; Score= -31.7; E_value=0.085; Accession=PF04576.6; Description=Protein of unknown function, DUF593
  Pfam annotation: Domain name=Ndc80_HEC; Domain location=4-183; Score=- 25.7; E_value=0.00014; Accession=PF03801.4; Description=HECNdc80p family
  Pfam module annotation: Pfam domain module=DUF593::Ndc80_HEC; Domain location=203-284::4-183
  Subcellular localization annotation: CTP_CleavageSite=32; ConfidenceScore=5.08e-01
MRPTARRQAKDSFIPPAPPTPLDFHHRQYSSRDSDVSSRPSSVGIGRRPTLDLYNEPSYKQTVVSTINSFLSSHNFPITFKTTLPSAKDIHETLKFLLSLLDFPFSKLEEDLPPLLKRLNYPFKLNKSILRSPAAPHQWPTFLALIHWLVQIAKFHLHLSSSPKQHNSLYQYTVNSYMHFIHNEDDAVEDLDRSIKDKLHHEKAAAEERLQATRRSAAELEAELERLRSAPSLKEALEKEKAMLEDDVKKFHKMIEELSLRIEQAERVLAEKEKQVEAKQAENEKICEENEELKRRVEAQSFNARDVERMKRELQAVERDTAEAELARNALEEQAWDLDTTLSHKIKDLEALGMECNQALKRLKIGNGIQYLLNAKGTTPAEIMGIDHKLVLKPALRSFSDEIKKSSMEKLEESISYQQKSGENAVRLEGKRNQLAAVQSRIDEMGIGKRNNVACEDFCFTFLSAAYRFIYQMEAQLNRIKKETHEYTSRASAEAKKMLEDVQLADHEIDIMEREAAEVLKTSELKLQEVIKQSEEEIQMHARELFQLVDSVSKFKEHVGSKISEIGRDLSETAAAVSDTYRGACPSTSGEKKLSKVDSCCQRVMTRARTVANRCLPFKLCTIYLSGTVVEGYSG

SEQ ID NO: 95109 - protein, 549 aa, Glycine max
  Coding DNA Sequence Number=SeqID_3424
  Gene Ontology: Mol. function=hydrolase activity; Cellular component =chloroplast thylakoid membrane; Biological process=lipid catabolic process
  Homolog annotation: Hit_ID=A2Q497; Match level="QueryCoverage=65%, HitCoverage=90%, E-value=1e-156, Identity=78%"; Hit description =Patatin
  Pfam annotation: Domain name=PAP_fibrillin; Domain location=16-173; Score=131.7; E_value=2.1e-36; Accession=PF04755.3; Description=PAP _fibrillin
  Pfam annotation: Domain name=Patatin; Domain location=300-464; Score =23.0; E_value=1.1e-07; Accession=PF01734.13; Description=Patatin -like phospholipase
  Pfam module annotation: Pfam domain module=PAP_fibrillin::Patatin; Domain location=16-173::300-464
MVSFFPGFLTKGSDVQKLKVELYEAIAPLDRGAEATPEDQQRVDQIARKLEAVNPVKEPLKSGLLNGKWELFYTTSQSILQTQRPKLLRPNGKIYQAINVDTLRAQNIETWPFYNQATANLVPLNSKRVAVKFDFFKIASLIPIKSPGSGRGQLEITYLDEDLRSGMGPCICSSHAQRLPYAANLNPNSSILRRRAQFISFASNSSPPQDEEATAKKSFAVATGELFLGLATRLIKSRNKGSSSLAEDSGSVGMFENNSEERIGAVVEDEIDPDVVWEQRVKDVEAERNRYSRLVTSPGFSFSAAGLLFPYHLGVAQFLIQNGYIKETTPLAGSSAGAIVCAVIASGASMEEALNATKILAEDCRNRGTAFRLGAVLRDILDKFLPDDVHIRSNGRVRVAVTQLLWRPRGLLVDQFDSKEDLINAVFTSSFIPGYLAPRPATMFRNRLCIDGGLTLFMPPTSAAQTVRVCAFPASRLGLQGIGISPDCNPENVCSPRQLFNWALEPAEDAILDRFFELGYLDASVWAKENPVEVIVQDDSPAFGSSSAT

SEQ ID NO: 95110 - protein, 76 aa, Glycine max
  Coding DNA Sequence Number=SeqID_3425
  Subcellular localization annotation: CTP_CleavageSite=60; ConfidenceScore=5.36e-01
MVRGLCNYTTGGTVPHSQFAPIFMMKMNFMNIKLRFRSNFNRWKYQSSSTLEFLPGLNLCCNFPGHLSLVPPAPWA

SEQ ID NO: 95111 - protein, 52 aa, Glycine max
  Coding DNA Sequence Number=SeqID_3426
MSNLRFKLFAKCHLRIAILVDLDTVNNLRGDAECHNFWSGRDHLLFGFRLED

SEQ ID NO: 95112 - protein, 339 aa, Glycine max
  Coding DNA Sequence Number=SeqID_3427
  Gene Ontology: Mol. function=heat shock protein binding; Cellular component=cytoplasm; Biological process=response to stress
  Homolog annotation: Hit_ID=A2Q505; Match level="QueryCoverage=99%, HitCoverage=99%, E-value=1e-142, Identity=74%"; Hit description=Heat shock protein DnaJ
  Pfam annotation: Domain name=DnaJ; Domain location=4-67; Score=144.4; E_value=3.2e-40; Accession=PF00226.22; Description=DnaJ domain
  Pfam annotation: Domain name=DnaJ_C; Domain location=215-337; Score =47.2; E_value=5.9e-11; Accession=PF01556.9; Description=DnaJ C terminal region
  Pfam module annotation: Pfam domain module=DnaJ::DnaJ_C; Domain location=4-67::215-337
MGVDYYKILQVDKHATDEELKKAYRKLAMKWHPDKNPTNKKEAETKFKQISEAYEVLSDPQKRAIYDEYGEEGLKGQVPPPDAGGHTFFQTGDGPTTFRFNPRNADDIFAEFFGFSSPFGGGGGGGGNGMRGGSFGGIFGDDIFSSFGEGRTMSQQGPRKAHPIEKTLPCTLEELYKGTTKKMKISREIADASGKTLPVEEILTIDIKPGWKKGTKITFPEKGNEQPNVIASDLVFVIDEKPHPVFTRDGNDLVVTQKVSLEEALTGHIVHLTTLNGRVLKIPINNVIHPTYEEVVPREGMPIPKDPSKRGNLRIKFNIKFPAKLTSEQQAGIKKLLPY

SEQ ID NO: 95113 - protein, 344 aa, Glycine max
  Coding DNA Sequence Number=SeqID_3428
  Gene Ontology: Mol. function=S-adenosylmethionine-dependent methyltransferase activity; Cellular component=nucleus; Biological process=tRNA processing
  Homolog annotation: Hit_ID=A2Q516; Match level="QueryCoverage=83%, HitCoverage=92%, E-value=1e-113, Identity=72%"; Hit description=SAM (And some other nucleotide) binding motif
  Pfam annotation: Domain name=GCD14; Domain location=44-340; Score =518.3; E_value=9e-153; Accession=PF08704.1; Description=tRNA methyltransferase complex GCD14
  Pfam annotation: Domain name=Methyltransf_11; Domain location=149 -247; Score=26.5; E_value=9.7e-05; Accession=PF08241.3; Description =Methyltransferase domain
  Pfam annotation: Domain name=Methyltransf_12; Domain location=149 -245; Score=16.9; E_value=0.013; Accession=PF08242.3; Description =Methyltransferase domain
  Pfam module annotation: Pfam domain module=GCD14::Methyltransf _11::Methyltransf_12; Domain location=44-340::149-247::149-245
MDYLDEEQRRAITMKSSFILLCYAVGFGLGSAKAGEYLGEVNGGFEWCERGVAAAAAALIVLQHDIMKAVTVCEGSVLQNRFGVFKHSDWIGKPFGSKVFSCKGGFVYLLAPTPELWTLVLNHRTQILYIADISFVIMYLEIVPGCVVLESGTGSGSLTSSLARAVAPSGHVYTFDFHEQRAASARADFERTGLSSLVTVQVRDIQGEGFPDDLTGMADSVFLDLPQPWLAIPAAAKVLRHDGTLCSFSPCIEQVQRTCETLRTRFTDTRTFEVLLRTYEVREEKMQSLCGDSNGSVPSKRKQCSGGSYVLGSSPSTSSVMARPCGEARGHTGYLTFARVKSLS

SEQ ID NO: 95114 - protein, 130 aa, Glycine max
  Coding DNA Sequence Number=SeqID_3429
  Gene Ontology: Mol. function=GTPase activity; Biological process =immune response
  Homolog annotation: Hit_ID=Q9FNL5; Match level="QueryCoverage=52%, HitCoverage=6%, E-value=6e-21, Identity=73%"; Hit description =Similarity to guanylate binding protein
MELLEEFWAKITQIEGQRGHFKVSLRKFKLSLFLFPRFSTQDREPEELEEDDKATPSSSPVIDPASPIRLVYCDENERFRMDPEAVATLQLVKELVGVVSVCGRARQGKSFILNQLNFQLKSMHDSFFGV

SEQ ID NO: 95115 - protein, 108 aa, Glycine max
  Coding DNA Sequence Number=SeqID_3430
MGALYPLLFYFICALGPFASLRAEAGAVVQSCCNALTVGCDVWQKERERYKQGYKNKDCSSGSASLGEILQSLSYIVKIYADFKGQNTSIAPFFFSIMPYAKMISNTR

SEQ ID NO: 95116 - protein, 356 aa, Glycine max
  Coding DNA Sequence Number=SeqID_3431
  Gene Ontology: Mol. function=hydrolase activity, acting on ester bonds; Cellular component=extracellular region; Biological process =lipid metabolic process
  Homolog annotation: Hit_ID=A7QPN9; Match level="QueryCoverage=93%, HitCoverage=80%, E-value=1e-119, Identity=60%"; Hit description =Chromosome chr10 scaffold_138, whole genome shotgun sequence
  Pfam annotation: Domain name=Lipase_GDSL; Domain location=40-347; Score=176.9; E_value=5.2e-50; Accession=PF00657.13; Description=GDSL- like LipaseAcylhydrolase
MVKMILALAMGMMMMMPWYSLAVDIERVREVAAKHNVSCILVFGDSSVDAGNNNALHTTMKSNFPPYGKDFFDSRPTGRFSNGRLATDFVAEALGYRKAIPPFLDPNLKPEDLQYGVSFASAATGFDDYTAEVSNVLSVSKQIEYFAHYKIHLKNAVGEERAELITRNALYIISMGTNDFLQNYFLEPTRPKQFSLLEFENFLLSRFSKDVEAMHRLGARRLIIVGVLPLGCIPLIKTIRNVEDCDKSLNSVAYSFNAKLLQQLDNLKTKLGLKTALVDVYGMIQRAVTNPKKYGFVDGSKGCVGTGTVEYGDSCKGMDTCSDPDKYVFWDAVHPTQKMYKIIADEATESFINNFF

SEQ ID NO: 95117 - protein, 432 aa, Glycine max
  Coding DNA Sequence Number=SeqID_3432
MCSNTCNSACGCETGGNVVSSIWSSGSGLKKQSKRPRVPKRGPGVAELEKILREQETIDLVDNKGNPEGFSSFVSHHSNSNSYPSSSMKLQPPTSPKKTIPYPSFMSSNFPTNVPSAPIFDHLGATTPPTITSIYGNYGSLEKNNGGSGLVSPEKELFPLNLNSCKSNLNMNEPIDVNRCDFANSPTRNLSNETNSIWPYHATVQKRNNNKYSSSTANQFPGIPTSSVSLSMRLHSNNHPDPELPSNQSLCYSYMSRVPEEHKMVGMKRSHSSALENSLIPPSNFHVLPSFSHYNRAHQSSINDSHGASSFNSTKECYRDAKWGSTLELSNTRFNSDITVPGHAIPPFVTPEVPSPPMHLFPGVLSKGNVLPSQVNDEKMDSYKHSESSESNRKPFYNFLEVEDSEVSETTRGANRGGRETGRVGIDLNLKL

SEQ ID NO: 95118 - protein, 491 aa, Glycine max
  Coding DNA Sequence Number=SeqID_3433
  Gene Ontology: Mol. function=manganese ion binding; Cellular component=mitochondrion; Biological process=acetyl-CoA catabolic process
  Homolog annotation: Hit_ID=A7QPM1; Match level="QueryCoverage=97%, HitCoverage=89%, E-value=1e-77, Identity=61%"; Hit description =Chromosome chr10 scaffold_138, whole genome shotgun sequence
  Pfam annotation: Domain name=NUDIX; Domain location=297-435; Score =43.7; E_value=6.6e-10; Accession=PF00293.19; Description=NUDIX domain
  Pfam annotation: Domain name=NUDIX; Domain location=67-205; Score =60.1; E_value=7.5e-15; Accession=PF00293.19; Description=NUDIX domain
  Pfam module annotation: Pfam domain module=NUDIX::NUDIX; Domain location=297-435::67-205
MDSSNSNGGSQRLLDLAQRLRLDKPPPFPEDILDQIMEEKGDKVVSEVSYTESATPIAQNTEKIRYKRAAVLICIFEGDAGDLRVILTKRSSKLSTYSGQVALPGGKAEEGDKDDGDTAKREAMEEIGLDPELVDVVTVLEPFFSKYLMRVIPVIGILHDKKAFKPVLNPAEVEAVFDAPLEMFLKDEKRSQKKMQCMGENYLIHLFDYEIEHKKFLIWGLTAGILIRAASVVYQRPPAFMEQNPKFKLPGDLTMGMGSNRAEVRGSQRLQALIHHLHSSIPSDSNEPNSKFTVWKKRAAVLICVFEGADGNLRVFLTQRASSLSTHSGGKREEGDADDVQTALREAKEEIGLDPSLVSVITLLPPFHTKKLDEVASEKVEYGVTIIPVVGVLFDKDAFSPVLNSAEVEAIFDVPLEMFLKNDNRRAEEREWMGEKHLVHYFDYEDGNKKYVIWAITAAILIRSATLLLQRPPAFLEQRPKIWGGMTENDI

SEQ ID NO: 95119 - protein, 543 aa, Glycine max
  Coding DNA Sequence Number=SeqID_3434
  Gene Ontology: Mol. function=hydrolase activity, acting on ester bonds; Cellular component=cellular_component; Biological process =lipid metabolic process
  Homolog annotation: Hit_ID=A7QDN1; Match level="QueryCoverage=93%, HitCoverage=86%, E-value=1e-103, Identity=57%"; Hit description =Chromosome chr10 scaffold_81, whole genome shotgun sequence
  Pfam annotation: Domain name=Lipase_GDSL; Domain location=37-361; Score=180.1; E_value=5.6e-51; Accession=PF00657.13; Description=GDSL- like LipaseAcylhydrolase
  Pfam annotation: Domain name=Lipase_GDSL; Domain location=375-543; Score=34.8; E_value=3.1e-07; Accession=PF00657.13; Description=GDSL -like LipaseAcylhydrolase
  Pfam module annotation: Pfam domain module=Lipase_GDSL::Lipase_GDSL; Domain location=37-361::375-543
MGSVCEERWITVTITTVALVIASSAPLLLAACPYTSIFSFGDSLADTGNLYFSPYPPTNHCLFPPYGETFFHHVTGRCSDGRLIIDFIAESLGIPRVKPYLGIKNIGRWSVEEGGANFAVIGATALDFSFFEERGVPVKTNYSLSAQLNWFKELLPTLCNSSTGCHEVLRNSLFLVGEIGGNDFNHPFSIRKSIVEVKTYVPYVINAISSAINELIGLGARTLIVPGNFPIGCSASYLTIYETEYKNQYDQFGCLKWLNKFAEYYNNELQSELDKLRRLYPRANIIYADYFNAALLFYRDPTKFGFTGLKVCCGMGGPYNYNTSADCGNPGVSACDDPSKHIGWDSVHLTEAAYRIVAEASSSAPLLAACPYTSIFSFGDSFADTGNLYLSSHPPTHHCFFPPYGETYFHRVTGRCSDGRLIIDFIAESLGLPLVKPYFGIKKFGGWSVEEGANFAVIGATALDFSFFEERGISIPTNYSLTMQLNWFKELLPALCNSSTGPYNYNAAADCGDPGAIACDDPSKHIGWDSVHFTEAAYRIIAE

SEQ ID NO: 95120 - protein, 436 aa, Glycine max
  Coding DNA Sequence Number=SeqID_3435
  Gene Ontology: Mol. function=binding; Cellular component=ubiquitin ligase complex; Biological process=protein ubiquitination
  Homolog annotation: Hit_ID=A7QDL8; Match level="QueryCoverage=92%, HitCoverage=89%, E-value=1e-125, Identity=58%"; Hit description =Chromosome chr10 scaffold_81, whole genome shotgun sequence
  Pfam annotation: Domain name=Arm; Domain location=111-151; Score =12.0; E_value=0.33; Accession=PF00514.14; Description=Armadillobeta -catenin-like repeat
  Pfam annotation: Domain name=Arm; Domain location=153-193; Score=3.2; E_value=4.4; Accession=PF00514.14; Description=Armadillobeta-catenin -like repeat
  Pfam annotation: Domain name=Arm; Domain location=196-235; Score =12.4; E_value=0.29; Accession=PF00514.14; Description=Armadillobeta -catenin-like repeat
  Pfam annotation: Domain name=Arm; Domain location=236-274; Score=3.2; E_value=4.4; Accession=PF00514.14; Description=Armadillobeta-catenin -like repeat
  Pfam module annotation: Pfam domain module=Arm::Arm::Arm::Arm; Domain location=111-151::153-193::196-235::236-274
  Subcellular localization annotation: CTP_CleavageSite=35; ConfidenceScore=5.62e-01
MSTPSSSSSSSSSIWVLSNIKLQFFARIRRFLQSKATRKRCDPSDRFDTAKSRVEHNNKVENLETVHVMEKHKEEEESVIMLQRTVKMLHFGSWEEKIVAAKEIEKLAKEDVKVSKLITELGVVPVLVSMVASPVASRRRVGLTALIHLADGTYTNKALIVEAGILSKLPKTIDLVDESTTSKLAEILLSLSSLANTQFPLASLDFIPLLRNILETGPSFDTKSSCLCALHNLSTVLENACPLVSSGVVPILLDVSSIKEISEKALATLGNLSVTLMGKKAIENNSMVPETFIEILSWEDKPKCQELSVYILMILAHQSSLQRKKMAQAGIVPVLLEVVLLGSPLAQKRAMKLLQWFKDERQTKVGPHSGPQTPRFAMGSPVNQREAKEGKRLMKSLVKQSLHRNMEIIAQRANAAGESSRLKSLIISTSSKSLPY

SEQ ID NO: 95121 - protein, 812 aa, Glycine max
  Coding DNA Sequence Number=SeqID_3436
  Gene Ontology: Biological process=intracellular signaling cascade
  Homolog annotation: Hit_ID=A7PAJ7; Match level="QueryCoverage=94%, HitCoverage=71%, E-value=5e-98, Identity=42%"; Hit description =Chromosome chr14 scaffold_9, whole genome shotgun sequence
  Pfam annotation: Domain name=DUF231; Domain location=224-389; Score =123.9; E_value=4.7e-34; Accession=PF03005.6; Description=Arabidopsis proteins of unknown function
  Pfam annotation: Domain name=DUF231; Domain location=413-573; Score =50.3; E_value=6.4e-12; Accession=PF03005.6; Description=Arabidopsis proteins of unknown function
  Pfam module annotation: Pfam domain module=DUF231::DUF231; Domain location=224-389::413-573
  Subcellular localization annotation: CTP_CleavageSite=37; ConfidenceScore=5.04e-01
MSGSIPKGAFLLPLTLFLIVLLLPLFRNFIQSSPKTYASNLETKETRRCNIFSGNWVPYPKEPYYNNETCPFILDQINCIKNGRPDRDFLKLRWKPHHCELPLFDATQFLELVRGKSMAFVGDSMGRNQLESLLCLINTVAHPEDITEKYTSNDNIFFRWWFVPDYNFTVTTMWSPFLVKFNDSDPTGRGFYSATKLYLEEADEAWRSKIKDFDFVVFSTGQWFFRPLTFYEKGQVVGCQKCENSTELNYYGYKKAFQTAFRTIRKLEGFKGLAFLVTHSPEHFENGAWNEGGTCNRTKPFEEKGVYENGDIVEALHQIQVEEFNAAREKGLRFGLIDITDAMGMRADAHPGRFRLGGNNNNNLNVNDCVHWCSPGAVDTWNEFLLYLMKLEAEIQHKHKVKSVDADPNASSFYRATKLYLDEADRAWAIVGCQRCEKNMTELNFYGYNRAFRTAFRTVIDFNGFKGLTFLVPHSPEHFENGLWNEGGMCNRTKPFTMEERGVYKNGDILETLHQIQTEEFEEAEKETRKKGLMGHPSRYGKVVDKNVTVSDCVHWCMPGPIDTWNEFLIYVMKLEGENDTMHHEAVKVLLFLLFHVTQVKDRVGCGSFTLEEGDGGCNDHGKMEGERGGDEKRGKPDECELPLFDAKQFLKVVRVKYMAFVGDSIGRNQMESLLCLLNSANKAWASHIENFDYVIFSGGQWFFRPLTFYENGQVVGCQKCHNLMEDPQNLYGYRHAFRTAFRTVINLKGFKGMVFMVSHSPNHFENGEWNKGLTNITAVMLMRSHKYGHNLDRNVSINDCVHWCMPGPVEC

SEQ ID NO: 95122 - protein, 386 aa, Glycine max
  Coding DNA Sequence Number=SeqID_3437
  Gene Ontology: Mol. function=aminoacyl-tRNA ligase activity; Cellular component=cytoplasm; Biological process=tRNA aminoacylation for protein translation
  Homolog annotation: Hit_ID=A7QC89; Match level="QueryCoverage=90%, HitCoverage=81%, E-value=2e-41, Identity=42%"; Hit description =Chromosome undetermined scaffold_77, whole genome shotgun sequence
MAASERRPRNGGKTTTFSEPNRTRNHLLRRARSSSYTIFFSPLDGQPCADYDRASGEGVQPQEEIQGVATLRPETMYGQTNAWVLPDGKLELLKSMKLMCLFLLTEQLLTLITRTIRGFRRDPLACLSSLIGLPLKSPLSFNEGDEDEWVFPFEIVPIIEVPRFGNKCVKTVCLQMKIKKPELIDKEKLAEAKKQTYLKGFTEGTMIVGEFAGRKFLVESLSDSTIYMAYYTVAHPFAEWWHDGFVVNAGWPTADAAPDLKLKSSNKYLQRSFRSESWLIREETPDSEQSSVVQSWNFKQKIQFLKFKKEEAIALGAQALDLRLPFGEIEVLKENLDVIKRQIGLEDVEILSAVDADSLARAEPLASLLNQNPPSPGKPTAIFLTR

SEQ ID NO: 95123 - protein, 58 aa, Glycine max
  Coding DNA Sequence Number=SeqID_3438
  Homolog annotation: Hit_ID=Q9FMF9; Match level="QueryCoverage=51%, HitCoverage=2%, E-value=6e-08, Identity=86%"; Hit description =Nuclear protein-like
GGIWKIYNSLYIGAQDALVAAYPALEDEHSNVYIFCTSSHQCKAQLLEHYFVSCYIDS

SEQ ID NO: 95124 - protein, 172 aa, Glycine max
  Coding DNA Sequence Number=SeqID_3439
  Gene Ontology: Mol. function=protein binding; Cellular component =signalosome; Biological process=red or far red light signaling pathway
  Homolog annotation: Hit_ID=Q41369; Match level="QueryCoverage=100%, HitCoverage=89%, E-value=3e-67, Identity=65%"; Hit description=COP9
MDFSSVRAALDSKSYDKVADVCDNLMLQVAADGIAYQDDWPYAAHLLSHIYVHDINSARFLWKSIPSSIKESQPEVTAVWKIGQKLWLRDYAGVHEAIRAFDWTQELQALEMFQLLLSAYSTISIKDTALFLGMNEDDATNYLLQQGWTVDPASRMLIVKKQPVVTEQKLDP

SEQ ID NO: 95125 - protein, 35 aa, Glycine max
  Coding DNA Sequence Number=SeqID_3440
MAKIEENAKELKVGAMETKVLSESESLIWRTTFCQ

SEQ ID NO: 95126 - protein, 160 aa, Glycine max
  Coding DNA Sequence Number=SeqID_3441
  Gene Ontology: Mol. function=cysteine-type endopeptidase activity; Cellular component=plasma membrane; Biological process=proteolysis
  Homolog annotation: Hit_ID=Q84Y03; Match level="QueryCoverage=85%, HitCoverage=35%, E-value=4e-49, Identity=62%"; Hit description =Cysteine protease
  Pfam annotation: Domain name=Peptidase_C1; Domain location=1-135; Score=37.2; E_value=2.7e-14; Accession=PF00112.14; Description =Papain family cysteine protease
MDYAFEWVMYNGGIDTETNYPYIGADGTCNVTKEKTKVIGIDGYYDVGQSDSSLLCATVKQPISAGIDGTSWDFQLYIGGIYDGDCSSDPDDIDHAILVVGYGSEGDDDYWIVKNSWRTSWGMEGCIYLRKNTNLKYDAWRFSGRGCKVKKDGKATVTMD

SEQ ID NO: 95127 - protein, 404 aa, Glycine max
  Coding DNA Sequence Number=SeqID_3442
  Gene Ontology: Mol. function=protein serine/threonine kinase activity; Cellular component=beta-catenin destruction complex; Biological process=protein amino acid phosphorylation
  Homolog annotation: Hit_ID=Q39011; Match level="QueryCoverage=100%, HitCoverage=98%, E-value=0.0, Identity=81%"; Hit description=Shaggy -related protein kinase eta
  Pfam annotation: Domain name=Pkinase; Domain location=34-348; Score =286.1; E_value=7.1e-83; Accession=PF00069.16; Description=Protein kinase domain
  Pfam annotation: Domain name=Pkinase_Tyr; Domain location=34-348; Score=-7.3; E_value=5.9e-12; Accession=PF07714.8; Description =Protein tyrosine kinase
  Pfam module annotation: Pfam domain module=Pkinase::Pkinase_Tyr; Domain location=34-348::34-348
MSSSVTNGDDSLTGHIISTTIGGKNGEPKQTISYMAERVVGTGSFGIVFQAKCLETGEAVAIKKVLQDRRYKNRELQLMRVLDHPNVISLKHCFFSTTSTDELFLNLVMEYVPESMYRVIKHYTNANQRMPIIYVKLYMYQIFRGLAYIHTVPKVCHRDLKPQNILVDPLTHQVKLCDFGSAKVLFLVSMSCSAQQQAVELSVFSFFSRFLSYQCVKGEANISYICSRFYRAPELIFGATEYTSSIDIWSAGCVLAELLLGQPLFPGENAVDQLVHIIKVLGTPTREEVRCMNPNYNDFRFPQIKAHPWHKIFHKKMPPEAIDLASRLLQYSPSLRCTALEACAHPFFDELREPHARLPNGRPFPPLFNFKQELSEASPVLVNKLIPDHVKRQIGLQFVPPAGS

SEQ ID NO: 95128 - protein, 107 aa, Glycine max
  Coding DNA Sequence Number=SeqID_3443
  Subcellular localization annotation: CTP_CleavageSite=18; ConfidenceScore=5.42e-01
MDSLYQIISSFPSFMVAVAATLRHRRTPLHHRSTASFEDFIRPMSSCAKTNFALPFDNVKNASSSQSNTVGSSSRNRHVAARLEPRPHAASVTLSYTPPWPVLVALG

SEQ ID NO: 95129 - protein, 365 aa, Glycine max
  Coding DNA Sequence Number=SeqID_3444
  Gene Ontology: Mol. function=DNA binding; Cellular component=nucleus; Biological process=regulation of transcription
  Homolog annotation: Hit_ID=Q6DXR2; Match level="QueryCoverage=98%, HitCoverage=99%, E-value=4e-47, Identity=38%"; Hit description =Putative MYB transcription factor
  Pfam annotation: Domain name=Myb_DNA-binding; Domain location=83-134; Score=42.8; E_value=1.2e-09; Accession=PF00249.22; Description=Myb -like DNA-binding domain
MPEGYEIHDNEETSSGCSSSFDLNEELACSEDNSDTEECCELTTTNEKAKDEGTSANGSSISSREGNERRGTVRQYVRSKMPRLRWTPELHHSFVHAVERLGGQERATPKLVLQLMNVRGLSIAHVKSHLQMYRSKKLDEVGQVLSQTSKSNQEVARRPLILHQCIIPQQHLMMGNGGIILASNFNKHNHFPSLLHPSFSLSRSQTNDSDSRHQHWYTNHQDFSIPIASSQIQPKDTRGRIAPMRPSQLLEEKRWPPLEILNNHQSMLKRLPAIVAPKNGSQAVQPAEWSFVNNTSIRDYLSNNSNEPLNNSNSLKLEFDPPFRIKKDEQQLPDLQLGLSHTVGTDGKIDHYKETPEISTKLSLS

SEQ ID NO: 95130 - protein, 290 aa, Glycine max
  Coding DNA Sequence Number=SeqID_3445
  Gene Ontology: Mol. function=protein binding
  Homolog annotation: Hit_ID=A7QDI9; Match level="QueryCoverage=81%, HitCoverage=97%, E-value=4e-58, Identity=49%"; Hit description =Chromosome chr10 scaffold_81, whole genome shotgun sequence
  Subcellular localization annotation: CTP_CleavageSite=44; ConfidenceScore=5.31e-01
MHPITPKHYSLPCPLLLSPSGHTPPLKVTHTFPSLFTSLMKNPVAQSFTEFYDKWVWKLEEILHQLLEVSKQRTQVVKTEQELQVLISKVTSHLKEYYTVKWASAHEDVLVFFSPTWLSPLENAYLWMTGWKPSMVLKLLETLKKQAASGGDFVMTEEQARKIEELRKRTRMEEEKVEREMERQQVAMADRKMVELVKLTTRARNGGGGGGDAVAEVALKGVLAGLERVMKASDCVRLKTLKGVLDVLSPMQCVDFLAANTAMQLRLRQWGKKKRDMPAGSTLNANHHNN

SEQ ID NO: 95131 - protein, 87 aa, Glycine max
  Coding DNA Sequence Number=SeqID_3446
MANEGLHIRMGLEVGVVTGLKDMLSAPSKINNLFYQKNLFYRKKVLPDEQFVLSEELSSDRSYGKNFFRTKENDMRMGIVRNAWDKG

SEQ ID NO: 95132 - protein, 233 aa, Glycine max
  Coding DNA Sequence Number=SeqID_3447
  Gene Ontology: Mol. function=metal ion binding; Biological process =metal ion transport
  Homolog annotation: Hit_ID=A7QUV4; Match level="QueryCoverage=86%, HitCoverage=100%, E-value=3e-31, Identity=36%"; Hit description =Chromosome chr1 scaffold_180, whole genome shotgun sequence
  Pfam annotation: Domain name=HMA; Domain location=115-177; Score =52.2; E_value=1.8e-12; Accession=PF00403.17; Description=Heavy-metal- associated domain
  Pfam annotation: Domain name=HMA; Domain location=26-97; Score=40.7; E_value=5.4e-09; Accession=PF00403.17; Description=Heavy-metal -associated domain
  Pfam module annotation: Pfam domain module=HMA::HMA; Domain location =115-177::26-97
MGRNNKEENSTQKKNKEEKKESDKAVVLKALVHCEGCSNQISKCLKGLAGVRHVQVDREHQRVTVKGEVVNDPAKVLERLRKKYSKNVELISPKPKPEKQKKAEEKKEQPKIKIVVLKMYMHCEGCVSDVKRKIEEMEGVHSVEVDKEKSRVMVRGTMDSTKLVEKVKKKLGKHVEIIKEDNKREPKREGSDNEKGNEDVNVIMYSYPPQYSTQYLYPNQSFSDENVFACSIM

SEQ ID NO: 95133 - protein, 353 aa, Glycine max
  Coding DNA Sequence Number=SeqID_3448
  Gene Ontology: Mol. function=molecular_function; Cellular component =membrane; Biological process=auxin mediated signaling pathway
  Homolog annotation: Hit_ID=A7QJ00; Match level="QueryCoverage=94%, HitCoverage=96%, E-value=1e-127, Identity=63%"; Hit description =Chromosome chr2 scaffold_105, whole genome shotgun sequence
  Pfam annotation: Domain name=DUF6; Domain location=178-307; Score =46.5; E_value=9.7e-11; Accession=PF00892.11; Description=Integral membrane protein DUF6
  Pfam annotation: Domain name=DUF6; Domain location=19-131; Score =23.3; E_value=0.00093; Accession=PF00892.11; Description=Integral membrane protein DUF6
  Pfam module annotation: Pfam domain module=DUF6::DUF6; Domain location=178-307::19-131
MRSTCDEWKPFIVMIAIDFSFAAVNILLKKVLEEGMNHLVFITYRLSIATIFIAPIGYFRERASVTQYFFLLGIQYTSATFSCAFINMVPVVTFMMALPFGLETVKIKSKSGRAKILGSLVCIGGALMLTLYKGKPLFNFSHYESVSPVAKSSEVNLASTRTTGKWTIGVIALALGTIFWSSWFILQSKISKRYPCQYSSTAIMSFFGAIQSAVICFFTDHNLSIWVLQGKIQIIAILYAGMIGSGLCFVGMSWCVKKRGPVFTAAFSPLVQIMAAMIDIPVLHEQLHLGSVMGSILVIIGLYILLWGKSMEMQNRVVKLVQEAEETKEQEPQPQIQQLTVYVHAETCDSQCH

SEQ ID NO: 95134 - protein, 282 aa, Glycine max
  Coding DNA Sequence Number=SeqID_3449
  Gene Ontology: Cellular component=anchored to membrane
  Homolog annotation: Hit_ID=Q2V5Z9; Match level="QueryCoverage=51%, HitCoverage=58%, E-value=2e-36, Identity=53%"; Hit description =Putative uncharacterized protein
  Pfam annotation: Domain name=Fasciclin; Domain location=76-211; Score= 77.0; E_value=6.2e-20; Accession=PF02469.13; Description=Fasciclin domain
  Subcellular localization annotation: CTP_CleavageSite=22; ConfidenceScore=5.35e-01
MKLIIFSFLLLLFVPIFSTTTSAQSPAAAPKPQAKPAPATPAPAPAKPLVPSLPQSPLSDSSSNQDIIRILRKAKSFNTLIRLLKTTQIINQVNAQLVTTKSGGGLTILAPDDGAFSQLKAGYFNSLGDRQQKALIQFHVLPVYVSSSNFDSLSNPVMTLASDSPNGYQINVTAYGNSVNISTGVVNATLTGIVYTDKTLAIYHVDKVLIPLDFSKPRPPAPAPTLAKAPKADKDNSSADDDDQGELNKATSAANSINLISIRGTMLVSLGVALVAAVTFSI

SEQ ID NO: 95135 - protein, 377 aa, Glycine max
  Coding DNA Sequence Number=SeqID_3450
  Gene Ontology: Mol. function=sequence-specific DNA binding; Cellular component=nucleus; Biological process=regulation of transcription, DNA-dependent
  Homolog annotation: Hit_ID=Q940V6; Match level="QueryCoverage=92%, HitCoverage=95%, E-value=1e-130, Identity=61%"; Hit description=Heat shock transcription factor
  Pfam annotation: Domain name=HSF_DNA-bind; Domain location=33-201; Score=200.1; E_value=5.4e-57; Accession=PF00447.8; Description=HSF -type DNA-binding
FESGQRFHLWVSDSTPAIAGGVKEAQGNSSSLPPFLTKTYEMVDDPSTNSIVSWSATNRSFIVWNPPEFSRDLLPKYFKHNNFSSFIRQLNTYGFRKIDPEQWEFANDDFVRGQPHLLKNIHRRKPVHSHSLQNIQGQGSSLLTESERRSFKDEIEKLKHEKERLLRELERHEQEWKMYEKPGIALNLLLLTENMDRKRRLPRSGLFSDDAGIEDHMETSPVLPRENADGSSIFSSSTERLDLLESSMTFWEDITHDVGDIFVQSHLNLDFDASTSCADSPAISCVQLEVEDQPKSPGINMNSEPSVVAVPDLDASKEQPVGKAPVTTGVNDIFWERFLTENPGSSEMQEAQSERKDSDGRSNAKFWWNIRNGGTQY

SEQ ID NO: 95136 - protein, 288 aa, Glycine max
  Coding DNA Sequence Number=SeqID_3451
  Gene Ontology: Mol. function=phosphoric monoester hydrolase activity; Cellular component=nucleus; Biological process=protein amino acid dephosphorylation
  Homolog annotation: Hit_ID=A7QDF2; Match level="QueryCoverage=97%, HitCoverage=77%, E-value=1e-73, Identity=53%"; Hit description =Chromosome chr10 scaffold_81, whole genome shotgun sequence
  Pfam annotation: Domain name=NIF; Domain location=103-280; Score =202.1; E_value=1.4e-57; Accession=PF03031.9; Description=NLI interacting factor-like phosphatase
  Subcellular localization annotation: CTP_CleavageSite=34; ConfidenceScore=5.41e-01
MVSKVKRSPVKSIKDLRNNNNRRWRRKTPIKNVVAASSAALATIRRRITKLFSKIARLSTSAHKKKATSYKILKKTTTTDGELDNIRRTLVFDDTTATTTTPLLPPLFSVRKTVFLDLDETLVHSHPSPPPERFDFVVRPVIDGEPMDFYVLKRPGVDEFLESLAAKYEVVVFTAALKEYASMVLDRLDRNRFISHRLYRDSCRNIDGKLVKDLNETGRDLKRVVIVDDNPNSFANQPENAILIRPFVDDILDRELWKLRSFFNGSDCCECDDMRDAVKHYVTVQHRR

SEQ ID NO: 95137 - protein, 283 aa, Glycine max
  Coding DNA Sequence Number=SeqID_3452
MLHSDVVLNSIPHIITFTAIRPIKKASQFPKLPVENIVHEGPYQNRVLGLVRERIRVIVDDNDPFEVATRFVKVLHELPVNVSARVAVEPVRDEPVPVEPVQDHGGVLLKRRGENDNLVLGGEGLEELVDAGALQDVEIHGLAVDDRPDDEVEALRRRRGVRVDERFVEVEEHRFSDGEQRREERGGGGGGGVVEHEGSANVVEFSVGCCSLFEDFVGGCFFLVGAGAEARDLREEFRDTAADGGQRGGGSRHHIFYGGFPSPATVVVVAEVLDGLHWASLHL

SEQ ID NO: 95138 - protein, 41 aa, Glycine max
  Coding DNA Sequence Number=SeqID_3453
MEWLMVGSCESISDPVTQLSNDLIRSITGSMLKIMNGSGME

SEQ ID NO: 95139 - protein, 303 aa, Glycine max
  Coding DNA Sequence Number=SeqID_3454
  Homolog annotation: Hit_ID=A7PVB9; Match level="QueryCoverage=58%, HitCoverage=48%, E-value=2e-57, Identity=54%"; Hit description =Chromosome chr4 scaffold_32, whole genome shotgun sequence
MKRERCQWCDWPNGQIGILRPAASPAKKRITHSSASIDTRRGRVRPYRTRQCEGHRVSGGGAGQRGAEGDGRETVEEGFNLRGRLGSGKDEGRPLRAYRWSSGGYGGRAWLGKKSRLVCWLVVSVIFGKVDNEGNNAFHLAAELGDYKPWLIPDEALQMHWEIKWYLDLVRSGGEWLKKTAGSCSLVAALIATVAFSTSTTIPGNFKDDTGAPTLEDRPEFKAFAIASLIARCCSVTSLVLFLSILTSRYQEHDFDSSLPRKLILGLTSLFMSIISTMVCFCAGHFFVLKDKLKSVAFPVYMP

SEQ ID NO: 95140 - protein, 70 aa, Glycine max
  Coding DNA Sequence Number=SeqID_3455
MSTQGSASWEDCYRNHALDTEMVGAPVSSLKLPGMVVDVEKATVAISAATKEQDPAVFFSHSPPLLTRSL

SEQ ID NO: 95141 - protein, 149 aa, Glycine max
  Coding DNA Sequence Number=SeqID_3456
  Gene Ontology: Mol. function=transporter activity; Cellular component= membrane; Biological process=oligopeptide transport
  Homolog annotation: Hit_ID=A7QDD0; Match level="QueryCoverage=74%, HitCoverage=17%, E-value=7e-25, Identity=54%"; Hit description =Chromosome chr10 scaffold_81, whole genome shotgun sequence
MEKPEVVDVKEEADFQLVDENKVDWKGRRALKFKYGGMCASVLILVTYAFTNFNLDAAMIGFENLGTFSLAVNSVPYFSGIMHYSIPDAANMLTNYMGTGYILAIPVAVLADTWIGRYRSVLISGVFEFVVSYKTSLLIVVNIQLNWRY

SEQ ID NO: 95142 - protein, 375 aa, Glycine max
  Coding DNA Sequence Number=SeqID_3457
  Gene Ontology: Mol. function=hydrolase activity, acting on ester bonds; Cellular component=nucleus; Biological process=lipid metabolic process
  Homolog annotation: Hit_ID=A9PEI0; Match level="QueryCoverage=94%, HitCoverage=99%, E-value=2e-89, Identity=49%"; Hit description =Putative uncharacterized protein
  Pfam annotation: Domain name=Lipase_GDSL; Domain location=34-334; Score=155.3; E_value=1.7e-43; Accession=PF00657.13; Description=GDSL- like LipaseAcylhydrolase
MTCETKTWLVMLLFLVANYMMQHCVHGVSQVPCLFIFGDSLSDSGNNNELPTSAKSNFRPYGIDFPLGPTGRFTNGRTEIDIITQLLGFEKFIPPFANTSGSNILKGVNYASGGAGIRIETGSDMGATISLGLQLANHRVIVSEIATKLGSPDLARQYLEKCLYYLNTGNNDYMGNYFRPQLYPASRIYSLEQYAQALIEELSLNLQALHDLGARKYVLAGLGLIGCTPAVMHSHGTNGSCVEEHNAATYDYNNKLKALVDQFNNRFSANSKFILIHNGSNALDIAHGFLVSDAACCPSGCNPNQKPCNNRSDYVFWDEVHPTEAWNLVNAISAYNSTIDPAFTYPMNIKQLVDCEVKRELEFRNESTSQLSATE

SEQ ID NO: 95143 - protein, 186 aa, Glycine max
  Coding DNA Sequence Number=SeqID_3458
  Gene Ontology: Mol. function=protein dimerization activity; Cellular component=nucleus; Biological process=regulation of transcription, DNA-dependent
  Homolog annotation: Hit_ID=A7Q6S2; Match level="QueryCoverage=55%, HitCoverage=36%, E-value=5e-28, Identity=69%"; Hit description =Chromosome chr12 scaffold_57, whole genome shotgun sequence
  Pfam annotation: Domain name=bZIP_1; Domain location=46-105; Score =45.9; E_value=1.4e-10; Accession=PF00170.12; Description=bZIP transcription factor
  Pfam annotation: Domain name=bZIP_2; Domain location=46-100; Score =39.9; E_value=8.9e-09; Accession=PF07716.6; Description=Basic region leucine zipper
  Pfam module annotation: Pfam domain module=bZIP_1::bZIP_2; Domain location=46-105::46-100
MAEVVAGTESEDNMSMSLQDLLGSHSHGGRRVKRKSVVEEPLVVDKVTLQKQRRMIKNRESAARSRERKQAYTVELESLVTHLEEENAVLLQLAADRKRLRLNQLMECLIPVEEKRIPKRMLRRVNSSQWISLGVTLLYREIMQLNNSTNLIQAEAYYWFTRWRIGLYWGKRVEIRMYVNARLSAF

SEQ ID NO: 95144 - protein, 122 aa, Glycine max
  Coding DNA Sequence Number=SeqID_3459
  Gene Ontology: Mol. function=ATPase activity, coupled to transmembrane movement of substances; Cellular component=integral to membrane; Biological process=transport
  Homolog annotation: Hit_ID=Q9SYI3; Match level="QueryCoverage=91%, HitCoverage=64%, E-value=9e-22, Identity=45%"; Hit description =Putative multidrug resistance protein 5
  Pfam annotation: Domain name=ABC_tran; Domain location=2-109; Score= -60.8; E_value=0.074; Accession=PF00005.18; Description=ABC transporter
MENHHSSQLFQEPILFNDSIRVNIAYSKEGGATEEEIIIAAAQEANGHKFISSLPHGYDTSVGERGTQLSGGQKQRITIATIALDAESECVVQEALDRVSVKLMKIDGGVYASLVALHISES

SEQ ID NO: 95145 - protein, 416 aa, Glycine max
  Coding DNA Sequence Number=SeqID_3460
  Gene Ontology: Mol. function=protein binding; Cellular component =cytoplasm; Biological process=regulation of transcription
  Homolog annotation: Hit_ID=A5BQB4; Match level="QueryCoverage=98%, HitCoverage=72%, E-value=1e-171, Identity=72%"; Hit description =Putative uncharacterized protein
  Pfam annotation: Domain name=F-box; Domain location=51-106; Score =29.3; E_value=1.4e-05; Accession=PF00646.24; Description=F-box domain
  Pfam annotation: Domain name=Tub; Domain location=109-410; Score =537.1; E_value=2e-158; Accession=PF01167.9; Description=Tub family
  Pfam module annotation: Pfam domain module=F-box::Tub; Domain location=51-106::109-410
MSFRSIVRDVRDSFGSLSRRSFDVRLTGHHRGKSQGSVQDLHDQPLVIQNSRWASLPPELLFDIIRRLEESENTWPARKHVVACAAVCQSWRNMCKDIVKSPEFCGKLTFPVSLKQLFLDVDQMKVQVIFALAGALLVENGKFLLSAKRTRRTTYTEYVISMDADNISRSSNTYIGKLRSNFLGTKFIIYDTQPPYSSAHICPPGTGKTSRRFYSKKVSPKVPSGSYNIAQVTYELNVLGTRGPRKMHCVMHSIPASALDAGGTVPGQPELLPRSLEDSFRSISFSKSLDHSIEFSSSRFSEIGESCIEDDDGKMRPLVLKNKPPRWHEQLQCWCLNFRGRVTVASVKNFQLIAATQPAAGAPTPSQPAPPEHDKIILQFGKVGKDMFTMDYRYPLSAFQAFAICLSSFDTKLACE

SEQ ID NO: 95146 - protein, 334 aa, Glycine max
  Coding DNA Sequence Number=SeqID_3461
  Gene Ontology: Mol. function=molecular_function; Cellular component =membrane; Biological process=auxin mediated signaling pathway
  Homolog annotation: Hit_ID=A7QBC8; Match level="QueryCoverage=100%, HitCoverage=92%, E-value=2e-81, Identity=49%"; Hit description =Chromosome chr4 scaffold_73, whole genome shotgun sequence
  Pfam annotation: Domain name=DUF6; Domain location=21-176; Score =21.5; E_value=0.0032; Accession=PF00892.11; Description=Integral membrane protein DUF6
MDMCNVVHALKPVMLMVLVQVANAWVNVLYKLALNDGMNLSVIVAYRYVFATAFIAPLAFILERFFFCSWFYVTEDEDKDDLEDTVSGISLRLNWVSNVFFIDMLLHGVLPQNLNMEAIALTSVTFTTAISNLIPAITFIISLSFGLERLNLKTKGGKAKIIGTITGISGAMILTFIKGPEVKMLSFHVNLFNHQNGHVVHSHASSGLMTIFGALASVASNVSYAMWLIIQAKMSERYPCPYSSTALMSLMGALLSISFAFCVERDLSQWRLDWNVRLLTVAYAGIVVSGVMVAVISWCVRTRGPLFVSVFSPLMLVVVAFAGSTILDEKLYLG

SEQ ID NO: 95147 - protein, 510 aa, Glycine max
  Coding DNA Sequence Number=SeqID_3462
  Gene Ontology: Mol. function=protein binding; Cellular component =nucleus
  Homolog annotation: Hit_ID=A7NZD0; Match level="QueryCoverage=96%, HitCoverage=97%, E-value=1e-161, Identity=57%"; Hit description =Chromosome chr6 scaffold_3, whole genome shotgun sequence
  Pfam annotation: Domain name=WD40; Domain location=177-216; Score =13.4; E_value=0.7; Accession=PF00400.23; Description=WD domain, G -beta repeat
  Pfam annotation: Domain name=WD40; Domain location=233-270; Score =7.2; E_value=4.1; Accession=PF00400.23; Description=WD domain, G -beta repeat
  Pfam annotation: Domain name=WD40; Domain location=348-387; Score =11.4; E_value=1.2; Accession=PF00400.23; Description=WD domain, G -beta repeat
  Pfam annotation: Domain name=WD40; Domain location=391-429; Score =19.3; E_value=0.015; Accession=PF00400.23; Description=WD domain, G -beta repeat
  Pfam annotation: Domain name=WD40; Domain location=51-89; Score=36.7; E_value=8.3e-08; Accession=PF00400.23; Description=WD domain, G-beta repeat
  Pfam annotation: Domain name=WD40; Domain location=93-134; Score=8.9; E_value=2.5; Accession=PF00400.23; Description=WD domain, G-beta repeat
  Pfam module annotation: Pfam domain module=WD40::WD40::WD40::WD40::WD4 0::WD40; Domain location=177-216::233-270::348-387::391-429::51 -89::93-134
MENLHNHRGITNSNSCPPRGFTDIFRRELGLSHPNSFARRFSASEVLVKSLDLYGKLDGHEGCVNAVEFNSTGDLLVSGSDDRQVMFWNWASKTRLFAYPSGHTDNIFQTKIIPFTDDCRIVTSAGDGQLNIFIMLKEHQMEGLTLAEWTSLIEHGESRFESLPGQVRLGLLWEDGRVDTTMLGKHHGCVYKLAVEPGSAHIFYSSGEDGFIQHFDLRSNSATKLFCCSSSIGNNKQTLSKVGLNSIVIDPRNPYYFAIGGSDEYARVYDIRKCQWGSARNSDRPVNTFCPCHLIGSNNVHITGLAYSSFSELLVSYNDELIYLFEKNVHSDSSPSSATSEDPKNIHEAQVYSGHRNAQTIKGVNFFGPNDEYIMSGSDCGHIFIWKKKEAKLVRLMVGDQHVVNQLEAHPHIPILATCGIEKNVKIWAPLGNDIPPLPANVKEIMETNRQGREDRSRRRQTLAYIERRHNRADIVSDEEDAEGYLLGFSDGDASSEEDSPGNSRDCNIS

SEQ ID NO: 95148 - protein, 268 aa, Glycine max
  Coding DNA Sequence Number=SeqID_3463
  Gene Ontology: Mol. function=protein binding; Biological process =ethylene mediated signaling pathway
  Homolog annotation: Hit_ID=A7NYB1; Match level="QueryCoverage=88%, HitCoverage=25%, E-value=2e-95, Identity=70%"; Hit description =Chromosome chr6 scaffold_3, whole genome shotgun sequence
  Pfam annotation: Domain name=TPR_1; Domain location=52-85; Score =19.0; E_value=0.018; Accession=PF00515.19; Description =Tetratricopeptide repeat
  Pfam annotation: Domain name=TPR_2; Domain location=178-211; Score =11.1; E_value=1.2; Accession=PF07719.8; Description=Tetratricopeptide repeat
  Pfam annotation: Domain name=TPR_2; Domain location=52-85; Score =24.1; E_value=0.00052; Accession=PF07719.8; Description =Tetratricopeptide repeat
  Pfam module annotation: Pfam domain module=TPR_1::TPR_2::TPR_2; Domain location=52-85::178-211::52-85
MDCGGFVLECPKKNLEHGLSPCSYRALAKVEEKQIKEGIIELDRFIGFKPSPDCLELRGWLYVALEDYDSAMRDIRALLTIEPNYITSHGKIKGEYLLQLLNYEVQQKCQADCWMQLYQQWSCVDDIGSLAIIHQMLDNEPGKSVLQFRQSLLPLRLNYQKAAMHSLRLPRNHSSPMQERLIYEGWILYDTGYREEAVARADRSIAIQRSFEAFFLKAYVLADTTLDPESSSHVIQLLKEALKCPADGLRKGQTLSNYKMLKVVKDKT

SEQ ID NO: 95149 - protein, 517 aa, Glycine max
  Coding DNA Sequence Number=SeqID_3464
  Gene Ontology: Mol. function=pyridoxal phosphate binding; Biological process=carboxylic acid metabolic process
  Homolog annotation: Hit_ID=Q4H1G0; Match level="QueryCoverage=95%, HitCoverage=95%, E-value=0.0, Identity=73%"; Hit description =Putative serine decarboxylase
  Pfam annotation: Domain name=Pyridoxal_deC; Domain location=107-446; Score=-123.6; E_value=2.8e-07; Accession=PF00282.10; Description =Pyridoxal-dependent decarboxylase conse
MVGSVDALNEGLRINGAVEPLPEDFDATAVIIDPVPSAVVDNGILKEEAQINKGKEKREIVLGRNVHTTCLEVTEPEADDEITGDREAHMASVLARYKRALTERTKHHLGYPYNLDFDYGALTQLQHFSINNLGDPFIESNYGVHSRQFEVGVLDWFARLWELEKNEYWGYITNCGTEGNLHGILVGREVFPDGILYASRESHYSVFKAARMYRMECEKVDTLWSGEIDCDDFKAKLLSHQDKPAIINVNIGKFLHHCFSLSHPMSPLLFTLLILAHPTETIAGTTVKGAVDDLDLVIKKLEEAGFSHDRFYIHCDGALFGLMMPFVKLAPKVTFKKPIGSVSVSGHKFVGCPMPCGVQITRLEYVNALARDVEYLASRDATIMGSRNGHAPIFLWYTLNRKGYRGFQKEVQKCLRNAHYFKGRLVEAGIGAMLNELSSTVVFERPHDEEFIRKWQLACKGNIAHVVVMPNITIEKLDDFLNELLDKRATWFQDGKDQPYCISSDVGEKNCLCALHK

SEQ ID NO: 95150 - protein, 282 aa, Glycine max
  Coding DNA Sequence Number=SeqID_3465
  Gene Ontology: Mol. function=oxidoreductase activity; Cellular component=extracellular region; Biological process=response to oxidative stress
  Homolog annotation: Hit_ID=Q9XFI7; Match level="QueryCoverage=92%, HitCoverage=84%, E-value=1e-141, Identity=90%"; Hit description =Peroxidase
  Pfam annotation: Domain name=peroxidase; Domain location=38-255; Score=310.0; E_value=4.4e-90; Accession=PF00141.14; Description =Peroxidase
MALFVLSLLFFSFLMGSSESQLQVGFYSNTCPQVDSIIRAVVRDAVLSDPNMAAVLLRLHFHDCFAQGCDGSILIENGPQSERHAFGHQGVRGFEVIERAKAQLEGSCPGLVSCADIVALAARDAVVMANGPAYQVPTGRRDGLVSNLSLADDMPDVSDSIELLKTKFLNKGLTVKDLVLLSDPAIRQNFLPRLKARCPQNGDVNIRLAIDEGSEQKFDINILKNIREGFAVLESDARLNDDIATKNVIDSYVSPFSPMFGPSFEADFVESVVKMGQIGVKT

SEQ ID NO: 95151 - protein, 704 aa, Glycine max
  Coding DNA Sequence Number=SeqID_3466
  Gene Ontology: Mol. function=phosphatidylinositol binding; Cellular component=Golgi apparatus; Biological process=clathrin cage assembly
  Homolog annotation: Hit_ID=Q9SA65; Match level="QueryCoverage=80%, HitCoverage=97%, E-value=1e-170, Identity=55%"; Hit description =Putative clathrin assembly protein At1g03050
  Pfam annotation: Domain name=ANTH; Domain location=139-426; Score =383.7; E_value=2.9e-112; Accession=PF07651.7; Description=ANTH domain
  Pfam annotation: Domain name=ENTH; Domain location=139-260; Score= -3.5; E_value=5.7e-05; Accession=PF01417.11; Description=ENTH domain
  Pfam module annotation: Pfam domain module=ANTH::ENTH; Domain location=139-426::139-260
GSGGCDNNDGCGSGDDDINGGGGYGGSNVSGDDIGDDCGDADGGGDNDDDSESNIDGSHNNVDNNDDVSDDDGGDGDGDDEVDIGDGGGVDNEDGDGASLEENLGRESMAPSSKFRRALGAVKDQTSISLAKVGSSTSVADLDVAIVKATRHDEYPAEEKHIREILSLTCYSRAFISACVNTLTRRLNKTKSWTVALKTLVLIQRLLLEGDPAYEQEIFFSTRRGTRLLNMSDFRDNSKSDSWDFSAFVRTYALYLDERLEYKMQSRRGMRSMYGLDEDEEEREREKEIIVRSTPVRDMKLDQIFSKMQHLQLLLERFLACRPTGGAKNHRIVIVALYPIVKESFRIYYDISEILSILIDRFPDMEVSDCVKVYDIFCRVGKQFDELDLFFGWSKSIGIARSSEYPEIERVTLKKLEVMEEFIKDKSALAQSNKLEAIEYKTQEEEVAYEPEPEPEPEEDVNATNALPPPPEEINEEAVEEVKEEPKEGKVVQTEGDLLNLGDDMMTSEEHGEKLALALFDGAVPEAATGATQALPWHAFDEGAADWETTLVQSATNLSNQKPTYGGGFDTLLLDGMYKQGEVNAAMQGQGYGVSGSASSVALGSAGRPSMLALPAPPTSRSGSDSISSDPFAASLAVAPPSYVQMSEMEKKQRFLVEEQMMWQQYAKDGMQGQAALAKLHSNNNNNNNSYTGGYPQNYGNYYR

SEQ ID NO: 95152 - protein, 52 aa, Glycine max
  Coding DNA Sequence Number=SeqID_3467
MANHPARQSVKAVEFSSRNNKSNMEASLIFTRHLAWDYHITHKEREMDEAFL

SEQ ID NO: 95153 - protein, 65 aa, Glycine max
  Coding DNA Sequence Number=SeqID_3468
MYKLRYSLDSRSFGGTCSVYTFSIFSTDPPLADNPNLLAHIMPPTPASTLHTAFLLDRISKEEIT

SEQ ID NO: 95154 - protein, 742 aa, Glycine max
  Coding DNA Sequence Number=SeqID_3469
  Gene Ontology: Mol. function=catalytic activity; Cellular component =mitochondrion; Biological process=protein amino acid dephosphorylatio n
  Homolog annotation: Hit_ID=Q8S5N3; Match level="QueryCoverage=52%, HitCoverage=73%, E-value=2e-80, Identity=44%"; Hit description =Putative uncharacterized protein OJ1003C07.6
  Pfam annotation: Domain name=PP2C; Domain location=512-719; Score= -30.6; E_value=0.00037; Accession=PF00481.12; Description=Protein phosphatase 2C
  Pfam annotation: Domain name=SpoIIE; Domain location=534-717; Score= -14.9; E_value=0.0041; Accession=PF07228.3; Description=Stage II sporulation protein E (SpoIIE)
  Pfam module annotation: Pfam domain module=PP2C::SpoIIE; Domain location=512-719::534-717
MVILAEHSDGSFVFRFASANEIREQLDELNKKKKSDALNKKKKKLAREGVLEEGKAGVRALVSESVKKLNTEVDRTLGGEIESSSTVVVDVADQNPQLLLNEKEGDVLDSDSGPPVTNDLQKIDRHLKLDSVEDGDGQRGISSEDVGTESNGVPSASEADSELDSHREAVVSTVATEADVVSDLKSDAFAEVEEEEEGDANIEVAHLSTAGKSYGVDRTTNNLAAAVDAELSELVPESTFLDSEQVGDSASNNQTDAVNAESSELVPESTCLESEQVSYSATNNQTDAVDAELSELVPESTSLESEQAGYSETNNLTDGVDANLSDLMPVSTSLESEQVGYGATNNLIAAVDANISELLPESTSAESEQVGYSETNNMTSGVDADLSELTPVSSSLESELVANDEETAHLIVDDFINASKMGKSELSLDEVPSSNLENNIDVDNTERSDYESTSQLTVPQILSAEVASHGEKTSKTELFLISGAACLPHPSKVPSILQYHDSFCSVNRDENEAYDKPTNNKFQALTGREDAYFISHQNWLAVADGVGQWSLEGSNAGLYIRELIEKCENIVSNYENNSTIEPAEVITRGAAETQSPGSCSILVTNFDGQVLHAANVGNTGFIIIRDGSIFKKSTPMFHEFNFPLQIVKGDDPSELIEGYTMDLHDGDVIVTATNGLFDNLYEQEIASIISKSLEASLTPQEIAEFLATRAQEVGRSTSMRSPFADAAQAVGYVGFIGGKLDD

SEQ ID NO: 95155 - protein, 330 aa, Glycine max
  Coding DNA Sequence Number=SeqID_3470
MGAQLGPRTNIMLPSGKLRRKRVVVLERESRGASQRQGIEDVCAGALSKEKGQPRKYSPDGYIALGLGLTHTPASSSEHLAKKHRGRPRLRKEVDGHTQNCFTPSHVRDSGGVGEGWLVILAFVIVVGGDRVVKGGGGVAGGGKEGGRLGRSSVTEYIFIVENCPCNNHTGVYQFKRGLLRSKSKDAKLSLEEVVPSYSFKRATILRINPALAASEEQNVVSDVVFLDKGWDLGLGNLTSGNLGCNEMALALALDEREMGETNVLEKAEAAIGFQALTLKAKQGDRNNEVEVKKAAKCKFTVGLLDHKKYNTHWVSGIANTPSKIAAATP

SEQ ID NO: 95156 - protein, 586 aa, Glycine max
  Coding DNA Sequence Number=SeqID_3471
  Gene Ontology: Mol. function=RNA binding; Cellular component =cytoplasm; Biological process=loss of chromatin silencing during replicative cell aging
  Homolog annotation: Hit_ID=A7QII7; Match level="QueryCoverage=67%, HitCoverage=64%, E-value=1e-108, Identity=55%"; Hit description =Chromosome chr12 scaffold_103, whole genome shotgun sequence
  Pfam annotation: Domain name=PUF; Domain location=442-476; Score =28.2; E_value=3e-05; Accession=PF00806.10; Description=Pumilio -family RNA binding repeat
  Pfam annotation: Domain name=PUF; Domain location=478-512; Score =46.2; E_value=1.1e-10; Accession=PF00806.10; Description=Pumilio -family RNA binding repeat
  Pfam annotation: Domain name=PUF; Domain location=517-551; Score =25.2; E_value=0.00024; Accession=PF00806.10; Description=Pumilio -family RNA binding repeat
  Pfam annotation: Domain name=PUF; Domain location=554-586; Score =18.7; E_value=0.022; Accession=PF00806.10; Description=Pumilio -family RNA binding repeat
  Pfam module annotation: Pfam domain module=PUF::PUF::PUF::PUF; Domain location=442-476::478-512::517-551::554-586
RDDVELEEELEMLLDEIPHATSHNLLRYHHHHRHGHGDDDGGAFVTKQTQYGHGHGHGMYYDDDFKSPISGFFLQSDGSSSSLFSSSPPPFEDLKSSVASRSSYYPNTTTTNNNSNLFFDPKIPDSTVKLNEAERLVHELSLCANFSKMHVADNNNNNNNNRRHNPNVLTFRDFVNHVHNTRRGGDCTDFERGFCDSVGFQSPFTRTRSPIAPAAEINSALSGLTQDHKIPNLFGSSLQPCTGWREHDSMVSQLNGFSAGSMDSLRCGSQLMNDYHFRGGMAPELVGSLSRSPAFDSSFYAQKYLMNLLEERGGSRLPNNSFCGNFKPCVSVQELLQYGLFQPNPNARGVPLSNARIPQGNLDAITSEGSFIIQGEGLNYVGVSRGSDHSWCQRAVLESGFAKQLPRSELDIQHQITGYENPRSPRNACSFPLLPNYNSLAEAQGLIYLIAKDQHGCRFLQRIFDEGTPEDVQVIFNEIIDHVVELMMNPFGNYLMQKLLDVCDENQRMQMILMVTEEPGQLVRISLNTHGTRVVQKVIETLKTRQQISLVVAALEPGFLALIKDLNGNHVVQHCLQCLSNEDNKV

SEQ ID NO: 95157 - protein, 94 aa, Glycine max
  Coding DNA Sequence Number=SeqID_3472
  Homolog annotation: Hit_ID=A7QPG4; Match level="QueryCoverage=100%, HitCoverage=98%, E-value=1e-31, Identity=72%"; Hit description =Chromosome chr18 scaffold_137, whole genome shotgun sequence
MEIVELKVEMVGIHEKRLRKCLAKLKGWFGIEKVEVDCNSQKVVVTGYAHKNKILKALRKAGLKAHFWSSKNDLLNAYLSASYANLKFNNFSIF

SEQ ID NO: 95158 - protein, 966 aa, Glycine max
  Coding DNA Sequence Number=SeqID_3473
  Gene Ontology: Mol. function=calcium ion binding; Cellular component =nucleus; Biological process=regulation of transcription, DNA -dependent
  Homolog annotation: Hit_ID=Q6NPP4; Match level="QueryCoverage=89%, HitCoverage=81%, E-value=0.0, Identity=50%"; Hit description =Calmodulin-binding transcription activator 2
  Pfam annotation: Domain name=Ank; Domain location=581-613; Score =11.9; E_value=0.63; Accession=PF00023.21; Description=Ankyrin repeat
  Pfam annotation: Domain name=Ank; Domain location=614-646; Score =37.8; E_value=3.8e-08; Accession=PF00023.21; Description=Ankyrin repeat
  Pfam annotation: Domain name=IQ; Domain location=791-811; Score=24.5; E_value=0.0004; Accession=PF00612.18; Description=IQ calmodulin -binding motif
  Pfam annotation: Domain name=IQ; Domain location=814-834; Score=26.2; E_value=0.00012; Accession=PF00612.18; Description=IQ calmodulin -binding motif
  Pfam module annotation: Pfam domain module=Ank::Ank::IQ::IQ; Domain location=581-613::614-646::791-811::814-834
MVVISLGIRVGLGSNLRFEMFPNHLKGNKNIVVNNEGDEVPTDSQKVTSPSSSLPTHHSCVSSLSTDSVSPTTSLMSLHEDADSEDIHHASSGLHPLHESQHSGNSPLTEKIGAGDNEQSSISGTDYIPVVHGDKFRGNDTAYTDGQKPHGMAPWGTVLQSTAKLHNDPSLASFPSILPSSMGDVLEQEHTIFGDLLMSKSGLTEEAESSQSLQSNWQIPFEDNSGGMPMLTQTQSFGLQFRSDYGTGLLGNETRNASSEIAPILYSFHGEPKEQPMQQNYPQELEDGQSQHALKSNSANKVPDEETINYGLTVKSTLLDRDESLKKVDSFSRWITKELGEVADLNMQSSPGISWSTDECQHVIDDTSLSPSLSQDQLFSINDFSPKWAYAESEIEVLIIGSFLKSQPEVTTCNWSCMFGEVEVPAEVLADGILCCQAPCHKVGRVPFYVTCSNRLACSEVREFDFREGFARNVDFADFYISSTEMLRHLRLEDFLSLKPVDPSNHSFEGDMEKRNLIFKLISLREEEDYSIKDEVTRELDISQHMVKEHLFHRQFKEKLYSWLLHKVTENGKGPNVLDEDGQGVLHLAAFLGYDWAINPIISAGVNINFRDVNGWTALHWAASCGRERTVAVLVSMGADCGALTDPSPAFPSGRTAADLASSYGHKGISGFLAESSLTHHLETLTMDDQKGGQQEISGMKVVQTVSERSATPVHYCDIPDAICLKDSLTAVRNATQAADRIHQVYRMQSFQRKQLTQYEGDDELGLSDQQALSLLASRACKSGQGDGLANAAAVQIQKKFRGWKKRKEFLMIRQRVVKIQAHVRGHQIRKQYKPIIWSVGILEKVILRWRRKGSGLRGFRPNAINKVPNQQNDSLKEDDYDYLKEGRKQKEEKIQKALSRVKSMVQYPEARAQYRRLLNVVEDFRQTKASNKGLINSEETVDGVEDLIDIDMLLDDDNFIPIAFD

SEQ ID NO: 95159 - protein, 647 aa, Glycine max
  Coding DNA Sequence Number=SeqID_3474
  Gene Ontology: Mol. function=DNA binding; Cellular component=nucleus
  Homolog annotation: Hit_ID=A5AUY6; Match level="QueryCoverage=93%, HitCoverage=93%, E-value=1e-108, Identity=41%"; Hit description =Putative uncharacterized protein
  Pfam annotation: Domain name=zf-C2H2; Domain location=340-363; Score =17.8; E_value=0.04; Accession=PF00096.17; Description=Zinc finger, C2H2 type
  Pfam annotation: Domain name=zf-C2H2; Domain location=387-409; Score =12.7; E_value=0.48; Accession=PF00096.17; Description=Zinc finger, C2H2 type
  Pfam module annotation: Pfam domain module=zf-C2H2::zf-C2H2; Domain location=340-363::387-409
MEASLKLESLACIDSTTLSHSELLALSLSSLCSTHDLLTPNIDPALFNQSTGSLRQTYSLPHSSPTARRRRRLAGLLPSPKLPPLPAHDPENAENRLIIDYLKQFIRDDPNFDQVELAPPSLPQPRIQRKRGRNPKVKVHLDDCYRGIDIVNQNGVSVDLQLLANSQDPFAEELKRRTEGLHNEEELLGFLRDLPGQWGSRRKKRRIVDSADFGDVLPLSWKILLGLKRKDGRAWIYCRRYISPSGQHFVSCKEVSSYLQSLLGNGDAQLQISRRTENVVQEHKLSADNSAAVTKEHQDEMQIVAVNMAVSGLSAANERVKEVALLGIENLADVQIHDLLECRKCNMSFNEKDLYLQHLLSFHQRTTRRYRLGSSVGDGVIIKDGKFECQFCHKVFLERRRYNGHVGIHVRNYVRKVEDSPGQPNVQGTDDKSPDTVTEPHSSAKLNRIPGSDAVGYLDQDGNSESPVSEQQMEDSMTGKNVDHDLDEKVEEIDDDNHAIDVKDDVPLTIEELDQSGMDLDDNSQNCISNKSELEFSLNGLKDVPVTVSTNVQEMGGKQFCSVDHEHDNVKGFQELRFDEIDIVEYDFFLINQLTTVCVWCGIEFDHDAVNSEIQPDSVGFMCPASKAKISGQVNVLDCGSPNAGCL

SEQ ID NO: 95160 - protein, 865 aa, Glycine max
  Coding DNA Sequence Number=SeqID_3475
  Gene Ontology: Mol. function=transferase activity, transferring glycosyl groups; Cellular component=cytoplasm; Biological process =metabolic process
  Homolog annotation: Hit_ID=A6XNC5; Match level="QueryCoverage=98%, HitCoverage=98%, E-value=0.0, Identity=63%"; Hit description =(Iso)flavonoid glycosyltransferase
  Pfam annotation: Domain name=UDPGT; Domain location=11-484; Score= -18.8; E_value=1.2e-09; Accession=PF00201.9; Description=UDP -glucoronosyl and UDP-glucosyl transferase
MSYNEERKPHAVLTPYPVQGHVNPLLKLAKLLHLRGFYITFVHTEYNYKRLLKSRGPNALDGLPDFRFVSIPDGLPPLDDANVTQHVPSLCDSIRKNFLKPYCNLVRSLNHSATEHGGTIPPVTCLVSDGCMPFTIQAAQQLGLPNLIFWPASACSFLSIINFPTLVEKGLTPLKDESYMRNGYLNSKVDWIPGMKNFRLKDIPDFIRTTDLNDVMLQFFIEVANKVQRNSTILFNTFDELEGDVMNALSSMFPSLYPIGPFPLLLNQSPQSHLASLGSNLWKEDPECLEWLESKESGSVVYVNFGSITVMSAEQLLEFAWGLANSKKPFLWIIRPDLVIGGSVILSSEFVNETRDRSLIASWCPQEQVLNHPSICGFLTHCGWNSTTESVCAGVPMLCWPFFADQPTNCRYICNEWEIGIQIDTNVKREEVEKLVSELMVGEKGKKMREKTMGLKKKAEEATRPSGCSYMNLDKVIKKTWDELLGGLHKRCMGYPPNILTIDGGPNALDGLPNFRFETIPDGLPPLDDDDNGDVTQHIPSLCDSIRKNFLQPFRDLLARLNHSATEGLIPPVTCLVSDGGMTFTIEAAHELGVPNVLFWPASACCFLSIINFPALVEKGLTPLKVANKVQRNSTILFNTFDELEGDVMIALSSMFPSLYPIGPFPLLLNQSPQNHLASLGSNLWKEDPECLEWLESKESGSVVYVNFGSITVMSAEQLLEFAWGLANSEKPFLWIIRPDLVIGVLNHPSICGFLTHCGWNSTTESVCAGVPMWCWPFNGDQPKNCKYICSEWGIGIEIDTNVKREEVEKLVNELMVGEKGKKMREKTMELKKKAEEATRPRGNSYMNLDKVSKEVLLNWATLEY

SEQ ID NO: 95161 - protein, 524 aa, Glycine max
  Coding DNA Sequence Number=SeqID_3476
  Gene Ontology: Mol. function=hydrolase activity, acting on carbon -nitrogen (but not peptide) bonds; Cellular component=nucleus; Biological process=nucleobase, nucleoside, nucleotide and nucleic acid metabolic process
  Homolog annotation: Hit_ID=Q9FMP3; Match level="QueryCoverage=93%, HitCoverage=94%, E-value=0.0, Identity=79%"; Hit description =Dihydropyrimidinase
  Pfam annotation: Domain name=Amidohydro_1; Domain location=88-434; Score=39.1; E_value=4.6e-09; Accession=PF01979.11; Description =Amidohydrolase family
  Pfam annotation: Domain name=Amidohydro_3; Domain location=88-432; Score=-55.0; E_value=0.00055; Accession=PF07969.2; Description =Amidohydrolase family
  Pfam module annotation: Pfam domain module=Amidohydro_1::Amidohydro _3; Domain location=88-434::88-432
MAMGLTSQLLLSLFISTLLLLLPSSLSQSNQFCDAGTSSKLLIKGGTVVNAHHQQVADVYVEDGIIVAINPTITVGDEVTVIDATGKFVMPGGIDPHTHLEFEFMDTETVDDFFSGQAAALAGGTTMHIDFVIPHKGSLTAGFEAYEKKAKKSCMDYGFHMAITKWDETVSREMELMVKEKGINSFKFFMAYKGALMINDELLLEGFKKCKSLGALAMVHAENGDAVYEGQEKMIELGITGPEGHALSRPAVLEGEATARAIRLADFVNTPLYVVHVMSIDAMEEIAKARKSGQRVIGEPVASGLALDESWLWHPDFETAAKYVMSPPIRKRGHDKALQAALSTGVLQLVGTDHCAFNSTQKALGIDDFRKIPNGVNGIEERMHLVWDIMVESGQISVTDYVRLTSTECARIFNIYPRKGAILPGSDADIIILNPNSTFEITAKSHHSKLDTNVYEGRSGKGKIEVTIAGGRVVWENNELKVAPGTGRYIKMPPFSYLFNGIDKKDAFYLNSLQAPVKRAKSNT

SEQ ID NO: 95162 - protein, 385 aa, Glycine max
  Coding DNA Sequence Number=SeqID_3477
  Gene Ontology: Mol. function=metal ion binding; Cellular component =integral to membrane; Biological process=ubiquitin cycle
  Homolog annotation: Hit_ID=A7Q662; Match level="QueryCoverage=64%, HitCoverage=68%, E-value=2e-53, Identity=48%"; Hit description =Chromosome undetermined scaffold_55, whole genome shotgun sequence
  Pfam annotation: Domain name=PHD; Domain location=166-211; Score= -2.0; E_value=0.023; Accession=PF00628.20; Description=PHD-finger
  Pfam annotation: Domain name=zf-C3HC4; Domain location=167-208; Score= 40.0; E_value=8.4e-09; Accession=PF00097.16; Description=Zinc finger, C3HC4 type (RING finger)
  Pfam module annotation: Pfam domain module=PHD::zf-C3HC4; Domain location=166-211::167-208
MGLHHHRKLMPLPEICGSICHVKKSELCSSDCKVCLKICLTNYSPPTLPPQVPPFQSYDDGAADQAYNHKISTYLFLALALLTAAFFVVCCRAIYTRFSSRRRVSSTSRRQNQTHHDDDDFVDEENGPMVDHPIWYIRTLGLQQSIINAITVCKYKKGEGLIEGTDCAVCLSEFQEDENLRLLPKCHHAFHLPCIDTWLRSHTNCPMCRAPIVADLATARMESSFVDSSSLENSHMEVLENSAPDSELMNNRAEEEEGQLEVEDGVRVCETETPVEDVASTLPRSSVSLDSFSFANFNLALATVESNGNSKRVLGGVDDDPTASKGVIGNDLATSSKGSSSFRLARYLQGVPSSSVKRSQSFNGKYLLSWYGCSQKKPNAPLRSF

SEQ ID NO: 95163 - protein, 1173 aa, Glycine max
  Coding DNA Sequence Number=SeqID_3478
  Gene Ontology: Mol. function=nucleoside-triphosphatase activity; Cellular component=flagellin-based flagellum; Biological process=DNA replication initiation
  Homolog annotation: Hit_ID=UPI000034EF08; Match level="QueryCoverage =54%, HitCoverage=80%, E-value=1e-151, Identity=60%"; Hit description= minichromosome maintenance family protein / MCM family protein
  Pfam annotation: Domain name=F-box; Domain location=790-837; Score =35.2; E_value=2.3e-07; Accession=PF00646.24; Description=F-box domain
  Pfam annotation: Domain name=FBA_3; Domain location=1000-1100; Score=- 25.1; E_value=0.0075; Accession=PF08268.3; Description=F-box associated
  Pfam annotation: Domain name=MCM; Domain location=288-675; Score =142.8; E_value=9.8e-40; Accession=PF00493.14; Description=MCM235 family
  Pfam annotation: Domain name=efhand; Domain location=642-670; Score =40.7; E_value=5.2e-09; Accession=PF00036.23; Description=EF hand
  Pfam annotation: Domain name=efhand; Domain location=678-706; Score =36.1; E_value=1.3e-07; Accession=PF00036.23; Description=EF hand
  Pfam annotation: Domain name=efhand; Domain location=715-743; Score =25.1; E_value=0.00025; Accession=PF00036.23; Description=EF hand
  Pfam module annotation: Pfam domain module=F-box::FBA_3::MCM::efhand:: efhand::efhand; Domain location=790-837::1000-1100::288-675::642 -670::678-706::715-743
MEKEKENWEMPMATFLIDHHSDQLRSISSSPDPNLHFPLFIDYAELMEDNPRIARLLFAQPKTYLPVFDDAALWAHKIVLREMPDDKKGVEKKFIHVRINISGSPLECPETFPSIGRVRVHHRGILLTLKGIVIRSGAIKMHEGERKYICQKCKNSFPVYPEVEARNSISLPSICPIQQSKPCGGTKFQYEENTIVCHDYQEIKIQESTQVLGVGAIPRSILVILKDDLVDVVKAGDDVIVTGLLTAKWSPELKDVRCDLDPVLIANNIRRINELKSEIDISDDMVKKFEQFWVHFKDSPLKGGRNAILRAICPQVFGLFTVKLAVALTLIGGVQHVDASGTRVRGESHLLLVGDPGMQSIALTISTAATGTGKSQFLKFAAKLSNRSVITTGLGSTSAGLTVTAVKDGGQFVESLGEWMLEAGALVLADGGLCCIDEFDRPGLDLHLIGYTCALPGSLDNLKLVEALDAFMKLDSSYLMEILAGLYIFILHPGIGYVTKHYFGSMREHDRATIHEAMEQQTISVAKAGLVTTLSTRTTVFGATNPKGQYDPDQLLLQFNYYCFSSILVRLNPRFDIVLVLLDTKNPDWDAVVSSHILSEAELDRTTNDEDLVNSWPLPTLKRRYNNKPRGRHNLTTQKKQEIKEAFELFDTDGSGTIDAKELNVAMRALGFEMTEEQINQMIADVDKDGSGAIDYEEFEYMMTAKIGERDTKEELMKAFHIIDHDKNGKISALDIKRIAKELGQNFTDREIQEMVEEADQDKIPNLAHILAIRRGKEPGRSLEMVDGNLKQEFLPYDVIINILKRLPVKSLIRFKCVSKDWFNLFQNTPNFFTQQHLNHSAHTNAFLLLQRIPRQPRPLPFSTCLIGPDINFVHPPQFFDIASPAAKIVASCNGILCLRDKTALSLFNPASRQIKQVPGTTLFGLYYVGFGFSPVANDYKIVRISMGVFDEEHQVVVLDNVRVDRAEVYSLTTGSWRQIDATKLRPLCLVSSSVATTETIFWLATMTSDSDTDSEIVVSFDIGREMFTLLNGPPLPPSPTRSYDNVLAECNDKLAVFRHYIIGDYESCSFDLWVLEDVHNHTSSGESWIKMYSVGPFSRVLYPLSIWRDLIVCREELSRRGNNYRIVETVLSLFNPLSNELKKLPANRDEFCYVPFTYVESLVPVGHIHHEQ

SEQ ID NO: 95164 - protein, 45 aa, Glycine max
  Coding DNA Sequence Number=SeqID_3479
MADKTCELRKLNGEELLGLKIRELQKLEKLIRKVEGDLLGQCLLE

SEQ ID NO: 95165 - protein, 494 aa, Glycine max
  Coding DNA Sequence Number=SeqID_3480
  Homolog annotation: Hit_ID=A7NUN6; Match level="QueryCoverage=85%, HitCoverage=98%, E-value=1e-81, Identity=43%"; Hit description =Chromosome chr18 scaffold_1, whole genome shotgun sequence
MEVERMRQLMLMWCRIRSNRVALVGGNHTAASTMKNKHLHDGRTIAALNPESFLVIRIPDALVLRILSRSLFVAMVLAALPFLGTVLKGFYFSSSFVPNVETAAASGSLDVGLLNSILHDFAHEGLLRENDKALVLNSPLPNVFREKIDVVMDSDWESKSLFADVSYDFVFTSGDIDAEFIDRILKIDGIVALPLGSKPSNSAFKEQNNYRVVSLKRYGTAVVVALKKTGPAVRLVDSDSSPKRKLLATKTEAKSVALKGLEDVLLEPPRKALVKSRKYLNKIKYLPDLVGDSLEGYKRRVFIGVGLPEENKGVMQWFKENYPKKNTKFETHSVAVVPEDHFAVSAWLSKNVKEEEYVVMKAEAGVVEEMMKTRTIRLVDELFLECKNEWWQRGKTMKKNERTYWECLALYGRVRDEGVAGGSVRIKGEGNLYSGQSVTGGNGGKITRGGELFILGNVGARSFLLAWTLPMDKSDKAMKKNDRRSTRKEAILVV

SEQ ID NO: 95166 - protein, 665 aa, Glycine max
  Coding DNA Sequence Number=SeqID_3481
  Gene Ontology: Mol. function=RNA binding; Biological process =gynoecium development
  Homolog annotation: Hit_ID=A2Q1N9; Match level="QueryCoverage=92%, HitCoverage=81%, E-value=1e-110, Identity=47%"; Hit description=KH, type 1
  Pfam annotation: Domain name=KH_1; Domain location=146-195; Score =30.0; E_value=8.9e-06; Accession=PF00013.20; Description=KH domain
  Pfam annotation: Domain name=KH_1; Domain location=358-426; Score =40.4; E_value=6.4e-09; Accession=PF00013.20; Description=KH domain
  Pfam annotation: Domain name=KH_1; Domain location=450-517; Score =60.1; E_value=7.7e-15; Accession=PF00013.20; Description=KH domain
  Pfam annotation: Domain name=KH_1; Domain location=46-106; Score =46.8; E_value=7.7e-11; Accession=PF00013.20; Description=KH domain
  Pfam annotation: Domain name=KH_2; Domain location=146-189; Score =6.1; E_value=0.065; Accession=PF07650.8; Description=KH domain
  Pfam annotation: Domain name=KH_2; Domain location=46-96; Score=6.9; E_value=0.054; Accession=PF07650.8; Description=KH domain
  Pfam module annotation: Pfam domain module=KH_1::KH_1::KH_1::KH_1::KH_ 2::KH_2; Domain location=146-195::358-426::450-517::46-106::146 -189::46-96
  Subcellular localization annotation: CTP_CleavageSite=52; ConfidenceScore=5.68e-01
MGSNFLSPPAKRSAPDPYPFHPNGPSKRSRQSKPPPPLSVPPGHVAFRLLCNASRIGGVIGKSGSVIKTLQQSTGAKIRIEDAPQELPDRIILVIADAALSGKILLRNEEVIEVSKAQEALLKVFDRILEVAAETEGVDVGDRVMSCRLVADAAQAGSVIGKGGKVVERIKKETGCKIRVLTDDLPLCASASDEIIEVFLLPALLRFSICHSTFRILLRDVRCQKTYLDILEVEKIEGRVSSVKKALVAVSQRLQDCHPVDRTKMMGSKPYEIVQYEALDALPRATSTAAPRVTLTAAPRGTLTAVQHETVDHLLLRSSALSTLSSSSNSYATRIHSLPTEVNRVSSLEPKALKQEVTFRILCSNDRVGGVIGKGGNIVRALQSETGATISIGPAVAECEDRLITIAASENPESRYSPAQKAAVLVFSRSIEVGFEKGLDSGLNKGSIVTVRLVVPSSQVGCLIGKGGVIVSEMRKATGANIRIIGTDQVPKCASDNDQVVQISGEFSSVQDALYNAMGRLRDNLFVSTQNSAGTRSLSSLRVDTSPYGRQQDVVPLGSQLPPATSHSLSRHTFAQGIDHLGLSRNLDHPSSPGLWTRNLDRPSSPGLWTRNLDRPSSPGLWTRNLDRPSSPGLWTRNLDRPSSPGLWAPPVYLSLCAGQLYLDK

SEQ ID NO: 95167 - protein, 952 aa, Glycine max
  Coding DNA Sequence Number=SeqID_3482
  Gene Ontology: Mol. function=microtubule motor activity; Cellular component=microtubule associated complex; Biological process =microtubule-based movement
  Homolog annotation: Hit_ID=Q2HVA4; Match level="QueryCoverage=92%, HitCoverage=96%, E-value=0.0, Identity=57%"; Hit description =Centromere protein, putative
  Pfam annotation: Domain name=Filament; Domain location=181-422; Score= -191.5; E_value=0.057; Accession=PF00038.12; Description=Intermediate filament protein
MDNVYTELDSAKAEVEKLKAECRLKTQLFDGLKRDRAEEFLKFQETKKLAEVQARELDLKSEEIHELKKILEDLKSSLHEKEAHVAHLSSENKKIQASSTDRLLELEGSNRELVLALVEVRATNGSLEQNACASSNEISSLKELLLAAEKKCSDAEEKAQQATMLKRRDDVILQLEEENISMKDKIKWRNEQFKHLEEAHEKLQVEFRLSKEEWNKERSLLLEEMSSLQISLDSQTRNVEGLQSRLEMCNHALAHEESRRKLLEVEFSEFKSSFENVFTQYEEKKSEIQLLTILRNDKIAQMRNSLGEKEMVVRELERKIVQLEQDNKELGDLLKELREAQINNGGANSVTSKLRNKLRRLEEVHKNCASILKSKESQRGDQVAKMEADIVTYKSTLTNKEQEIRELEMELENCYYAIEENRLGLLIFKSELAEAYSKSFRGRADPDKAFDIKENEDMVLISAEQLRVKDKSLKTMAQAAQQHSLLEEELKQQKKKLEESSEGQLILEEQLLQMEYTLQYERSAAFEALEVLEHEIASKNDEISRLDCEVQVWKSTAETLKVSYEEIQGTSKKMKASLLSHIETEQALKQANENLLCIVKDQERKTEDLLLQIGLLERCNAEKMKEAERCKQENEGLIQIVEERECCIKDLHKDIAISCLKQESMEKELEDAIHAQLDAEKALKQEKEILLKIKDVKDRTIEHLQGLATASEQDLLGALCFSFSKQVEKWIEVSVLRDALKNAEYLAKLEIEEKNTRIVKSEESIFHLKQEAEQLQASLEALKFENEKLTDKQQAMEFMITELKFENGNLLQDIMNLSTEREDMLVHFEVIFGRIGELSSGDMQLMEMLGNVLNTSEDENEIAMGSVVCDKPHESARDRMCNLADGNARKVQVQNNILFTLACLIVYDIKCTGLALHLGCSDTLQDSLNGQRRRQLSDAFVKLDFGGSQPDA

SEQ ID NO: 95168 - protein, 181 aa, Glycine max
  Coding DNA Sequence Number=SeqID_3483
  Gene Ontology: Mol. function=sequence-specific DNA binding; Cellular component=nucleus; Biological process=regulation of transcription, DNA-dependent
  Homolog annotation: Hit_ID=A7QWA5; Match level="QueryCoverage=55%, HitCoverage=42%, E-value=2e-31, Identity=67%"; Hit description =Chromosome undetermined scaffold_201, whole genome shotgun sequence
  Pfam annotation: Domain name=K-box; Domain location=1-62; Score=5.7; E_value=0.00015; Accession=PF01486.8; Description=K-box region
MGEELMGLGIKELQSLENQLEMSLKGVRMKKDQILTNEIEELRQKGNLIHQENVELYQKMEQIQKENAELQKKVYEARSTNEENVASNPSYKVRNGYDLHAPISLQLSQPQPQYSEPSAKAIKLGYPLKLIYQAWKCFCKNICNLMLALDMDKLDYFGLNIFSDEMMINVNVLGSFMMSKG

SEQ ID NO: 95169 - protein, 432 aa, Glycine max
  Coding DNA Sequence Number=SeqID_3484
  Gene Ontology: Mol. function=methylmalonate-semialdehyde dehydrogenase (acylating) activity; Cellular component =mitochondrion; Biological process=valine metabolic process
  Homolog annotation: Hit_ID=Q2HV89; Match level="QueryCoverage=90%, HitCoverage=87%, E-value=1e-163, Identity=67%"; Hit description =Aldehyde dehydrogenase
  Pfam annotation: Domain name=Aldedh; Domain location=30-414; Score =356.6; E_value=4.2e-104; Accession=PF00171.13; Description=Aldehyde dehydrogenase family
MANSHLSTPSELFSRQHKPPRVPNLIGGSFLDSKSLTFIDVINPATQEVVSQVPCTTDEEFKAAVSAAKKAFPSWRKTPITKRQRVMLKFQELIRRDMDKLALNVTTEQGKTLKDAQGDVFRGLGWSFYGIDTYSIREPLGVCAGICPFNFPAMIPLWMFPVAVTCGNTFILKPSEKVPGASVMLAELAMEAGLPEGVLNIVHGTHDIVNAICDDDDIKAISFVGSNVAGMHIYARAAAKGKRVQANMGAKNHAVVMPDASVDATVNALVAAGFGAAGQRESKLVEHAKALKVNVGTEPDADLGPVISKQVPGYESGNFIGPTILSDVTANMECYKEEIFGPVLLLTEADNLEEAINIINENKYGNGASIFTTSGVAARKFQTEIEAGQEVHALSAECHAKRAYEGPKPTSAAINRESVQGTEHTPPQNPLS

SEQ ID NO: 95170 - protein, 1390 aa, Glycine max
  Coding DNA Sequence Number=SeqID_3485
  Gene Ontology: Mol. function=DNA-directed DNA polymerase activity; Cellular component=nucleolus; Biological process=transcription
  Homolog annotation: Hit_ID=A2Q1A6; Match level="QueryCoverage=99%, HitCoverage=99%, E-value=0.0, Identity=61%"; Hit description=DNA polymerase V
  Pfam annotation: Domain name=DNA_pol_phi; Domain location=298-1078; Score=485.0; E_value=9.5e-143; Accession=PF04931.4; Description=DNA polymerase phi
MGSSSKKRSSATEEQTLAAADAPKPLIKKPKNTTTDDDSQQQQQPSVKPMERKKKRKALDKERRRTTSQPEPEHAASEPKPAPPSTDSPSSSGGVMPEFHIGVFKDLAAASESAREAAAKQMVTELKAVQNAYDSREEKESGEGGLKLEAEKDDGLDNCASSVRYAVRRLIRGVSSSRECARQGFALGLTVLAGTVHNIKVDSFLKLVVNLLEVTSSMKGQEAKDCLLGRLFAYGALARSGRLTQEWNMEKSTPYIREFISVLISLANKKRYLQEPAVSIILDLVEKIVYSHCLYPGTSSCENDWIASTFSMSDPCMHMSMCIDPHRHLQTTTCIIESVYAMSGSLSHRLPVEALVNHVLEAPGLQEWFEAAIEVGNPDALLLALKVREKISIDSSVFGKLLPNPFSSSQLFSADHLSSLSNCLKESTFCQPRVHSVWPVLINILLPNTILQLEDAASASNSLKKHKKSRKSSSSDEEIAKNLQNFCEIIIEGSLLISSHDRKHLAFDVLFLLLQKLPASLVPVVLSNKVVQCLVDVLSTKNTWLFKVAQHFLKQLSDWVGDDDVRRVSVIVAIQKHSNGKFDRITRTKHVKDFMSQFKTEPGCMLFIQNLMNLFVDEGNALEEPSDQSQTTDENSEIGSIEDKDSPRTNGNSDFLKSWVIESLPSILKFLKLDHEEKFRVQKEIMKFLAVQGLFTASLGSEVTSFELQEKFRWPKSPTSNALCKMCIDQLQLLLANAQKGEGSCPLANSVEPNDLGSYFMKFFGTLCNIPSVSLFRSLDDVDQKAVKKLQAMETRLSREERSRDCSTDANRLHALRYLLIQLLLQVLLHPGEFSEAASELVICCKKAFSTSDLPESSGEDDVEVDDAPELMDVLVDTLLSLLPQSSAPMRSSIEQDWSDFTYSIKNEKDELPGFNGWYEHAIQKWMQPVTYLAMVFKYFCGDITNDGLMRMLRVIKKNLKPARHPDAANADDDDDEDDDFIDIEEEEIDQAETGETGESDGQTDDSESVVEVEETDHGHSEASDDSDSGMDDDAMFRIDTYLAQIFKEKKNQAGGETAHSQLVLFKLRILSLLEIFLHENPGNSKLPCIERGVLHMTLEFAQIGSQKNGKPQVLMVYSNLAQAFVNPHTAEVSEQLGQRIWGILQKQIFKAKDYPRGDGVQLSNLESLLEKSLKLASKPFKRQKSASNLSKQSAAWNRQKMISSLAQTSTFWILKIIDSRNFAESELERIVLIFREVLVGYFDKKSQIKSGFLKEIIRRRPWIGHAIFGFILERCGSAKSDFRRVEALELVMEILKSLSTGNSDEQNASKKILKNSLDKLSHLLKELVTNMPSKPARRTEVQKFCVKALEILSKLNLTKNFVKTLAPDTQAALEAQLGEQFISLKKLEK

SEQ ID NO: 95171 - protein, 23 aa, Glycine max
  Coding DNA Sequence Number=SeqID_3486
MENEEAKNTNGSAKELYRGESNI

SEQ ID NO: 95172 - protein, 746 aa, Glycine max
  Coding DNA Sequence Number=SeqID_3487
  Gene Ontology: Mol. function=oligopeptide transporter activity; Cellular component=integral to membrane; Biological process =oligopeptide transport
  Homolog annotation: Hit_ID=A7UQT0; Match level="QueryCoverage=96%, HitCoverage=98%, E-value=0.0, Identity=83%"; Hit description =Peptidase aspartic, active site; Oligopeptide transporter OPT superfamily
  Pfam annotation: Domain name=OPT; Domain location=39-700; Score =851.7; E_value=3.9e-253; Accession=PF03169.6; Description=OPT oligopeptide transporter protein
MSSDPEKRVTSEVVEDDELSPIEEVRLTVTNTDDPTRPVWTFRMWFLGLLSCSLLSFLNQFFAYRTEPLIITQITVQVATLPIGHFMAAFLPTTTFSIPGFGSKSFSFNPGPFNMKEHVLITIFANAGSAFGSGSPYAVGIVNIIKAFYGRSISFAASWLLIITTQVLGYGWAGLLRKYVVEPAHMWWPSTLVQVSLFRALHEKDDHRLSRAKFFFIALVCSFSWYVVPGYLFTTLTNISWVCWIFSKSVTAQQIGSGMRGLGVGALTLDWAAVASFLFSPLISPFFAIVNVFVGYALIVYVVIPVSYWGLNVYNANRFPIFSSHLFTAQGQKYNIPKIVDNHFELNVAEYEKQGRIHLSVFFALTYGFGFATIASTLTHVVCFYGREIMERYRASSKGKEDIHTKLMRRYKDIPSWWFHSLLLVTLLVSLALCIFLKDQVQMPWWGLLFAGVLAFGFTLPISIITATTNQTPGLNIITEYVFGLIYPGRPIANVCFKTYGYISMAQAVSFLSDFKLGHYMKIPPRSMFLVQFIGTMLAGTINIGVAWWLLNSIKNICHDDLLPEGSPWTCPGDRVFFDASVIWGLVGPKRIFGSQGNYSAMNWFFLGGAVGPIIVWLLHKAFPKQSWIPLINLPVLLGATGMMPPATPLNYNAWIFVGTIFNFFIFRYRKKWWQRYNYVLSAALDSGVAFMTVLLYFALGLENKSLNWWGNDGEHCPLAVCPTAKGVIVDGAGQAACYLFEEENT

SEQ ID NO: 95173 - protein, 165 aa, Glycine max
  Coding DNA Sequence Number=SeqID_3488
  Gene Ontology: Mol. function=transporter activity; Cellular component= integral to membrane; Biological process=transport
  Homolog annotation: Hit_ID=A7R3Z5; Match level="QueryCoverage=81%, HitCoverage=25%, E-value=1e-34, Identity=59%"; Hit description =Chromosome undetermined scaffold_592, whole genome shotgun sequence
  Pfam annotation: Domain name=SelR; Domain location=2-51; Score=-73.6; E_value=0.092; Accession=PF01641.9; Description=SelR domain
MAIGFPGTGEYDKFYEEGVYNCAGCGTPLYSLAAPFIDDNAPVTQVCFFPKDDILSILLAWLAIFYMHIPSGYALGYVYGCLVGSHLGWRYAFWVESLLMIPFAISGLFMKPLQLRGLVPADSKKALTPETVASGVQVMEASNGRDESLSLKAELRDKSSNDHSK

SEQ ID NO: 95174 - protein, 345 aa, Glycine max
  Coding DNA Sequence Number=SeqID_3489
  Gene Ontology: Mol. function=transcription regulator activity; Cellular component=nucleus; Biological process=regulation of transcription
  Homolog annotation: Hit_ID=O81348; Match level="QueryCoverage=92%, HitCoverage=91%, E-value=1e-170, Identity=96%"; Hit description =Symbiotic ammonium transporter
  Pfam annotation: Domain name=HLH; Domain location=164-213; Score =49.5; E_value=1.1e-11; Accession=PF00010.17; Description=Helix-loop -helix DNA-binding domain
MEISSIRGLPELGIIEDPNFLHQWQLNSIDTTSLKGAAFGDILQKHSFSDNSNFNPKTSMETSQTGIERYAKQLGDNSWNHNKSQQQTPETQFASCSNLLSFVNTNYTSELGLVKPKVEMACPKIDNNALADMLISQGTLGNQNYIFKASQETKKIKTRPKLSQPQDHIIAERKRREKLSQRFIALSALVPGLKKMDKASVLGEAIKYLKQMQEKVSALEEEQNRKRTVESVVIVKKSQLSSDAEDSSSETGGTFVEALPEIEARFWERNVLIRIHCEKNKGVIEKTISEIEKLHLKVINSSALTFGSFILDITIIAQVISAPIPLAETLVHTNQVQSIYVSVSN

SEQ ID NO: 95175 - protein, 70 aa, Glycine max
  Coding DNA Sequence Number=SeqID_3490
MQFNSYHHFQRRLPIKLRVRDTTTHDGNVGVVKGKAGVPAVEVGDLEVVSDIEEEVLRLEVAVGNIAAVT

SEQ ID NO: 95176 - protein, 129 aa, Glycine max
  Coding DNA Sequence Number=SeqID_3491
MAFSSSLWSSLSVANPNRTYFNNSDGDKEVVREYFNNTDEVGPRQDGREHAEHVEGRRFPSRRYDLRRWVWYRFSLPLAKEGGEVFELERDVVDELGSGRIRSCHRGGGEGGKGGAWRGWKEYSLEDRI

SEQ ID NO: 95177 - protein, 814 aa, Glycine max
  Coding DNA Sequence Number=SeqID_3492
  Gene Ontology: Mol. function=protein binding; Cellular component =membrane of vacuole with cell cycle-correlated morphology; Biological process=mitochondrion organization and biogenesis
  Homolog annotation: Hit_ID=A5BCY3; Match level="QueryCoverage=100%, HitCoverage=100%, E-value=1e-154, Identity=67%"; Hit description =Putative uncharacterized protein
  Pfam annotation: Domain name=CBS; Domain location=210-325; Score =31.8; E_value=2.4e-06; Accession=PF00571.19; Description=CBS domain
  Pfam annotation: Domain name=DUF21; Domain location=14-191; Score =181.6; E_value=2e-51; Accession=PF01595.11; Description=Domain of unknown function DUF21
  Pfam annotation: Domain name=DUF21; Domain location=446-623; Score =175.1; E_value=1.8e-49; Accession=PF01595.11; Description=Domain of unknown function DUF21
  Pfam module annotation: Pfam domain module=CBS::DUF21::DUF21; Domain location=210-325::14-191::446-623
MAVEYQCCETQFFIRLLIILLLVLFAGLMSGLTLGLMSLSLVDLEVLAKSGTPQGRKHAAKILPVVRNQHLLLCTLLICNAAAMEALPIFLDGLVVAWGAVLISVTLILLFGEIIPQSICSRYGLAIGATVAPFVRVLVWICFPVAYPISKLLDYLLGHRHEALFRRAELKTLVNLHGNEAGKGGELTHDETTIIAGALELSEKTASDAMTPITEIFSVDINAKLDRDLMSLILEKGHSRVPVYYEQPTNIFGLVLAKNLLTIDPEEEIPVKSVTIRRIPRVPETLPLYDILNEFQKGHSHMAVVVRHFEKTRQQSSNNNADVRDVKVDIDGEKTPQGNILKTKRKWSKNMYSYILEIDGNSLPSLPEKEEAVGIITMKDVIEELLQSRFLKLFGSSGFNKISRFGRTILGHMHKRSNSEIGLIMPPDSVVSMGVEYTCCDMEFYKRILIIVLLVMFAGLMSGLTLGLMSLSIVDLEVLAKSGTPQDRNNAAKILPVVRNQHLLLCTLLICNAIAMEALPIFLDSLVVAWGAILISVTLILLFGEIIPQSICSRYGLAIGATVAPVVRVLVWVCFPVAYPISKLLDFLLGHRHKALFHRAELKTLVNLHGHEAGKGGELTHHETTIIAGALELAEKTAGDAMTPITEAFCIDINSKLDMYLMNLILENGHSRVPVFYDQPTNIIGLILGHSHMAIVVKHCDKTGYQSSNNNAYARDVKVDIDGEKPPREKNLKTKMSCHKRKSFPNANNLNKGSPQSRKWSKNMYSDILEIDGNSIPKLPEKEAAVGIITMEDVIEELLQGEIFDETDHDFEVS

SEQ ID NO: 95178 - protein, 178 aa, Glycine max
  Coding DNA Sequence Number=SeqID_3493
  Gene Ontology: Mol. function=aspartic-type endopeptidase activity; Cellular component=extracellular region; Biological process=response to biotic stimulus
  Homolog annotation: Hit_ID=Q9XFB4; Match level="QueryCoverage=67%, HitCoverage=74%, E-value=1e-58, Identity=82%"; Hit description=PR1a precursor
  Pfam annotation: Domain name=SCP; Domain location=7-123; Score=103.9; E_value=5.1e-28; Accession=PF00188.17; Description=SCP-like extracellular protein
MLKIQHVDAHNAARSEVGVPDLAWDDSVAAYAENYANQRKGDCALIHSGGEYGENIAMSTGELSGTDAVKMWVDEKANYDHDSNSCVGGECLHYTQVVWRDSVRLGCAKVTCDNGGTFITCNYDPLPPNQSQKNDDLESVHRWIVVKFEYHVRNTIPSILTVGNFDIMSEMREKPFAL

SEQ ID NO: 95179 - protein, 175 aa, Glycine max
  Coding DNA Sequence Number=SeqID_3494
  Homolog annotation: Hit_ID=O81898; Match level="QueryCoverage=92%, HitCoverage=96%, E-value=5e-45, Identity=54%"; Hit description =Putative uncharacterized protein T6K22.40
  Pfam annotation: Domain name=DUF1218; Domain location=44-152; Score =124.0; E_value=4.3e-34; Accession=PF06749.3; Description=Protein of unknown function (DUF1218)
MTKNYGFLICILVIVLDIVAGILGIEAEIAQNKEKHMWVWIFECRYPSYQAFKLGLAAATFLALAHVIANLLGGCICVWSKEQYLSATANRKLAVAFLIFSWVVLAVALSMLMIGTLANSRSRKSCGMFSRHFLSIGGILCFIHGLFTVPYYVSATATKRDEKRPENASHTLDHL

SEQ ID NO: 95180 - protein, 262 aa, Glycine max
  Coding DNA Sequence Number=SeqID_3495
  Gene Ontology: Mol. function=NADPH:quinone reductase activity; Cellular component=flagellum; Biological process=negative regulation of transcription
  Homolog annotation: Hit_ID=Q8L5Q7; Match level="QueryCoverage=74%, HitCoverage=95%, E-value=1e-102, Identity=91%"; Hit description =Putative quinone oxidoreductase
  Pfam annotation: Domain name=FMN_red; Domain location=70-247; Score= -35.0; E_value=0.016; Accession=PF03358.6; Description=NADPH -dependent FMN reductase
  Pfam annotation: Domain name=Flavodoxin_1; Domain location=68-197; Score=64.7; E_value=3e-16; Accession=PF00258.16; Description =Flavodoxin
  Pfam module annotation: Pfam domain module=FMN_red::Flavodoxin_1; Domain location=70-247::68-197
METGRQDRAVQVTTNGYQGLYCIITLIILLSICRLMNWVGVFGEKRDLGLARAIGEFHPTFSQNEKSYYSTYGHVEKLAREIEKGAASVEGVEAKLWQVPETLPEEVLAKLGAPPKSDAPIITPNELPEADGFLFGFPTRFGSMAAQFKAFFDATGGLWRTQSLAGKPAGFFYSTSSQGGGQETTPLTSITQLVHHGLIFVPIGYTFGGGMFEMEKVKGGSPYGAGTYAGDGSRQPSELELAQAFHQGKYFAGIAKKLKGSQ

SEQ ID NO: 95181 - protein, 218 aa, Glycine max
  Coding DNA Sequence Number=SeqID_3496
  Gene Ontology: Mol. function=transcription regulator activity; Cellular component=nucleus; Biological process=regulation of transcription
  Homolog annotation: Hit_ID=A5BG38; Match level="QueryCoverage=87%, HitCoverage=91%, E-value=3e-46, Identity=53%"; Hit description =Putative uncharacterized protein
  Pfam annotation: Domain name=HLH; Domain location=42-91; Score=20.4; E_value=0.0011; Accession=PF00010.17; Description=Helix-loop-helix DNA-binding domain
MEYQDEDHLCFTMEEFALATENVSSRQRMSRKRNYDDDTRVYKSKNLEIERRRREKLSTRLLMLRSINPIITNMNRGTIIVDAITYIEKLQHEVQRLSQELHQLEATSEKTAEAKVDEIDAVEDMKHWGIQAEVRVAQIDENKLWVKIIIEKKRGRFSKLMEALNNFGIELIDTNFTTTKGAFLITSCIQVKDGERLEIHQSKSLLQEIINDISSKSE

SEQ ID NO: 95182 - protein, 368 aa, Glycine max
  Coding DNA Sequence Number=SeqID_3497
  Gene Ontology: Mol. function=ubiquitin-protein ligase activity; Cellular component=ubiquitin ligase complex; Biological process =protein ubiquitination
  Homolog annotation: Hit_ID=A7R2Q8; Match level="QueryCoverage=95%, HitCoverage=99%, E-value=1e-104, Identity=58%"; Hit description =Chromosome undetermined scaffold_442, whole genome shotgun sequence
  Pfam annotation: Domain name=Arm; Domain location=116-157; Score=4.6; E_value=2.9; Accession=PF00514.14; Description=Armadillobeta-catenin -like repeat
  Pfam annotation: Domain name=Arm; Domain location=158-199; Score=7.3; E_value=1.3; Accession=PF00514.14; Description=Armadillobeta-catenin -like repeat
  Pfam annotation: Domain name=Arm; Domain location=203-241; Score=8.0; E_value=1.1; Accession=PF00514.14; Description=Armadillobeta-catenin -like repeat
  Pfam annotation: Domain name=Arm; Domain location=279-320; Score=7.5; E_value=1.2; Accession=PF00514.14; Description=Armadillobeta-catenin -like repeat
  Pfam annotation: Domain name=U-box; Domain location=6-81; Score=84.4; E_value=3.6e-22; Accession=PF04564.6; Description=U-box domain
  Pfam module annotation: Pfam domain module=Arm::Arm::Arm::Arm::U-box; Domain location=116-157::158-199::203-241::279-320::6-81
MAAEAQLPDHFKCPISLQIMSDPVILSSGHTFDRSSIQRWLDAGHRTCPITKLPLPAHSSLIPNHALRSLISNYAPINPQQHHHPQTLISSLTSLSSPLPSKLDALHHLTRLSHSDSLFRRRLFNSPALVPALLTCLQHISADLRHRALSLLLHLSLDDDAKVGLVAEGLLSPLITLLLSAAPSDCRALSATLLTSLAVLHVNKATIGAFPGSIHALVTLLRDGKGRERKEAATALYALCSFPDNRRRAVECSAVPVLLRSADSGLERSVEVIGVLAKCKEGREHMERFRGCVQILTRVLRNGSSRGVQYALMALYSLCCHSEETVVEALRNGVLDICQGLVEDDNAKVKRNSSCLVQLLRGNTHRLS

SEQ ID NO: 95183 - protein, 202 aa, Glycine max
  Coding DNA Sequence Number=SeqID_3498
  Gene Ontology: Mol. function=protein serine/threonine kinase activity; Cellular component=integral to membrane; Biological process=recognition or rejection of self pollen
  Homolog annotation: Hit_ID=A7QZK6; Match level="QueryCoverage=99%, HitCoverage=30%, E-value=3e-58, Identity=51%"; Hit description =Chromosome undetermined scaffold_278, whole genome shotgun sequence
  Pfam annotation: Domain name=Pkinase_Tyr; Domain location=1-186; Score=-115.5; E_value=2.5e-05; Accession=PF07714.8; Description =Protein tyrosine kinase
MNEVTVILKLQHRNLVRLLGCCIEGEEKMLIFEYMPNKSLDFYLFDPVKKVVLDWQKRLNVIEGISRELNPKILVRPKSLEAAKMRPILEGLCEHKKSDVFSFGVLLLEIISGRENSSFRNHELLLSLLGYAWQLWNEEEIVSLIDPEIFNPDNVNHILRCIHIGLLCVQELAKETPTMATVVSMLNSEVVNFPPPRQPSFI

SEQ ID NO: 95184 - protein, 198 aa, Glycine max
  Coding DNA Sequence Number=SeqID_3499
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=26%, HitCoverage=50%, E-value=9e-24, Identity=100%"; Hit description=LacZ protein
MWRLKIADGGNDPYIFSTNNFVGRQTWEFDSEAGTAEERAQIEAARQNFYENRFMVKACGDRLWRFQGREAKSGWGKRFPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 95185 - protein, 336 aa, Glycine max
  Coding DNA Sequence Number=SeqID_3500
  Gene Ontology: Mol. function=nutrient reservoir activity
  Homolog annotation: Hit_ID=Q2HSU3; Match level="QueryCoverage=68%, HitCoverage=54%, E-value=1e-64, Identity=53%"; Hit description=Cupin region
  Pfam annotation: Domain name=Cupin_1; Domain location=103-232; Score =9.6; E_value=7.6e-05; Accession=PF00190.13; Description=Cupin
MHPAGIRRRVAKNLHWATRGPNCVRGGSHATTIWTKFLQLKEEDKLYHLREIVQQEEGKEEEEFVDEEEQQTSWSWRKILESVFEDEVKNTREKVTKTSPLSCNLYDRKPDFKNCYGWSVDQDGSEYSPLKSSGVGIYHVNLSADGTPCESKGKRVWHRAERVRQNPNSVSKRKYFAFCQIASKNEPLEFFGFTTSAQKNRPQFLVGATSLMRTMVGPELAAAFGVSEETMRRMARAQHEAVILPTPWTAHAHDHKVVVDRVQKLTKNEMSVGRGPVTMLVQIVMVTKLVLTRIWCDFGKVDEVVDLGGDIFVQIEKGRFGVWIYANTERFVGGII

SEQ ID NO: 95186 - protein, 200 aa, Glycine max
  Coding DNA Sequence Number=SeqID_3501
  Gene Ontology: Mol. function=cysteine-type peptidase activity; Cellular component=cellular_component; Biological process=amino acid and derivative metabolic process
  Homolog annotation: Hit_ID=A7YFC1; Match level="QueryCoverage=77%, HitCoverage=60%, E-value=3e-67, Identity=79%"; Hit description =Otubain-like cysteine protease
MPMDLTKCFTVYTDWSYVYRKISTERKNLEIFLAYCSSVCLGETELFLEQLESVIQGKETSISHEELVLRSRDQSISDYVVMFFRFVTSAEIQKRAEFFEPFILGLTNTTVEQFCKSSVEPMGEESDHMHITALSDALGIPIRVVYLDRSSCDTGGVSVNHHDFMPVAGDLPNASCSSEKNIPFITLLYRPGHYDILYTK

SEQ ID NO: 95187 - protein, 86 aa, Glycine max
  Coding DNA Sequence Number=SeqID_3502
  Homolog annotation: Hit_ID=Q2HTU7; Match level="QueryCoverage=79%, HitCoverage=26%, E-value=4e-20, Identity=69%"; Hit description =Uncharacterized Cys-rich domain
MKLAGFGSCYIQAIVYFLLAIGAFVTFIAYTITRTHYFLYPAVALIIVVGAYLGFYRTRMRKKFNIKDVSDMNVKIDTAHGMVGVT

SEQ ID NO: 95188 - protein, 73 aa, Glycine max
  Coding DNA Sequence Number=SeqID_3503
MAELRDSEASPEIMDMKQKKKGFRSKEEEGFLEEAEGVFVWSPGAIYGVMLLKGEKQYNKNQGSEINHIRVPF

SEQ ID NO: 95189 - protein, 372 aa, Glycine max
  Coding DNA Sequence Number=SeqID_3504
  Gene Ontology: Mol. function=inositol or phosphatidylinositol phosphatase activity; Cellular component=mitochondrion; Biological process=sulfur metabolic process
  Homolog annotation: Hit_ID=A7R3G7; Match level="QueryCoverage=90%, HitCoverage=84%, E-value=1e-114, Identity=56%"; Hit description =Chromosome undetermined scaffold_521, whole genome shotgun sequence
  Pfam annotation: Domain name=Inositol_P; Domain location=41-371; Score=87.8; E_value=3.5e-23; Accession=PF00459.16; Description =Inositol monophosphatase family
  Subcellular localization annotation: CTP_CleavageSite=29; ConfidenceScore=5.10e-01
MAMDILRSPVSAVRLFNGGATRSRRFNVRATLPFPQQNAKHYKELQAAIDVVQRACRLCLNVKSSLFSTDGKVLEKNDQTPVTVADFGVQALISFELNKLFPSIPLVAEEDSAFLRTRNLADVCSHCIPGDEKMVVLDPIDGTRGFLKAGKALYVVGLALVVEGEIVIGVMGCPNWKEDLSEKSSVEIEEGWDSLGGSGTVMIAHKGCGTWMKSLNSQLKSSGVWTRCFVDGSDIIHKARFCIPDSQTWESLPLTSLFNATSNADNVGSNQILLLGACCGSLCKYLMVASGRASIFILRAKEKTIIKAWDHAVGIICVHEAGGKVTDWKGSDIDLAADHVGRRIIFPSGGVLVANGNLHNKILQIINQTSRV

SEQ ID NO: 95190 - protein, 226 aa, Glycine max
  Coding DNA Sequence Number=SeqID_3505
  Gene Ontology: Mol. function=binding
  Homolog annotation: Hit_ID=A7R4L4; Match level="QueryCoverage=100%, HitCoverage=44%, E-value=1e-74, Identity=56%"; Hit description =Chromosome undetermined scaffold_736, whole genome shotgun sequence
  Pfam annotation: Domain name=Arm; Domain location=1-34; Score=8.6; E _value=0.88; Accession=PF00514.14; Description=Armadillobeta-catenin -like repeat
  Pfam annotation: Domain name=Arm; Domain location=123-163; Score =18.0; E_value=0.035; Accession=PF00514.14; Description=Armadillobeta- catenin-like repeat
  Pfam annotation: Domain name=Arm; Domain location=36-79; Score=15.1; E_value=0.13; Accession=PF00514.14; Description=Armadillobeta -catenin-like repeat
  Pfam annotation: Domain name=HEAT; Domain location=130-165; Score =11.6; E_value=0.5; Accession=PF02985.13; Description=HEAT repeat
  Pfam annotation: Domain name=HEAT; Domain location=4-36; Score=6.3; E_ value=3.1; Accession=PF02985.13; Description=HEAT repeat
  Pfam module annotation: Pfam domain module=Arm::Arm::Arm::HEAT::HEAT; Domain location=1-34::123-163::36-79::130-165::4-36
MVEEGVVSTFVSLVRSKDEAVQVSSVELIQNIASGDELVRQMVIKEGGIRVLLRVLDPKWSCSSKTREVVMRVIDNLCFSSRSCVSVLLSYGFVDQLMYYVRNGEALIQELALKVAFRFCETSEEAKKALGDACFMAELVKFLNAKSFEVREMAAEALSSMVMVAKNRKRFVQDDRNISLLLQLLDPGEGNSERLAEAEVSSDAKRLVRKLSTNRFRSMLSGIWHS

SEQ ID NO: 95191 - protein, 845 aa, Glycine max
  Coding DNA Sequence Number=SeqID_3506
  Gene Ontology: Mol. function=zinc ion binding; Cellular component =mitochondrion; Biological process=regulation of transcription, DNA -dependent
  Homolog annotation: Hit_ID=Q8H349; Match level="QueryCoverage=91%, HitCoverage=91%, E-value=1e-174, Identity=43%"; Hit description =VP1/ABI3 family regulatory protein-like protein
  Pfam annotation: Domain name=B3; Domain location=301-404; Score=86.9; E_value=6.6e-23; Accession=PF02362.12; Description=B3 DNA binding domain
  Pfam annotation: Domain name=zf-CW; Domain location=533-578; Score =83.3; E_value=7.7e-22; Accession=PF07496.6; Description=CW-type Zinc Finger
  Pfam module annotation: Pfam domain module=B3::zf-CW; Domain location= 301-404::533-578
MASASSSSSKLCFNSDCKELKSERPKKGWRLRSGELAELCDRCGSAFEEGRFCEIFHSNASGWRSCETCRKPSNLPWPQSFPLQNRLSDRLRDLSGKGWSQLAGSGPVPWKQAPSLFNSASSSDMIPEVPSLVELSNSFDKMYCNERLPVSALEKKNEDLSGMSVNWNIKLGSREMMLMNGMRNEDKSSSCLNMCQQPSSLKEESSPQPFGLPVPNSCQNERNGKLGVTGSHPQQTPPPGKQFNGTMHLAPDSSGEAQVRNGRPRADARGRNQLLPRYWPRCTDLELQQISIEYPSNHMIVVLKTLSASDAGRIGRLVLPKKCAETYFPPISQPEGLPLKILDAKGKEWIFQFRFWPNNNSRMYVLEGVTPCIQSMQLQAGDTVTFSRLEPEGRLVMGFRKASSAVPSDQDNETKTGNGFSAHGEVELADPNSWSKVDKSGYIAKEALGSKSLISRKRKSNILGSKSKRLRIENEDLIELKITWQEAQGLLRPPPSHIPSIVVIEGFEFEEYEEAPVLGKPTIFTSDSVGEKIQWAQCEDCFKWRKLPASALLPSKWTCSDNSWDPERSSCSAAQELTAEQLENLLPPCSSAVPKKMKAAKQDPDNAEALEGLDTLANLAILGEGEALPASAQATTKHPRHRPGCSCIVCIQPPSGKGPKHKQTCTCNVCLTVKRRFRTLMLRREKKQSEKEAETTRKKQQQQHPQPLPSSEILLDEDSLPCSNTGDSSPNQNKEGNDGSDDDPNRIKSSALPFKGQIDLNIQPEREEELSPGSDSGGMMKLLHDATERYLKQQTVNSGTGDSSGSQSRLVGDAMREDKLSNGVAHGSGSHNTDKEHAQSLSMNV

SEQ ID NO: 95192 - protein, 43 aa, Glycine max
  Coding DNA Sequence Number=SeqID_3507
MAPPAGAATCYYSTTIQKKKKKKKKKEILRWVKMEIRSGRLQY

SEQ ID NO: 95193 - protein, 425 aa, Glycine max
  Coding DNA Sequence Number=SeqID_3508
  Gene Ontology: Mol. function=DNA binding; Cellular component=nucleus
  Homolog annotation: Hit_ID=A7R4S0; Match level="QueryCoverage=85%, HitCoverage=89%, E-value=2e-80, Identity=44%"; Hit description =Chromosome undetermined scaffold_764, whole genome shotgun sequence
  Pfam annotation: Domain name=Myb_DNA-binding; Domain location=6-59; Score=26.3; E_value=0.00012; Accession=PF00249.22; Description=Myb -like DNA-binding domain
MGTEVMGRWGTWEELLLGGAVLRYGTRNWNVVAAELRARTACPYTITPEVCKAKYEDLQQRYTGNKAWFEELRKTRVAELKRALELSEDSIGSLESKLESLEAGKNEKKDDCHVDKGSAGPKLHVASQKLERVESSTKETSKDGLSAGSFTHETRTNWSPECPVPAGFAEDMETKPEVSHSTEQAKVLNVDELTRTIYEGQGGSFKKRRGKRKRKDCGRNMKEASVGESDLLDSADVVSWCKESSTSNCGEVAKSCGVDDQNRNLKKDRVEDMMEILDFIFETKGASAFQRRLDSQSTREYKTALLLRGIVTKKMRESLKGTSNKATTQATNFPIKLLVHNPHVKPRSVRPGNRKIVAKAVGGKNSASGESHGTKKPSKVDSPSSVESLTMKKKGFGRPKKVGRGAAAGQRPAMPMKGKKRVRTK

SEQ ID NO: 95194 - protein, 67 aa, Glycine max
  Coding DNA Sequence Number=SeqID_3509
MKILLNLSHQSMKSNGVGTSCSCPELGGDDVPIPGSVAENGPTKEELLPGAPPPHHLRSHHRTRVRL

SEQ ID NO: 95195 - protein, 51 aa, Glycine max
  Coding DNA Sequence Number=SeqID_3510
MASQKTKTEKTKGEKLRKKGNEQEDAEEGSDNGLRPVSGHRITKRKLGNHT

SEQ ID NO: 95196 - protein, 1271 aa, Glycine max
  Coding DNA Sequence Number=SeqID_3511
  Gene Ontology: Mol. function=nucleic acid binding; Cellular component= nucleus; Biological process=metabolic process
  Homolog annotation: Hit_ID=A5AIW5; Match level="QueryCoverage=96%, HitCoverage=88%, E-value=0.0, Identity=51%"; Hit description =Putative uncharacterized protein
  Pfam annotation: Domain name=DEAD; Domain location=532-794; Score= -26.9; E_value=0.0043; Accession=PF00270.20; Description=DEADDEAH box helicase
  Pfam annotation: Domain name=Helicase_C; Domain location=1137-1215; Score=78.7; E_value=1.8e-20; Accession=PF00271.22; Description =Helicase conserved C-terminal domain
  Pfam annotation: Domain name=SNF2_N; Domain location=525-920; Score =153.5; E_value=5.8e-43; Accession=PF00176.14; Description=SNF2 family N-terminal domain
  Pfam annotation: Domain name=zf-C3HC4; Domain location=958-998; Score= 18.3; E_value=0.00074; Accession=PF00097.16; Description=Zinc finger, C3HC4 type (RING finger)
  Pfam module annotation: Pfam domain module=DEAD::Helicase_C::SNF2 _N::zf-C3HC4; Domain location=532-794::1137-1215::525-920::958-998
MCSCAFTVDPCLLTSASGNSVLECEHENQGPSSQTFSSPNALAGGFRDSSMLESDEFCFTEMTGVSNCETPAYIADRRFPVPEANSSSVAVCGDNLNLPLWKCENDSQIKHIGYDAQSEHASHGSIIENIDLNFGDYETYMEDIIGLSGKQENDSCTSFEMSFVDADRSSRVATSTDSSICQGSNVPNDFSDYYPSLNCYQGMDDRPVVANSSGCLPNGVYPHVRKNEEMVRNMKVAKMELFADTSSGMHSSINGGISFQDSQFRFADSKYASSFPGNVLFEDNASVELSTCGSYISREGQSLTVKAERDELIMPYQNSVHSNDAEFNVGQEMKQLPGIFPAVGCQGNDFFKCRDKVTIVTSQKAKYYQDGIDGAANNFQANMGNLNLKPLDKSLYNAQISIASGKQYNCVMSEGEGKAIEHRSIDSQLSKGSIERSIIEDDSDVCIIEDISHPAPISRSTVLGNSLITSQSSRGGYTHSYMVGSMGPKARDEQYILRVALQDLSQPKSEVSPPDGLLAVPLLRHQRIALSWMVQKETSSLYCSGGILADDQGLGKTVSTIGLILKERPPLLNKCNNAQKSELETLNLDADDDQLPENGIVKNESNMCQVSSRNPNQNMNLLLHAKGRPSAGTLIVCPTSVLRQWAEELHNKVTCKAKLSVLVYHGSNRTKNPHELAKYDVVLTTYSIVSMEVPKQPLVDKDDEEKGTYDDHAVSSKKRKCPPSSKSGKKGLDSAMLEAVARPLAKVAWFRVVLDEAQSIKNHRTQVARACWGLRAKRRWCLSGTPIQNAIDDLYSYFRFLRYDPYAVYTSFCSTIKIPISRSPSKGYRKLQAVLKTIMLRRTKATLLDGEPIISLPPKSVELKKVEFSPEERDFYSRLEADSRAQFQEYADAGTVKQNYVNILLMLLRLRQACDHPLLVKRYNSNSLWKSSVEMAKKLPQEKRLCLLKCLEASLALCGICNDPPEDAVVSVCGHVFCNQCICEYLTGDDNQCPAPNCKTRLSTPSVFSKVTLNSSFSDQPCDNLPDYSGCEVEESEFCSQAQPYDSSKIKAALEVLQSLSKPQCFASQNNSVQSTSGESTDGLGSSSSADRMKSLNEIPESQNVLEERSSNNSVGVGEKAIVFSQWTRMLDILEACLKNSSIQYRRLDGTMSVTARDKAVKDFNTLPEVSVMIMSLKAASLGLNMVAACHVLMLDLWWNPTTEDQAIDRAHRIGQTRPVTVLRLTVRDTVEDRILALQVSVGCSFWWKQKKQGAENFVAWPLLTLDMKII

SEQ ID NO: 95197 - protein, 940 aa, Glycine max
  Coding DNA Sequence Number=SeqID_3512
  Gene Ontology: Mol. function=transmembrane receptor activity; Cellular component=intrinsic to membrane; Biological process=innate immune response
  Homolog annotation: Hit_ID=A2Q4Q1; Match level="QueryCoverage=99%, HitCoverage=99%, E-value=0.0, Identity=64%"; Hit description=CIP7 , related
MDSNSKAILDYALFQLTPTRTRCELLVFRGGVHQKIASGLFEPFVSHLKFLKDEISKGGYSIKLLPPNHGGFWFTRATFERFVRFVSTPAILERFVSLENEILQIRSSFQANAFSMSVATPDEGSVPQANGITRRLSDSTKLNDVLEGVDNKEENSKVSLHRLLESRIALLRKEQAMAYTRGLVAGFEIDSIDDLIYFANAFGAARLSEACMNFKELWKKKHADDLWIKEVAAMQSSLPPALSLSGSSGIILANDITTHNSSRDSIASGDENVSLETLNSALNKKEGMPCADVNLPTADHKLSHTANVNMPMPWPYNVPPYMYNLQNPQMPSYQGYPMTNMQSVPPYLVPNMQWSPDLGVNQKPSETKRDKSHKKRAEEYQDQQTESSDPDSGSESDSDKQNHSSHSSKDDLKRKKHRRKSSRTVVIRNINYITPKRRNNEGGVSDESLEDDDGIDEETIKQKVGVALESLQKVHKVEKRAKGKKAAAWHNVTKSSDATEEDLTYNLSDASEGGKKNDNWDAFQNLLKIDEGTGTDGPERMQSIDIQDEHFVLRSSELRMPNGASSSPNLDFKEVLKNPKVPNDCFIVSQRDGGNEGGSKLDEYVDNCGPVTKSRDNIGEEMLLSHRSKEPGRNELGDPLSTFAADSLQTKGRAADDWFIVDNLEKMRSPDPTIVPAVFDGDYTSSVNDRSQSEKRSERTLIDDSFMIQGQLVDNDLSDSQWKTDLSMVADLTAANKLESDAAASNEKHALSKNQEPSDLFVVLQRDSGLDSVEASRTMDYEIDFSFSETNRRSSMDDSHAKVNDNLPVSPVKTNVRKSQVSGTRSSGKDEKSKVLRDYSGKSKPEIMSRARKPALPKKPIVQKSKREQEDEIRQKMEELRNERQRRIAERTASSGIARAATRKDQIEGKTARISAKSDKNKAQPVKETSRISSVKVRGI

SEQ ID NO: 95198 - protein, 47 aa, Glycine max
  Coding DNA Sequence Number=SeqID_3513
MVEDGITHEVVDKGGVTRDGGRRGWGTEKFTGKGKGKGCKDLVYNIY

SEQ ID NO: 95199 - protein, 258 aa, Glycine max
  Coding DNA Sequence Number=SeqID_3514
  Gene Ontology: Mol. function=nucleotide binding; Biological process =defense response
  Homolog annotation: Hit_ID=A2Q3B4; Match level="QueryCoverage=41%, HitCoverage=23%, E-value=2e-35, Identity=70%"; Hit description =Disease resistance protein; Calcium-binding EF-hand
MAEYFVFDIAESLLGKLASYVYEQASRACDLYEDVQGIIDTLSIVKGVLLDAEEKHGLLEWLRQIQNICFDVEDVLDGYECQSLRKHVVKASCSTKMKRIDIDHRLVQRREITYSHVNASGVIGMDGDKDEIIKLLMQPHPHHGDGDGDKIGSGKVENIARQYIDERSLLEDFEDYGHLYHFKVHDLVHDLALYVAKEELLVVNSQTRNIPEQVRHFSVVENDSLSHALFPKSTSVRTILVRIEGMGVNNETLLDIWI

SEQ ID NO: 95200 - protein, 259 aa, Glycine max
  Coding DNA Sequence Number=SeqID_3515
  Gene Ontology: Mol. function=oxidoreductase activity, acting on NADH or NADPH; Cellular component=mitochondrial respiratory chain; Biological process=electron transport
  Homolog annotation: Hit_ID=A7P914; Match level="QueryCoverage=92%, HitCoverage=91%, E-value=1e-87, Identity=68%"; Hit description =Chromosome chr3 scaffold_8, whole genome shotgun sequence
  Pfam annotation: Domain name=Fer4; Domain location=192-215; Score =38.5; E_value=2.4e-08; Accession=PF00037.18; Description=4Fe-4S binding domain
MAAILARKSLLALRARQLAVSGQGLHSSQNYGLRLSAHSYSTKREDEEREQLAKEISKDWSSVFERSINTLFLTEMVRGLMLTLKYFFETKVTINYPFEKGPLSPRFRGEHALRRYPTGEERCIACKLCEALCLDVTKCSMSLVNVETNVQLFLYWNNTTQSVRLRPLICPAQAITIEAEEREDGSRRTTRYDIDMTKCIYCGFCQEACPVDAIVEGPNFEFATETHEELLYDKEKLLENGDRWETEIAENLRSESLYR

SEQ ID NO: 95201 - protein, 95 aa, Glycine max
  Coding DNA Sequence Number=SeqID_3516
MGKTSVNKNLNQMLNPIGYSSITLAPSIKVTEEQLQHVGLNRSQLFQTTGIALPGRTNTSPNICPVSNSTSERTGYLKLVQKVGVLLGIGFGPKD

SEQ ID NO: 95202 - protein, 628 aa, Glycine max
  Coding DNA Sequence Number=SeqID_3517
  Gene Ontology: Mol. function=1-phosphatidylinositol-4-phosphate 5 -kinase activity; Cellular component=plasma membrane; Biological process=phosphatidylinositol metabolic process
  Homolog annotation: Hit_ID=Q8RY89; Match level="QueryCoverage=97%, HitCoverage=79%, E-value=0.0, Identity=59%"; Hit description =Phosphatidylinositol-4-phosphate 5-kinase 8 (EC 2.7.1.68) (AtPIP5K8) ...
  Homolog annotation: Hit description=(1-phosphatidylinositol-4 -phosphate kinase 8) (PtdIns(4)P-5-kinase 8)
  Pfam annotation: Domain name=MORN; Domain location=110-132; Score =32.0; E_value=2.2e-06; Accession=PF02493.11; Description=MORN repeat
  Pfam annotation: Domain name=MORN; Domain location=133-155; Score =30.9; E_value=4.6e-06; Accession=PF02493.11; Description=MORN repeat
  Pfam annotation: Domain name=MORN; Domain location=156-178; Score =29.3; E_value=1.4e-05; Accession=PF02493.11; Description=MORN repeat
  Pfam annotation: Domain name=MORN; Domain location=179-200; Score =27.3; E_value=5.7e-05; Accession=PF02493.11; Description=MORN repeat
  Pfam annotation: Domain name=MORN; Domain location=18-40; Score=18.3; E_value=0.03; Accession=PF02493.11; Description=MORN repeat
  Pfam annotation: Domain name=MORN; Domain location=41-63; Score=19.8; E_value=0.01; Accession=PF02493.11; Description=MORN repeat
  Pfam annotation: Domain name=MORN; Domain location=64-86; Score=24.0; E_value=0.00055; Accession=PF02493.11; Description=MORN repeat
  Pfam annotation: Domain name=MORN; Domain location=87-109; Score =23.0; E_value=0.0011; Accession=PF02493.11; Description=MORN repeat
  Pfam annotation: Domain name=PIP5K; Domain location=432-627; Score =244.8; E_value=1.9e-70; Accession=PF01504.9; Description =Phosphatidylinositol-4-phosphate 5-Kinase
  Pfam module annotation: Pfam domain module=MORN::MORN::MORN::MORN::MOR N::MORN::MORN::MORN::PIP5K; Domain location=110-132::133-155::156 -178::179-200::18-40::41-63::64-86::87-109::432-627
MEDSGRFDEKSFSNGDVYIGMIKGIVPHDKGKYTWSDGTVYEGDWEGEKMTGKGLIVWSSGAQYEGEISGGYLHGYGTLTTSAGCIYRGGWRMNAQHGIGRKQYSNSDVFEGLWKEGVPEGSGRYTWNNGNMYVGNWKNGKIYGRGVMKWVNGDTFDGLWLNGLMHGTGVYRFGDGGLYIGTWNKGLKDGKGVFYPAGSKHPSLKKLHSPRDSDHNGFLLNVEKQEAPKARVKRSLSENMPVISRFKSFRQISHRTSSLKINLIRSDSAQDCVCHDSSLTLSNALDGDQSEASGESTLVYEREYVQGVLIMERICECSESSREKKQQNKFSVKQVKKSSCLDIFEGRRSYYLKLNLQLGIRYTVGKITPVPAREVRSSDFGDRARIRMYFPRAGSKLTPPHSSINFYWKDYCPMVFRNLREMFKLDAAEYMMSICGDSGLRDLSSPGKSGSIFYLSKDDRFVIKTVNKSELKVLLSMLPKYYRHVGDHENTLITKFFGLHRITLRGGKKVRFVVMGNVFCTELQIHRRYDLKGSKQGRYTNNDKINCNTTLKDLDLKYEFHMDKKLRESLLKQISLDCKFLESQHIIDYSLLLGLHFRAPENMKAFVEHHESVQRQESLPSGDGKYLH

SEQ ID NO: 95203 - protein, 437 aa, Glycine max
  Coding DNA Sequence Number=SeqID_3518
  Gene Ontology: Mol. function=heat shock protein binding; Cellular component=cellular_component; Biological process=protein folding
  Homolog annotation: Hit_ID=A7PYK9; Match level="QueryCoverage=86%, HitCoverage=99%, E-value=1e-77, Identity=44%"; Hit description =Chromosome chr12 scaffold_38, whole genome shotgun sequence
  Pfam annotation: Domain name=DnaJ_C; Domain location=254-377; Score =47.1; E_value=6e-11; Accession=PF01556.9; Description=DnaJ C terminal region
MGDHPRSQPLDLHHLFKIKNKSLKDVSKAYKSLVSKRHHHDKKNPEEPITPPRFEENDNKRVDEDIWSPKFLSRAASRRSKTPTLKSRPMSRHGSRRCTTPTSLSRSSSSSGRRSATEIAASSLKRIMSRRGSPASLSSKLNISEPKLTNHVASPTKDADACLKTTRKPEYIPAVSLSSNLSCRLTTPIIFSQTTARRKPPEVERKLHCTLENLCFGCIKKIKVTRDVIKYPGVIIQEEEILKIEVKPGWRKGTKITFEGVGDEKPGYLPSDIVFLIDEKKHPLFRREGNDLEICVEIPLVDALTGCFISIPLLGGENMGLSFENNVIYPGYEKVIKGQGMPNPKNNGIRGDLHVKFFIEFPTELSEEQRKEAARLLKKKGNFHQCSLDVVFDKWKIFGLLSSRPNMYLVNLPSYKHSLHHSRPKPGYRMQHLHYYH

SEQ ID NO: 95204 - protein, 100 aa, Glycine max
  Coding DNA Sequence Number=SeqID_3519
MAKEMQLLIFVFILMITLSFIFPLDAFQQQAVEYGAAGLQSQSSFQTTIYFGMLPRGLVPPSGPSTPINTRLTSATACLATMKFKATLCIALIMFLLLLN

SEQ ID NO: 95205 - protein, 721 aa, Glycine max
  Coding DNA Sequence Number=SeqID_3520
  Gene Ontology: Mol. function=nucleoside-triphosphatase activity; Cellular component=cytoskeleton; Biological process=protein transport
  Homolog annotation: Hit_ID=A7PYL1; Match level="QueryCoverage=28%, HitCoverage=87%, E-value=2e-76, Identity=59%"; Hit description =Chromosome chr12 scaffold_38, whole genome shotgun sequence
  Pfam annotation: Domain name=AAA; Domain location=473-635; Score =158.1; E_value=2.3e-44; Accession=PF00004.20; Description=ATPase family associated with various cellular activities (AAA)
MRKRSIYAWLVALVCFLLLMIVTPAIPQSQEYHDFADHRTFLGIPNALNVISNFPFLVIGLVGLVLCHHGNYFRLSLQGELWGWTCFYVGVAAVAVGSSYYHLKPDDARLVWDRLPMTVAFTSIMAIFIIERIDERKGTVSIIPLVLAGSYLLAKVLEATDDVIYEWAQHIVSGHTLKHLVAAMVPVFLTFMLAKRSVEPERILVRVYEEKKITEPKGLGRWEEVTVEALNSTAKLNHARTPKHCKNDDDDDEGKAQSASRKRRKKIDRSEETLQRMEALHVRRKVQGSSSSSSASECDDEDEEGTVSTSEDTIYGEKVEPEFDLMKTTLRKSYTPKKVATEEKNVELEVGNSSKDTLVNEEMGNSSKGTSTLVNEEWKEVKGSCWGSVSNGKDGPRFKDLGGMKEVLEEPKNEVIVPLFHPQLPRQLGVRPMAGILLHGPPGCGKTKLAHAIANETGLPFYHISDPLDTKSGFLLYGPPGCGKTLIAKAVVNEAGANFIHIKGPELLNKYVGESELQIDTLTTKRGKEGGWVIERLLNQLLVGLDGAEERRDVFVVGATNRPEVMDRAVLLRPGRFGKLLYVPLPSPDERVLILKALARKEAVDASVDLSDIAKMEACENLSGADLAALYYNYKGWTIEKVVVSLREILILWTIQMNEAAMAALVENLDSIETTCDTLTIKSPIKRHHFEVALSIVSPSVSDRIWLILLYLFHMKYDALW

SEQ ID NO: 95206 - protein, 802 aa, Glycine max
  Coding DNA Sequence Number=SeqID_3521
  Homolog annotation: Hit_ID=A7QYN8; Match level="QueryCoverage=94%, HitCoverage=90%, E-value=1e-153, Identity=57%"; Hit description =Chromosome undetermined scaffold_252, whole genome shotgun sequence
MSNPAPFSTGNPPFWIPIHIVIPERPTECAVFNVIADTDISVLSTPVGGFTMKDSPRDSVQFIEWSPTCCPHALLIANFHGRVTIWAQPSQICFSCLFVSDFLSIPGQANLALDASCWLREHEWQQDIAVVTKWLSGYRWLSSKPSAPANSRSTFEEKFLSRQCQTSGSVQLHWSQWPPQNATTPKWFCTSKGPLGCGPCGIMAGDAIITDSGTMLVTGVPIVNPSTIVVWETNQNLGDSIPLNCSPVSNFSAYVSPETAAQSAATTTWGSGVTAVAFDPTCGGSVIAVVIVEGQYMSPYDPDEGPSITGWRVQRWESSLQHDVLHPIFGNPTSSMGGQPPMQTVWQTKVELSIPPTNDFKNHQAPAVGMNTDMQKISVGSAIAAPAFSSTSCCSASVWHDTSKDQTILKIIRVLPHAIPTSQVKANSSNWERAIAERKSRFWWSLLVGVNWWDAVGCTQSAAEDGIVSLNSVIAVLDADFHSLPSAQHRQHYCPILSQLVPASKGGEEPSLGRSRIGTGNAGQGYTYGERLTVNLWSYYTGNAGLQHPLPVSQVGSNNIQVRLHYIDGNYTVLPEVVEAALGPHMQMAMQNMPRPRGADAAGLLLCELELHPPAEEWHRRNMFGGPWSDPDVLDSANDALKLVSLNPLDSSSLENCDVYYGANGLWPRKRRMSERDAAFGLNTYVGLGAYLGIMGSRRDAVTALWKTGIEGIWYKCMRCLRQTCAFASPASTNLPSQNDREIWWISSWAYGCPMCGGTWEKRHVDYLTGSLSIKIVYVSEKAELVEGMDEELVTLRMRRND

SEQ ID NO: 95207 - protein, 42 aa, Glycine max
  Coding DNA Sequence Number=SeqID_3522
MSIRSTSDDIDKLSLDEDDDDVPQPSDNTMEDVNPNESNIGE

SEQ ID NO: 95208 - protein, 864 aa, Glycine max
  Coding DNA Sequence Number=SeqID_3523
  Gene Ontology: Mol. function=DNA-directed RNA polymerase activity; Cellular component=nucleus; Biological process=transcription
  Homolog annotation: Hit_ID=P38420; Match level="QueryCoverage=98%, HitCoverage=81%, E-value=0.0, Identity=56%"; Hit description=DNA -directed RNA polymerase II subunit RPB2
  Pfam annotation: Domain name=RNA_pol_Rpb2_1; Domain location=35-235; Score=149.2; E_value=1.2e-41; Accession=PF04563.6; Description=RNA polymerase beta subunit
  Pfam annotation: Domain name=RNA_pol_Rpb2_2; Domain location=205-371; Score=73.0; E_value=9.7e-19; Accession=PF04561.5; Description=RNA polymerase Rpb2, domain 2
  Pfam annotation: Domain name=RNA_pol_Rpb2_3; Domain location=458-524; Score=71.1; E_value=3.7e-18; Accession=PF04565.7; Description=RNA polymerase Rpb2, domain 3
  Pfam annotation: Domain name=RNA_pol_Rpb2_4; Domain location=542-598; Score=16.4; E_value=1.9e-05; Accession=PF04566.4; Description=RNA polymerase Rpb2, domain 4
  Pfam annotation: Domain name=RNA_pol_Rpb2_5; Domain location=607-657; Score=65.9; E_value=1.4e-16; Accession=PF04567.8; Description=RNA polymerase Rpb2, domain 5
  Pfam annotation: Domain name=RNA_pol_Rpb2_6; Domain location=662-864; Score=96.2; E_value=1e-25; Accession=PF00562.19; Description=RNA polymerase Rpb2, domain 6
  Pfam module annotation: Pfam domain module=RNA_pol_Rpb2_1::RNA_pol _Rpb2_2::RNA_pol_Rpb2_3::RNA_pol_Rpb2_4::RNA_pol_Rpb2_5::RNA_pol_Rpb2_ 6; Domain location=35-235::205-371::458-524::542-598::607-657::662-864
MDLKEFLASNRLARNWQITQEHVWTVISAYFEEKGFVCQQLDSFHHFIIQTIMQEIVDDSAYIEIRPKNQHNPAHKSDPVEAAYKFRFGKIYLSEPMMTESDGKTARMYPMPARLGNVNVYKAVIKKGHDGEVFTETKDLPKIFIGKVPIMLGSSYFSSSKNSESGFNKIRECPFDQGGYFIINGSEKVLIAQDRRGRALIMSMCSRRTNLASKPRWLKFVRMLSRTSSRGGSSGQYICATLPYIRTEIPIVIVFRALGIVPDKHILEHISYDFSDTQMVELLRPSLGEAFVIQNQQVALDYIGKRGATVARVYTCIITAFCRYLMKILQKEMLPHVGVGEYCETKKDYYGQVYVGLDLDDRDHYGNKRRELAGPLVGVRTLQSLAVSGVRYAPVSMSYTDTTPVLCSIFWTLQVSTSPYLCRVQCPCRCRCFILKYSLATGNWGQPNAAGTQAGVSQVLNRLTYASTLSHLRRLNSPIGSEEKLAKPRQLHNSQWGMICPAETPEGQLVQLKILFWSILGKLGIENFEEISPAVIPQATKVFVNGCWMGIHRDPDKLVTTLRELRRRFMLILKLGLSEISVLKSCAYVQIMEGRVQFKEYPEEGGWYALMSKGLIEYIDTEEETTMISMTISDLVQARINPEEAFSDTYTHCEIHPSLILGVCASNIPFPDHNQSAMRKQAMEIYATNYQLRMPLISPRAMEYLHFRQLSAGINAIVAIACYSGYNQEDSVIMNQSSIDRGSYSSILHDMKDGSYDKLDDDGLVPPGTRVSGDDVIIGKTTPISQGQVLRYTRRDHSISLRHSETGIVDRIGDKFSSRHGQKGIVGMTYTEEDMPWTVEGITPDIIINPNAIPSRMTIGQLIE

SEQ ID NO: 95209 - protein, 162 aa, Glycine max
  Coding DNA Sequence Number=SeqID_3524
  Gene Ontology: Mol. function=catalytic activity; Biological process =metabolic process
  Homolog annotation: Hit_ID=Q5NAM1; Match level="QueryCoverage=98%, HitCoverage=47%, E-value=8e-56, Identity=66%"; Hit description =Phosphoglycerate mutase-like
QTAEIIWQGREKPLVYLDSLKEISLYHLEGMKNGETASARLENSEQAADAKQIYPKEYTIWREDPANFIMNGRYPVRDLWKAAKDCWKEMLLSPGESFLVVTHKSILRALTCTALGLGPERFRSIDINNGGICVFNFNVRGEAMLDALNTTAHMYSDHVYPG

SEQ ID NO: 95210 - protein, 706 aa, Glycine max
  Coding DNA Sequence Number=SeqID_3525
  Homolog annotation: Hit_ID=A7R6L4; Match level="QueryCoverage=90%, HitCoverage=100%, E-value=0.0, Identity=55%"; Hit description =Chromosome undetermined scaffold_1331, whole genome shotgun sequence
MAGNEKDNGCGGGSDGEGLSLGNFSQGACTTFLGHTDRFELEYGSHCGNGSCNPVGGNGELPNFMLFHATRCVERQKVQILVGFPDSGYQDAVFPFHPNTTLVSEGMWDEKENRLCAVACRILNFTESLVNPYVGDCKTRLSLRFPAVLSLRNRSTVLGQIWSDKVVGESGYFSKVGFQGSSRVSKSLQGFLYKYADTERVRKSCAEKMNAKGKGNTYPDGYSSDMAFSMLVTNSRGQVAQGYSSPLSVCDQIYSGQSYGAPFVLTTGKPKAHATQSDKYSNLLNVSYTISLNPPPDFKFGRGVSSTKVKIGAEGIYNRNTGVLCMIGCQHLRSTDKILIKNETLDCEIMVNVQFPPLNAKGGESLTGTIESTRQKSDPYYFDPLQLSSYSIYRNQADASIWRMDFELIMVLVSNTLACVFVGLQLLHVKKHPDVLPYISVVMLAVITLGHMIPLILNFEALFMANHSVQNTFLGSGGWLEVNEVVVRMVTMVAFLLELRLVQLTWSSRQGEGSHPGLWDSEKKALYITLPLYIGGGLTAWLVHISKTSHQKRFRPFRLSRHKFSLPREHFYRPPSLWEDFKSYAGLLLDGFLLPQILLNIIFNSETKALASSFYVGTTIVRILPHAYDLYRAHSSAWYLDLSYIYANHRMDFYSTAWDIIIPSGGILFALLVYFQQRFGSRCILPKRFRESTAYEKVPVIGNDDL

SEQ ID NO: 95211 - protein, 25 aa, Glycine max
  Coding DNA Sequence Number=SeqID_3526
MATFLIDQTRPVVFSFIVGKSPLAV

SEQ ID NO: 95212 - protein, 1184 aa, Glycine max
  Coding DNA Sequence Number=SeqID_3527
  Gene Ontology: Mol. function=protein binding; Cellular component =ubiquitin ligase complex; Biological process=regulation of transcription, DNA-dependent
  Homolog annotation: Hit_ID=A7QCD4; Match level="QueryCoverage=99%, HitCoverage=97%, E-value=0.0, Identity=85%"; Hit description =Chromosome undetermined scaffold_77, whole genome shotgun sequence
  Pfam annotation: Domain name=HEAT; Domain location=165-201; Score =17.8; E_value=0.042; Accession=PF02985.13; Description=HEAT repeat
  Pfam annotation: Domain name=HEAT; Domain location=246-285; Score =3.3; E_value=8.6; Accession=PF02985.13; Description=HEAT repeat
  Pfam annotation: Domain name=HEAT; Domain location=336-360; Score =4.8; E_value=5.1; Accession=PF02985.13; Description=HEAT repeat
  Pfam annotation: Domain name=HEAT; Domain location=365-401; Score =3.9; E_value=7; Accession=PF02985.13; Description=HEAT repeat
  Pfam annotation: Domain name=HEAT; Domain location=41-77; Score=5.2; E_value=4.5; Accession=PF02985.13; Description=HEAT repeat
  Pfam annotation: Domain name=HEAT; Domain location=548-586; Score =11.1; E_value=0.59; Accession=PF02985.13; Description=HEAT repeat
  Pfam annotation: Domain name=HEAT; Domain location=591-625; Score =0.3; E_value=24; Accession=PF02985.13; Description=HEAT repeat
  Pfam annotation: Domain name=HEAT; Domain location=631-667; Score =2.0; E_value=14; Accession=PF02985.13; Description=HEAT repeat
  Pfam annotation: Domain name=HEAT; Domain location=842-877; Score =11.1; E_value=0.6; Accession=PF02985.13; Description=HEAT repeat
  Pfam annotation: Domain name=HEAT; Domain location=919-955; Score =22.0; E_value=0.0022; Accession=PF02985.13; Description=HEAT repeat
  Pfam annotation: Domain name=HEAT; Domain location=999-1030; Score =10.2; E_value=0.81; Accession=PF02985.13; Description=HEAT repeat
  Pfam annotation: Domain name=HEAT_PBS; Domain location=1015-1047; Score=7.6; E_value=7.6; Accession=PF03130.7; Description=PBS lyase HEAT-like repeat
  Pfam annotation: Domain name=HEAT_PBS; Domain location=345-381; Score= 5.4; E_value=16; Accession=PF03130.7; Description=PBS lyase HEAT-like repeat
  Pfam annotation: Domain name=HEAT_PBS; Domain location=862-891; Score= 4.7; E_value=20; Accession=PF03130.7; Description=PBS lyase HEAT-like repeat
  Pfam annotation: Domain name=TIP120; Domain location=1032-1182; Score= 256.5; E_value=5.5e-74; Accession=PF08623.1; Description=TBP (TATA -binding protein) -interacting protein 120 (TIP120)
  Pfam module annotation: Pfam domain module=HEAT::HEAT::HEAT::HEAT::HEA T::HEAT::HEAT::HEAT::HEAT::HEAT::HEAT::HEAT_PBS::HEAT_PBS::HEAT _PBS::TIP120; Domain location=165-201::246-285::336-360::365-401::41 -77::548-586::...
  Pfam module annotation: Domain location=591-625::631-667::842 -877::919-955::999-1030::1015-1047::345-381::862-891::1032-1182
MANLALTSILEKMTGKDKDYRYMATSDLLNELSKATFKADADLEVKLTNIIIQQLDDAAGDVSGLAVKCLAPLVRKVSEVRVVEMTSKLCDKLLNGKDQHRDIASIALKTVVAEVSTQSLAQSILQTLTPQLIRGITGPGMGSEIKCESLDILCDVLHKFGNLMAADHELLLSSLLSQLSSNQASVRKKTVACIASLSSSLSDDLLAKATVEVVTNLKNKVAKSEMIRTNIQMIGALSRAVGYRFGPHLGDTVPVLINYCTNASENDEELREYSLQALESFLLRCPRDISVYCDEILHLTLEYLSYDPNFTDNMEEDTDDEGLEEEEDDESANEYTDDEDVSWKVRRAAAKCLAALIVSRPEILSKLYDEACPKLIDRFKEREENVKMDVFNTFIELLRQTGNVTKGQTDADMRQQEVSKIVKSINRQLREKSIKTKVGAFSVLKELVVVLPNCLADHIGSLIPGIEKALNDKSSTSNLKIEALTFTRLVLSSHSPDVFHPYIKALSAPVLSAVGERYYKVTAEALRVCGELVRVVRPNIEGSGFDFRPYVHPIYNGIMSRLINQDQDQEVKECAISCMGLIVSTFGDHLNAELPACLPVLVDRMGNEITRLTAVKAFAVIAASPLRVDLSCVLEHVVAELTAFLRKANRALRQATLGTLNSLIVAYGDKIVLSAYEVIIVELSGLISDSDLHMTALALELCCTLMGDKRSNQSIGLAVRNKVLPQALTLIKSSLLQGQALSALQNFFAALVYSANTSFDSLLESLLACAKPSPQSGGIAKQALHSIAQCVAVLCLAAGDQKCSSTVKMLTDILKDDSSSNSAKQHLALLCLGEIGRRKDLSTHAHIENIVIESFQSPFEEIKSAASYALGNIAVGNLPKYLPFILDQIDNQQKKQYLLLHSLKEVIVRQSVDKAEFQESSVEKILNLLFNHCESEEEGVRNVVAECLGKIALIEPVKLIPALKVRRTSPAAFTRATVVIAVKYSIVERPEKIDEIIYPEISSFLMLIKDNDRHVRRAAVLAISTFAHNKPNLIKGLLPDLLPLLYDQTIVKQELIRTVDLGPFKHIVDDGLELRKAAFECVDTLLDSCLDQVNPSSFIVPYLKSGLDDHYDVKMPCHLILSKLADKCPSAVLAVLDSLVDPLQKTINFKPKQDAVKQEVDRNEDMIRSALRAIASLNRIRFVI

SEQ ID NO: 95213 - protein, 529 aa, Glycine max
  Coding DNA Sequence Number=SeqID_3528
  Gene Ontology: Mol. function=nucleotide binding; Cellular component =intracellular; Biological process=small GTPase mediated signal transduction
  Homolog annotation: Hit_ID=A7QGU3; Match level="QueryCoverage=93%, HitCoverage=82%, E-value=0.0, Identity=71%"; Hit description =Chromosome chr16 scaffold_94, whole genome shotgun sequence
  Pfam annotation: Domain name=ATP_bind_1; Domain location=252-433; Score=-68.7; E_value=0.036; Accession=PF03029.8; Description =Conserved hypothetical ATP binding protei
  Pfam annotation: Domain name=Dynamin_N; Domain location=250-375; Score=-46.3; E_value=0.066; Accession=PF00350.14; Description =Dynamin family
  Pfam annotation: Domain name=GTP_EFTU; Domain location=245-432; Score= -57.8; E_value=0.00079; Accession=PF00009.18; Description=Elongation factor Tu GTP binding domain
  Pfam annotation: Domain name=MMR_HSR1; Domain location=248-375; Score= 122.6; E_value=1.1e-33; Accession=PF01926.14; Description=GTPase of unknown function
  Pfam annotation: Domain name=MMR_HSR1; Domain location=42-166; Score =96.1; E_value=1.1e-25; Accession=PF01926.14; Description=GTPase of unknown function
  Pfam annotation: Domain name=Miro; Domain location=249-375; Score= -8.0; E_value=0.056; Accession=PF08477.4; Description=Miro-like protein
  Pfam module annotation: Pfam domain module=ATP_bind_1::Dynamin_N::GTP_ EFTU::MMR_HSR1::MMR_HSR1::Miro; Domain location=252-433::250-375::245- 432::248-375::42-166::249-375
MSRIRRLVYVHLIPPVTERGFSSLSVVTAPLDFTEIQISRLPTVVILGRPNVGKSALFNRLIRRREALVYNTPDDHVTRDIREGLAKLADLRFRVLDSAGLEAEATSASILHRTASITAHVLAKSHFALFLTDARAGLHPLDLQVGKWLRKHAPQIKPIVAMNKSESLFDATGSLASAANEMCRLGFGDPIAISAETGLGMHDLYMSLKPLLEDYMLRVFTEEGARENSHNEVEDSSDLDVDKSKLPLQLAIVGRPNVGKSTLLNALLQEDRVLVGPEAGLTRDSIRTQFEFQGRTIYLVDTAGWLQRTKQEKGAASLSIMQSRKSLLRAHIIALVLDAEEIINARRSMKHAEVVIARRAVEEGRGLVVIVNKMDLLRGKHKSSSYEKVMEVVPQEIQTIIPQVTGIPVVFISALEGRGRTTVLNQVMSRHSWKDQAAQPKVKYFTQVKARPPTFVAFVRGKTQLSDTDIRFLTKSLKEDFDLGGIPIRIMQRSVTKKDASGSGNSKNSHSVCRVVERTVSDKRSIVDE

SEQ ID NO: 95214 - protein, 331 aa, Glycine max
  Coding DNA Sequence Number=SeqID_3529
  Gene Ontology: Mol. function=metal ion binding; Cellular component =integral to membrane; Biological process=ecdysone receptor-mediated signaling pathway
  Homolog annotation: Hit_ID=A5B4C8; Match level="QueryCoverage=100%, HitCoverage=100%, E-value=4e-85, Identity=50%"; Hit description =Putative uncharacterized protein
  Pfam annotation: Domain name=C1_3; Domain location=276-306; Score =8.2; E_value=0.057; Accession=PF07649.3; Description=C1-like domain
  Pfam annotation: Domain name=PHD; Domain location=277-327; Score =52.5; E_value=1.4e-12; Accession=PF00628.20; Description=PHD-finger
  Pfam module annotation: Pfam domain module=C1_3::PHD; Domain location= 276-306::277-327
MEGVPHPIPRTVEEVFTDFKGRRAGLIKALTTDVEKFYQQCDPEKENLCLYGFPNETWEVNLPVEEVPPELPEPALGINFARDGMQEKDWLSLVAVHSDSWLLAVAFYFGARFGFGKNERISTMAEHRLAVGAWACWWYTWTVETIMCKVGLQLSQIGFLVVTEKEEVEDFNKSAMVRVQSGFGFWLWRSDYCHDESGRKRLFQMINDLPTIFELVTGSAKQLKDQPAAHNNGSKCKSSGKVSHQSESQAKGMKMSAPPKEEDESGEEEEDDEQGATCGACGDNYGTDEFWICCDMCERWFHGKCVKITPAKAEHIKQYKCPSCSNKRVRV

SEQ ID NO: 95215 - protein, 89 aa, Glycine max
  Coding DNA Sequence Number=SeqID_3530
MLTIRVALHCTTTSMLHSNELMAVSTRHQLSNCEWKKEKQLMEIFVELSFSKFKTRSTGPALKKFVSINYFFCSSSEQSKVIQLCIRSQ

SEQ ID NO: 95216 - protein, 141 aa, Glycine max
  Coding DNA Sequence Number=SeqID_3531
  Gene Ontology: Mol. function=sodium:hydrogen antiporter activity; Cellular component=integral to membrane; Biological process=sodium ion transport
  Homolog annotation: Hit_ID=Q93YH1; Match level="QueryCoverage=75%, HitCoverage=20%, E-value=3e-24, Identity=55%"; Hit description =Sodium/hydrogen exchanger
MPFEKLRVGETEIWIFQMENTMPDKLSKNVLLIGGSTGTMLEALEVVGSDSPVESPLASVSTRTNFEGNNVYISPDDEEPSSGNKIKMKLQEFQRSAASFTAIDKNYLTPFFTSQNGDEEDEAVPLTLKNVGLDDHDHYSS

SEQ ID NO: 95217 - protein, 396 aa, Glycine max
  Coding DNA Sequence Number=SeqID_3532
  Gene Ontology: Mol. function=DNA binding; Cellular component=nucleus; Biological process=transcription from RNA polymerase III promoter
  Homolog annotation: Hit_ID=A7R3V7; Match level="QueryCoverage=67%, HitCoverage=72%, E-value=4e-99, Identity=63%"; Hit description =Chromosome undetermined scaffold_574, whole genome shotgun sequence
MATTMEMIEIPSTNHKNHRNEMALMPCQRSSGIMIKLKKGFREKTVCFSGLYLIKYTDPILYKYAGDYRNFVLKSSLETILSDTIYSCLASVAGVTCQLIINRRINEAVHKSTRTERMRTLRSTSSTRKVNTASLQEHLPVLYPEVVLSVEVYHNVRKGTKIQELLVLGGQTLTALRDKIFCSTDQVMHKAGQHDPSGYFLIEVCLITYTHNAKVDVFCPDLRDPSAIDLTRPILDWLRDSKEEAQKKWEYIITGELQKKQKAIMGEKSASQLPHFRSIEMHKIRFCDLSFQLGAGYLYCHQGDCTHTLVIRDMRLIHPEDVHNRAVYPIITFQLKLRFQKCNVCKIFRATKVTVDDKWTPENPCYFCDECFSLLHQADDGTLLYTDFVEYDYNHD

SEQ ID NO: 95218 - protein, 489 aa, Glycine max
  Coding DNA Sequence Number=SeqID_3533
  Gene Ontology: Mol. function=nucleotide binding; Cellular component =cAMP-dependent protein kinase complex; Biological process=fatty acid biosynthetic process
  Homolog annotation: Hit_ID=Q7XYX7; Match level="QueryCoverage=44%, HitCoverage=79%, E-value=2e-88, Identity=68%"; Hit description=AKIN beta2
  Pfam annotation: Domain name=AMPKBI; Domain location=395-485; Score =122.1; E_value=1.7e-33; Accession=PF04739.6; Description=5'-AMP -activated protein kinase, beta subunit, complex-interacting region
  Pfam annotation: Domain name=Pollen_Ole_e_I; Domain location=165-284; Score=-32.2; E_value=0.021; Accession=PF01190.8; Description=Pollen proteins Ole e I family
  Pfam module annotation: Pfam domain module=AMPKBI::Pollen_Ole_e_I; Domain location=395-485::165-284
MDSVPVPSLSASSTLTEEVQVTALQMIELLTSTTDEHGGVIVEMDKPMDSATFVSILRASISHWKQLGNMGVWIKSPIHLVSLVEALVKEEGVQHILRKGKVDKQINTKMMMSYFCGWHALAILVLIASPAAGENNHPLLELLSSRDEVVQIAGYGEEKLSTVLITGSVNCEAPHQPQPQPHAWPVQGASVAVNCQSHGRKWKGKSMVARGVTDEFGDFMIDLPSHLHAIPNLERPPLNVNVTREEEATVADENAMPQSPPTTPTTTHSPLLFAPQVPVVPLQRPDDIHVPSCSWMETTSGYEDMYTQVGIPTMITWSYDGKEVAVEGSWDNWKTRFRYNAPAEIREGLCLNEVLPSGVYQYRFIVDGRKKYTPDSPWAQDDAGNAYNILDLQPPQSPDSSYDNLHLSSEDYAKEPPLVPPLLQMTLLNVPATNMEIQPPMSRPRHGVLNHLYTQKGKSSPSVAGLGTTHRFLAKYVTVVLYKSLQSKP

SEQ ID NO: 95219 - protein, 669 aa, Glycine max
  Coding DNA Sequence Number=SeqID_3534
  Gene Ontology: Mol. function=identical protein binding; Cellular component=extracellular region; Biological process=negative regulation of catalytic activity
  Homolog annotation: Hit_ID=A7R194; Match level="QueryCoverage=99%, HitCoverage=95%, E-value=0.0, Identity=52%"; Hit description =Chromosome undetermined scaffold_342, whole genome shotgun sequence
  Pfam annotation: Domain name=PA; Domain location=336-439; Score=80.6; E_value=4.9e-21; Accession=PF02225.13; Description=PA domain
  Pfam annotation: Domain name=Peptidase_S8; Domain location=125-578; Score=-12.7; E_value=4.4e-06; Accession=PF00082.13; Description =Subtilase family
  Pfam annotation: Domain name=Subtilisin_N; Domain location=2-81; Score=55.1; E_value=2.5e-13; Accession=PF05922.7; Description =Subtilisin N-terminal Region
  Pfam module annotation: Pfam domain module=PA::Peptidase _S8::Subtilisin_N; Domain location=336-439::125-578::2-81
MGSHEHGEGVTDADFDLVTQIHHEFVKSYVGSSEKAKEAIIYSYTRHINGFAAMLEEKEAADIAKHPDVVSVFLNKGRKLHTTHSWEFMDLEGNDGVYGQNLRALEMRGWDLYHQGGKELVNMITPASVVTVQFDDDYCDLFMRVLHKKLIGARYFNKGYMAHAGADAKFNRSLNTARDYEGHGSHTLSTIGGTFVPGANVFGLGNGTAEGGSPRARVATYKVCWPPIDGNECFDADIMAAFDMAIHDGVDVLSLSLGGNATDYFDDGLSIGAFHANMKGIPVICSAGNYGPTPATVFNVAPWILTVGASTLDRQFDSVVELHNGQRFMGASLSKAMPEDKLYPLINAADAKAANKPVENATLCMRGTIDPEKARGKILVCLRGVTARVEKSLVALEAGAAGMILCNDELSGNELIADPHLLPASQINYKDGLAVYAFMNSTKNPLGYIYPPKTKLQIKPAPAMAAFSSRGPNTVTPEILKPDVIAPGVNIIAAYSEGVSPTNLGFDKRRVPFITMSGTSMSCPHVAGVVGLLKTLHPDWSPAVIKSALMTTARTRDNTGKPMLDGGNDAKATPFAYGSGHIRPNRAMDPGVKNVGPPGTYTARLKVPARLSISVEPNVLKFDNIGEEKSFKLTVEVTRPGETTAFGGITWSDGKRQVRSPIVVGGVRG

SEQ ID NO: 95220 - protein, 139 aa, Glycine max
  Coding DNA Sequence Number=SeqID_3535
  Homolog annotation: Hit_ID=A2Q5F7; Match level="QueryCoverage=87%, HitCoverage=98%, E-value=2e-22, Identity=50%"; Hit description =Putative uncharacterized protein
MEQQKMKRAREGDDETQKGCFENNENAKKRDEEGCSSEALGVFDFPWLKDGVTTKPEDYLMDLEDNLSSLLEQEDSSFKAATACIDFSSEAKLEDLAWQPFESDVLELEADDVDYIWSSLLKQPLRPHPAATIFSINIV

SEQ ID NO: 95221 - protein, 42 aa, Glycine max
  Coding DNA Sequence Number=SeqID_3536
MAILEKKKKKTEMKLFMTYEIQYFIDGGGVSLGPLRVGQSGG

SEQ ID NO: 95222 - protein, 783 aa, Glycine max
  Coding DNA Sequence Number=SeqID_3537
  Gene Ontology: Mol. function=ubiquitin-protein ligase activity; Cellular component=intracellular; Biological process=protein modification process
  Homolog annotation: Hit_ID=A7QZX3; Match level="QueryCoverage=97%, HitCoverage=80%, E-value=1e-174, Identity=64%"; Hit description =Chromosome undetermined scaffold_292, whole genome shotgun sequence
  Pfam annotation: Domain name=HECT; Domain location=496-782; Score= -14.2; E_value=6.7e-09; Accession=PF00632.16; Description=HECT-domain (ubiquitin-transferase)
  Pfam annotation: Domain name=ubiquitin; Domain location=25-94; Score =57.3; E_value=5.1e-14; Accession=PF00240.14; Description=Ubiquitin family
  Pfam module annotation: Pfam domain module=HECT::ubiquitin; Domain location=496-782::25-94
MRKDEAKAPGAMPQQQRSHIQFFVRMMSAGNTIVMQAFPEDTVKSIHERIQSMKGIPLFEQRLIYRGKQLQWEQTLAECFIQNDANLQLVGRMRSTEHPQAWQVINDMVSLVYRLCRGETVHDALKTVKGLMTSYLNMTPRIDNDSASGYFQIFMSSSAPAVLVMLYVSPYAGNKDCADSSVRHFLSSCRNILSKALHGQCARVVLEFCKLLRRVGSHDPLYLFCRSTFGSLLETAGVSYGSGSDNVKGLVLIQDIFPFVCELANSLLRDLDLSIVSPSAAGPLSNDVGDFSAFLLPLRTGIKEQQAVKDSMAQDKHHKLTEEIEYLHGLYVQLLNKIDQCLQKMDQSLAGQEMMEGDNLYPAWSHYLSILKELYQISKLYDGAEEKLWGVLTRQRSVLCLLIVRYAKRTDEHQWILEHRYVTNFESRRHLAMMMFPEVKEDYEELHEMLIDRSQLLTESFEYIARAEPDSLHAGLFMEFKNEEATGPGVLREWFLLVCQAIFNPQNALFVACPNDRRRFFPNPVFLEESRGVVNLKLWRQTLKTKGFHLSRSKMEYMHSIIVRDEKYDLEVVWTCRKEASEEHWNLEVDCMSLSPMKRRRRPRRTLELGTSKVHPLHLEYFSFAGRVIALALMHKVQVGIAFDRAFFLQLAGNYIAIKDIRDADPYLYTSCKQILDMDADLIDSDALGLTFVREVEELGQRKVVELCPGGKNLAVNSKNRDKYVDLLIQDHFVTSISEQVSHFAKGFADILSNSKLQQYFFQSLDLEDLDTMLHGSVAMFSL

SEQ ID NO: 95223 - protein, 79 aa, Glycine max
  Coding DNA Sequence Number=SeqID_3538
  Gene Ontology: Mol. function=binding; Cellular component=cell division site; Biological process=embryonic development via the syncytial blastoderm
  Homolog annotation: Hit_ID=Q9FGK3; Match level="QueryCoverage=93%, HitCoverage=21%, E-value=6e-26, Identity=81%"; Hit description =Putative MO25-like protein At5g47540
MGGGGESSKSIQIEAFHVFEPFAANQKKAADIISIFVANRSKLLRLLGDLKIDKEDEQFEADKAQVIKEIAALEPRDIA

SEQ ID NO: 95224 - protein, 201 aa, Glycine max
  Coding DNA Sequence Number=SeqID_3539
MGNRLCVLLCYQIPDDNNLKREKMQGRFCKILKRKKEMETEKKVPNQTLEDWILPSPGLKPDYVIRPGEFSSSCSSKSQKKVHPCVSKVQVPGSLIAEAKDSLCLDRPMNMNRNEEAEELLSSTSIGKSQKKVSFKLSHNVIFYSPDEPCSPEPYYYNSSESEGSFYSSICREYSFDPSADETLIKLAVDVLPHVSVSSKI

SEQ ID NO: 95225 - protein, 35 aa, Glycine max
  Coding DNA Sequence Number=SeqID_3540
MGYSKLDQSAADNNTEKEKEKMCKNVKGVSTNVEA

SEQ ID NO: 95226 - protein, 77 aa, Glycine max
  Coding DNA Sequence Number=SeqID_3541
  Subcellular localization annotation: CTP_CleavageSite=43; ConfidenceScore=5.04e-01
MDTRLRVIGDPMNGVQRSKSIGVHKVRGSFRCTRSEPTGCRILGEERNQNFLPVQWGRFLSKDSVYALQPRLFNSFP

SEQ ID NO: 95227 - protein, 274 aa, Glycine max
  Coding DNA Sequence Number=SeqID_3542
  Homolog annotation: Hit_ID=A7R2U4; Match level="QueryCoverage=91%, HitCoverage=90%, E-value=6e-56, Identity=49%"; Hit description =Chromosome undetermined scaffold_453, whole genome shotgun sequence
METKSHSGSGISPSASPEFEFWMVRNPSFPQPNILSADQLIVNGVLLPLHLLNKPDPSPAITDSSSSSSSAATASKRWKDIFKKSDKKNTDAKKLKEKKSGVTTSAELNINIWPFSRSKSAGNAATRPKPFVPATRKANSAPCSRSNSAGESKSRKWPSSPARPGVHLGRSSPVWQVRRPKNPVPEPLNPDINKSKRESHRSKVVGGSGSSKTKVLNLNVPMCIGYRHHFTCRSDENSAIRVSNPNPPHAHANVGGKLFTLRSLFTKKNVVTSH

SEQ ID NO: 95228 - protein, 156 aa, Glycine max
  Coding DNA Sequence Number=SeqID_3543
  Gene Ontology: Mol. function=transcription repressor activity; Cellular component=cytoskeleton
  Homolog annotation: Hit_ID=A7R2U6; Match level="QueryCoverage=81%, HitCoverage=90%, E-value=9e-38, Identity=62%"; Hit description =Chromosome undetermined scaffold_453, whole genome shotgun sequence
  Pfam annotation: Domain name=DUF623; Domain location=91-150; Score =96.9; E_value=6.2e-26; Accession=PF04844.4; Description=Protein of unknown function, DUF623
  Subcellular localization annotation: CTP_CleavageSite=30; ConfidenceScore=5.13e-01
MNNSKQQKQQHQLQQRGCKALCCSCRFSVSSSEEAESSSASDRFPSVSSLAHAMVQERLDQMIRARHVERRRQQSREGTKFVVMVAMEKSSYDPREDFRESMMEMITANRLQDAKDLRSLLNYYISMNSDEYHSLILEVFHEVCTSLFLSCKCHNW

SEQ ID NO: 95229 - protein, 545 aa, Glycine max
  Coding DNA Sequence Number=SeqID_3544
  Gene Ontology: Mol. function=diphosphate-fructose-6-phosphate 1 -phosphotransferase activity; Cellular component=6-phosphofructokinase complex; Biological process=glycolysis
  Homolog annotation: Hit_ID=Q2HTG9; Match level="QueryCoverage=99%, HitCoverage=99%, E-value=0.0, Identity=76%"; Hit description =Pyrophosphate-dependent phosphofructokinase PfpB
  Pfam annotation: Domain name=PFK; Domain location=86-326; Score= -82.9; E_value=9.9e-08; Accession=PF00365.11; Description =Phosphofructokinase
MAPSFAINGGFPGARVTPPSVTGRFAAVYSEVQNSRIDHELPLPSVLKNPFIIVDGPQSSAAGNPGLASSHLLLQFSVNNSSYYLQDLAEGSTLYGFRGGPAGIMKCKYVELTSDYIYPYRNQGGFDMIRSGRDKIETPEQFKQAEETVQKLNLDGLVVIGGDDSNTNACLLAEHFRSKNMKTRVIGCPKTIDGDLKCKEVPTSFGFDTACKIYAEMIGNVMIDARSTGKYYHFVRLMGRAASHITLECALQTHPNITIIGEEVAAKKMTLKDVTDYIVNIISKRAEDNYNYGVILIPEGLIDFIPEVQHLIAELNEILANDAVDEGGLWKKKLTDQSLKLFEFLPKAIQEQLMLERDPHGNVQVAKIETEKMLIQMVETELEKRKQQGTYKGGFRGQSHFFGYSVYFRYIILGVVSYEGRCGLPTNFDSTYCYALGYGAAALLQSGKTGLISSVGNLCAPVEEWTVGGTALTSLMDVERRHGKFKPVIKKAMVELEGAPFKKFASLRDEWALKNCYISPGPIQFTGPGSDAINHTLLLELGAQA

SEQ ID NO: 95230 - protein, 376 aa, Glycine max
  Coding DNA Sequence Number=SeqID_3545
  Gene Ontology: Mol. function=oxidoreductase activity; Cellular component=extracellular region; Biological process=hydrogen peroxide catabolic process
  Homolog annotation: Hit_ID=Q9LSP0; Match level="QueryCoverage=78%, HitCoverage=88%, E-value=4e-83, Identity=53%"; Hit description =Peroxidase 29 precursor
  Pfam annotation: Domain name=peroxidase; Domain location=45-291; Score=268.8; E_value=1.1e-77; Accession=PF00141.14; Description =Peroxidase
MEISFPWILVATMVMAMRPLSFRIKANQLSYDYYKFSCPNLESIVKSELLSLFLTDATAPAAFLRLMFHDCQVQGCDASILLDSNYLAHSHSSEMISSRNFGIRKRETIGQMKSILEEECPGQVSCADIIVLAAKESVSLSGGPHIEIPLGRKDSRTCSFHEADAKLPSPIITVDEFISIFMSIGMNIEESVSILGAHTLGIGHCFNIVGRLYDPRLGDKMDFALEASLRLACPTEIPLTNLTFVPNDMTPVIFDNQYYRDIMMGRGLFGIDSSISRDPRTAPFVMRFAMDQNYFFKAFSSAFVKLSSTNVLTDVQGDVRRQCNQARGPSNLRSIKISTLVPMLCPSLCWVAFYITIYYLACKGKKSVTLMTKLQS

SEQ ID NO: 95231 - protein, 326 aa, Glycine max
  Coding DNA Sequence Number=SeqID_3546
  Gene Ontology: Mol. function=nucleotide binding; Cellular component =Golgi apparatus
  Homolog annotation: Hit_ID=A7R0N0; Match level="QueryCoverage=61%, HitCoverage=39%, E-value=1e-68, Identity=64%"; Hit description =Chromosome chr10 scaffold_312, whole genome shotgun sequence
  Pfam annotation: Domain name=DUF246; Domain location=158-326; Score= -24.4; E_value=3.3e-13; Accession=PF03138.5; Description=Plant protein family
  Subcellular localization annotation: CTP_CleavageSite=29; ConfidenceScore=5.65e-01
MVSASEPDRCSPTSRTPRRLSSSRRSQSQSSSSWYPRKRTKLLLALIAFLAFVFFLNWFMLLRLQHQHDAPDPIPKPTLRSSSVSLSLQGKWNKPANKKKSQKGNYARMLALAAHALAENKREPKDLWQEPFVPASSWRPCADQRNWEPNEGGNGYILVTANGGINQQRVAVCNAVVVARLLNSTLVIPKFMYSSVWRDVSQFSDIYQEEHFINYLTPDIRIVRQLPKELQSLDLEAIGSVVTDVDMEKEAKPSFYLKHILPIILKNQVVHFVGFGNRLAFDPIAFELQPYYALPNWGTSYRDFVADVIFMPCNLFPEYKKPVLCF

SEQ ID NO: 95232 - protein, 318 aa, Glycine max
  Coding DNA Sequence Number=SeqID_3547
  Homolog annotation: Hit_ID=A7QUJ5; Match level="QueryCoverage=95%, HitCoverage=89%, E-value=1e-129, Identity=69%"; Hit description =Chromosome chr10 scaffold_179, whole genome shotgun sequence
MLLLILIHSLLLSLTTRAQSTPCRTSCGDIPIEYPFGIDDGCGSPYYRYILVCSDSGKLQVRTPSGRYHVHNVSYADPHILVTDPFMWNCDDGENYRPTRPFSLDTSTRFKLSPQNEYLFFNCSEDHVIVKPKPIFCERFPERCDSSCDSGSYLCRHMPGCSFAMTGSSCCSYSPRSIESLRLMLKYCTSYTSVYWRNVGAPQPHDQVPEYGIRIDFDIPVTTRCLQCQDPSKGGGTCGFDTQTQSFMCLCKEGNFTTHCKDYDAARHNRKVHVIAGTVSGVSAAGAFGIGAGIWYLKKVRAKAPVTCGVQSNENRLF

SEQ ID NO: 95233 - protein, 84 aa, Glycine max
  Coding DNA Sequence Number=SeqID_3548
MESGKSLETCGELVVEQPHCDGSTASLWNQWMSTCDSVILVHYMYPLCYVLTKLMTLLTHTSFHMLKSITTLLVIFFACFVPLV

SEQ ID NO: 95234 - protein, 82 aa, Glycine max
  Coding DNA Sequence Number=SeqID_3549
  Gene Ontology: Mol. function=transferase activity, transferring glycosyl groups; Cellular component=integral to membrane; Biological process=protein amino acid glycosylation
  Homolog annotation: Hit_ID=A7QZP8; Match level="QueryCoverage=70%, HitCoverage=23%, E-value=2e-20, Identity=81%"; Hit description =Chromosome chr10 scaffold_282, whole genome shotgun sequence
MTQCHETLGSSMMNSYMFYIWCILDKAIEVEERLHADFLRLNHIEGYLELSAKTKIYFSIAVALWDAEFYVKVDDVHVNLGE

SEQ ID NO: 95235 - protein, 447 aa, Glycine max
  Coding DNA Sequence Number=SeqID_3550
  Homolog annotation: Hit_ID=A7P0R0; Match level="QueryCoverage=81%, HitCoverage=64%, E-value=5e-33, Identity=28%"; Hit description =Chromosome chr19 scaffold_4, whole genome shotgun sequence
  Pfam annotation: Domain name=DUF593; Domain location=185-268; Score= -22.9; E_value=0.013; Accession=PF04576.6; Description=Protein of unknown function, DUF593
  Subcellular localization annotation: CTP_CleavageSite=53; ConfidenceScore=5.58e-01
MNTRKHPIPSGRNFPSVNFRRTSPKTHLSARKLAARLWHLRFFKPKLQSSPPRVKLTEQEGTKRANTPIRKLLRETKLIGGDSVLLSELLRAQTCINKLKAEHKFSKKKLEDEKLLWKRREFIKNQALLEDLKDKLARERTSRERMESVNAKLIHELAEAKLYAKQFMVNYKEEKRKRGIIEQVCNELAMQMGEDKARLEGIRVEMEEERNMFRIAWLLREESIQMKLLDAKLALEDKYNHMIHLIAHLQSFLSSRGHELGAMDAQLVKQAAESLNLELSYDLAKSNDVFDEIKIKESVFKVEPYYPSNLIGPSSTVHIVSLDEDHCLNNNANQNIHGLECCENAEDGCYEHSDSVPQQKSQDSKIGKRKGRLARNAVKSGGKGSGESGFRQWELLGQPVNPHITRGMKGCIEWPRGIPKINSKVIIPLEERVRKQKSQLQHILKPH

SEQ ID NO: 95236 - protein, 507 aa, Glycine max
  Coding DNA Sequence Number=SeqID_3551
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=A7QUL7; Match level="QueryCoverage=83%, HitCoverage=91%, E-value=1e-170, Identity=61%"; Hit description =Chromosome chr10 scaffold_179, whole genome shotgun sequence
  Pfam annotation: Domain name=Glyco_hydro_1; Domain location=50-471; Score=570.3; E_value=2e-168; Accession=PF00232.9; Description =Glycosyl hydrolase family 1
MEKNTPLLTLRREEKQENAMGALYMSVMEILLFLFIFICSLTPISQSQGLHQSPPFLFGTSSSSYQYEGAYLSDGKGISNWDVFTHKPGSISDESNGDVAVDQYHRYLEDIDLMEAIKVNSYRFSISWARILPKGRFGEVNLAGINYYNRLIEALLLKGIQPFVTLFHFDIPQELEDRYGGWLSPQSQVKYWVTFNEPNYLVPLAYRLGIFPPLRCSSKFGNCSEGDSEKEPFVAAHNMILSHAAAVDLYRNKYQTEQGGEIGIVLHCDSFEPLSNSTADKLATERAQSFSINWILDPILFGKYPKEMEMILGTTLPKFSSNDKAKLRQGLDFIGINHYASYYTPFDWLSVYPLGMKSILMYLKDRYNNTPMFITENGYGNLYDPDLTEEEYLNDFKRIEFMSGHLDNLMAAIREGADVRGYFAWSLLDNFEWLYGFSVRFGLHHVDFSTLKRTPKLSAIWYEHFIENYKLTDSIVPEHGREKGIWNKPTTQLRTLVSPEPRMNNLD

SEQ ID NO: 95237 - protein, 208 aa, Glycine max
  Coding DNA Sequence Number=SeqID_3552
  Homolog annotation: Hit_ID=O64438; Match level="QueryCoverage=76%, HitCoverage=67%, E-value=1e-80, Identity=91%"; Hit description=ARG10
MAQRTLTNRSFAVKDEVFCLFEGALDNLGNLRQQYGLAKSVNEVLLVIEAYKALRDRAPYPANHVVGHLSGSFAFIVFDKSTSTLFVASDQYGKVPLYWGITADGYVAFADDAELLNGACGKSLASFPQGCFYSTAVGGLMCYENPKNKITAVPANEEEIWGATFKVTKCNLGFPSCDVTVHKFSKSFKVNLRTHLNEISLNQMVVVL

SEQ ID NO: 95238 - protein, 144 aa, Glycine max
  Coding DNA Sequence Number=SeqID_3553
MSQSHEALILIQKMVKVPPPKALLLFNTATYQGLHHTPHSISFILNLLLSSDMLLQAQSLILRLISAIFNAYVHSLTFLHHMIHWGHVPRSNTDRDSTAGSKGSTRSKKYKAKTEGNNLSPIWLAVTHAFMHQYIESANQQTLG

SEQ ID NO: 95239 - protein, 248 aa, Glycine max
  Coding DNA Sequence Number=SeqID_3554
  Gene Ontology: Mol. function=aspartic-type endopeptidase activity; Biological process=proteolysis
  Homolog annotation: Hit_ID=A7NWG3; Match level="QueryCoverage=50%, HitCoverage=42%, E-value=4e-20, Identity=41%"; Hit description =Chromosome chr5 scaffold_2, whole genome shotgun sequence
  Subcellular localization annotation: CTP_CleavageSite=86; ConfidenceScore=5.44e-01
MAFSFGHELPYLKSSSTSENASYGSSAATTPTPQRTTLSDVGLTNACKQAKGTACITCTNHTLKTGCTNNTCGVDPFNPLGAFFVSGDVDEDIYLVLRPLYTCHASFLHVLGLMAFCKTSPSITIFDDDPSSEYFIDDKSIKVDGKIVNLNTCLLSIDKQGNGGSKLSTVVPYTKTIGKTVTGPNVSTIDLVLKGGFQWRIYGANSMVKVAKNVLCLAFVDGGFGAMKFHCNFDCHWWVSDGGQSFGV

SEQ ID NO: 95240 - protein, 104 aa, Glycine max
  Coding DNA Sequence Number=SeqID_3555
MATSDRFLPDAKLNFMGFKNLERLILSSFDEIVGLSHECDVGSIKKKEKILGVGLLFFFSLSRRRKRSNNIAIQEGDWTLNFMFSKFSSQIPRMNGNPAAGQIQ

SEQ ID NO: 95241 - protein, 569 aa, Glycine max
  Coding DNA Sequence Number=SeqID_3556
  Homolog annotation: Hit_ID=A7NWF5; Match level="QueryCoverage=99%, HitCoverage=99%, E-value=0.0, Identity=62%"; Hit description =Chromosome chr5 scaffold_2, whole genome shotgun sequence
MPEKVVISPQWALWSIPMLHWRVGLLTALVMVGMVVVWSIDGCTVKNIIQAWRYQQDYLAVKSHTPNLTFVSPYSPVNFTVYGKKPLLVKGHASWVSSELEPNLTSNLIARWSARGGEPCKDSKAVEIAIPGLDGGEVIELSAGDVHEFGFQALDDSGKPLCVGGDYFETDLSGDSWKSRPLVKDFSNGSYLISLQVHPDFDGVYNLTIILLYRHFEGLKFTPWRFSYDQMLRSVAIRFYKSSVRLPELQGCKASDFDRDVWIGRWTRHGKNDDCTIGNDGRYRCLAPDFPCQAPWCDGSLGILESNGWVYSTHCSFKLYSAESAWNCLKNRWIFFWGDSNHVDTIRNLLNFVLDLPEIPSVPRRFDMNFSNPRDPSQTVRITSIFNGHWNETQNYLGLDSLRDEGFQDLLKKYFSEDTIPDTVIMNSGLHDGVHWRNIRAFSVGADYAASFWGDVMKTVKQRGLAWPRVFFRNTVATGGYARSLAFNPNKMEVFNGVLLEKLKQSGVVSGVIDNFDMTFPWHFDNRCNDGVHYGRAPAKMKWRDGQIGHQYFVDLMLAHVLLNALCAR

SEQ ID NO: 95242 - protein, 336 aa, Glycine max
  Coding DNA Sequence Number=SeqID_3557
  Gene Ontology: Mol. function=adenylate dimethylallyltransferase activity; Cellular component=intracellular; Biological process=tRNA processing
  Homolog annotation: Hit_ID=Q2MHM8; Match level="QueryCoverage=94%, HitCoverage=98%, E-value=1e-117, Identity=66%"; Hit description =Adenylate isopentenyltransferase
  Pfam annotation: Domain name=IPPT; Domain location=74-273; Score =13.2; E_value=9.4e-12; Accession=PF01715.8; Description=IPP transferase
  Pfam annotation: Domain name=IPT; Domain location=39-267; Score= -110.3; E_value=0.0005; Accession=PF01745.7; Description=Isopentenyl transferase
  Pfam module annotation: Pfam domain module=IPPT::IPT; Domain location= 74-273::39-267
  Subcellular localization annotation: CTP_CleavageSite=45; ConfidenceScore=5.50e-01
MMNMLSVSAALCKPVASFNPASHSLRNMNSLSLFMNKKEKVVVIMGATGTGKSKLAIELATQFPPAEIVNSDKMQVYEGLNITTNKVTEEERRGVPHHLLGTVNPNTSFTAQDFCDQATLAVGSILGRDGLPIIAGGSNSFLDALVNHHTEFRLRYDCCFLWVDVSLPVLHSSLSARVDRMIHSGQLHEVRQSFQYHNQDYTLGIRKAIGVPEFHDFFRAEADGADQRTKQRLLQAAIASLKTNNCTLAKRQLQKIHRLYSMWKRNMHRLDATEVFLKTTRQEAEEAWEDHVLSKTRRILHKFLYEDTHVVPAGIASVVIASSPPPMPATAAAATH

SEQ ID NO: 95243 - protein, 30 aa, Glycine max
  Coding DNA Sequence Number=SeqID_3558
MDWTPRKDNIITFNAGAPHPIGTEDSVRVN

SEQ ID NO: 95244 - protein, 509 aa, Glycine max
  Coding DNA Sequence Number=SeqID_3559
  Gene Ontology: Mol. function=inositol or phosphatidylinositol phosphatase activity; Cellular component=intracellular; Biological process=response to abscisic acid stimulus
  Homolog annotation: Hit_ID=A5BNQ5; Match level="QueryCoverage=99%, HitCoverage=43%, E-value=0.0, Identity=73%"; Hit description =Putative uncharacterized protein
  Pfam annotation: Domain name=Exo_endo_phos; Domain location=6-316; Score=94.2; E_value=4.1e-25; Accession=PF03372.14; Description =EndonucleaseExonucleasephosphatase family
MGQWWLDTIGRALEEGKAFERMGSRQLAGLLVSLWVRKNLRTHVGDIDAGAVPCGFGRAIGNKGGVGLRIRVYDRIICFVNCHLAAHLEAVNRRNADFDHIYRNMVFTRTSSLLNTAAGMVPYLFLLCSLAFSTYLFWLLYSSGLPLVLSVTAGVSTAVHVLRGANATGVSSEEPKADLSEADMVVFFGDFNYRLFGISYDEARDFVSQRCFDWLREKDQLREEMKAGKVFQGMREALIKFPPTYKFERHKPGLGGYDSGEKKRIPAWCDRIIYRDTRSAPVSECNLDCPVVSSILQYDACMDVTDSDHKPVRCKFNVKISHVDRSIRRKEFGVVMTSNEKIRSILEDLCDVPEATVSPNSLVLQNLDTSLLLITNRSTKDKAIYKITCEGQSIVKNDGQAPDYSPRGGFGFPRWLEVTPAAGIIKPEQSVEVSVRLEDLHTSEESANGIPQNWWSEDTRDKEVILVVHVQGSSSVQTSCQQIHVRHCMSAKTVRIDSKSNSARRNQIS

SEQ ID NO: 95245 - protein, 867 aa, Glycine max
  Coding DNA Sequence Number=SeqID_3560
  Gene Ontology: Mol. function=translation elongation factor activity; Cellular component=eukaryotic translation elongation factor 1 complex; Biological process=translational elongation
  Homolog annotation: Hit_ID=Q8S3W1; Match level="QueryCoverage=48%, HitCoverage=100%, E-value=0.0, Identity=80%"; Hit description =Elongation factor 1-gamma
  Pfam annotation: Domain name=EF1G; Domain location=259-367; Score =158.7; E_value=1.6e-44; Accession=PF00647.10; Description=Elongation factor 1 gamma, conserved
  Pfam annotation: Domain name=GST_C; Domain location=106-198; Score =43.5; E_value=7.3e-10; Accession=PF00043.16; Description=Glutathione S-transferase, C-terminal domain
  Pfam annotation: Domain name=GST_N; Domain location=2-77; Score=66.0; E_value=1.2e-16; Accession=PF02798.11; Description=Glutathione S -transferase, N-terminal domain
  Pfam module annotation: Pfam domain module=EF1G::GST_C::GST_N; Domain location=259-367::106-198::2-77
MAPLILHGGKTNKNSYKTLIAAEYAGVQVDFAPNFEMGVSNKTPEFLKINPIGKVPVLETPDGPVFESNAIARYVTQLKGDNTLYGSSLIEHAHIEQWIDFSSLEIDANIIKWYAPRVGRGPYLPPAEEAAISALKRALAALNTHLASNTYLVGHSVTLADIIMTCNLYLGFANILVKCFTSEFPHVERYFWTLVNQPNFRKIIGQVKQAETIPPVQSAKKPSQPKESKPKVKNEPKKEANKEPEKPKEEAEEEAPKPKAKNPLDLLPPSPMILDEWKRLYSNTKTNFREVAIKGFWDMYDPEGYSLWFCDYKYNQENTVSFVTLNKVGGFLQRMDLARKYAFGKMLVIGSDPPFKVKGLWLFRGQEIPQFVIDECYDMELYEWTKVDISDEPQKERVNQMIEDCEPFEGEALLDAKCFKQLETGWRQHNLCLWILISHFSASFPPRSILSSVVRHPIKSSNLLGCHVVESVIRVMPLSRFAADYSVKSAKARPSLAVAMAGGKYMQMTGGIINTKWNVKTAGYILLYCFPLFVLQLFVIFVGGEFKSSSSSSCTYPLLSTLLLGLFALILTSYLFWLGSRILKLVINKGLQKRVYTLVLSVSGFLPLRVVFLGLSVLSGPEDFMFEAFAFLAFLALASCAGVCMCMLVYRPLADCLALDINDTTSLIKGDRDATFLQLSLFSPTPNRFLSFLSSVKFMSPVKPTPWKPCNWRRTSSVLANQCADFLARLGSSSSETLRTVALPLPEMKPLLLADASRDSMFDTAKMVENGFVQDDITPPPKSCSNKKMVEPGKPAGLTWQRKLNNNGNASSQISLSLKEIIHLAPIGYRLWRHCREEAAKGRGGMIDPFAKRHVTFCHGVPLGGIG

SEQ ID NO: 95246 - protein, 1366 aa, Glycine max
  Coding DNA Sequence Number=SeqID_3561
  Gene Ontology: Mol. function=nucleotide binding; Cellular component =microtubule; Biological process=regulation of transcription, DNA -dependent
  Homolog annotation: Hit_ID=A7QCC0; Match level="QueryCoverage=65%, HitCoverage=96%, E-value=0.0, Identity=71%"; Hit description =Chromosome undetermined scaffold_77, whole genome shotgun sequence
  Pfam annotation: Domain name=DUF482; Domain location=990-1364; Score =525.0; E_value=8.4e-155; Accession=PF04339.3; Description=Protein of unknown function, DUF482
  Pfam annotation: Domain name=Dynamin_M; Domain location=268-547; Score=-46.3; E_value=3.7e-08; Accession=PF01031.11; Description =Dynamin central region
  Pfam annotation: Domain name=Dynamin_N; Domain location=38-219; Score= 119.4; E_value=1.1e-32; Accession=PF00350.14; Description=Dynamin family
  Pfam annotation: Domain name=GED; Domain location=735-828; Score =25.6; E_value=1.8e-05; Accession=PF02212.9; Description=Dynamin GTPase effector domain
  Pfam annotation: Domain name=GTP_EFTU; Domain location=33-311; Score=- 82.7; E_value=0.051; Accession=PF00009.18; Description=Elongation factor Tu GTP binding domain
  Pfam annotation: Domain name=MMR_HSR1; Domain location=36-220; Score =7.3; E_value=0.00023; Accession=PF01926.14; Description=GTPase of unknown function
  Pfam module annotation: Pfam domain module=DUF482::Dynamin_M::Dynamin_ N::GED::GTP_EFTU::MMR_HSR1; Domain location=990-1364::268-547::38 -219::735-828::33-311::36-220
MEAIEDLVQLSDSMRQAAAVLADEDVDNYKRPSTFLNVVALGNVGAGKSASLNSLIGHPVLPTGENGATRAPISIELNRDTSLSSKSIILQIDNKTQQVSASALRHSLQDRLSKGSSGRSRDEIYLKLRTSTAPPLKLIDLPGLDQRIVDDKMVSRYMLSCPKFKFSMRISEYVEHNDAILLLVVPAAQAPEISTSRALRVAKEYDAESTRTVGVISKIDQASSEPKALAAVQALLLNQGPPKTSDIPWVALIGQSVSIASAQSGSGASENSLETAWRAETESLKSILTGAPQSKLGRIALVESLAGQIRNRMKLRLPTLLTGLQGKSQIVQEELVKFGEQMVSSSEGTRALALQLCREFEDKFLQHLTGGERLELFLMCHIGDFRMSKDDEGNGWKVVASFEGNFPNRIKQLPIDRHFDINNVKRIVLEADGYQPYLISPEKGLRSLIKGVLELAKEPSRLCVDEVHRVLVDLVSSSANATPGLGRYPPFKREIVAIASSALEAFKNESKKMVVALVDMERAFVPPQHFIRLVQRRMERQRREEELKNRPSKKALDAEQSILNRATSPQTSQQSGGNLKSMKEKSSQQDKDTQEGSGLKTAGPEGEITAGFYYSSQNLYYRSNITKECNIDEISDDDEASTKSSKDKKSNGPDSGKASNLIFKITSKVPYKTVMKAQSAVLLKAESMADKVEWINKLRSVAQAKGGQAIGEPSFPMRQSLSDGSLDTMARKPADPEEELRWMSQEVRGYVEAVLNSLAANVPKAVVLCQVEKAKEDMLNQLYSSISAQSSAKIEELLQEDHDVKNKRERVQKQSSLLSKLTRQLGVHDNRASAASNWSDKGSAAESSPGSSGPSSVDDWRSAFDSAANGPSDLPSRYGSGGHSRRYSDPSQNGDVSSGSNSNSRRTPTRLPPAPPHSESEWMWCSGEVGMAAVSVSVTVRVRWCTRKPPTPTPTRFSVNALFGDWGFGNRTRNSLQQQFTFTLADSKVISVSVVSSISDVASSEWDACALDATGPDNFNPFLSHAFLSTLEHSASAVRETGWIPHHIVAKANNNSNNNVVAVVPLYLKTHSYGEFVFDHSWANAYHSYGYNYYPKLQSCVPFTPVTGPRILLRNTSFKHQVFDIIVSAMKELALTVIHSQLSSLHVTFPSENEWHKLTEKGFLPRIGMQYHWKNRNYKNFDDFLMDMKQSKRKNIRQERKKARHWDSFYSFYRNTTDNKWGTPHLTREFFHELGAKMGDNVLLVVAEEGDELVAGALNLIGGDTLFGRLWGCQPRSYYPSLHFEACYYQAIEAAIELNLKTVEAGAQGEHKIQRGYLPVTTYSCHYLIDEEFREAIQDFLIREAAQVKLVIKLLHDSGPFKEGIL

SEQ ID NO: 95247 - protein, 146 aa, Glycine max
  Coding DNA Sequence Number=SeqID_3562
MAKWCGMTIICLHMSSSSPPLDDKRAQNDDNLSLRAIRHDRAWMERRRMTIICLCVPSNTSEPGWKAQNDHNLSLRAIGHDRLWMAKKCGMTIICLHMSSGSPPLDDKRVQNDHNLSMRAIGHDRAWMERRRMTNLSLRAIEHDPL

SEQ ID NO: 95248 - protein, 105 aa, Glycine max
  Coding DNA Sequence Number=SeqID_3563
MDKPKCPSPREKISGVATNVYSRKMLEKPKRGLRILKRRVRELFMHKEGKGSLWGSCSSPRRASFFTMKLFGGPGELEASLGELGSRKTKEKTLLSLFFWYFSHS

SEQ ID NO: 95249 - protein, 211 aa, Glycine max
  Coding DNA Sequence Number=SeqID_3564
MVIDQSLFYDLTQLSSDGVPFEGALNDDWKFDFSLYDACRLVCTNQADMTRRLLASSLALESRILHYLIVCILLHKSSNLAQALRLNAPLPYPYLVTLFLQHFNIPLDSEPYVPIKRSFLIGAVVVASFGYCKERDDSWRTREPRLCSPAKGHVATDRFDGLQTYVGERFDSLERQVDTRFEEMNSRIAKVEEDVTIICDFFDLPPPPPSI

SEQ ID NO: 95250 - protein, 42 aa, Glycine max
  Coding DNA Sequence Number=SeqID_3565
MQCNIFECDGALTLWQVKAYACMISEMRNNVVPNPDMHREPH

SEQ ID NO: 95251 - protein, 282 aa, Glycine max
  Coding DNA Sequence Number=SeqID_3566
MASLLYCHEGSGIRLDYHEESGILSFLNLAPISHTSYITLDRARMIYGIIQRMDMNVGYMISAHISMIAQHDSSRLGFPALITALCKARGVPSDSLTFKSFSPAINVAYVKKNCWNLDDLTVTFRGPCKAKGKRSEALPSFEIPFLQLLHLLIFLLYQLQLPLPYQLRQFQLLLQDHPPSHLRHYFACCKAFIKASVDEFLSQVAWPGVQPSPSGGGKATAAQEPMPAEEPVLVAEDELVPPEPFIFETDLVAQEEAVAQEPTSPATILDDPEPSAPASDPE

SEQ ID NO: 95252 - protein, 53 aa, Glycine max
  Coding DNA Sequence Number=SeqID_3567
  Subcellular localization annotation: CTP_CleavageSite=34; ConfidenceScore=5.07e-01
MCLAKGSSASLSHRHLSKRMSVHPQKMNSLSAVRALIEAVPESNKHENAVTRK

SEQ ID NO: 95253 - protein, 104 aa, Glycine max
  Coding DNA Sequence Number=SeqID_3568
MKSLLLETVRMIVVAASNKEEQGISMRFIDKRRWIWALWGQRIWDQLWVQLVLESSQVGLKCHQVTYKMINENLVKLAINYNRSFHKIVNENLVNNSEWHRIDE

SEQ ID NO: 95254 - protein, 693 aa, Glycine max
  Coding DNA Sequence Number=SeqID_3569
AKDPRVEANDISRLKKRKFPPPFPLPHCSQWKNNRYGVPFEGSLNDDWKFDFSVHDAHRFVCTNQADMTRRLLAGSLAFESRILHYLIVRILLPRSSNLAQVSKEDLIVMWAFHKGRQIDWAYLVRYRMHNVLRLNAPLPYPHLVTLFLQHLSIPLDSEPYVPIKRSFLIGAAGAQPIDEEGHLPVGEDFSLLQRILDRFDGLQTFVGERFDALELQVDMRFDEMDSRITKGTFFVVQVEGTSIWVVLTENKRRYISYGSVQVEGFYKVEKKSQGPQVAWGLDTPEVLSGNRNEHAKCTRALSLFITTVKILDFQMNGLSGPCRAKRMTSKKRKTPSTPRKILPERNVILHHSEVDEFTKELKCRNWHKDLTNFVDGTIDVAIVKVRGRLVKFDADTLNLFLKTPVILEEGENFLVYSRFCHSKPEPRELVARLCIPGRGFKLNADGLPLKILRKNLTMLAKISLIAQHDSSRLGFLALITALCKAKGVVSDSLTLESLGPAINVAYVKKNCWNLDDLSVTFRGPHKAKGKKYEAPPSFEVSLSSAPAAPFASTYVLLVPLFVGPNFIFTPQMMHSMLQSIHRVQSIIMQSLQGLGLPSIMSMDEFDAQVAWPGAQPSPSSGGGASVAQELASEEPATATAEGDDEPTPPEPFYFDADQIPEPSPAPTPDDATRSALAPELEQPISQDSLDAQ

SEQ ID NO: 95255 - protein, 74 aa, Glycine max
  Coding DNA Sequence Number=SeqID_3570
MPLKGKQLVVYPCKTLGGPLVSPPTTTLHSTAEHVQKRARIFQRICPKIERPSSSSGTNLSKNMPKDGETWQLK

SEQ ID NO: 95256 - protein, 173 aa, Glycine max
  Coding DNA Sequence Number=SeqID_3571
MAITELERETKRARKKEHDQNSELKLRRAERDRSWVEGMILKDELKACHRSKRSLSKQLSKTEGNMWAIIDQYKEKLSLAATHEQRLEDEYAKVSTLQAEREARERVIDSLHREAMMRMDSFTFTLNGSQELPRLLAKAKAMADVYSSPKEVHGLLNYCQQMIDLMAHTIRSR

SEQ ID NO: 95257 - protein, 108 aa, Glycine max
  Coding DNA Sequence Number=SeqID_3572
  Gene Ontology: Biological process=transposition, DNA-mediated
  Homolog annotation: Hit_ID=Q1J7G7; Match level="QueryCoverage=39%, HitCoverage=61%, E-value=5e-12, Identity=81%"; Hit description =Transposase
MVKVGTSYVPINVSFSPKVGPGLPGINRDTRIYLFCEVLQWLLFLSAVPPVQLLTGWCVTAKAPPDISAGKCSGAIGAGLFAITPAGERGMCCKAIKLGNARVFPVTT

SEQ ID NO: 95258 - protein, 90 aa, Glycine max
  Coding DNA Sequence Number=SeqID_3573
MKHGSKLPGGGYMNIIAIHRAPKKGREWRIAQSNHYAWLQTRSSLVNHEAWVQTLWWRMHERKRNSWVSYPNFVRGPLLDDMRPFFGPCE

SEQ ID NO: 95259 - protein, 145 aa, Glycine max
  Coding DNA Sequence Number=SeqID_3574
YIEQLTEMLKMFFTMPLGYINGVGTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPEFDILKAFPHSLEGVAKDWLYYLAP

SEQ ID NO: 95260 - protein, 84 aa, Glycine max
  Coding DNA Sequence Number=SeqID_3575
MASEWRRKRERRHHFKKKMSLEEAHHHRRPWIRAWRKKEMNEGRGREEHEILCSKRALKSEPTIQDQVQDSPLSMLRCHEACKA

SEQ ID NO: 95261 - protein, 83 aa, Glycine max
  Coding DNA Sequence Number=SeqID_3576
LLLAWNNALKYLDDVPQPKSKAPARWIVVKSNRQKGSTECDYYVMHWMSTIILGSFSNNLEAYFNDPKPLEPKRLKVLQIQWA

SEQ ID NO: 95262 - protein, 78 aa, Glycine max
  Coding DNA Sequence Number=SeqID_3577
MKMRTNSASLHSQAHRQSWLYCKSQCMWPSVHMGLRSASHEIDFLELTVSRSEAIMSTLDAPISDSLGSGKIEDDSND

SEQ ID NO: 95263 - protein, 64 aa, Glycine max
  Coding DNA Sequence Number=SeqID_3578
  Gene Ontology: Mol. function=DNA binding; Biological process=DNA integration
  Homolog annotation: Hit_ID=A5BKB9; Match level="QueryCoverage=76%, HitCoverage=4%, E-value=2e-10, Identity=59%"; Hit description =Putative uncharacterized protein
MVKSVGVQFYEMWKLKKLEFSFSQAVSYDNSEKWLNAMKEEINSMEHNGVWDLVELPKGCKRVC

SEQ ID NO: 95264 - protein, 131 aa, Glycine max
  Coding DNA Sequence Number=SeqID_3579
  Subcellular localization annotation: CTP_CleavageSite=64; ConfidenceScore=5.28e-01
DCDHKAPSGPGGAQQGPGVSSSGYRPLSALQGARPPQKGIAPVRHPVDSEKSNRVLGFPALELRASVSSTKCLPPPARSSGPPTNQAFIKKYCAPRQAQGDTPQQPGDGRQRATGAPPPPLEFTSAHPQKG

SEQ ID NO: 95265 - protein, 98 aa, Glycine max
  Coding DNA Sequence Number=SeqID_3580
  Subcellular localization annotation: CTP_CleavageSite=35; ConfidenceScore=5.55e-01
MATPPSSPPPPPTGAASHSPSTLKRTRKVRRLRSLATRLVGAERPLVHVDPAIGKADSPHRKKLRTYLGIVTRDKVDVTYENWKKVPATHKDLIWEDI

SEQ ID NO: 95266 - protein, 138 aa, Glycine max
  Coding DNA Sequence Number=SeqID_3581
  Subcellular localization annotation: CTP_CleavageSite=76; ConfidenceScore=5.12e-01
MKLASTVYWSTFPFFCFAGFQQGPYNQQGQWRSHPGNQLIKDQGGRSNRPPQQGPNIFQRTTKKEETLTQFMQVTMSNHKSTESALKNHEIQMGQLAMQLAEKLSSSFGANTRKNPKEECKVVMTRSRKLVVRFRCVN

SEQ ID NO: 95267 - protein, 38 aa, Glycine max
  Coding DNA Sequence Number=SeqID_3582
MPVLAETKGNVRSASSGETSSLDLDRSSFLPDVDCHFF

SEQ ID NO: 95268 - protein, 151 aa, Glycine max
  Coding DNA Sequence Number=SeqID_3583
MGEADFQRMPREDCSRPPKNREKSNYGHNDEHVSLHEEVMDSQVITDCRYYAVAMNMLPSMVQSKLNHPLGRLRKLGQMKRVREGETHAVTAIPIRHAFPSSFPPTQQCHYSANNKSSSLPHPPSYPQSNLPISTKSLPWGRHNDEFPTTI

SEQ ID NO: 95269 - protein, 96 aa, Glycine max
  Coding DNA Sequence Number=SeqID_3584
  Subcellular localization annotation: CTP_CleavageSite=20; ConfidenceScore=5.18e-01
MMTKVMTKSSKINQRTTQVNQEQFKSSKIRIKKNSRLKKKVKSQESRFKVQDLKNQDQDSRLKKKVKSQESRFKVQDLKNQDQDSRLKIQESREGL

SEQ ID NO: 95270 - protein, 56 aa, Glycine max
  Coding DNA Sequence Number=SeqID_3585
MGHLRFVILFGRNNQHENTEKGVEDKSPKFQEPRDLRSNPFQGGENDAILSRKSIG

SEQ ID NO: 95271 - protein, 133 aa, Glycine max
  Coding DNA Sequence Number=SeqID_3586
  Homolog annotation: Hit_ID=A5B3J2; Match level="QueryCoverage=81%, HitCoverage=30%, E-value=5e-10, Identity=32%"; Hit description =Putative uncharacterized protein
MDEEPRRVTLEDYSSSSVPQFFTSIARLEVQAQNITYPHSLIQLIQNNLFHGLPNEDPYAHLATYIEICNTVRLAGNNVKTWDEVVEKFLKKYFPESKTAEGKAAISSFHQFPNESLRGKIKLKTLEEAMELI

SEQ ID NO: 95272 - protein, 113 aa, Glycine max
  Coding DNA Sequence Number=SeqID_3587
MVSLTRAAAVHLQLATTSPPLAIAMPDPVPAWACKLAQACDQSRKPQGPVGPLRVHWVSRGENVAKQQHHPNLCEGGHAGAHDSHPSPRYARAKSYLETHSNWLIAFSSKLEA

SEQ ID NO: 95273 - protein, 104 aa, Glycine max
  Coding DNA Sequence Number=SeqID_3588
MKFSFIAMSRSITESNNIKPCDSASSSEEIQHVGHIVILLSSSIVPKGPFGSCPCLKIGLISEPSNGGPKLHEGRPREGTGVLTLPVHIVPDRMSRLAAPGPCD

SEQ ID NO: 95274 - protein, 160 aa, Glycine max
  Coding DNA Sequence Number=SeqID_3589
  Subcellular localization annotation: CTP_CleavageSite=64; ConfidenceScore=5.08e-01
MAIKNPSHSSTSDSENIPSPSPSTHKHKGKGKAIEGVAISSPKKKSSMKVKKSGQKRRRPQYEVAALFKDRKLLEKFDIRWRWMRVFDVHEPNHPRLVRAFFAAIVVDSSNFTVKTTLKVSYPNFVRGLLLDNMQPLIGRFEIPDNLCCTICEVQRRIGN

SEQ ID NO: 95275 - protein, 128 aa, Glycine max
  Coding DNA Sequence Number=SeqID_3590
MHENEWHRVCLLHAPNWEPIGQYLGASEGEAHGCTFQRRKDARSRHQRLFVENVGKTEGNRSKMKIISSGVVFTFEEGISTSHVDKSGALAPTYPPSKRKSDLRSSFFKSESSDSFYLKGDHFKALDL

SEQ ID NO: 95276 - protein, 44 aa, Glycine max
  Coding DNA Sequence Number=SeqID_3591
MFFPVMQSYPARALDRRLQEDWARDAREGPGVLMSLRVDFEPMG

SEQ ID NO: 95277 - protein, 95 aa, Glycine max
  Coding DNA Sequence Number=SeqID_3592
MAGVGGAGLDDEGMSSVLALVLDAIYKKGIQTTTKIKLKPMEARLSVRLSTQILTKLPGLSESASLSHRYCIKRMNIHPQKINSLSAINVLNEFF

SEQ ID NO: 95278 - protein, 79 aa, Glycine max
  Coding DNA Sequence Number=SeqID_3593
MNEVPRRVKNQKEARLAQSVKFRNVAEDEKRLFLRNPPTWAFQKLPPIGCCFWRKQPGSPGRAELAWASWAASISPILL

SEQ ID NO: 95279 - protein, 86 aa, Glycine max
  Coding DNA Sequence Number=SeqID_3594
MARRDKLWSFCALLSSRGGGPDDMRMTNYGIPHTVLPSYTLCPMARMTGGNTETDNGLPATFLFDSAREQQVILHAEISWSPKATL

SEQ ID NO: 95280 - protein, 121 aa, Glycine max
  Coding DNA Sequence Number=SeqID_3595
MPAILRLLWCFTLRLPGDAVLLDESSISRGPLKARTWSPLKARASSPLKARACSPLKVRACSPLKVKACSPLKVRTCSPLKARTRSSLKARAWIPLKVRACSPLKARACSPLKARTCSLLK

SEQ ID NO: 95281 - protein, 186 aa, Glycine max
  Coding DNA Sequence Number=SeqID_3596
MPKDQSASKFYSRQESKNPRKSRYMIKLISRILGRSFQIEKVKGLAKEFYLNHFKLRFTLSLLSVVIDYTSLVIAYQRRFSENNFQESHLSKWFMNGHQRGFLNTSEGLSLCGSDFVKGVLQREWKISRFTSDSPQISASPQQLDFAPYASGSYNAQWNALGFLHDKHTLRSSRILGKMEVEGGIL

SEQ ID NO: 95282 - protein, 58 aa, Glycine max
  Coding DNA Sequence Number=SeqID_3597
MWYHGDQSESQYFARMLQPCGIDTGLKEHSNRVTPKAYSPKSPSEPLPPDSGPTQKIF

SEQ ID NO: 95283 - protein, 424 aa, Glycine max
  Coding DNA Sequence Number=SeqID_3598
  Gene Ontology: Mol. function=ATPase activity, coupled to transmembrane movement of substances; Cellular component=integral to membrane; Biological process=transport
  Homolog annotation: Hit_ID=A2YH32; Match level="QueryCoverage=80%, HitCoverage=62%, E-value=1e-172, Identity=88%"; Hit description =Putative uncharacterized protein
  Pfam annotation: Domain name=ABC_membrane_2; Domain location=2-255; Score=24.2; E_value=3.6e-08; Accession=PF06472.6; Description=ABC transporter transmembrane region 2
  Pfam annotation: Domain name=SbmA_BacA; Domain location=35-306; Score= -74.8; E_value=1.3e-06; Accession=PF05992.3; Description=SbmABacA -like family
  Pfam module annotation: Pfam domain module=ABC_membrane_2::SbmA_BacA; Domain location=2-255::35-306
MARLDDADRHRRPVARSGLYQRADQPVESGVLRCAAEQELPGIQGAAVALYLSGADLHRAGGLQDLPDSGAADALAALDDGKQQIVDNPDQRIAEDLNVLTQYTLSLSLGLLSSLVTLFSFIDILWHVSGPMTFALGQHAITLPGYMVWFALLYAVLGSLLIWWVGKPLVILGFNQERYEANFRFGLIRIRENNDAIALYHGEPREAQQLGDRFDTIRSNWWAIMRITRRLNIATNFYGQFAIVFPLLVAAPRYFSGAIQMGGLMQIASAFGQVQGALSWFIDAFNDLATWKACVNRLAGFNAAVDQVHHQPRGIQLREETAHPLTLDNLSLNLPDGQPLLAGAEMTLQRGDRLLIVGPSGCGKSTLLRAIAGIWPYGAGAIGVAANANTLFLPQRSYIPIGTLREALSYPSLASEYSDPQLMR

SEQ ID NO: 95284 - protein, 387 aa, Glycine max
  Coding DNA Sequence Number=SeqID_3599
MHADQSQAVAANFLHRLRQVGIPDTVLAVLAAGVGFLAVAVAKTRVNAQPHRVPCGNLAELIQHVDGTGVDRDLQFADARQRGVIQHVRGKHDFARFAARLKTGLQRPLDLAQRHRIHLHALLAHQAQNMNVRTGLLCEADSVEVAQLSNALADDVRIIGPNRAAETLRQGQQVSGVQRSGGVVQRAWHGDIPNSKMTADNAIVPHAESGGKYLFSRSLFIYDIAFPLIERPRHAQHLFAADRNLSGGDDHRQPDRGGGPAADLATDPVRSGARALVPYRAGPTVVRRGAALLLRPRSHRQRRRRHPPVSAGAAVDRVPAGIFPIAAAGGVPALYRTLPGSQLQRYPARVAAAGRVVVGPAPRSRADGNHPDAGGHRAGDADDVERS

SEQ ID NO: 95285 - protein, 160 aa, Glycine max
  Coding DNA Sequence Number=SeqID_3600
LGKNNSGRTSLVCTRGNHGKFGLGYKPTQANIRKSIAKRKNRGQGSRLGQQAEGAPPCHISRTFISSGLRHEGQVAAICEDDPPRGSVLVRPCPPGFRLGNWRVEECPDVYATSIIFDDESLEGTNTRDPTIDFEQEAGRMESEEDEDEGLPPELERIIA

SEQ ID NO: 95286 - protein, 77 aa, Glycine max
  Coding DNA Sequence Number=SeqID_3601
MPFCERARQGSRVRFPREERCTESPPTFVCGKCRKNRRKPVIKNIPSSRVVFTLEEGRQKRGSCSYVPSIEEEIRPT

SEQ ID NO: 95287 - protein, 36 aa, Glycine max
  Coding DNA Sequence Number=SeqID_3602
MGVKNFEVVKRKLHANKQWSPDEIRIFIIKHGLHHP

SEQ ID NO: 95288 - protein, 83 aa, Glycine max
  Coding DNA Sequence Number=SeqID_3603
MSISPCGSISWDRAHKAPSGPEGALQGPGVSSFGYGPLSFLQGARPPQQKGEELATQLAQASQVASSKSNSLLEEESRRPKWA

SEQ ID NO: 95289 - protein, 192 aa, Glycine max
  Coding DNA Sequence Number=SeqID_3604
  Pfam annotation: Domain name=Ins_element1; Domain location=126-185; Score=-14.0; E_value=0.0028; Accession=PF03811.4; Description =Insertion element protein
TAGNGRGIHSRAMKTFQFAHGKRCNKGEHYPISPAHRLSLPYEIPDEHSSGGQESERSGYRYIEQLTEMPQNVLYDAIGIYQRWYIHWNLLRADNVSFSPKVGPGLPGINRDTRIYLFCEVIFRHSCPSCSATDGVVRNGKSTAGHQRWQAAQLLGRAIGAGLFAITPAGERGMCCKAIKLGNARVFPVTTL

SEQ ID NO: 95290 - protein, 297 aa, Glycine max
  Coding DNA Sequence Number=SeqID_3605
  Gene Ontology: Mol. function=transporter activity; Cellular component= integral to membrane; Biological process=transport
  Homolog annotation: Hit_ID=A8GI92; Match level="QueryCoverage=99%, HitCoverage=88%, E-value=1e-166, Identity=93%"; Hit description =Substrate-binding region of ABC-type glycine betaine transport system precursor
  Pfam annotation: Domain name=OpuAC; Domain location=1-279; Score =198.0; E_value=2.3e-56; Accession=PF04069.3; Description=Substrate binding domain of ABC-type glycine betaine transport system
STISEETFQTLLVSKALEKLGYDVKEPREVDYNVAYTSIASGDATFIAVNWDPLHADQYKAAGGEAKFYREGVYVNGAAQGYLIDKKTAEQYHITNVEQLKDPKIAKLFDTNGDGKADLTGCTPGWGCEAVINHHIKAYGLSNTVEHNQGNYAAMIADTITRYKEGKPVLYYTWTPYWVSDVMVPGRDVVWLQVPFSSLPGEQKNVDTKLPNGANYGFPVNTMRIAANKQWAEANPAAAKLFAIMKLPIADINAQNLRMHEGQASEADIQNHVNGWIKAHQATFDGWVKTAAEAAKP

SEQ ID NO: 95291 - protein, 89 aa, Glycine max
  Coding DNA Sequence Number=SeqID_3606
MGFRIGSKIPLAIYTLGVVAKYLDIAKIRLPITRAFIEKYCTQRQAQGDAPQAAGAPPPPHQAGPTGSFDMEQYLHHLVRQQAANHRAH

SEQ ID NO: 95292 - protein, 23 aa, Glycine max
  Coding DNA Sequence Number=SeqID_3607
ICLPKEEGGLGIKEISKFNEALL

SEQ ID NO: 95293 - protein, 75 aa, Glycine max
  Coding DNA Sequence Number=SeqID_3608
  Homolog annotation: Hit_ID=A5AGE5; Match level="QueryCoverage=81%, HitCoverage=5%, E-value=9e-23, Identity=71%"; Hit description =Putative uncharacterized protein
MGHIAKICWWVSKKPTQSDDIPQALAALTLDNTIAETKWSFDTGASNHMTGTDSVLIGDGSCGVPKLMTGLIEII

SEQ ID NO: 95294 - protein, 162 aa, Glycine max
  Coding DNA Sequence Number=SeqID_3609
MVVVVVMTRIVVMKIDHDGGCGGSGHGGDKFGIVYDNATTYGGNLEFGCLERNLSVSLCPNSVRLLVFVGGGRLFVGDMIILLSQGVRILFAKGRLLLYGRSSLGLYCFMCLCLVCLYVLSWPPRDGGRLPTVPQVLWCKHFSHELAFQGGMRPSSSKDVKT

SEQ ID NO: 95295 - protein, 133 aa, Glycine max
  Coding DNA Sequence Number=SeqID_3610
  Gene Ontology: Mol. function=protein binding; Cellular component =anaphase-promoting complex; Biological process=regulation of mitotic metaphase/anaphase transition
  Homolog annotation: Hit_ID=A7PUT4; Match level="QueryCoverage=41%, HitCoverage=28%, E-value=6e-21, Identity=87%"; Hit description =Chromosome chr4 scaffold_32, whole genome shotgun sequence
  Pfam annotation: Domain name=APC10; Domain location=2-124; Score= -43.0; E_value=2e-05; Accession=PF03256.7; Description=Anaphase -promoting complex, subunit 10 (APC10)
DETIVGAQSSKLSTLPVNKLIVLYVVFKLDESYTPSKVSIRAGDGFHNLKEIKTVELVKPTGWVYPSLSGVDPSVDETNLRSMLVSSKRFNSTLKVDDDGKFKSWSFGPAGFALSLLWSEIGGEPIVVLHFWR

SEQ ID NO: 95296 - protein, 152 aa, Glycine max
  Coding DNA Sequence Number=SeqID_3611
METTKSTQRALQSVEIQVGELVEVVTQFMVRQEKSFVEVEAQKKSLVQEHESREKDEEKDEEQAQQQWEKYSTVENQQENILQSNNLPHQLIDKKGRQGEHEETLSAILSLITNTFLEMIWNFLPDYMKFMKFLAKRRNFMEDVFFVTFMPP

SEQ ID NO: 95297 - protein, 160 aa, Glycine max
  Coding DNA Sequence Number=SeqID_3612
MWAFHKGLQIDWAHLVRYRMHKALRLNASLPCPHLVTLFLQHFNIPLDSEPYVPIKRSFLIGASVIASFGYIKEHDGSWVKKGARNVGEEGNEGEDSSLFLKIMERFDGFQTFIGERFDTLELQVDMRFNEMESRMTKVEEDVSYIRSSFDLPPPPPPSS

SEQ ID NO: 95298 - protein, 122 aa, Glycine max
  Coding DNA Sequence Number=SeqID_3613
MKGQIRSFILYRNHEPSWKIPLQSTGSSHCGVSTKNNNVLRWLMVAVGDGESAWDIRNGFGRRKGEEMAFFLSYTKAKAETKFREDPTVNEGWAAFLPRQFHVAFSRSFIKRLPPEASSWLL

SEQ ID NO: 95299 - protein, 121 aa, Glycine max
  Coding DNA Sequence Number=SeqID_3614
  Homolog annotation: Hit_ID=A7R311; Match level="QueryCoverage=30%, HitCoverage=10%, E-value=1e-07, Identity=70%"; Hit description =Chromosome undetermined scaffold_470, whole genome shotgun sequence
MFLHVGLSQQVVIAKHKGYVSGSLSDEGKVELGGDSGKSESSLEKGLVDRSDASDVDAKVDNMARCFRTNQRILVLSAAKVAKKMKLKFTKEWIAYLRLPLPIDVYKELKHYILKHGANVM

SEQ ID NO: 95300 - protein, 26 aa, Glycine max
  Coding DNA Sequence Number=SeqID_3615
MAYAFSHQVYAIFLVVILKATKILYH

SEQ ID NO: 95301 - protein, 157 aa, Glycine max
  Coding DNA Sequence Number=SeqID_3616
  Pfam annotation: Domain name=Transposase_23; Domain location=37-107; Score=-10.3; E_value=0.016; Accession=PF03017.5; Description =TNP1ENSPM transposase
MQSQRLALPPKHEVGPSGPRVSTKESYVDPLGNDPKTGDSDICGLYIEANPSHPIALGRVYEGSTAVHNIPLSHGQVKVGVEDVKDVEALVPVPTDEVTLVGQALNTFLAWLAHLVKLSEQVAVSPAKPPERSNPEVDDPLYLMTLTIPKLFLKPLQ

SEQ ID NO: 95302 - protein, 275 aa, Glycine max
  Coding DNA Sequence Number=SeqID_3617
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIARRLDKTVAMIEQGLAGGTCLNVGCVPSKTLLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 95303 - protein, 29 aa, Glycine max
  Coding DNA Sequence Number=SeqID_3618
MEVFMIQAKIEEDEKEIVEIEICFPKQSE

SEQ ID NO: 95304 - protein, 107 aa, Glycine max
  Coding DNA Sequence Number=SeqID_3619
  Homolog annotation: Hit_ID=A0ST23; Match level="QueryCoverage=23%, HitCoverage=51%, E-value=3e-07, Identity=100%"; Hit description =Putative reverse transcriptase
  Subcellular localization annotation: CTP_CleavageSite=69; ConfidenceScore=5.06e-01
MVKVGTSYVPINVSFNLNQIFGPGLPGGARYQLLFPLVRVNFELGVIMVIAVSFGKPVVPAALMNRPTRGERRFAYWALAECILAYYVGTDEGVSEVLHVAGEKRLH

SEQ ID NO: 95305 - protein, 43 aa, Glycine max
  Coding DNA Sequence Number=SeqID_3620
MATKGWSFVGASMVEEEEENGNVRERRKRLLKFLGLTMPHVSI

SEQ ID NO: 95306 - protein, 59 aa, Glycine max
  Coding DNA Sequence Number=SeqID_3621
TYQGNPCGVYPDLSSFTKSGIYPDLSSFTGSGVIQISVACIKRSAPSQVHIIWYQSFSS

SEQ ID NO: 95307 - protein, 97 aa, Glycine max
  Coding DNA Sequence Number=SeqID_3622
  Homolog annotation: Hit_ID=A5B134; Match level="QueryCoverage=100%, HitCoverage=15%, E-value=2e-07, Identity=38%"; Hit description =Putative uncharacterized protein
MSNYFIGYSERSRSYKFYDPKLKTIFETGTTTFFEDIEFGGRNKVRDFVLEEESVTIPEPIHIVAFDKANSKPLQDIVIESPTQDNLVVHEEQTQDP

SEQ ID NO: 95308 - protein, 100 aa, Glycine max
  Coding DNA Sequence Number=SeqID_3623
MVISNVLLFLLPKNPKLEMRTLRQSRVCEVSLLIVDGSVRVCEVLLLIVVGRWKYLLFASFGIHEVISAFFLLWWSLMSLLVEWSRFCLPRGQPKNKQGG

SEQ ID NO: 95309 - protein, 79 aa, Glycine max
  Coding DNA Sequence Number=SeqID_3624
MLGFTSDSPQILAIPHQLDFAPYASGPYNAQWNAPELLHDKHRLRLSWMAFVDNWVVGKEKGCYWLSNDIVGLVGNLAV

SEQ ID NO: 95310 - protein, 75 aa, Glycine max
  Coding DNA Sequence Number=SeqID_3625
  Gene Ontology: Mol. function=phosphoprotein phosphatase activity
  Homolog annotation: Hit_ID=A7QSI2; Match level="QueryCoverage=72%, HitCoverage=23%, E-value=9e-12, Identity=50%"; Hit description =Chromosome undetermined scaffold_160, whole genome shotgun sequence
MSVAWCAVVPLICFHVVEWHQPDRVLRQFGMQQPISESPSQPHNIHGLTLKGKQDENWRKTKMFVDQNNAKTSTL

SEQ ID NO: 95311 - protein, 161 aa, Glycine max
  Coding DNA Sequence Number=SeqID_3626
MGHNRTSEASFLNFERLDTLRDIIGHSSKKLLSFDFAQSFNSEFQASRYNTGHNRTSDISIHFGTQSDIRVKSYCRLILLRASVLNLEHLDILRDTIRHPSKKLLSFILLRASILNFERLDILRDSFGHPSKKLLSFYIAQNFCSEFRASRYTTGFNRTSE

SEQ ID NO: 95312 - protein, 177 aa, Glycine max
  Coding DNA Sequence Number=SeqID_3627
MSSKQRKSGGSKPTTQYDTRRFHSFEAWTRYDDNVMGRHILAERKVEIYHTELDEFKAELERRNFHKCLTNLDDSSIDLALVKEFYASLYSPEGPSPKQVRIRGHLIRIDADSLNAFLETPVVLSEGESLPAYSRYCRMPTDIKEIEVALCIPGRGLILNAEGHPRKIIRKDLTTFA

SEQ ID NO: 95313 - protein, 69 aa, Glycine max
  Coding DNA Sequence Number=SeqID_3628
DKPEESSSTPTHAQCICSSLSEAIVSSVLSTRLVLSQISLTRAKRAFEIYEFLSDSEVPRGGGDIPTPL

SEQ ID NO: 95314 - protein, 45 aa, Glycine max
  Coding DNA Sequence Number=SeqID_3629
MKAMPSKPIRKGRKWLKAQVEKDEGLSGEGQSPRVEKDEGPSGEG

SEQ ID NO: 95315 - protein, 342 aa, Glycine max
  Coding DNA Sequence Number=SeqID_3630
MKREKHASDSSHNYCKSLSEELRDYYEGRHRSHLRPHSHRREKERKPQEANINLSYFHGKDNVEANLDWEIRVEQQLKKKSTSKSYGSHSYPKKDQGQGILGVTPSKPKDDKGKAIEKQAPKATKIEATTSPSSSESEEAKGEESSEEIYPQEDGQPLVVKEKCKEVSVSSKRLAKKETHFTIKTNIKETFPLRQPPHFLFCKKTLASIATPLGLEFIPQVKKLLDEGLVRKSLNPCALLVPKIGIIRHQIPKIGGMMNVLSGATLFCKITCAPNILMFQSKLSDQGVPMNPKRIKVIPEWPTPPTPLIELVRNHVPSWEDAQEMGFQTLPYSNIPNTTNTY

SEQ ID NO: 95316 - protein, 165 aa, Glycine max
  Coding DNA Sequence Number=SeqID_3631
MAPKKLTSKRARKTTEGKGSSIAPPVEFEFDGHRFFSEEHQCRFEETKDWSFLKERRVQLAEGEHFEFQTKISRRHWTQPAKPMPKYDPEVVLEFYANDCPTEEGVLDKRSKVWGQWIPYDIDAINQFLGNPLILEEGQQCEYTTRRGQTTKRSSMRDSTIDYHT

SEQ ID NO: 95317 - protein, 93 aa, Glycine max
  Coding DNA Sequence Number=SeqID_3632
MTPVEAMPSKDYFDDAKESRVKQIPKIQESNFKKQDSRFKNHVSRIKIKIQESREDSIKISTKKSFSITLSSTRSFHKIITKEFYCLVIDYQK

SEQ ID NO: 95318 - protein, 78 aa, Glycine max
  Coding DNA Sequence Number=SeqID_3633
MAHPPPRERTLRELAAPDFTYESLCIQYPDEDVPYVLKTGLIHLLPKFHGLAGLSSFFRGSGEGLAILPCSMVHHELG

SEQ ID NO: 95319 - protein, 28 aa, Glycine max
  Coding DNA Sequence Number=SeqID_3634
MNVPVNILVEKFEDEGLPTGKVVVVLNN

SEQ ID NO: 95320 - protein, 167 aa, Glycine max
  Coding DNA Sequence Number=SeqID_3635
  Pfam annotation: Domain name=G-patch; Domain location=45-89; Score =18.3; E_value=0.0012; Accession=PF01585.14; Description=G-patch domain
MSQCPSSAPYVEAAEESLETAFQSFEVVSCASVEPSPSLPSLSKAAIMVARVMLRNGFEPGMGIGKDCLGNADVVDIKGNPYKYGLGYEPGMPGRRNVPSRFRADRVWPGCISQCFTSTGMVSEEEVTAIEEEFPQDPPSFVQACHPNSQVGNWRVISQSEVYIADS

SEQ ID NO: 95321 - protein, 129 aa, Glycine max
  Coding DNA Sequence Number=SeqID_3636
MSASPPGCLVMNFPEHTVYFDEYTPFRLLSEENFADYMSMGVKRLKLINQGPHANNDCPRMKLGDSGSLKTTKASAIGLAISGRRGADNRKGVDDHIGLCLSSDLGSPNDELLITVRCLCMPPDSRVAG

SEQ ID NO: 95322 - protein, 89 aa, Glycine max
  Coding DNA Sequence Number=SeqID_3637
MQRRSPIGDLIPIDLEINATCRRHNIERISKFLQDLEAAATPEEEPQSSEVSSSFPIRRQSHTNLIEEVIMAKEPRRVTPEDYSSSSVP

SEQ ID NO: 95323 - protein, 333 aa, Glycine max
  Coding DNA Sequence Number=SeqID_3638
MWLKGLKTPVFLFGNRDEHDRTKPDHVALSTFILLMSFNDESAKCVCALSGPTWERYTDIIVPRKLLLERNVVIYHTEFDEFKEELERRRWDEELTSFYANLYDPEDKSPKQVRVIGHLIKFGEDALNTFLKTLVIIEERETLLAYSRFALLRSDPQELAAKLCILGRGFELNADGQPLKILIKMDMNQGYLISHQISITQHDSSRLGFPALITTLCKARGVTSDSESLESLSPAINLAYIKKNCRDLDDPTVTFRGPRKAKGKRSEAPPTSAAPDASAPSSSTLPDPTSATPSSSTPATPASIPAQFPIQLPASSAPASDFVLTLEMLHSMM

SEQ ID NO: 95324 - protein, 52 aa, Glycine max
  Coding DNA Sequence Number=SeqID_3639
MSRNFTDCLTMGFKYLEAIKRRSHPTKQMVPERKWAPNDQHHPDTIEFVPLG

SEQ ID NO: 95325 - protein, 162 aa, Glycine max
  Coding DNA Sequence Number=SeqID_3640
  Homolog annotation: Hit_ID=A7QZ64; Match level="QueryCoverage=59%, HitCoverage=25%, E-value=1e-29, Identity=62%"; Hit description =Chromosome undetermined scaffold_265, whole genome shotgun sequence
  Pfam annotation: Domain name=DUF821; Domain location=3-156; Score= -213.4; E_value=4.4e-08; Accession=PF05686.3; Description=Arabidopsis thaliana protein of unknown function (DUF821)
MFLKIKIGMLVYLPRIGFENHKRGSANQTCQVNALIDIRCTLKVLLGQSVKNTFCHVTLPLYVYDYMFHLLNSYAKLFRYKPSISANATELCVESMVCGAEGSVKKFMMESLVKVPANTDPCTMPAPFDPPTLYATLQRKESSIQQVESWEKSCWDNQTITS

SEQ ID NO: 95326 - protein, 394 aa, Glycine max
  Coding DNA Sequence Number=SeqID_3641
  Homolog annotation: Hit_ID=Q6WAY6; Match level="QueryCoverage=91%, HitCoverage=63%, E-value=8e-24, Identity=28%"; Hit description =Putative uncharacterized protein
KGESAPFIDILALLIFGGVLFPNVDGLVDLATIDAFLAYHNHKESPVVAMLADLYDTFDRRCEKSNTRIVCCTPALYVWLVSHLFRQEVRHACPVENHRSCTEKGGANWDQLLASKEGASVNWFLQWREGRTRVLISCRGFPNVPLIGMRGCISCNPVLAIRQLGYPMIGALLEEEPAPAISRGFNKTDVETLQKVRQAWEVVQKKDKELRGSNNGPIGGYRKWLKAHVQGLDWLPSLRTVKREEVEASEEDEEVQALRAKLEQAQIVKERFKLAALKIRKENAELRDINEATTKALEQETKRTRKEEHGRDKFRGALWSSNSELKLRREERDQSRAHGMVLKEELAACSGSKRSLSQHLCETETNMLAIVSKYQEELNLATAYEHKVADEYAR

SEQ ID NO: 95327 - protein, 514 aa, Glycine max
  Coding DNA Sequence Number=SeqID_3642
  Gene Ontology: Mol. function=motor activity; Cellular component=cell projection
  Homolog annotation: Hit_ID=UPI00006A2D9E; Match level="QueryCoverage =94%, HitCoverage=100%, E-value=4e-19, Identity=17%"; Hit description= UPI00006A2D9E related cluster
FKGLHTLAFSGLHVLTFRGLHVLTFRGLHILAFKGLHALAFRKVHVLAFRGLHALDFRGLHVLTFRGLHILVFKGLHALSLKGLHGLTSRGLRALTLGGPHVLPFRGLHAPAFRGLHVLHFRGLHVLDVRGLRVLTFIRLHALTFKGLHVLALRTTGPHLQTTTRPRLQRATSPRLQRTTRPHLQRTTRPSLQRAAHPFLQRTTSPRLLKATGSHLQWTTCPRIKDYVSSSSEGYTLSPSEDYRLLHALAFKGLHALTIKGLHALSFRGLQALTFRGLQALTFRGLQVLSFRGLHVLAFRGLHVLTFSRLHALKFRGLHLLRIRGQQVLTFRELQALVFRGLHVLPFRGLQVLAFRGQHVLTFRVLHVLTFRRLHARNLSGLHLLAIRGQQWTTRLPFRGLHVLPFKGLHALPVLTFRGLHVLTFRGLHVPAFIGLHGLSFGGLRVLTFRGLHALTLRRLHVLTFRGLNSPCLKRTTGPLLQRTTRPHLQRAACPCPTSPSEDYTSSRLEDYSS

SEQ ID NO: 95328 - protein, 141 aa, Glycine max
  Coding DNA Sequence Number=SeqID_3643
  Gene Ontology: Biological process=transposition, DNA-mediated
  Homolog annotation: Hit_ID=Q1J7G7; Match level="QueryCoverage=21%, HitCoverage=42%, E-value=2e-10, Identity=100%"; Hit description =Transposase
MPQNVLYDAIGIYQRCGTSYVPINVSFRQKLAQGFPVSTGTPGLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTL

SEQ ID NO: 95329 - protein, 79 aa, Glycine max
  Coding DNA Sequence Number=SeqID_3644
  Homolog annotation: Hit_ID=A7P953; Match level="QueryCoverage=58%, HitCoverage=6%, E-value=6e-11, Identity=73%"; Hit description =Chromosome chr3 scaffold_8, whole genome shotgun sequence
MNSFFFLDEKVEEGWALRASGFFFHACYAVLLIETKDQEGQSQVLSAALEIAEDENVEVDPKFRALVAVGSLVFLSFYL

SEQ ID NO: 95330 - protein, 70 aa, Glycine max
  Coding DNA Sequence Number=SeqID_3645
AGSKSSPTCCGAFGRERPRDDSRFVVGVGAGRSGSEAQVVMQVRGERSSPLGHALCTTKRRASEGRKYRM

SEQ ID NO: 95331 - protein, 166 aa, Glycine max
  Coding DNA Sequence Number=SeqID_3646
  Homolog annotation: Hit_ID=A5B1B1; Match level="QueryCoverage=84%, HitCoverage=64%, E-value=2e-18, Identity=30%"; Hit description =Putative uncharacterized protein
MDEYFRVSNCKNAKEMWGTLQVAHEGTTDVKRSRINTLTREYELFRMNPNEIIQDMNKKAKKAYITWEDNDIDSSGDSKNEVVNLSLMAKNYDSEEEDFLKKSWYIDSGCYKHMTGDASKFTHIFPKKSGHVTYGDNNKDKTSNHAQCFFLVKMMILGYGIEELLI

SEQ ID NO: 95332 - protein, 69 aa, Glycine max
  Coding DNA Sequence Number=SeqID_3647
  Homolog annotation: Hit_ID=Q8Z2A9; Match level="QueryCoverage=100%, HitCoverage=51%, E-value=2e-25, Identity=81%"; Hit description =Putative DNA-binding protein
MEYKDPEFELLSSLEQIIFKDVPQTITLQQKSNPFTEYEQLRKGTGLKTEEFARAMGVSVAMVQEWESK

SEQ ID NO: 95333 - protein, 123 aa, Glycine max
  Coding DNA Sequence Number=SeqID_3648
  Subcellular localization annotation: CTP_CleavageSite=45; ConfidenceScore=5.23e-01
MRTRSPLKARACSPLQARMCSPLMVRTYSPLKVIGTSTQGSTFMRKQEIDSSRGPVIQQDWTRDLGTYWVKTSNRALGSLEVFYMVPFIAPSVRLREARCFDVLMMLKDQVLLSFIQDKNPRK

SEQ ID NO: 95334 - protein, 89 aa, Glycine max
  Coding DNA Sequence Number=SeqID_3649
  Subcellular localization annotation: CTP_CleavageSite=32; ConfidenceScore=5.15e-01
MSFPVFPTFSSNKHWWRLRAYSFLGRRSHESRVALPPKGRLRQLATPLGTYILSYYVHPRIVPFAYASCTGSVLIPSLGKTNGGSVPPC

SEQ ID NO: 95335 - protein, 77 aa, Glycine max
  Coding DNA Sequence Number=SeqID_3650
MGVQIAPRPIWALRDPPKAVASGGSNLLAGRLTRLGDWAEHSPIAINRENAEGMNLAKVSTVLRRLHPFFIVLRSST

SEQ ID NO: 95336 - protein, 99 aa, Glycine max
  Coding DNA Sequence Number=SeqID_3651
MTKVNKEPFLGVFCLCPVLLGLLVCDDLDDELPGCWGSLGGLMGTRVEKNEDMGYVGVRELSWRWATGDGGFMRDLWMWKTCCAPSPDRHLVPHVMGTP

SEQ ID NO: 95337 - protein, 208 aa, Glycine max
  Coding DNA Sequence Number=SeqID_3652
  Gene Ontology: Mol. function=chlorophyll binding; Cellular component =photosystem; Biological process=photosynthetic electron transport
  Homolog annotation: Hit_ID=Q2MI75; Match level="QueryCoverage=100%, HitCoverage=58%, E-value=5e-76, Identity=74%"; Hit description =Photosystem II P680 chlorophyll A apoprotein
  Pfam annotation: Domain name=PSII; Domain location=1-207; Score =143.4; E_value=6.4e-40; Accession=PF00421.10; Description =Photosystem II protein
MGLPWYRVHTVVLNDPGRLLSVHIMHTALVAGWAGSMALYELAVFDPSDPVLDPMWRQGVACFGFGAFHVTGLYGPGIWVSDPYGLTGRIQSVNPAWGVEGFDPFVPGGVASHHIAAGTLGILAGLFHLSVRPPQRLYKGLRMGNIETVLSSSIAAVFFAAFVVAGTMWYGSATTPIELFGPTRYQWDQGYFQQEIYRRVGAGLAENQ

SEQ ID NO: 95338 - protein, 174 aa, Glycine max
  Coding DNA Sequence Number=SeqID_3653
MGKVEEVQEKMKADMEAMKEQMATMMEAMMSMRKIMEANAVAVAATSTVAKVNPMPPSGLNQMNHPTSAMTHEIRHHNLTNFEPCLRYATEGQAVGGLPMQNTVESPQYHPQVHLLHSTTSENPHAMAEIGKLDHLEERLRAIEGGEDYAFANLQELFLVPNIITPPKVQGVGV

SEQ ID NO: 95339 - protein, 85 aa, Glycine max
  Coding DNA Sequence Number=SeqID_3654
MTTIEKPRQARERSKLAVVVVLPTLPLLEVMTAMVLERRRRIGVEEECGVEGTGSAKDKVVVLIIKYAAGSTMQNAVATAKERLW

SEQ ID NO: 95340 - protein, 64 aa, Glycine max
  Coding DNA Sequence Number=SeqID_3655
MGEEEKKPEENKVQEKKAEEEEKKEEEKKPEESKDDKESKEKSAPPEIVQDTTFAMHEHFKHDI

SEQ ID NO: 95341 - protein, 116 aa, Glycine max
  Coding DNA Sequence Number=SeqID_3656
MGNHPRVRISVPPPYKRSPQRCGLFAFLLSILLKNILKLFNLLPQAGHNDQETESLRAVSDRGAADGYERLRRGWRHATAAGPDAESSQPACPAGQQRQRAGAGDEKKLAAMGCAR

SEQ ID NO: 95342 - protein, 363 aa, Glycine max
  Coding DNA Sequence Number=SeqID_3657
  Gene Ontology: Mol. function=ATP-dependent DNA helicase activity; Cellular component=membrane; Biological process=DNA repair
  Homolog annotation: Hit_ID=A8GCM3; Match level="QueryCoverage=93%, HitCoverage=49%, E-value=1e-138, Identity=69%"; Hit description =UvrD/REP helicase
MELKATSMGKRLAQHPYNRVRLLAAGVEVSGDRHEYLIPFNQLIGITCKRGLVWGELEFLLPEEKVVRLHGTEWQETQRFYHYLQHAWQQWSLEMSEISAQVLSALQQEIVAFTGQDRWLKRSELAAVKETITRQFSALPLPLARLEEFDNCRTLWRFCQQWLEQGESAIRQRNREWSARVISDNHAFFSTVETTPLNPSQCEAVVNGEDALLVLAGAGSGKTSVLVARAGWLLQRKLAQPEQILLLAFGRQAAEEMNDRIQTRLGESAIQARTFHALALHIIREGSNKQPVISRLESDSSARRQLLIENWREQCNSKKAQASGWRQWLQEELAWDVPEASCRAAGALARPDAHARRRAGGDD

SEQ ID NO: 95343 - protein, 64 aa, Glycine max
  Coding DNA Sequence Number=SeqID_3658
MSAYNPFAKRQLCAKRIFGHALSRESQALSPQPLDLRLIWSAKLAKDELSQLQFDLNFLLIAAR

SEQ ID NO: 95344 - protein, 183 aa, Glycine max
  Coding DNA Sequence Number=SeqID_3659
MGEVEEIQEKMKADMEAIKEKTATMMEAMMSVKKIMEANAVAIAATSVVAKVNLMSPSGINQMNHPTSDMVGKDLGSTGSPHNVQIQNEHAFPPYGLPPNYTPPNVAYTLSENLNNSTPAHISQTMGKTHEIPHLNLADFEPWLGYATEGQAVGGVPFENTLESPQFRPQPQPLHFCGGKSPS

SEQ ID NO: 95345 - protein, 226 aa, Glycine max
  Coding DNA Sequence Number=SeqID_3660
MNCVFVHASSTFEFGAMRSDCLVQFSILDPFSEPMNCVFVHVSSTFEFGAMRSDCLVQFSILNPFSEPMNCVFVHASSSFEFGAMRSDCLVQFSILNPFSEPMNCVFVHASSTFEFGAMRSDCLVQFSILNPFSEPMNCIFVHVSSTFEFGAMRSDCLVQFSILNPFSEPMNCVFIHVSSTFEFGVMRSDCSVQFSILNPFSEPMNCVFVHASSTFEFGAMRSYCL

SEQ ID NO: 95346 - protein, 38 aa, Glycine max
  Coding DNA Sequence Number=SeqID_3661
MKEMLATQLAQASTARPSELGCFLQKQPPSGGTSWKAQ

SEQ ID NO: 95347 - protein, 181 aa, Glycine max
  Coding DNA Sequence Number=SeqID_3662
  Homolog annotation: Hit_ID=A5C0V9; Match level="QueryCoverage=81%, HitCoverage=27%, E-value=7e-08, Identity=26%"; Hit description =Putative uncharacterized protein
VAVSPPKPPPKPDPEVIWDATVFGVVNPDFPLYIKHKDLSEIAHGGQCLSISVLQLWILHLTETCMRAGNSDIYGFLEPQSIQRSGQSQFESESYIKSWMQSSQRDVYLGAYLNGLDNYLKGIINSAIKGLDDAPQPKSKAPARWIVVKCNRQKGTTECGYYVMHWMSTIILGSFRNNWEA

SEQ ID NO: 95348 - protein, 167 aa, Glycine max
  Coding DNA Sequence Number=SeqID_3663
  Gene Ontology: Mol. function=aminoacyl-tRNA ligase activity; Cellular component=cytoplasm; Biological process=tRNA aminoacylation for protein translation
  Homolog annotation: Hit_ID=A7LG49; Match level="QueryCoverage=100%, HitCoverage=78%, E-value=5e-84, Identity=90%"; Hit description =Leucine tRNA synthetase
MQRNWIGRSEGVEITFDVADSEEKLTVYTTRPDTFMGATYVAVAAGHPLAQQGARNNPALTDFIDECRNTKVAEAEMATMEKKGMPTGLFVVHPLSGEKLPVWVANFVLMEYGTGAVMAVPAHDQRDWEFATKYDLPIKPVILNLDGSQPDVSAEAMTDKGALFNSG

SEQ ID NO: 95349 - protein, 66 aa, Glycine max
  Coding DNA Sequence Number=SeqID_3664
GLSKEHKDLETLHELKGPITRSRVKLLQEEMAKRIKDGLLIKRTEGENHKELNWSTLKIVEQHAWA

SEQ ID NO: 95350 - protein, 77 aa, Glycine max
  Coding DNA Sequence Number=SeqID_3665
MKDRKELMRLNQHEENVKKKKGIALKASHLLKKEKRIGNLKRNSSMKKKVEAYLHGMTMIWILMRNQRRSCKPESND

SEQ ID NO: 95351 - protein, 119 aa, Glycine max
  Coding DNA Sequence Number=SeqID_3666
MGEGEKVQEQMKADTEAMKRANGHNDGGQDGHEGDNGGQCGCIAEVNPMPPSGLNQMNHPTSNMVGKDLGSRDGPHDVQIQNKHAFPPYGLPPNYTPPNVAYTPSENVNNSTPIPIESQ

SEQ ID NO: 95352 - protein, 83 aa, Glycine max
  Coding DNA Sequence Number=SeqID_3667
KQTSLLHDDESRLIQGDSRCFDQNKDDDKKPMRKIQEKFQVSSFQESRIKNNQELDSRLKIQESRKDSIKISTEKFFKTLSST

SEQ ID NO: 95353 - protein, 101 aa, Glycine max
  Coding DNA Sequence Number=SeqID_3668
  Subcellular localization annotation: CTP_CleavageSite=19; ConfidenceScore=5.22e-01
FSNFHRNWVQAIGLFAQATCAPEFGLPRPFNQRLLVLHVGGAAVRQQGQPFPCVQESSTTRDPRSLNPFSEIRRREEEISLKRDRLYNEDQSKFLIEYASG

SEQ ID NO: 95354 - protein, 86 aa, Glycine max
  Coding DNA Sequence Number=SeqID_3669
MELASVGSLVVVLSCWGFEKKVKDRVPKELKISVILLLSPIALKVVGPLLLDSNSSMDGTNPPFQFPMWQLTNNETKREAITKDQK

SEQ ID NO: 95355 - protein, 200 aa, Glycine max
  Coding DNA Sequence Number=SeqID_3670
MGDQEEIQEQMKADMSTLKEQMDSMMDAMLGMRQLMENNVAIAATVSSATEADPTLPATAHHPLPNAVGRERSTLGHISNHHLGYNRVAYPYGLPPNYMPPVMHDDAGHVPSLVLEGEPVEDHREYAQVDVDFYPAVPVEGPAPNILPQPNLPAQPIFLSTEGPPPAAEERRKLDLIEERLRAVESFGDYLFTDMADLAW

SEQ ID NO: 95356 - protein, 148 aa, Glycine max
  Coding DNA Sequence Number=SeqID_3671
MLPFDFRHVTELHVLCNNGCQVPLSGEAKVEPIRKITKKPYFPLTGGSVLDNGGRMNSARQSIRGALDSNGGGCMNDNQFMGLLNKIWWRTHEWQSIHGAPDLMVEDARTALGNQFVGLPRLDGGGCMNDNQFMGSELRFDGRMHEQR

SEQ ID NO: 95357 - protein, 136 aa, Glycine max
  Coding DNA Sequence Number=SeqID_3672
  Gene Ontology: Biological process=transposition, DNA-mediated
  Homolog annotation: Hit_ID=Q1J7G7; Match level="QueryCoverage=30%, HitCoverage=71%, E-value=2e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRCADWNPGPLSKTLMASMPSLD

SEQ ID NO: 95358 - protein, 212 aa, Glycine max
  Coding DNA Sequence Number=SeqID_3673
MRVFLSFDKFLPQHAPFISREVGPAWFTDYFPTVDPDNEEEVNEIWSFYLNPQILSCRTGVQSNYLGLVGYQPNLVSRQFGLSQIRPKSLFEDPQDVIRGANLSEKTFKKFLKISLDENYNLHPFEFNHSHFCTMGLESGFAQPTIENIRSSLQARGKAPMTKRSAETSRADVRPKKPTGVKVQEGKQEEKEEEERPLIRKRKLPTTSTKIC

SEQ ID NO: 95359 - protein, 82 aa, Glycine max
  Coding DNA Sequence Number=SeqID_3674
MMAHQPVKLHSTPKKEDELAEQKRKLPDHEGVNKTFHAGGPSSSSSDMQWPPIPLSFPPRAILNKKMEEVDKEILETFRKVE

SEQ ID NO: 95360 - protein, 82 aa, Glycine max
  Coding DNA Sequence Number=SeqID_3675
  Homolog annotation: Hit_ID=A0PAV3; Match level="QueryCoverage=46%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVVRNGKSTAGHQRWQSVSGHAARNHHTRRA

SEQ ID NO: 95361 - protein, 283 aa, Glycine max
  Coding DNA Sequence Number=SeqID_3676
  Gene Ontology: Mol. function=N-acetylglucosamine kinase activity; Cellular component=cytoplasm; Biological process=N-acetylglucosamine metabolic process
  Homolog annotation: Hit_ID=A4W9D3; Match level="QueryCoverage=100%, HitCoverage=93%, E-value=1e-145, Identity=89%"; Hit description=ROK family protein
  Pfam annotation: Domain name=Glucokinase; Domain location=6-260; Score=-196.8; E_value=0.0029; Accession=PF02685.7; Description =Glucokinase
  Pfam annotation: Domain name=ROK; Domain location=4-194; Score=191.7; E_value=1.8e-54; Accession=PF00480.11; Description=ROK family
  Pfam module annotation: Pfam domain module=Glucokinase::ROK; Domain location=6-260::4-194
MYYGFDIGGTKIALGVFDKDLKLQWETRVPTPRDSYDEFLTAIAALVAQADERFGVKGSVGIGIPGMPETDDGTLYAANVPAASGKPLRADLSALLERDVRLDNDANCFALSEAWDDEFRRYPLVMGLILGTGVGGGIVINGKPITGRSYITGEFGHIRLPVDALEVVGRDFPLTRCGCGQHGCIENYLSGRGFAWLYEHFYHQKLEAPQIISLWEQGDAQAREHVERYLDLLAVCLGNILTIVDPDLLVIGGGLSNFTAITERLSGRLPRHLLPVARVPRIE

SEQ ID NO: 95362 - protein, 123 aa, Glycine max
  Coding DNA Sequence Number=SeqID_3677
  Homolog annotation: Hit_ID=A0PAV3; Match level="QueryCoverage=30%, HitCoverage=17%, E-value=5e-07, Identity=76%"; Hit description =Restriction endonuclease
MVKVGTSYVPINVSFSPKVGPGLPGINRDTRIYLFCEVIFRHSCPPVQLLTGWCVTAKAPPDISAGKCSGHAARRVPFAIQAAQLLGRAIGAGLFAITPAGERGMCCKAIKLGNARVFPVTTL

SEQ ID NO: 95363 - protein, 89 aa, Glycine max
  Coding DNA Sequence Number=SeqID_3678
  Gene Ontology: Biological process=transposition, DNA-mediated
  Homolog annotation: Hit_ID=Q1J7G7; Match level="QueryCoverage=37%, HitCoverage=47%, E-value=1e-11, Identity=96%"; Hit description =Transposase
MVKVGTSYVPINVSFRQKLAQGFRYHRDTRFIILRSDLPSQVLQWLLFLSAVPPVQLLTGWCVTAKAPPDISAGKCSGHAARNHHTRRA

SEQ ID NO: 95364 - protein, 82 aa, Glycine max
  Coding DNA Sequence Number=SeqID_3679
  Subcellular localization annotation: CTP_CleavageSite=54; ConfidenceScore=5.11e-01
MTNERRTSKNGWRSSRKSPRKHYGSASARIFFTEPIFFPNFNKMGEMLATQLAQVSKVTYSKWAWFLFAPPFLLNTPPTFFL

SEQ ID NO: 95365 - protein, 131 aa, Glycine max
  Coding DNA Sequence Number=SeqID_3680
MSQELPRLFAGGSHEMCEFNTSATYHCHAFTFIQLLHYSLHSIFSSHCRYQKVTIVTKKKEHALRQPYRTRAKAKIMSEIEEVHEQMKDHSSEVQGSTSIIPTWPRIECSCKTCAKGSMSPSRNTARGGGI

SEQ ID NO: 95366 - protein, 350 aa, Glycine max
  Coding DNA Sequence Number=SeqID_3681
  Gene Ontology: Mol. function=1-acylglycerol-3-phosphate O -acyltransferase activity; Cellular component=integral to membrane; Biological process=phospholipid biosynthetic process
  Homolog annotation: Hit_ID=A7PFR4; Match level="QueryCoverage=32%, HitCoverage=34%, E-value=6e-36, Identity=63%"; Hit description =Chromosome chr11 scaffold_14, whole genome shotgun sequence
MEVTPLSSPSPIHGLHLRHKEARFLAVASTLYVILHHSFLEFDLSLCPSPLSQPYNPSPQCSLRAISKKHENVAWLSVSPKLHVQNKFPRDVVVRSELTAAGSAGDGYFLPELKVESKVRGVCFYVVTAFCAIFLFMMMLVGHPSVLLFDRYRRKFHHFIAKVWATLTVAPFYKIKFEGLENLPPPDTPAQDWDIPLSNNWVGDVSFGHHSFEAHGQPKSAGSLVARFGGRNVENPYVKMKDLKQTGTVDDYLLQLNIKRKLHTLKPQSQLQGMQFPWDIEPNISDLPAFVGSYGWQNGDSIFSTTMRPLKSSISMGGSKLGPTIVSSSVTVSSKRAAIWMEEKIQKFEL

SEQ ID NO: 95367 - protein, 155 aa, Glycine max
  Coding DNA Sequence Number=SeqID_3682
MVELFWTNTTNIPRRSPTGISTVQQIIQQPGIKNSSRFKVLFQLCFVMDLFMAIQAAPDQVKNWFESHPEFLKPADPKTSLFLNQKSQLATFLASSKSKESLAQNLKEVLQLLQQEEDEEPSNKEAESSEDIDDQDDDPFYQNEDDCFGISLEDD

SEQ ID NO: 95368 - protein, 178 aa, Glycine max
  Coding DNA Sequence Number=SeqID_3683
MKFVLCIFSGKRDELAKRACCAKRMASRKRKSIGSRPTTQYDTSRFHSLDAWNRYTDNVLGRNILPERKEELYHTEFDDFKTKLERRTLHKRLTNLVDGSIDLALVKEFYANLYNSDGPSPKQARVRGHLVKINADSLNTFLETPVVLVEGETLPTYSRYCKLPLDPRECWIKWPQNN

SEQ ID NO: 95369 - protein, 111 aa, Glycine max
  Coding DNA Sequence Number=SeqID_3684
TKLLQAILQASRLSLHVAPLISNIMDKNNVTNFTWNFLVKFTFDELVAHHSRLVIKIKMAEANSGVVMKLPSRVGMNFEVLHKRGKGSYASFDVVFVRVGQLANDANDVYS

SEQ ID NO: 95370 - protein, 40 aa, Glycine max
  Coding DNA Sequence Number=SeqID_3685
MNNKLMAAEWRWKNDDWRCHFKEKMSQEEAHHHSKPGIRA

SEQ ID NO: 95371 - protein, 304 aa, Glycine max
  Coding DNA Sequence Number=SeqID_3686
  Gene Ontology: Mol. function=acetylornithine transaminase activity; Cellular component=cytoplasm; Biological process=arginine metabolic process
  Homolog annotation: Hit_ID=A8GFQ5; Match level="QueryCoverage=100%, HitCoverage=75%, E-value=1e-157, Identity=90%"; Hit description =Acetylornithine and succinylornithine aminotransferase
  Pfam annotation: Domain name=Aminotran_1_2; Domain location=5-295; Score=-100.3; E_value=0.029; Accession=PF00155.12; Description =Aminotransferase class I and II
  Pfam annotation: Domain name=Aminotran_3; Domain location=1-247; Score=270.9; E_value=2.7e-78; Accession=PF00202.12; Description =Aminotransferase class-III
  Pfam module annotation: Pfam domain module=Aminotran_1_2::Aminotran _3; Domain location=5-295::1-247
VFFCNSGAEANEAALKLARKHAHDQHGAGKDQIVAFNNAFHGRTLFTVSAGGQPKYSQDFAPLPGGITHTPYNDLAAAAELINDRTCAVIVEPIQGEGGVLPAEASFLQGLRELCDRHNALLIFDEVQTGVGRTGHLYAYMQYGVVPDVLTTAKALGGGFPIGAMLTTDALAKTLGVGTHGTTYGGNPLATAVAGTVFSIINTPEVLEGVKQRHQWFIDGLNDINRQYPIFADIRGGGLLIGCQLTKDYAGKAKQITQLANEEGVIALIAGPDVVRFTPSLIIPEQDVKEGLARFARAVARICS

SEQ ID NO: 95372 - protein, 76 aa, Glycine max
  Coding DNA Sequence Number=SeqID_3687
  Homolog annotation: Hit_ID=A5BCY8; Match level="QueryCoverage=80%, HitCoverage=7%, E-value=1e-10, Identity=48%"; Hit description =Putative uncharacterized protein
MKYQGKFSQFKISYNCVQEEERLKQERTESAHVLSTSKDKGKRKRVEEPKNEALRVHHKRNKIKVTTVSFAVSLDM

SEQ ID NO: 95373 - protein, 54 aa, Glycine max
  Coding DNA Sequence Number=SeqID_3688
MHIVVERMQVGMKSRSTDRCPFSALNKQRTSLQDSPVSFVFAVFFYYLFVLKRK

SEQ ID NO: 95374 - protein, 121 aa, Glycine max
  Coding DNA Sequence Number=SeqID_3689
MSYVPESDIRLNCYDHSNFSRPSVVQFRASGYILSPKSDIRVKCYDHSNFSRASIVQFRASRLVISDLSSGVYPDLSSFTGSGVYPDLSSFTGSGVYPDLSSFTGSGVIQTSVACIKRSAP

SEQ ID NO: 95375 - protein, 45 aa, Glycine max
  Coding DNA Sequence Number=SeqID_3690
MRGSGEFVPFLDTTSRVGIKTEPICHAYAKDTMRECAQYDNIYQT

SEQ ID NO: 95376 - protein, 279 aa, Glycine max
  Coding DNA Sequence Number=SeqID_3691
  Gene Ontology: Mol. function=nucleic acid binding; Biological process= RNA-dependent DNA replication
  Homolog annotation: Hit_ID=Q2AA09; Match level="QueryCoverage=67%, HitCoverage=60%, E-value=3e-10, Identity=30%"; Hit description =Retrotransposon gag protein
MAQPPPYERTLREMVAPDFTYESLCIQYPDEGVPYVQKTGLIHLLPKFHGLAEGVAKDWLYYLAPSNNERNMIDAASGGALGDMTPAEARNLIEKMASNSQQFSARNDAIVLTGVHEVATDSFSSTENKKLEGQLDALANLVTQLAMNQKSTSAPVARVCGPCSSVDHYTNLCPSLQQSGVNEQPEAYVANIYNRPLQQQNQQQQNNYDLSSNRYNPGWRNHPILRWTSPPQQQQRVPPFQNATSPSKPYVPPPMQQQQQQSQQRQQANEANDHQNMQF

SEQ ID NO: 95377 - protein, 211 aa, Glycine max
  Coding DNA Sequence Number=SeqID_3692
  Subcellular localization annotation: CTP_CleavageSite=52; ConfidenceScore=5.51e-01
VDSRGSPTFPIFLTFSSNKCWWRLRVPSSLGRRARESRITLSPKGRLRHSVTASYGRTGYPYGPYGLPIPTPFHVPLLLRQRKRTKIHRVLLTIERTPPENKYASNRPLTKATYTHLRKFFESNIQIRLHHEVSSIGACRPRIFFINGFLCFLEDEWQRNEERKRERRRHFKEKMSLEEAHHHRRPWIRAWRKKEMNEGRGREEHEILCSK

SEQ ID NO: 95378 - protein, 74 aa, Glycine max
  Coding DNA Sequence Number=SeqID_3693
DYVSKWVEAKPTRTNDAKVVADFVRIHDVGYNVQDILPENTGIAKSIEAAGSTMSDTMSRTSCPRILELLYNGR

SEQ ID NO: 95379 - protein, 254 aa, Glycine max
  Coding DNA Sequence Number=SeqID_3694
  Homolog annotation: Hit_ID=Q2HW90; Match level="QueryCoverage=33%, HitCoverage=17%, E-value=5e-09, Identity=40%"; Hit description =Putative uncharacterized protein
MGTNQNIKRFYQVKVKGLDVTSLKELGRLMGPLQRKAFRKVYGKILDLTVAEVFTEAVVSLAQYYDQPLRCFTFGDFQMVPTIEEFEEILGCPLGGEKTVSFLRLSSFLEQGCDCDWRFSKRVGSHKANSERHSGPASENTWKTRQGIWRAKRSGAPLAIRQLGYPMRGAPTEESLSPFLVRNLGAQSLKAIQRVHKAWRSPLRKDKELRGIRNGVIRGYHGWLRIHTRGLDWLSKLKVIDEEDFEAPEEDEEV

SEQ ID NO: 95380 - protein, 110 aa, Glycine max
  Coding DNA Sequence Number=SeqID_3695
MVEAESSQNLQSTQDSTDWTNDIYSKVKGPEKRGRVRCLGKLPHQASSSQSSYTNNRIQKLENLLGNLVVVLKVRFAEDPQINQVLEAIDQEVPTNDSTSKDHQTTNNLN

SEQ ID NO: 95381 - protein, 73 aa, Glycine max
  Coding DNA Sequence Number=SeqID_3696
MQGSCMSEHENKRRENGLNDRLKLVKNARKETENLETYPLKNEERMKNGEEQRTTFTELLTETSRKRYGSASA

SEQ ID NO: 95382 - protein, 64 aa, Glycine max
  Coding DNA Sequence Number=SeqID_3697
MKKQQWKRSGKQRRRGKRRRHPLGNKPWKKELHHQDEPWIRSLERMLQWRKRKRERKREGGARN

SEQ ID NO: 95383 - protein, 178 aa, Glycine max
  Coding DNA Sequence Number=SeqID_3698
  Subcellular localization annotation: CTP_CleavageSite=56; ConfidenceScore=5.71e-01
MAESSKKRKGSSTSAATTRTPRPGATGASPAPIPPSLSSSTLFSSDEQPIRILMPRSSNLAQASEEDLILMWAFLTGRPIDWAHLICYCMHKALWSGAPLPYPQLVTLFLRHFEIPLDLEPFLLVKRSFAIGAGAVTSFGYRKDMDGQWLKKDAQPPQDECTPSPPPQRDDSSALMNE

SEQ ID NO: 95384 - protein, 102 aa, Glycine max
  Coding DNA Sequence Number=SeqID_3699
MKILPLYKMIVGLQGCVYKIDSLYGGSLKLEDRDFPSYLSYLSKRLFLTLRSGFTLCLEWSLYTLLLPSILFHKVPEGSTHLQNISEVSTFFHKLLESSTLL

SEQ ID NO: 95385 - protein, 59 aa, Glycine max
  Coding DNA Sequence Number=SeqID_3700
MWYHFPVKNLVGHLRVHDKTHHTMSMSGLKEHSNQVTPKAYTPKSPSGPLPPDSGKHIL

SEQ ID NO: 95386 - protein, 44 aa, Glycine max
  Coding DNA Sequence Number=SeqID_3701
MKTDMEAMKEQMTMMMQPMMSMRMMMEDNCHNLPFGGRATRDSR

SEQ ID NO: 95387 - protein, 61 aa, Glycine max
  Coding DNA Sequence Number=SeqID_3702
MAKFDPEIVMEFYANVWPTEEGVHDMHSWLYKTLLHDLTVGIFEKMYGVCAKLPFPRAFLI

SEQ ID NO: 95388 - protein, 76 aa, Glycine max
  Coding DNA Sequence Number=SeqID_3703
LGNLGHFKEERLPGVQSERYKAGPSVSTLMILSYKTNKQQAMCAKIVVGSRNLGTLLNQYDGSIVKMGSMLQLNIP

SEQ ID NO: 95389 - protein, 48 aa, Glycine max
  Coding DNA Sequence Number=SeqID_3704
MEVSVEAIASLTQYYDQSLRNPGMSARKKKAISLLGVPSLHGKSSKGS

SEQ ID NO: 95390 - protein, 46 aa, Glycine max
  Coding DNA Sequence Number=SeqID_3705
MESPTVATYPSMGGRCRAHGCIFQERIMRGVATNVYSRKTSEKPER

SEQ ID NO: 95391 - protein, 148 aa, Glycine max
  Coding DNA Sequence Number=SeqID_3706
  Gene Ontology: Mol. function=transcription factor activity; Biological process=regulation of transcription, DNA-dependent
  Homolog annotation: Hit_ID=A7MKV2; Match level="QueryCoverage=95%, HitCoverage=57%, E-value=8e-31, Identity=44%"; Hit description =Putative uncharacterized protein
  Pfam annotation: Domain name=LysR_substrate; Domain location=1-147; Score=-7.3; E_value=0.012; Accession=PF03466.11; Description=LysR substrate binding domain
MELITREENMALLMQDLGEGLLDAAFIRLPCESSKAFNLKVIATEEMKVALPASHALSQQQSVALTQLAEESLIIFPREAPQITSSLGMVGAGCGIALVPASLCCVNNPQLVFRDIKNNTLFTDIAFAWRRNHPAKTVLHLLSLLNGE

SEQ ID NO: 95392 - protein, 179 aa, Glycine max
  Coding DNA Sequence Number=SeqID_3707
MGTNQNGKRFYQVKVKSLDVTSLKELGRLMGRLQRQAFRKVYGRILDLTAAEVFTEAVVSLAQYYDQPLSKIAAVIGDSAKDLDRMKQTRNGVVGLPRKYLEGKARDMASQEKWGPPPLMLSFAISTIARKVQWWLILADFFDTFDRSAINWFPRWKEGKEGVLFSCGDYPNVPLIGTR

SEQ ID NO: 95393 - protein, 124 aa, Glycine max
  Coding DNA Sequence Number=SeqID_3708
MREVKSSTDAAPQTPQYPSVVKPLPFPYQNSHAVLWRYAPPSERKEEATDINSLSARVTNITRLSGVTRSGRVFAPPDLLTQPVNVKGKAKIAEEQNDKVKHLGGLFGSAASQRLSTHASRVPG

SEQ ID NO: 95394 - protein, 95 aa, Glycine max
  Coding DNA Sequence Number=SeqID_3709
MSKIPTVEVCAFEFRTTYLTFMKIQRLQCERFSSKLRHNMEIPNGENARNWVANMVFKFHDDPMVNESEIIVFLRQVWWDAGKRKVLRGEREKRK

SEQ ID NO: 95395 - protein, 80 aa, Glycine max
  Coding DNA Sequence Number=SeqID_3710
MAKDEKLDHLEERLRAIEGGRDYAFVDMAELCLVPDVIIPLKKPVEFTPIPMSYADLLPYLLDYSMDAITPAKVPQPPFF

SEQ ID NO: 95396 - protein, 154 aa, Glycine max
  Coding DNA Sequence Number=SeqID_3711
  Gene Ontology: Mol. function=helicase activity; Biological process =viral genome replication
  Homolog annotation: Hit_ID=Q2A9E0; Match level="QueryCoverage=81%, HitCoverage=8%, E-value=1e-33, Identity=52%"; Hit description =Putative uncharacterized protein
MWYDERINKDKQTKNPKFSLCCGDGKIQLPILHDAPQPLWQLLFDSRDSQVKKFQQNIRLYNLMFAFTSLGVKVDTSYNTGRGPPTLRIHGQSHHLIGSLLPIPDNSPKFAQLYIYDTENEVNNRLSQYPHYNWYQEYARYPQSICTKIQNGKG

SEQ ID NO: 95397 - protein, 114 aa, Glycine max
  Coding DNA Sequence Number=SeqID_3712
MEKGQGRSCLAQRLLNFDSPGQQAGGVLILCDNTTERVALLGGQLCDNTTEKAALSFNMLWSQRPYEIVMSFTRSKPGPRAVRKIGRNLSGTTHPTLPPIGGRPFYSRPKKELQ

SEQ ID NO: 95398 - protein, 87 aa, Glycine max
  Coding DNA Sequence Number=SeqID_3713
MKTRMIKMTQHKKMIIFPKNGKLQEIILFTTSSVISQKGNWDRRVQAQDEDKDDQDDTAQENDNLPKEWKTSRNHPLHNIIGDISKG

SEQ ID NO: 95399 - protein, 174 aa, Glycine max
  Coding DNA Sequence Number=SeqID_3714
  Homolog annotation: Hit_ID=Q6UUU1; Match level="QueryCoverage=34%, HitCoverage=40%, E-value=1e-18, Identity=78%"; Hit description =Putative uncharacterized protein
FLLQGPSSHVSSPPLHAPSDRRFGQEDPCLHETNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 95400 - protein, 373 aa, Glycine max
  Coding DNA Sequence Number=SeqID_3715
  Gene Ontology: Mol. function=glucose-6-phosphate dehydrogenase activity; Cellular component=cytosol; Biological process =carbohydrate metabolic process
  Homolog annotation: Hit_ID=P0AC54; Match level="QueryCoverage=100%, HitCoverage=75%, E-value=0.0, Identity=89%"; Hit description=Glucose- 6-phosphate 1-dehydrogenase
  Pfam annotation: Domain name=G6PD_C; Domain location=70-372; Score =662.8; E_value=2.8e-196; Accession=PF02781.7; Description=Glucose-6 -phosphate dehydrogenase, C-terminal domain
  Pfam annotation: Domain name=G6PD_N; Domain location=1-68; Score= -6.2; E_value=1.6e-08; Accession=PF00479.13; Description=Glucose-6 -phosphate dehydrogenase, NAD bindi
  Pfam module annotation: Pfam domain module=G6PD_C::G6PD_N; Domain location=70-372::1-68
MPPSTFGAICEGLGAAKLNAKPARVVMEKPLGAALETSQEINDSVGKFFDESQVFRIDHYLGKETVLNLLALRFANSIFVNNWDNRTIDHVQITVAEEVGIEGRWGYFDKAGQMRDMIQNHLLQILTMIAMSPPSDLSADAIRDEKVKVLRSLRRIDQTNVREKTVRGQYTAGFVQGKKVPGYLEEEGANKQSSTETFVAIRVDIDNWRWAGVPFYLRTGKRLPTKCSEVVVYFKNPEMNLFKDSYAELPQNKLTIRLQPDEGVDIEILNKVPGLDHKHKLQTTKLDLSYSETFNQSHLADAYERLLLETMRGIQALFVRRDEVEAAWTYVDSIIEAWNADGDASKPYQAGTWGPVASVAMITRDGRSWNEFE

SEQ ID NO: 95401 - protein, 212 aa, Glycine max
  Coding DNA Sequence Number=SeqID_3716
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=97%, HitCoverage=7%, E-value=5e-20, Identity=28%"; Hit description=CTV.20
  Subcellular localization annotation: CTP_CleavageSite=69; ConfidenceScore=5.27e-01
MVMDKATPSVPRPAPTIEQIKQDNSGKVEITFNRRNSFSSRIEASRSEYESTRRSFSVRTLSIPVGLTRSESRNQFPTVNLQGLYTTSSIPRTTYNQEQEDDQKSIQSQLILLWNLMMLSDNFSIDKETLRKDFYSPENEPQRRWFFQQYKSTNRKHIQDKFYEFVERVKINVLFFDWFLAYTIRKDIDYPWKQDIIGDPTTNVITNWQMKD

SEQ ID NO: 95402 - protein, 172 aa, Glycine max
  Coding DNA Sequence Number=SeqID_3717
  Homolog annotation: Hit_ID=Q0KIL1; Match level="QueryCoverage=95%, HitCoverage=18%, E-value=3e-07, Identity=27%"; Hit description =Gag/pol polyprotein, 3'-partial, putative
  Pfam annotation: Domain name=G-patch; Domain location=38-82; Score =26.7; E_value=8.5e-05; Accession=PF01585.14; Description=G-patch domain
MPYVEAAEESLETAFQSFEVVSISSVDSFSGQACLSDAEVMMARVMLGNGYEPGMGLGKDNGGITSLINAKGNRGKYGLGYKPTQADVKRSIAGRKGGGQSSRLRQESEGSPPCHISRSFISAGLGDEGQVVAIYEDDVPSTLDLVRPCPPDFQLGNWRVEERPDIYAASIM

SEQ ID NO: 95403 - protein, 394 aa, Glycine max
  Coding DNA Sequence Number=SeqID_3718
  Gene Ontology: Mol. function=hydrolase activity
  Homolog annotation: Hit_ID=A8GEX9; Match level="QueryCoverage=61%, HitCoverage=93%, E-value=1e-113, Identity=82%"; Hit description=N -formylglutamate amidohydrolase
  Pfam annotation: Domain name=FGase; Domain location=26-236; Score =203.6; E_value=4.9e-58; Accession=PF05013.3; Description=N -formylglutamate amidohydrolase
  Pfam annotation: Domain name=PilZ; Domain location=304-390; Score =19.7; E_value=0.0044; Accession=PF07238.5; Description=PilZ domain
  Pfam annotation: Domain name=YcgR; Domain location=210-303; Score= -6.4; E_value=0.0049; Accession=PF07317.3; Description=YcgR protein
  Pfam module annotation: Pfam domain module=FGase::PilZ::YcgR; Domain location=26-236::304-390::210-303
MPHSFIPPLLSADEPSAAAVEIPRGKAPFLLLCDHAGKAIPQSLGDLGLPPGEIERHIGWDIGALSVSRHLSRQLDATLIHQRYSRLVIDCNRAPGIASSIPHLSELTPIPGNIGIDAEHALAREREVFLPYHHAIDDHLGQRQLRELPTAVIAMHSFTPVFKGASRPWQVGLLFNRYPEFAHLLAELLREEGDLQVGINEPYAMTDATDYTLPVHAERRGLPYVGIEIRQDLIADERGQQAVGPDNIVFSGEEAENAIDGACTIVIESNDAKIEFSVGQAELTEHQGVQACSTRLPQELVYIQRRRQFRITTPHWRQFFCTGEYPNGTPYELRIHDLSAGGVGLRFDGPLPDFFQPGLQFKKAELDLGSYGSFKVNMELVVVNDDQETDDNDQ

SEQ ID NO: 95404 - protein, 186 aa, Glycine max
  Coding DNA Sequence Number=SeqID_3719
MTTLAQTWSVLSFSNLIPTSHTSDVTLDRAKLIYDIIMKMDMNVGYLISHQISITAQHNSSRLGFSALITALCKARGVQLDYKPLESLSPTINLAYIKKNCWNLDDPTVTFRGPRKARGKRSEVPTTSAAPETTTPSSSTAQAPPISTPAQTPAIPAPSAQIPLPAPLSIGPSDFLFTPQILHSML

SEQ ID NO: 95405 - protein, 324 aa, Glycine max
  Coding DNA Sequence Number=SeqID_3720
  Gene Ontology: Mol. function=two-component response regulator activity; Cellular component=cytoplasm; Biological process=two -component signal transduction system (phosphorelay)
  Homolog annotation: Hit_ID=A7MQV2; Match level="QueryCoverage=68%, HitCoverage=98%, E-value=4e-90, Identity=75%"; Hit description =Putative uncharacterized protein
  Pfam annotation: Domain name=Response_reg; Domain location=102-213; Score=144.4; E_value=3.1e-40; Accession=PF00072.15; Description =Response regulator receiver domain
  Pfam annotation: Domain name=Trans_reg_C; Domain location=246-322; Score=81.2; E_value=3.4e-21; Accession=PF00486.19; Description =Transcriptional regulatory protein, C t
  Pfam module annotation: Pfam domain module=Response_reg::Trans_reg_C; Domain location=102-213::246-322
  Subcellular localization annotation: CTP_CleavageSite=56; ConfidenceScore=5.20e-01
MPRDNSGTMRLSHHFKIKKPGASSEVTGLSPRSRALPVDTACRFRLRQPDWFDNCRSARDPGVTASLAAPVRQSIPPAHGAAQFWRVDMPDTSMPPRGVSVTTILIVEDEKEIRRFVRLALESEGLKIVEAEQLQRGLIEAATRKPDLVILDLGLPDGDGNAFIREVRQWSSMPVIVLSARSDEQDKIEALDAGADDYLTKPFGIGELLARVRVALRRHQRSQPEPLVQFGEVSVDLAARRVLRSGEEVHLTPTEFRLLSLLLNNAGKVLTQRQLLNQVWGPNAVEHSHYLRIYMGHLRQKLEANPTQPTHLLTETGIGYRFMP

SEQ ID NO: 95406 - protein, 343 aa, Glycine max
  Coding DNA Sequence Number=SeqID_3721
  Gene Ontology: Mol. function=transferase activity, transferring nitrogenous groups; Cellular component=intracellular; Biological process=regulation of transcription, DNA-dependent
  Homolog annotation: Hit_ID=Q11MC6; Match level="QueryCoverage=90%, HitCoverage=69%, E-value=2e-73, Identity=45%"; Hit description =Transcriptional regulator, GntR family
  Pfam annotation: Domain name=Aminotran_1_2; Domain location=1-329; Score=-3.2; E_value=5e-07; Accession=PF00155.12; Description =Aminotransferase class I and II
MAAPDPALLPDLRPAMLAGLASPQLNSYQREAISPQLQAAIAPRWPCPAEAWLATDGGFDAMNLIVQTLLSPGDRVVIEDPTATRLLDMLDNIGAEILPLPGDEQGPLPAVLATHLQKAPAMFIYQPRTHSATGYSVSQQRSEALAQVLAQSATLIVEDDGIGDLSRWPVWSLGRHYPQRTLHVHSFSKAYGPDLRLAVVSGTAELVKRLQSWRNFGVSWTSRILQDAVAWMLSDAPTQQRIQQAKATYAARRQQLLAALARRGLVQEDRDGLSVMLPVASEQYAMITLAARGITVLPGERCSINSGQFIRVSIARLPADQLDSIADALVIACGRELSISPDL

SEQ ID NO: 95407 - protein, 88 aa, Glycine max
  Coding DNA Sequence Number=SeqID_3722
MPRARTARAPRWRQSHPALLAISWLILPHCANGVETANKQNAEVPGKEKVDDPDHHGACCAACGKPISLRDVIPLSSLHSASAARHVE

SEQ ID NO: 95408 - protein, 304 aa, Glycine max
  Coding DNA Sequence Number=SeqID_3723
  Gene Ontology: Mol. function=L-malate dehydrogenase activity; Cellular component=cytoplasm; Biological process=metabolic process
  Homolog annotation: Hit_ID=A8GDC3; Match level="QueryCoverage=98%, HitCoverage=82%, E-value=1e-124, Identity=71%"; Hit description =Malate/L-lactate dehydrogenase
  Pfam annotation: Domain name=Ldh_2; Domain location=2-285; Score =310.1; E_value=4.2e-90; Accession=PF02615.5; Description=MalateL -lactate dehydrogenase
MASLTQGFLQLNQHVSIEKDAGAVLTLNGQKGFGQVAAYEAMQHGIERANRFGLAAVGLHHSHHIGRIGHWAEQCAAAGFVSFHFVNVMGDPMVAPFNGSDRRFGTNPFCAVFPRRDGEPLLLDFATSGIAFGKTRVAYNKGQPVAPGYLLDAQGQPTTDPGVMHQSPYGALTAFGLHKGYALATMCEILGGALSGGRTTHDATLLTGTDAIFNGMTTIILNPDAFDAPAMQQEAEEFLAWVRRSPQSGEAEILVPGEWETRNRAAREREGIPLDSNSWQQICAAARQAGMPEDELAAFRALAQ

SEQ ID NO: 95409 - protein, 114 aa, Glycine max
  Coding DNA Sequence Number=SeqID_3724
  Gene Ontology: Mol. function=gluconate transmembrane transporter activity; Cellular component=membrane; Biological process=gluconate transport
  Homolog annotation: Hit_ID=A4TQW4; Match level="QueryCoverage=83%, HitCoverage=21%, E-value=5e-41, Identity=88%"; Hit description =Gluconate permease
  Pfam annotation: Domain name=GntP_permease; Domain location=1-114; Score=-272.9; E_value=0.00016; Accession=PF02447.7; Description=GntP family permease
MPLLYVAIGVALLLLLMIRFKLNGFIALILVALAVGMMQGMPVNKVIGSIKTGVGGTLGSLALIMGFGAMLGKLLADCGGAQRIATTLIEKFGQKSHSVGVGTHRLHRGLRAVL

SEQ ID NO: 95410 - protein, 202 aa, Glycine max
  Coding DNA Sequence Number=SeqID_3725
KNGIGGQMRNNGLPPCHNTGLAGYFSQVTDPRQIALLGRITVEILRQERRLTRTAICLKLIGHINDTDDDVEAEQARPYPLPHAALPKIINTRFDGGEDVIPDSFLRPVHANARPMRPASVCRYGTWIAACSGSSKLLSQPIASEIADRRVSLPPARFIQIYFLHFTLMRTSRHTVDPIERTGAGAGATCRSMTTIQPDDAA

SEQ ID NO: 95411 - protein, 613 aa, Glycine max
  Coding DNA Sequence Number=SeqID_3726
  Gene Ontology: Mol. function=DNA binding; Biological process=DNA recombination
  Homolog annotation: Hit_ID=A7FCR7; Match level="QueryCoverage=19%, HitCoverage=95%, E-value=3e-41, Identity=70%"; Hit description =Putative uncharacterized protein
CLCPSELAFRLVMLFSDISTEMGGWESIEMVQRYAHLAPNHLTEHARQIDAIFGSRVPNLSHGEILKAEGAMRMTSRKKEILSFFDPEHREWVTGTIGAPPFDVSGVAYLLSGMNSFKSRHHMESARRTLEAMVNDGLLEKITSYEQRQDSTQSGAGKGVWCNCSRYGLIGQCLVMRDRDGSDNYIEDEYKNPIRRESVRRSLELMVSFGLLTKSSHREVRNGMTCVMRKSLSVTFRVPAELSEAFIGAVNAADGDKTAWLVDAIRQKLSLPESNPDARMMALVERMELAAAALIGGKQGIPPLPYNEEAVIRIASETIRQGFDNGRIIAERLNEAGYQTKAGKAWDKDIYSAWKRQADHKAKGACSHHGGVGSGGGISLISALALAGYSFYRLDKAEAHEKCMIYESSKQNVWFEFSLTSAPFNPQEHYSIKGNALSYTYLSSINSKPECLTVAISDAESTKIEKLARTLASHSNAPNMPVLDGLDVSLTINIGDTATFHAQQAVTLFGQQGLRYVGADSFSPFLFTVNAQAFFMRNAAGGIEFFTYTTDHLSGSDKNEPASVVMANPASVYCQKVGGALEIVKNETGESAIIVAGIALLIWFIASGAYAPG

SEQ ID NO: 95412 - protein, 227 aa, Glycine max
  Coding DNA Sequence Number=SeqID_3727
  Gene Ontology: Cellular component=cytoplasm
  Homolog annotation: Hit_ID=UPI00005F260E; Match level="QueryCoverage =43%, HitCoverage=83%, E-value=3e-18, Identity=46%"; Hit description =COG3109: Activator of osmoprotectant transporter ProP
  Pfam annotation: Domain name=FINO; Domain location=1-166; Score=-6.3; E_value=0.0023; Accession=PF05286.2; Description=Fertility inhibition protein (FINO)
  Pfam annotation: Domain name=PerC; Domain location=145-227; Score =39.8; E_value=9.8e-09; Accession=PF06069.2; Description=PerC transcriptional activator
  Pfam annotation: Domain name=ProQ; Domain location=44-206; Score =36.2; E_value=1.1e-07; Accession=PF04352.4; Description=ProQ activator of osmoprotectant transporter ProP
  Pfam module annotation: Pfam domain module=FINO::PerC::ProQ; Domain location=1-166::145-227::44-206
TMTTLSIKRKPKGLYGKPEQQSKQPETEATSNDKPAQKPAGAARKQSAAAKRNHRRLEKLSSLFPAVINLTEPKPLKVGILEDMSQSLKARGETFGEGQIKNALARYTRNWRYQTALAAGGSRYNIEGQPEGQVTAEQQQKAAEMLAQLKGGADDKAASRWLEVFDKCETEAGREWLRNRRNECLAKRVRPAVLVDTFGDVTRAASDTQRRMGLAKPGGEAFRLKAK

SEQ ID NO: 95413 - protein, 271 aa, Glycine max
  Coding DNA Sequence Number=SeqID_3728
  Gene Ontology: Mol. function=DNA binding
  Homolog annotation: Hit_ID=UPI000067369C; Match level="QueryCoverage =95%, HitCoverage=92%, E-value=2e-99, Identity=70%"; Hit description =COG3561: Phage anti-repressor protein
  Pfam annotation: Domain name=AntA; Domain location=38-123; Score =93.0; E_value=9.6e-25; Accession=PF08346.3; Description=AntAAntB antirepressor
MLQVDSRGSPISDISGNDFATIVPVISGQIGGRETNIVSAKALHKALGVGNDFSTWVKLRIDEYGFTLGADYVVFDSSDFRNQSANIEQAERGWVTKRGGDRRSKDYGLSLGMAKEVAMVERNEQGRAIRRYFIQCEEALQRSVPEIAAQYRRQLKARLSAANMFKPMCAALDVARAEQGKQTLSRHYSNESNMIARIVLGGLTAKQWAQVNGFQGEPRDGMNSSQLEHLTYLESTNITLIDMGMAYDQRKAELMRLSQRWLAKRLEAAHD

SEQ ID NO: 95414 - protein, 288 aa, Glycine max
  Coding DNA Sequence Number=SeqID_3729
  Gene Ontology: Mol. function=methylenetetrahydrofolate dehydrogenase (NADP+) activity; Cellular component=mitochondrion; Biological process=folic acid and derivative biosynthetic process
  Homolog annotation: Hit_ID=A8GAY2; Match level="QueryCoverage=99%, HitCoverage=99%, E-value=1e-145, Identity=89%"; Hit description =Bifunctional protein folD [Includes: Methylenetetrahydrofolate dehydrogenase (EC ...
  Homolog annotation: Hit description=1.5.1.5); Methenyltetrahydrofolate cyclohydrolase (EC 3.5.4.9)]
  Pfam annotation: Domain name=THF_DHG_CYH; Domain location=4-121; Score=241.6; E_value=1.8e-69; Accession=PF00763.14; Description =Tetrahydrofolate dehydrogenasecyclohydrolase, catalytic domain
  Pfam annotation: Domain name=THF_DHG_CYH_C; Domain location=124-283; Score=374.4; E_value=1.8e-109; Accession=PF02882.10; Description =Tetrahydrofolate dehydrogenasecyclohydrolase, NAD(P)-binding domain
  Pfam module annotation: Pfam domain module=THF_DHG_CYH::THF_DHG_CYH _C; Domain location=4-121::124-283
MAAKIIDGKTIAQQVRFEVAEKVQQRLAAGKRAPGLAVVLVGENPASQIYVANKRRACEEVGFVSRAYNLPASTSEAELLEVIDELNNDDAIDGILVQLPLPAGIDNVKVLERITPDKDVDGFHPYNVGRLCQRAPKLRPCTPRGIVTLLERYNIDTYGLNAVVVGASNIVGRPMSMELLLAGCTTTVTHRFTKDLRHHVEHADLLVVAVGKPGFIPGDWIKPGAIVIDVGINRLESGKVVGDVDFASASERAAYITPVPGGVGPMTVATLIENTLLACEQYHDVEQA

SEQ ID NO: 95415 - protein, 403 aa, Glycine max
  Coding DNA Sequence Number=SeqID_3730
  Gene Ontology: Mol. function=ATP binding; Cellular component=integral to membrane; Biological process=transport
  Homolog annotation: Hit_ID=A8AJT9; Match level="QueryCoverage=82%, HitCoverage=41%, E-value=1e-118, Identity=62%"; Hit description =Putative uncharacterized protein
  Pfam annotation: Domain name=FtsX; Domain location=227-396; Score =63.1; E_value=9.4e-16; Accession=PF02687.12; Description=Predicted permease
  Subcellular localization annotation: CTP_CleavageSite=48; ConfidenceScore=5.01e-01
MLWALLAGVVMLALLLALLGWGTLLLLRRLVVRNLALRLAINRLLRQPAMTLSQLAAFSLSFMLLALLLVMRGDLLDRWQQQLPADAPNYFLLNLTQQQVPQVDEFLRQHQVNAGTFYPIVRARLTELNGKPADPNMDNALNRELNLTWQTERPDHNPLVAGSWPPKAGEVSMEVELADRLGVRLGDRLTFSGDTQQFSATITSLRKVDWESLRPNFFFIFPPGALDQQPQTWLTSFRMANDPALLAQLNRAFPTLSLLDVGSMLKQIGQVLAQVSQALEIMVILVTVCGVLLLLAQIQVGMRQRRQELVVYRTLGASQRLLRGTLWCEFALLGVVAGIAAALGAEAALWGLQRKIFDFPWQPDWTLWLALPLCGAALLSLCGGWLGVRLLKGKALFRRFDAA

SEQ ID NO: 95416 - protein, 379 aa, Glycine max
  Coding DNA Sequence Number=SeqID_3731
  Gene Ontology: Mol. function=hydrolase activity, acting on ester bonds; Biological process=lipid metabolic process
  Homolog annotation: Hit_ID=A7MJY1; Match level="QueryCoverage=57%, HitCoverage=99%, E-value=3e-86, Identity=72%"; Hit description =Putative uncharacterized protein
  Pfam annotation: Domain name=Lipase_GDSL; Domain location=202-368; Score=115.8; E_value=1.3e-31; Accession=PF00657.13; Description=GDSL- like LipaseAcylhydrolase
  Subcellular localization annotation: CTP_CleavageSite=42; ConfidenceScore=5.09e-01
MEPSASTQATASVSASQTINSEGERHSRQNQRQIMLPPTTCRRAAAGDDRSRGGEIAVERKQQIGDAIAGFAIEVTGRLIGKQQAGTAAEGARQRHALLFAAGELGRQMRLAQQMHFAAAAIIQSGENAQQGGFPGSRLADQRQRLGWFDNQLNSGKDGQLMLSLTDGLSKMMNCNNVFRWHYSFLLLLLLLVSRIAAADTLLILGDSLSAGYRMSATAAWPSLLDKTWQQQPKVVNASISGDTAGQGLARLPGLLKQHQPQWVLIELGGNDGLRGFPPQNIAQDLSKIIDQVKAANAQPLLMQIRLPANYGRRYTDAFSALYPRLAQQYHIPLVPFFMEQVYLKPEWMQQDGIHPNPDAQPFIANLMAEQLAPLVKHD

SEQ ID NO: 95417 - protein, 947 aa, Glycine max
  Coding DNA Sequence Number=SeqID_3732
  Gene Ontology: Mol. function=hydrolase activity, acting on acid anhydrides, catalyzing transmembrane movement of substances; Cellular component=integral to membrane; Biological process=metal ion transport
  Homolog annotation: Hit_ID=Q8XD24; Match level="QueryCoverage=75%, HitCoverage=85%, E-value=0.0, Identity=60%"; Hit description=Copper -transporting P-type ATPase
  Pfam annotation: Domain name=E1-E2_ATPase; Domain location=493-715; Score=285.8; E_value=8.4e-83; Accession=PF00122.11; Description=E1 -E2 ATPase
  Pfam annotation: Domain name=HMA; Domain location=304-365; Score =58.5; E_value=2.3e-14; Accession=PF00403.17; Description=Heavy-metal- associated domain
  Pfam annotation: Domain name=Hydrolase; Domain location=719-943; Score=127.3; E_value=4.6e-35; Accession=PF00702.17; Description =haloacid dehalogenase-like hydrolase
  Pfam annotation: Domain name=NfeD; Domain location=10-141; Score=3.1; E_value=0.00086; Accession=PF01957.9; Description=Nodulation efficiency protein D (NfeD)
  Pfam module annotation: Pfam domain module=E1-E2_ATPase::HMA::Hydrolas e::NfeD; Domain location=493-715::304-365::719-943::10-141
MELIAHPHWFWLTLGGLLLAAEMLGTNGYLLWSGVAAVLVGIIEWLFPFSWTSQGMLFAALTLLCVFFWYRWMRFRESAQQPNTLNQRGSQLIGQHLTLDSALKDGVGRFAGGHTGDRDRRVRHHAADSAAFAALLITAARQVIDDGTFGTVIARAGCSQFQQTRAHRVQLFNMRRDLIRLLQGARFNIGTVARRVIKQRDQFATLLEREAHLPRLAQKIELIQVALEQRSDVEQAEVTQQEARVTGAASASDLIATVEQAGYHATLKNEASSPKPDPLPAQEPQPEALTTESQPAEENLAVHHLLIGGMSCASCVSRVEQALQKVPGVSQARVNLGERSALVLGDAVPSALVSAVDEAGYSAEVIEDEQTRRERQQVSAQQAMRRFSWQAALALIVGVPMMVWGMLGDHMMLNDSNQTLWRVLGAVTLAVMALAGGHFYRSAWRSLRHATATMDTLVALGTGAAWIYSMSVALWPAFFPPQARHLYFEASVMIIGLINLGHALEQRARQRASQALERLLDLTPAQACVITAEGEKPLPLSEITPGMTLKLVTGDRVPVDGEVSRGEAWLDEAMLTGEALPQSRRPGDKIYAGTLVQDGSLQFTARATGSHTTLARIINLVRQAQSSKPEMGRLADRISAVFVPVVVAIALLSGAVWYVVGPQPQLAYTLVIVTTVLIIACPCALGLATPMSVIAGVGRAAELGVLVRDADALQRASEVDTIVFDKTGTLTQGTPQVSEVLLYSDWDRQQVLQAAAQLELGSGHPLAKAIVAAAPTVSDARVAQFRTIRGKGVSATVADRTLLLGNAALLEEQHINLRAAQQDIARLAAQGATPVLLADQQQLLGLIALRDQLRPESRAALQRLHQLGYRLIMLTGDHQTTAEAIAAEAGIDEVIAGVLPDGKAQAIAQQQQQGRSVVMVGDVINDAPALAQGGCGDRHGRRQRCGG

SEQ ID NO: 95418 - protein, 159 aa, Glycine max
  Coding DNA Sequence Number=SeqID_3733
  Gene Ontology: Mol. function=protein binding; Biological process =regulation of transcription, DNA-dependent
  Homolog annotation: Hit_ID=A9R238; Match level="QueryCoverage=86%, HitCoverage=86%, E-value=3e-49, Identity=72%"; Hit description =YbaK/ebsC protein
  Pfam annotation: Domain name=YbaK; Domain location=10-155; Score =244.3; E_value=2.7e-70; Accession=PF04073.6; Description=YbaK prolyl-tRNA synthetases associated domain
MTPAVKLLEKQQVAFTLHPYEHDSHETHFGDEAVRKLNLDARQVFKTLLVALNGDGKALAVAVTPVSSQLDLKKVAKALGAKKADMADPQLAQRVTGYLVGGISPLGQKKRLPTVIDQQASEFPTIFISGGKRGLDIELAAQDLARLLDATLADVARRD

SEQ ID NO: 95419 - protein, 195 aa, Glycine max
  Coding DNA Sequence Number=SeqID_3734
  Subcellular localization annotation: CTP_CleavageSite=54; ConfidenceScore=5.31e-01
MIVGVQNAEAIAAFRLPRLRQQRQQQHNQRQPAPSVRSPFNSRPKANTVMHDSRASAERYAAIAVTGDLSAAAERFQPQLCANWFDYADVSGYGLIITTADWLLHRQISETLVTAGRDGVYPVRSGAADLCQHLSAGAAGRSAGWLRLIGVPSGIVARGAYGLRRPPRAGSVAVSGEPLVQPPAARHAGQRCQQA

SEQ ID NO: 95420 - protein, 399 aa, Glycine max
  Coding DNA Sequence Number=SeqID_3735
  Gene Ontology: Mol. function=kinase activity; Biological process=D -ribose metabolic process
  Homolog annotation: Hit_ID=A7MNM7; Match level="QueryCoverage=95%, HitCoverage=88%, E-value=0.0, Identity=83%"; Hit description =Putative uncharacterized protein
  Pfam annotation: Domain name=PfkB; Domain location=12-359; Score =46.2; E_value=1.1e-10; Accession=PF00294.15; Description=pfkB family carbohydrate kinase
DDDFLQRYGLSAGHSLVIDDATAEALYNELMREQLISHQFAGGTIGNTLHNYSVLADDRSVLLGVMCNNIQIGGYAYRYLCNTSSRMDLNFLQGVDGAIGRCFTLIGEQGERTFAISPGLMNQLQAASIPEEVIAGASALVLTSYLVRCQPGEPMPEATLRAIEFAKKHNVPVVLTLGTKYVIQDNPQFWRDFLREHVSIVAMNEEEAFALTGEADPLLASNMALDWVDLVLCTAGPTGLYMAGFTEEAFKRKTNHPLLPGAIAEFNQFEFSRAMRHQDCQQPLRIFSHIAPYMGGPEKIMNTNGAGDGALAALLHDITANNFHRQKVPNSSKHAREYLTYSSLAQVCKYANRVSYQVLNQHSPRLTRGLPEREDSLEESYWDSRDMALVCAINCAATV

SEQ ID NO: 95421 - protein, 214 aa, Glycine max
  Coding DNA Sequence Number=SeqID_3736
  Gene Ontology: Mol. function=phosphotransferase activity, phosphate group as acceptor; Cellular component=cytoplasm; Biological process =nucleobase, nucleoside, nucleotide and nucleic acid metabolic process
  Homolog annotation: Hit_ID=A4W7F8; Match level="QueryCoverage=100%, HitCoverage=100%, E-value=1e-105, Identity=88%"; Hit description =Adenylate kinase
  Pfam annotation: Domain name=ADK; Domain location=5-187; Score=342.6; E_value=6.7e-100; Accession=PF00406.13; Description=Adenylate kinase
  Pfam annotation: Domain name=ADK_lid; Domain location=123-158; Score =80.5; E_value=5.3e-21; Accession=PF05191.5; Description=Adenylate kinase, active site lid
  Pfam module annotation: Pfam domain module=ADK::ADK_lid; Domain location=5-187::123-158
MRIILLGAPGAGKGTQAQFIMEKYGIPQISTGDMLRAAVKAGTELGQQAKAIMDAGKLVTDELVIALVKERIAQEDCKNGFLLDGFPRTIPQADAMKEAGIKVDYVLEFAVPDELIVDRIVGRRVHAPSGRVYHIKYNPPKVEGKDDVTGEELTTRKDDQEETVRKRLVEYHQLTAPLIAYYSKEAEAGNTEYHKIDGTRQVTEVSAQLADILG

SEQ ID NO: 95422 - protein, 393 aa, Glycine max
  Coding DNA Sequence Number=SeqID_3737
  Gene Ontology: Mol. function=unfolded protein binding; Cellular component=cytoplasm; Biological process=response to stress
  Homolog annotation: Hit_ID=Q6D7Z6; Match level="QueryCoverage=100%, HitCoverage=62%, E-value=0.0, Identity=82%"; Hit description =Chaperone protein htpG
  Pfam annotation: Domain name=HSP90; Domain location=1-393; Score =210.1; E_value=5.2e-60; Accession=PF00183.9; Description=Hsp90 protein
ALWTRNKGEISDEEYNEFYKHIAHDFSDPAIWSHNRVEGKQEYTSLLYIPSRAPFDMWNRDSKHGLKLYVQRVFIMDDAEQFMPNYLRFVRGLIDSSDLPLNVSREILQDSRVTQSLRAALTKRSLQMLEKLAKDDAEKYQQFWKEFGLVLKEGPAEDHANQEAIAKLLRFATTQSEGAAQTVSLEDYVSRMVEGQEKIYYITADSYAAAKSSPHLELFRKKGIEVLLLSDRIDEWMMSYLTEFDGKAFQSVSKADESLSKLADEETEAQKEAEKALEPFVDRVKTLLGERVKEVRLTHRLTDTPAIVTTDANEMTTQMAKLFAAAGQDVPEVKYIFEINPEHTLVKRVADTQDEARFAEWVELLLDQALLAERGTLDDPNQFIRRMNQLLTA

SEQ ID NO: 95423 - protein, 506 aa, Glycine max
  Coding DNA Sequence Number=SeqID_3738
  Gene Ontology: Mol. function=transferase activity, transferring glycosyl groups; Cellular component=cytoplasm; Biological process =purine ribonucleoside salvage
  Homolog annotation: Hit_ID=A8GAU8; Match level="QueryCoverage=37%, HitCoverage=96%, E-value=1e-74, Identity=73%"; Hit description =Adenine phosphoribosyltransferase
  Pfam annotation: Domain name=Pribosyltran; Domain location=353-489; Score=159.9; E_value=6.7e-45; Accession=PF00156.18; Description =Phosphoribosyl transferase domain
NQRADHRQHQRRHQSAGTAGKHPPLQPAGSQANNNPDDKGHASPPVSAVSSIEESERLTAAPRSPVYAARRGSAPAAPAESPPRASAAAARSAFQLAPGAVRAAAAWPAIAFSETAARQSAADGSYRPAAAQSAGAACQSLRADAVGRAVEASLRFRIWHAAHFTVKPWLAGDCAGHAGHCITFTTDHAIRVAGRLVFCPLVAALSSLAAVALAVWPLSASLAAASRHAARCQRPGHVADCHHLCGFNLAGEAAVAAHPARCDAGAIVAHAVAHPGCSRKCEPARTVASGLHLAGCLLRFGHLRAWLPFEKRLRLTRFPGVTFMTATAQQLELIKNSIKSIPDYPKPGILFRDVTSLMEDPQAYAAAIAILVERYRNKGITKVVGTEARGFLFGAPVALGLGVGFVPVRKPGKLPRETFSESYELEYGSDALELHKDAIKSGDVVLVVDDLLATGGTLEATVKLIRRAGGEVKDAAFVINLFDLSGEARLNALGIDCYSLVNFPGH

SEQ ID NO: 95424 - protein, 212 aa, Glycine max
  Coding DNA Sequence Number=SeqID_3739
  Gene Ontology: Mol. function=protein transporter activity; Cellular component=membrane; Biological process=protein secretion
  Homolog annotation: Hit_ID=Q7WTR0; Match level="QueryCoverage=100%, HitCoverage=53%, E-value=2e-81, Identity=73%"; Hit description =Membrane-fusion protein precursor
  Pfam annotation: Domain name=HlyD; Domain location=65-212; Score= -26.7; E_value=0.074; Accession=PF00529.11; Description=HlyD family secretion protein
MNKNRGLAPLAAAVMLTGSFLLTGCDDNKSQQAAQQQPPEVGVVTLKNEPLKITTELPGRTSAFRVAEVRPQVSGIILKRNFVEGSDVKAGDSLYQIDPATYQAAYDSAKGDLAQAQANARVAQLTVNRYKPLLGTKYISQQDYDNAAATAAQTAAAVQAAQANVETARINLAYTKVTSPISGRIGKSSVTEGALVSNGQTTALATVQQLDP

SEQ ID NO: 95425 - protein, 537 aa, Glycine max
  Coding DNA Sequence Number=SeqID_3740
  Gene Ontology: Mol. function=transporter activity; Cellular component= integral to membrane; Biological process=transport
  Homolog annotation: Hit_ID=Q7WTQ9; Match level="QueryCoverage=99%, HitCoverage=50%, E-value=0.0, Identity=82%"; Hit description =Multidrug efflux transporter
  Pfam annotation: Domain name=ACR_tran; Domain location=1-537; Score =430.2; E_value=2.9e-126; Accession=PF00873.10; Description =AcrBAcrDAcrF family
MAKFFIDRPIFAWVLAIIIMLAGALSIIKLPIEQYPNVAPPAVEIQASYPGADAKTLQDSVTQVIEQNMNGIDGLMYMSSSSDSSGTLTLTLTFQSGTDADIAQVQVQNKLQLAMPLLPQEVQQQGIQVKKSSSSFLMVAGFVSEDGSMTQNDISDYVASNIKDPISRTPGVGDTQVFGAQYAMRIWLDPHKLNNYQLTPVDVISALQTQNTQVAAGQLGGTPPVPGQQLNASIIAQTRLTSTEEFGNIMLKVNQDGSQVRLRDVAKIELGGENYEIIARYNGKPASGIGVKLATGANALDTADAVKAELAKLEPFFPAGMKTVYPYDTTPFIKISIFKVVKTLFEAIVLVFLVMYLFLHNFRTTLIPTIAVPVVLLGTFAIISAFGYSINTLTMFGMVLAIGLLVDDAIVVVENVERVMAEEGLPPKEATKRSMEQIQGALVGIALVLSAVFIPMAFFGGSTGVIYLQFSITIVSAMALSVLVALILTPALCATMLNPIKKGKHGKTTGFFGWFNRLFDKSTNHYFDCVGHIVLII

SEQ ID NO: 95426 - protein, 167 aa, Glycine max
  Coding DNA Sequence Number=SeqID_3741
  Homolog annotation: Hit_ID=Q8ZRB1; Match level="QueryCoverage=83%, HitCoverage=75%, E-value=3e-51, Identity=72%"; Hit description =Glycoprotein/polysaccharide metabolism
  Subcellular localization annotation: CTP_CleavageSite=56; ConfidenceScore=5.23e-01
CADHSKPVPTPTLGASVAGQPSAIAQPNVSGSVYIRQRIALPPDAVLTVTLADASLADAPSKVLSQRVVRTEGKQAPFQFVLPFNPADIQPNARILLSAAITIDGKLAFITDTVKPVINQGGTKAELLLVPVTNMAMPTQPGAATTVPSTSPTQVTPSASVPAPTSL

SEQ ID NO: 95427 - protein, 477 aa, Glycine max
  Coding DNA Sequence Number=SeqID_3742
  Gene Ontology: Mol. function=ATPase activity, coupled to transmembrane movement of substances; Cellular component=integral to membrane; Biological process=transport
  Homolog annotation: Hit_ID=Q7N0M4; Match level="QueryCoverage=72%, HitCoverage=65%, E-value=3e-44, Identity=70%"; Hit description =Multidrug resistance-like ATP-binding protein
GERGVMLSGGQKQRIAIARALLLNAEILILDDALSAVDGRTEHEILHNLRQAQWHSAAITIRWRRSRAGIAICIAISSWKPRWMRTRQNREPTMAKSQRLWPTLKRLLAYGKPWRKSLWLAVGMLWIAAAAEVTGPVLVSYFIDNLVAKHRMPWGIVAGLLVGFVLLQLLAAGLHYFQALLFNRAAIGVVQQLRVDVMNAALRQPLSAFDTQPVGTDYFARHQRYRSDQRSLRHGGGHCAAQRCADWRDAGGDVCTRLAYGAGGAGDFPAGVNGDADLSALQHADCAPRALWRAHGRSQPIALSGADGDAAAGRLFAASAAQPVFCTDIVGVLYAFITYLGRLNEPLIELTTQQSMLQQAVVSGERIFELMDAAQQGYGSDAQPLASGRITLRDVSFAYRDNRDVLSHINLEVPARGFVALVGHTGSGKSTLANLLMGYYPRGDGATGSGGTGRYAAGQRAFGTRYQRRGRVARAGE

SEQ ID NO: 95428 - protein, 273 aa, Glycine max
  Coding DNA Sequence Number=SeqID_3743
  Gene Ontology: Mol. function=hydrolase activity; Cellular component =membrane; Biological process=metabolic process
  Homolog annotation: Hit_ID=A7MFJ6; Match level="QueryCoverage=99%, HitCoverage=100%, E-value=1e-103, Identity=65%"; Hit description =Putative uncharacterized protein
  Pfam annotation: Domain name=Hydrolase; Domain location=2-233; Score =42.4; E_value=1.7e-09; Accession=PF00702.17; Description=haloacid dehalogenase-like hydrolase
  Pfam annotation: Domain name=Hydrolase_3; Domain location=5-258; Score=199.5; E_value=7.9e-57; Accession=PF08282.3; Description =haloacid dehalogenase-like hydrolase
  Pfam annotation: Domain name=S6PP; Domain location=1-258; Score= -34.3; E_value=7.3e-08; Accession=PF05116.4; Description=Sucrose-6F -phosphate phosphohydrolase
  Pfam module annotation: Pfam domain module=Hydrolase::Hydrolase _3::S6PP; Domain location=2-233::5-258::1-258
MARLAAFDMDGTLLLPTHRLGAETLQSLNALHQRGVTLAFATGRHLLDMQAVRQQITLPAWLITGNGTRIHDVEGRQLYGCDLAPSVAEEVLHSHWQTPASIHIFNDEGWFTDKPLPGLLEAHAMSGFHYQLRDLRRMPAHEVTKICFIAPYEMLLALKIELQQALGDRASLCFSARECLEVLPLDCHKGAALARLCQHLSLSLADCMAFGDAMNDREMLERVGRGFIMGNAMHQLKTSLPHLPIIGHCETQAVSHYLNHWMTTPHLDYSPEC

SEQ ID NO: 95429 - protein, 543 aa, Glycine max
  Coding DNA Sequence Number=SeqID_3744
  Gene Ontology: Mol. function=transporter activity; Biological process= transport
  Homolog annotation: Hit_ID=A7MFJ7; Match level="QueryCoverage=96%, HitCoverage=92%, E-value=1e-153, Identity=51%"; Hit description =Putative uncharacterized protein
  Pfam annotation: Domain name=SBP_bac_5; Domain location=134-465; Score=46.3; E_value=1e-10; Accession=PF00496.13; Description =Bacterial extracellular solute-binding proteins, family 5
MAQHCYCSERHVRTLLRQWQQAGWLQWHGAAGRGKQGELRFLLSPEQLRQQLLSQQLAAGEAVQALQVLDVAPERLVKMLRPLMGGQWQNQAPVLRIPYYRAMEALDPLQLTGRAEQHLVRQIFSGLTRFNADDVEGDLAHHWQHDAQGREWYFWLRPLLSWHNDEPVQAAQLVQQLQRIMQTPQGGRLLAAVEHIDAPHPLALRIRLRTSDYWLPQRLAHQFCLLPHPEHADIGSGPWRLTHFTRELVRLESHARWHHQRPLIQVVEYWITPQLFDRGLGTSCRHPVQIAIGDPDELDTLRPVDRSISLGFCYLAPRFSARFSQAQAKTLLALIQHSGVIQQLPLDEGLITPTAELLPGWPLPAPHRPEGTLPATLTLHYHLPIELHVMAQALVPLLAAQGCTLTCVFHDVKSWRDDIDLSDADIIMGDRLIGDAPQFTLVNWLENDAAWQPLRPAVLQAPLHAIARQASPALRSAAIHQLFQQLMRDGHLLPLFNYRYQVFAPPGVEGIQLNSMGWFDFTRAWIPPPAAGGAVQPAPEPVP

SEQ ID NO: 95430 - protein, 922 aa, Glycine max
  Coding DNA Sequence Number=SeqID_3745
  Gene Ontology: Mol. function=nucleoside-triphosphatase activity; Cellular component=intracellular; Biological process=regulation of transcription, DNA-dependent
  Homolog annotation: Hit_ID=A7FHW0; Match level="QueryCoverage=63%, HitCoverage=99%, E-value=0.0, Identity=64%"; Hit description=Sigma -54 dependent transcriptional regulator
  Pfam annotation: Domain name=AAA_2; Domain location=645-791; Score= -48.7; E_value=0.057; Accession=PF07724.5; Description=ATPase family associated with various c
  Pfam annotation: Domain name=GAF; Domain location=386-523; Score =62.9; E_value=1e-15; Accession=PF01590.17; Description=GAF domain
  Pfam annotation: Domain name=HTH_8; Domain location=879-919; Score =32.8; E_value=1.2e-06; Accession=PF02954.10; Description=Bacterial regulatory protein, Fis family
  Pfam annotation: Domain name=Sigma54_activat; Domain location=633 -845; Score=361.1; E_value=1.9e-105; Accession=PF00158.17; Description=Sigma-54 interaction domain
  Pfam module annotation: Pfam domain module=AAA_2::GAF::HTH_8::Sigma54_ activat; Domain location=645-791::386-523::879-919::633-845
MPPDRRGSGKGNFSDALAGGQRFAGFAAKALHYIQHARREQIANQLHQQRNTKRRLLSRFQHHAVTGGQRRCQLPRRHEQREVPRDDLSDHAERLVEVIGHRGFVDLSGAALLRAQAAGKIAKMVDRQRQIGVERLANRFTVIPALRYRQLLKTGFYTIGHLQQQVGALLYAGFAPRIRSLMRGIQRQIDIARVGAREPGNIAAVYRRGVHKVLAAQRLGEVAGDIVAVGRLERDQRAGRAGMCITHRKLLIIRSEGLNRQRNCLCRYCSARASFFSSGAKAINALFINQINSFPASYPVSPPRQTLYLCCVSQQCRNPNATMLQHLHAVLRSLMQGNSAASAVHANPLLSDSWFRSQLYGLERSADDFPRVRQGELADVLASNAGLQQFAQPVIRQLAQQMAETQSVVILSDASGLVLNTFGDMQALEKAQRFALAPGNLWSECGRGTNAIGTALAIDDGCEIDGQQHFLTRNQGLYCAAMPLQMPNGQIAGVLDISGPAHFPHPHTLNRVKAAAKQIEYLWVKQSLHPQQWLLSLHPQPQGIDTSDELLLVFSDNVLTAANRLAMRELALSADRFASLTFQQLFPQLQQQANSVPAAVDIGAQRYWFRLRAPQRSHVSVPDSRTHDLPRVLGADGAKMLRLLDAGVSLCIYGETGSGKEYVSRALHQQSRWRTGKFVAINCAAIPEALIESELFGYQPGAFTGASKNGYIGKIREADGGVLFLDEIGDMPLTLQTRLLRVLQEKEVAPLGSSRSWPVNFAVICATHRDLAQRVTAGEFREDLLYRLQEFALTLPPLRAWPNVAGFIRDLWQELGAAQRGVQLSQALLTALAQQPWPGNVRQLRSLLRVLLALADEGETLTESHLPAEYRRPPAPPLRERHDEQLISETLQRYDGNISKAAQALGVARSTLYRRAARDRGD

SEQ ID NO: 95431 - protein, 863 aa, Glycine max
  Coding DNA Sequence Number=SeqID_3746
  Gene Ontology: Mol. function=diaminohydroxyphosphoribosylaminopyrimidi ne deaminase activity; Cellular component=riboflavin synthase complex; Biological process=riboflavin biosynthetic process
  Homolog annotation: Hit_ID=A6T5E7; Match level="QueryCoverage=41%, HitCoverage=96%, E-value=1e-149, Identity=74%"; Hit description =Bifunctional diaminohydroxyphosphoribosylaminopyrimidine deaminase/ 5- ...
  Homolog annotation: Hit description=amino-6-(5-phosphoribosylamino) uracil reductase
  Pfam annotation: Domain name=AIRS; Domain location=605-749; Score= -7.4; E_value=0.00058; Accession=PF00586.15; Description=AIR synthase related protein, N-terminal domain
  Pfam annotation: Domain name=DMRL_synthase; Domain location=391-535; Score=297.5; E_value=2.6e-86; Accession=PF00885.10; Description=6,7 -dimethyl-8-ribityllumazine synthase
  Pfam annotation: Domain name=NusB; Domain location=523-637; Score =88.7; E_value=1.8e-23; Accession=PF01029.9; Description=NusB family
  Pfam annotation: Domain name=RibD_C; Domain location=147-361; Score =224.3; E_value=2.8e-64; Accession=PF01872.8; Description=RibD C -terminal domain
  Pfam annotation: Domain name=dCMP_cyt_deam_1; Domain location=1-100; Score=152.1; E_value=1.6e-42; Accession=PF00383.13; Description =Cytidine and deoxycytidylate deaminas
  Pfam module annotation: Pfam domain module=AIRS::DMRL_synthase::NusB:: RibD_C::dCMP_cyt_deam_1; Domain location=605-749::391-535::523 -637::147-361::1-100
MTDAHYMARALELARRGQYTTTPNPNVGCVIVRDGAIMGEGWHQRAGEPHAEVHALRMAGDHARGATAYVTLEPCSHHGRTPPCCDALIAAGVSRVVAAMQDPNPQVAGRGLYRLQQAGIDVSHGLMMNEAEALNRGFLKRMRTGFPWIQLKLGASLDGRTAMASGESQWITSAAARRDVQRLRARSSAILTTSATVLADNPSLTVRWDELSETVRQQLDESQLRQPVRVVIDSQQRVTPQHRLIAQPGETWLMRTEADAQSWPPGVSQIEVPPRGEQLDLVAMMMLLGQRQINSVWVEAGAGLAGALLQAGLVDELIVYLAPKLLGNAARGLCALPGLETLADAPALNFSDVRQPERVAEEYDRIRPLLRGHKTNTQRICMKVIEAAVATPDANIAIVIARFNNFINDSLLDGAVDALKRIGQVKAENITVVWVPGAYELPLAARALAKTGKHDAIVALGTVIRGGTAHFEYVAGEASSGIAHVAMNSEIPVTFGVLTTENIEQAIERAGTKAGNKGAEAALTALEMINALYSWQLSNNDIADVEYQFLAEQDVKDVDISYFRELLAGVATNSAFLDGLMKPYLSRQLEELGQVEKAILRISLFELSKRDDVPYKVAINEGIELAKVSRRDVEKGIGDDCALLNVPEKQTLAISTDTLVAGVHFLRDIHPADLGYKALAVNLSDLAAMGADPAWLTLALTLPEVDEPWLAAFSDSLFELLDYYDMQLIGGDTTRGPLSLTLGIHGLVPAGRALKRAGAKPGDWIFVTGTLGDSAAGLSLLQHHHRLNDPAVHEVLIKRHLRPMPRVLQGQALRNLATSAIDLSDGLISDLGHILTASRVGARINPDALPLSAALRDHFEPEQ

SEQ ID NO: 95432 - protein, 1781 aa, Glycine max
  Coding DNA Sequence Number=SeqID_3747
  Gene Ontology: Mol. function=P-P-bond-hydrolysis-driven protein transmembrane transporter activity; Cellular component=type II protein secretion system complex; Biological process=intracellular protein transport across a membrane
  Homolog annotation: Hit_ID=A8GAM7; Match level="QueryCoverage=34%, HitCoverage=99%, E-value=0.0, Identity=83%"; Hit description=Protein- export membrane protein SecD precursor
  Pfam annotation: Domain name=Queuosine_synth; Domain location=92-305; Score=460.4; E_value=2.4e-135; Accession=PF02547.6; Description =Queuosine biosynthesis protein
  Pfam annotation: Domain name=SecD_SecF; Domain location=1605-1748; Score=116.9; E_value=6.1e-32; Accession=PF02355.7; Description =Protein export membrane protein
  Pfam annotation: Domain name=Sec_GG; Domain location=1004-1035; Score= 25.1; E_value=0.00027; Accession=PF07549.5; Description=SecDSecF GG Motif
  Pfam annotation: Domain name=Sec_GG; Domain location=1532-1560; Score= 28.9; E_value=1.8e-05; Accession=PF07549.5; Description=SecDSecF GG Motif
  Pfam annotation: Domain name=TGT; Domain location=568-806; Score =568.5; E_value=6.7e-168; Accession=PF01702.9; Description=Queuine tRNA-ribosyltransferase
  Pfam annotation: Domain name=YajC; Domain location=818-903; Score =128.6; E_value=1.9e-35; Accession=PF02699.6; Description=Preprotein translocase subunit
  Pfam module annotation: Pfam domain module=Queuosine_synth::SecD _SecF::Sec_GG::Sec_GG::TGT::YajC; Domain location=92-305::1605 -1748::1004-1035::1532-1560::568-806::818-903
FAPHYRVELDKIARRAGQLRHNVALGSGAKSRQRLRRMQLIPVARQEVVPDHVEGQYRPPPAAATAPQRCRAQSRPADYPAVSCRPGLQGEADFAFELPESLIAHYPQAQRSGCRLLSLDGPSGALNHGVFTDVLDKLNPGDLLVFNNTRVIPARVYGRKASGGKIEMLVERMLDDKRVLAHVRASKAPKPGAELLLGDDESVKATMVARHDALFEIEFADDRAVLDILNSVGHMPLPPYIDRPDEEADRELYQTVYSARPGAVAAPTAGLHFDEPLLAALKAKGVEMAFVTLHVGAGTFQPVRVENINDHIMHSEYAEVPQDVVDAVLACKARGNKVVAVGTTSVRSLESAAQACQDGLIAPFFDDTQIFIYPGYHYQVIDALITNFHLPESTLIMLVSAFAGYQHTMAAYQSAVAEQYRFFSYGDAMYITRNPQAPDEIVNVKFELDTTDGRARRGRLVFDRGVVETPAFMPVGTYGTVKGMTPEEVKETGAQILLGNTFHLWLRPGQEIMKLHGDLHDFMHWQGPILTDSGGFQVFSLGDIRKITEAGVHFRNPINGDPIFLDPEKSMEIQYDLGSDIVMIFDECTPYPADWDYAKRSMEMSLRWAQRSRDRFDALGNKNALFGIIQGGVYEDLRDVSVKGLVEIGFDGYAVGGLAVGEPKEDMHRILEHVCPQIPQDKPRYLMGVGKPEDLVEGVRRGIDMFDCVMPTRNARNGHLFVTDGVVKIRNAKYKDDTAPLDAECDCYTCRNYTRAYLHHLDRCNEILGARLNTIHNLRYYQRLMAGLRQAIEEGKLEHFVSEFYQRTGKAVPPLNGSPYSLVIMLVVFGLIFYFMILRPQQKRAKDHKKLMDSISKGDEVLTNGGLVGRVTKVAETGYIAIALNDTTEGTAVLNRYPLWKYIMLVVVILVGLLYALPNLYGEDPAVQITGARGGAASEQTLDQIQTVLKQDNIQSKSLALENGAILARFANTDIQLRAREAITNALGEDFVVALNLAPATPRWLTMLAAEPMKLGLDLRGGVHFLMEVDMDTALGKLQEQNADGLRSDLREKNIPYTNVSKIANYGTEIRFRDGASRDAAISYLTPRHRDLVITSAGSDTLRAVMTDARLSEAREYAVQQNINILRNRVNQLGVAEPLVQRQGADRIVVELPGIQDTARAKEILGATATLEFRLVNTSVDPSAAASGRVPGDSEVKKTREGQPVVLYKRVILTGDHITDSTSSMDEYNQPQVNISLDGAGGNIMSNFTKDNIGKPMATLFVEYKDSGKKDANGRAILVKQEEVINVANIQSRLGNSFRITGISNPNEARQLSLLLRAGALIAPIQIVEERTIGPTMGQQNITQGLEACLWGLIASIIFMVVFYKKFGLIATSALLCNLVLIVGIMSLLPGATLTMPGIAGIVLTLAVAVDANVLINERIKEELRNGRSVQQAIHEGYKGAFSSIVDANVTTLIKVIILYAVGTGSIKGFAITTAIGIATSMFTAIVGTRAIVNLEYSIEQLNHGRKVVDFMRWDTLAFIISGLLIVASIAIIGVRGFNWGLDFTGGTVIEINLEKPADLDALRDGLVKAGFEEPLVQNFGSSRDVMVRMPPTTGNAGQELGNKVVASINQTTQQNATVKRIEFVGPSVGSDLAQAGAMALLSALIAILIYIGFRFEWRLALGTVLALAHDVIITCGILSLFHIEIDLTIVASLMSVIGYSLNDKIVVSDRIRENFRKIRRDAEPYVDHLDHHAGDDPDPVHLWWRAAERLLADHADRCHHRYHFVDLRVVRAGAEAGHEA

SEQ ID NO: 95433 - protein, 129 aa, Glycine max
  Coding DNA Sequence Number=SeqID_3748
  Gene Ontology: Mol. function=transferase activity, transferring groups other than amino-acyl groups; Cellular component=integral to membrane
  Homolog annotation: Hit_ID=A3VZP4; Match level="QueryCoverage=37%, HitCoverage=7%, E-value=2e-13, Identity=70%"; Hit description =Acyltransferase 3
MSVPVSLRYRPDIDGLRAVAIILVVLFHCGVSAVPGGFIGVDIFFVISGFLIGVLFTPHPAYCARPVFYADGIAAARLSAVITAGIKPAGKIQHGGVSLGAQYAVTEERRLFQRGCRSQSAADDLVAGH

SEQ ID NO: 95434 - protein, 200 aa, Glycine max
  Coding DNA Sequence Number=SeqID_3749
LFTPHPAYCARPVFYADGIAAARLSAVIPAGIKPAGKIQHGGAVLYRAAVYSAAGRAAAAHNDGHGATAQPAVAGRLPVVNAPLQHSGVLSAANPRLGAGCRRAAGAVATPPRHRPAGQPLSSRWLAADHRPLNQRLLENAPMRFIGAEHLCRGAGHRLALLALHRTAIPSGAQRYALADPRLLRLVAAGSRCHGAAVAK

SEQ ID NO: 95435 - protein, 375 aa, Glycine max
  Coding DNA Sequence Number=SeqID_3750
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q6D864; Match level="QueryCoverage=100%, HitCoverage=85%, E-value=1e-156, Identity=73%"; Hit description =Sensor protein
  Pfam annotation: Domain name=HATPase_c; Domain location=251-362; Score=125.6; E_value=1.4e-34; Accession=PF02518.17; Description =Histidine kinase-, DNA gyrase B-, and HSP90-like ATPase
  Pfam annotation: Domain name=HisKA; Domain location=141-207; Score =95.4; E_value=1.7e-25; Accession=PF00512.16; Description=His Kinase A (phosphoacceptor) domain
  Pfam annotation: Domain name=PAS; Domain location=36-132; Score=46.7; E_value=8.4e-11; Accession=PF00989.15; Description=PAS domain
  Pfam annotation: Domain name=PAS_4; Domain location=42-137; Score =16.2; E_value=0.0053; Accession=PF08448.1; Description=PAS fold
  Pfam module annotation: Pfam domain module=HATPase_c::HisKA::PAS::PAS_ 4; Domain location=251-362::141-207::36-132::42-137
MTPPTGRGSWEPLFYGLYQMQLRNRRRRRELGNLIKRFRSGAESLPDAVVLTTEEGTIFWCNGLAQQHLGLRWPEDNGQNILNLLRYPEFSRYIRQRDFNKPLTLVLNNQHHMEFRVMPYSEGQWLMVARDVTQMHQLEGARRNFFANVSHELRTPLTVLQGYLEMMDDAGMNERTRSKALNTMQEQTRRMDSLVKQLLTLSRIEAAPAIDLKETVDVPTMLLLLQREAETLSQGRHSIHFHTDPHLKVFGNDEQLRSAISNLVYNAVNHTPDGTRIDISWLRTKQGAEFKVCDNGPGISEEHLPRLTERFYRVDKARSRATGGSGLGLAIVKHALGHQTTRLEISSVPHQETCFRFVLPPCLIVANGIRENVAQ

SEQ ID NO: 95436 - protein, 270 aa, Glycine max
  Coding DNA Sequence Number=SeqID_3751
  Homolog annotation: Hit_ID=A8GBK2; Match level="QueryCoverage=58%, HitCoverage=71%, E-value=2e-42, Identity=55%"; Hit description =Putative uncharacterized protein precursor
  Pfam annotation: Domain name=DUF799; Domain location=77-270; Score =198.5; E_value=1.7e-56; Accession=PF05643.2; Description=Putative bacterial lipoprotein (DUF799)
VLAGCAPKGPEPIYYWGDYQQQVYSYYQKDSDPQKQIDALNLDIEKAKAVNKPVAPAVSGIGPVHGLSDEEKRSEPMKKLIAVCGVFAALLLTGCAQNKKPYDYSAFRASKPASILVLPADNRAPDINASHSFTSLVTQPLAEAGYYVFPVAVVEETFQQNGLSNGHEIQAVSTKRLHDIFNADSALYISITDYGSSYLVVDSVTTVSATARLVDLRSGKELWQGMATANDSENSNNSNGGIIGMRPRLLAQNEQGGLLAGPRYKAPVTR

SEQ ID NO: 95437 - protein, 561 aa, Glycine max
  Coding DNA Sequence Number=SeqID_3752
  Gene Ontology: Mol. function=sequence-specific DNA binding; Cellular component=intracellular; Biological process=regulation of transcription, DNA-dependent
  Homolog annotation: Hit_ID=Q6CYY0; Match level="QueryCoverage=58%, HitCoverage=93%, E-value=1e-152, Identity=80%"; Hit description=AraC family transcriptional regulator
  Pfam annotation: Domain name=HTH_AraC; Domain location=439-480; Score= 6.6; E_value=0.56; Accession=PF00165.14; Description=Bacterial regulatory helix-turn-helix proteins, araC family
  Pfam annotation: Domain name=HTH_AraC; Domain location=486-530; Score= 51.3; E_value=3.3e-12; Accession=PF00165.14; Description=Bacterial regulatory helix-turn-helix proteins, araC family
  Pfam annotation: Domain name=SurA_N; Domain location=414-504; Score= -87.7; E_value=0.026; Accession=PF09312.2; Description=SurA N -terminal domain
  Pfam module annotation: Pfam domain module=HTH_AraC::HTH_AraC::SurA _N; Domain location=439-480::486-530::414-504
DAPHLDPADHGIIAAAVERAGQALAEFGKERDRYGLIHADLRLTNLLLHKGETRVIDFDDCGMGWYLHDLAAAISFVEHHPRAAEWVDNWILGYERVAHISDAEMALVPTLLIQRRIQMTAWMGTHADTEMALSLKPHWASHSVRLCRRYLESSQLPRASRHRRADRHADRHRERASGGQAVHCLAPRAVGGRCAFATPASNRGVLAAAATGLSAFITDKGGDVDRIFGISGIDSELLASPTLSLGLVNYCRVMEEAARHSGFDNFGLHYGRQFKPQSLGLIGYIGLCSPTLEQALHNVVNAFPWHQHDTLTRLVDKGDCWRLDYQVRHGAILARRQDAELTLGMFLNLIRHVAGKNWAPREVHFEHPRPEQWHEHCKVFDAPVWFDQPFNSLLIAKRDLQRAMPEQDAMLLMVMQDAIRRLNSSASVQSVVEQARSQVSLTLIQGEPVLEEIAGKMGLSSWSLQRRLREEGISFSALVDKVRCEMATHYLQQRQLPISEMALLLGYSEVSAFSRAFRRWFGISPRQWRQDGLVSQAGAAQSQTTLAGRAAAEAVSRATDQ

SEQ ID NO: 95438 - protein, 310 aa, Glycine max
  Coding DNA Sequence Number=SeqID_3753
  Gene Ontology: Mol. function=transcription factor activity; Cellular component=cytoplasm; Biological process=regulation of transcription, DNA-dependent
  Homolog annotation: Hit_ID=UPI00005F9713; Match level="QueryCoverage =91%, HitCoverage=93%, E-value=6e-36, Identity=35%"; Hit description =COG0583: Transcriptional regulator
  Pfam annotation: Domain name=HTH_1; Domain location=15-74; Score =75.2; E_value=2.1e-19; Accession=PF00126.18; Description=Bacterial regulatory helix-turn-helix protein, lysR family
  Pfam annotation: Domain name=LysR_substrate; Domain location=94-305; Score=41.9; E_value=2.3e-09; Accession=PF03466.11; Description=LysR substrate binding domain
  Pfam module annotation: Pfam domain module=HTH_1::LysR_substrate; Domain location=15-74::94-305
MATAEHLISNHLPSVKQLQCFLAVAHELNFRRAAERLSMTQPPLTRQIKRLEAVLEQPLFSRSTHDVSLTDAGRALVIKAEKILQALNELKPGPLSSEKRLRIGLTRTLNFALIAPIHQQLLKLDAADDVETPDLTSAQLLQCLAKNRLDLVLTGEKATGHEDTVQYQWIGREPLLVAMPARHPASLKEKVSLEAIGDLPLFWFARSANPSFYDKCERLFSQLHTPLKRVKEPDDSLVMLTHIARGKGFALMPQSKCTFHQEGLCYRALADDEAQNLHIDIYAAIRLNENRPAVLHAHDIVCHAGQLSQH

SEQ ID NO: 95439 - protein, 932 aa, Glycine max
  Coding DNA Sequence Number=SeqID_3754
  Homolog annotation: Hit_ID=A8GAI7; Match level="QueryCoverage=52%, HitCoverage=92%, E-value=0.0, Identity=71%"; Hit description =Oligopeptide transporter OPT superfamily protein precursor
  Pfam annotation: Domain name=DUF1177; Domain location=607-889; Score =273.1; E_value=5.6e-79; Accession=PF06675.2; Description=Protein of unknown function (DUF1177)
  Pfam annotation: Domain name=IclR; Domain location=35-166; Score =25.5; E_value=2.7e-06; Accession=PF01614.9; Description=Bacterial transcriptional regulator
  Pfam annotation: Domain name=OPT; Domain location=124-631; Score= -29.3; E_value=4.5e-09; Accession=PF03169.6; Description=OPT oligopeptide transporter protein
  Pfam module annotation: Pfam domain module=DUF1177::IclR::OPT; Domain location=607-889::35-166::124-631
  Subcellular localization annotation: CTP_CleavageSite=60; ConfidenceScore=5.07e-01
MARLAASSGCMGYISVLDGDDVLVMRMYHGRFFTQLVTPPGTRVSVTGTSTGRVLLAQLSDDEVRARFSDNWQTASINSPLNIDALCKELALIRQQGWALARNETLPGISSLAVADNPNLISRRNTSRHTGEIAGAIIGVQLITTIGVTPNTSIIGALFAMLLARIPLQWFRRYRSVEVQNLAQTAISSATFGAANSLLMPIAVPWALGEPQLVLPLFVGVSAAMLLDAWLLYRLFDTRVFPASNAWPPGVAAAEAIKAGDKGGRQAWLLVAGIVGGVAGSMLKIPMSAFGTAFIGNIWALTMLGIGFLLRAYAQPVAGIDINALYIPHGVMVGAGLVALIQVVQVIRSRRHDNLNVSRSDNEVKRALGLGTVGYIVISALLALGGGLWSEMGLPMLLLFIIYAAFAAFVHELIVGIAAMHSGWFPAFAVALITLILGILLGFPPLALCLLCGFTAATGPAFADMGYDLKAGFILRGNGADVQQELWGRRIQLIAAMIAFVIAIPVVWYAHNLFFVDNLLPPVARVYAKTIQAGAEPGIAGSLLMWAIPGAIIQLIGGPKRQLGVLLATGLLINNAAAGWAVLVGIALRVLILRVWGERGRSPMEVMAAGFIAGDALAYVDGQQVVDLFAAYPGVQASFKRVSGPKGRTDFVRIDIPGAQGKSRGGSAPTLGIIGRLGGIGARPTRIGMVSDADDADQRRRAGRRRDRNHAYCPDAPTRPHEPVDFMDSPCDDITMNDNEVVEGVDAILSIDTTKGNRILNHKGYALSPTVKEGYILRVSEDLLRIMEMTSGQPAVTFPITTQDITPYGNGVYHLNSILQPSTATDVPVVGVAICAQSVVPGCGTGASHEVDIAATPPAQPESLMMKPSLVTLTIGQSPRSDILPLLQEHLPADAVAHAGLLDGLTLAEVEQLYAPAPADKVLVSRMSSGEQ

SEQ ID NO: 95440 - protein, 147 aa, Glycine max
  Coding DNA Sequence Number=SeqID_3755
  Homolog annotation: Hit_ID=A8GHH3; Match level="QueryCoverage=99%, HitCoverage=96%, E-value=2e-61, Identity=78%"; Hit description =Putative uncharacterized protein
  Pfam annotation: Domain name=DUF188; Domain location=1-146; Score =257.2; E_value=3.4e-74; Accession=PF02639.5; Description =Uncharacterized BCR, YaiIYqxD family COG1671
MSIWVDADACPNVIKEVLYRAAERTKVTVTFVANQPLRVPPSPFLKTLQVAAGFDVADNEIVKRVQPGELVITGDIPLAAEVLEKGAAALNPRGERYSSDTIRQRLTMRDFMETMRASGIQSGGPSALSPRDRQQFANELDKWLRQR

SEQ ID NO: 95441 - protein, 93 aa, Glycine max
  Coding DNA Sequence Number=SeqID_3756
  Homolog annotation: Hit_ID=A1JRS6; Match level="QueryCoverage=83%, HitCoverage=72%, E-value=8e-21, Identity=64%"; Hit description =Putative starvation-inducible protein precursor
  Pfam annotation: Domain name=PsiF_repeat; Domain location=16-49; Score=65.1; E_value=2.4e-16; Accession=PF07769.5; Description=psiF repeat
  Pfam annotation: Domain name=PsiF_repeat; Domain location=56-90; Score=65.5; E_value=1.8e-16; Accession=PF07769.5; Description=psiF repeat
  Pfam module annotation: Pfam domain module=PsiF_repeat::PsiF_repeat; Domain location=16-49::56-90
MAAGLLLAGGAGAAEKTAQQEKMTLCNQHAGAQNLKGDARKSFMSECLKKDSKMGNMTPQQMKMKSCNSEAGEKKLSGDARKTFMSSCLKKSA

SEQ ID NO: 95442 - protein, 629 aa, Glycine max
  Coding DNA Sequence Number=SeqID_3757
  Gene Ontology: Mol. function=4 iron, 4 sulfur cluster binding; Cellular component=cytoplasm; Biological process=lipoate biosynthetic process
  Homolog annotation: Hit_ID=A7ZJ15; Match level="QueryCoverage=48%, HitCoverage=94%, E-value=1e-164, Identity=92%"; Hit description =Lipoyl synthase
  Pfam annotation: Domain name=Radical_SAM; Domain location=70-234; Score=87.8; E_value=3.4e-23; Accession=PF04055.12; Description =Radical SAM superfamily
MALIPVKTVVTERQEILRKPEWMKIKLPADSSRIQGIKAAMRKNGLHSVCEEASCPNLAECFNHGTATFMILGAICTRRCPFCDVAHGRPNAPDANEPLKLAQTIADMALRYVVITSVDRDDLRDGGAQHFADCISAIREKSPSIKIETLVPDFRGRMDRALEILTATPPDVFNHNLENVPRVYRQVRPGANYEWSLKLLERFKEAHPDVPTKSGLMVGLGETNVEIIEVMRDLRRHGVTMLTLGQYLQPSRHHLPVQRYVSPAEFDEMKEEALAMGFTHAACGPFVRSSYHADMQAKGLEIMQSSFHIDELDFMRAADVSGPSSGRPRSGASGESLDALKARTTPMDITNPFVTPHASCELAFLATAISIDHRYDEIHLHLPQSAQPASAPAPAPALPFTELRSVTPDETPLLPALLPLESAQQAAGESVWHSLPEVPALSPALSLVSALPAAWYAAEHQTPHPSPVPTLPVRQPLSLPEVAVLRDIRQHDYAVDYDDSGEPKMFSGTLAAGAQVHIYIDNVLIEVVTGDAQGHWQFAQPADLSAAQHVFTAAIITPIDDSDLSAIDCALMELAMQQDDIAPALLPLTFSEAWLDEWHSADSTLTASGDHGGNLPGWDEPLEHHIVWH

SEQ ID NO: 95443 - protein, 34 aa, Glycine max
  Coding DNA Sequence Number=SeqID_3758
MVPLTSIQGGGNDIGLFKEEVFDLGGFNIDGSIT

SEQ ID NO: 95444 - protein, 44 aa, Glycine max
  Coding DNA Sequence Number=SeqID_3759
MVEREKFDHIEERLRAIEEGGDYPFANMAELCLVLDVIIPPKFK

SEQ ID NO: 95445 - protein, 94 aa, Glycine max
  Coding DNA Sequence Number=SeqID_3760
MWAIIDQYKEKLNLAASREQRLEDNHAKVSVMQWEREVRERVTNSLHREAMMWMDRFAFTLNGSQELPRLLAKAKAMADVYSAPEEVHGLFDYC

SEQ ID NO: 95446 - protein, 169 aa, Glycine max
  Coding DNA Sequence Number=SeqID_3761
MALKKFSTKRSRRDATGEGSSVAPEFDSHRFQSAEHQQHFEAIKGWSFHKERRDQLREDEYMDFQEEIARRHWTPLVTHMAKFDPEIVLEFYANAWPTEEGVRDMRSWVRASSWVTRLFWRKASSVSSARGGTGPTGSMRKPLPSCCAHRGRISPRQLQGGGCGSCAPA

SEQ ID NO: 95447 - protein, 110 aa, Glycine max
  Coding DNA Sequence Number=SeqID_3762
MQKRFTRIVNHLASLEKIFPNEDLIIKVLGCLSKEWQPKEHEMELQRLNQNEETDKRKRSITLKASSSMQEENVDEESEDEEDFSIFVNKFHKFVKNRRIERRQNFNHGK

SEQ ID NO: 95448 - protein, 66 aa, Glycine max
  Coding DNA Sequence Number=SeqID_3763
  Gene Ontology: Mol. function=aspartic-type endopeptidase activity; Biological process=DNA integration
  Homolog annotation: Hit_ID=A5AWG2; Match level="QueryCoverage=81%, HitCoverage=12%, E-value=5e-09, Identity=55%"; Hit description =Putative uncharacterized protein
MTLYAKNSLKTCKQTKNGIFVNQSKYCKELIHRFGMENAKHMATPMSTACYLDKDEIDQSIDVKQY

SEQ ID NO: 95449 - protein, 40 aa, Glycine max
  Coding DNA Sequence Number=SeqID_3764
MGIILMSFSLERVWNAGQADDRALTVARSVPSPARGRGLG

SEQ ID NO: 95450 - protein, 142 aa, Glycine max
  Coding DNA Sequence Number=SeqID_3765
MHKALRLNAPLPYPHLVALFLLHFNIPLDFEPYVLIKRSFLIGAAMVASFGYRKERDGSRVKKGVQPNDDEGHFPVEGDSSLLQSILDRFDGLQTYVGERFDSLERQVDTRFEEMNSRIAKVEEDGTIIRDCLDLPPPPPSV

SEQ ID NO: 95451 - protein, 96 aa, Glycine max
  Coding DNA Sequence Number=SeqID_3766
MKNWMQNLKRDVYLGAYLNGALKGLDDTSQPKFKAGARWIVVKCNRQKGSTKCGYYVIHWMSTIILGSFRNNWETAIGSREIEGASHPVDTVLSQS

SEQ ID NO: 95452 - protein, 265 aa, Glycine max
  Coding DNA Sequence Number=SeqID_3767
  Homolog annotation: Hit_ID=Q3JV35; Match level="QueryCoverage=67%, HitCoverage=27%, E-value=1e-08, Identity=30%"; Hit description =Putative uncharacterized protein
MEAFVAAMHGVGQGLADARPEEADDAVVAVLEIARMAGRAGPLQVGGRGIDAQLQVADAPRHQGLVGQLAAAHHAVDVLADHVDDAVAHAHIELDVRVARMEGGQGGHQDHARQRTGHVDPQPAARHGRGDGEAGLGVVHVGQQAQHAFVVDRAVGGDVDLARGAVEQAHAQAGLELLHQLGDAGLAHVQGVGRLGEAAGLHHAGEGLHCVETIHRHSRDQGIVCILQTVMDRLARLSAAAPSVQCLHHQYGLQGPGQENEYGNA

SEQ ID NO: 95453 - protein, 192 aa, Glycine max
  Coding DNA Sequence Number=SeqID_3768
  Gene Ontology: Mol. function=nucleic acid binding
  Homolog annotation: Hit_ID=Q2AA09; Match level="QueryCoverage=82%, HitCoverage=50%, E-value=2e-09, Identity=30%"; Hit description =Retrotransposon gag protein
MERSMIDAASGGALGDMTPAEARNLIEKMASNSQQFSARNYAIVLRGVHEVATDSSSSAKNKKLEGKLNALVNLVTQLAMNQKSASALDARVCGLCSFADHHRDLCLSLQQSGVNEQPEACAANIYNRPPQQQNQQQQTNYDLSSNRYNPGWRNHPNLRWASPPQQQQPVPPFQNVAGPSKPYVPPSMQQQQ

SEQ ID NO: 95454 - protein, 109 aa, Glycine max
  Coding DNA Sequence Number=SeqID_3769
MKRCLCDACIYGHESPENYLFLLAYSGTQCPMCAVKKMIWTFRLPVTKDEITIQRMCDNMMQIRKTATGGYLSYADNSREVRGSPQGWSRCPPLPWPWLVVGEALDSNS

SEQ ID NO: 95455 - protein, 174 aa, Glycine max
  Coding DNA Sequence Number=SeqID_3770
DAGVDRVADEAVLIQSGQVLRGPARHLPVQGGRGESFAWLEPDHGQRRAAAVHDDLDRMPPQRGGVVGQRRRLGLHQRIADHHVPAADRQVPGEGAVQGHSGQLGVVQLGGAQVGQIEMGHGGSDCSEGPTVPDAKGRGKVVLGKCPSRARIRRCPGVTGTRLERWPSGLRHRS

SEQ ID NO: 95456 - protein, 125 aa, Glycine max
  Coding DNA Sequence Number=SeqID_3771
VTIAEGGVVDKSEAFAPTYPSFVMTTLASACQSNLGSLNNEVRITGRCFRMLPESWVLIEKGGVVDKMRGEKVASAQDFGWQSKGEDHFGSRVYGKLGFWLKACRTAGHDICQDVGLANGSGKGD

SEQ ID NO: 95457 - protein, 210 aa, Glycine max
  Coding DNA Sequence Number=SeqID_3772
MSMTSSTASSRSSKIYIQTFIEILSFYHQQWAPNYPESVQMRYNGATYQIQLQQHRGRFFLADGLTDFIADLKIYESIIINFLACDDNSIFDVHFTPPLDQQTCAKPLLHFRQHIWIEEITQCILGAPHPLEIPFHAAKHLNEYGNHMTILRKHRPPLQWKVVTLDVGIKDKSIVRPSYKFLKENDFHHGDEVSFYYRPHEKIWEIVIRK

SEQ ID NO: 95458 - protein, 106 aa, Glycine max
  Coding DNA Sequence Number=SeqID_3773
  Subcellular localization annotation: CTP_CleavageSite=61; ConfidenceScore=5.15e-01
MTLVSACYQALSLTDSKRIFIWITTWAISACPLTSRHFVSKRPFRGNTGSNKNRRKSLKVYQSHTGEDGNSHPGSRFMVSLDFGSRLVERLDMIYVRVLVWPAVPG

SEQ ID NO: 95459 - protein, 240 aa, Glycine max
  Coding DNA Sequence Number=SeqID_3774
  Subcellular localization annotation: CTP_CleavageSite=69; ConfidenceScore=5.61e-01
MVAMVSIVLGSIQTKSRRRYKGLTLVVFVSLVRPMRVGPCATFPFVTFMFNLSNFISKPQHFFHLNVPLARSRNSSMLLEGEEHMQVLLRVCGPIMTLQVEQFPTQGQVNHHDSIYERKSSSHPSFMSICMRGVVIIHGILGLTRMRFPLGALIDCMGGVFVSLKEPNMSLYWRRASLSIMVVRGGFQFSGGGYRLRPNRVLTISVGGREEGFTMAPQVDCRQNGLHNLQCHTCRYPEQR

SEQ ID NO: 95460 - protein, 81 aa, Glycine max
  Coding DNA Sequence Number=SeqID_3775
MCSPWTRESERSAPRCGANGSPLMRIPFVATCPFAGERGEAHGCAFQRRKDAWSRHQRLFVEKPNETGQNKNSKFGSYIYV

SEQ ID NO: 95461 - protein, 66 aa, Glycine max
  Coding DNA Sequence Number=SeqID_3776
MLRNFTDCALTLPFNSQHVAILHGLPNDGCQVPRSGQAKVASHQTDGLQTKLEYESCPSLLVFYWR

SEQ ID NO: 95462 - protein, 77 aa, Glycine max
  Coding DNA Sequence Number=SeqID_3777
  Gene Ontology: Mol. function=aspartic-type endopeptidase activity; Biological process=RNA-dependent DNA replication
  Homolog annotation: Hit_ID=Q2HW89; Match level="QueryCoverage=100%, HitCoverage=13%, E-value=2e-12, Identity=36%"; Hit description =Integrase, catalytic region; Ribonuclease H
MEVVILFEVEIPSLRILVESGLGEAEWAQACFDQLNPIEGPFVVKKAFLGGALLHMNMDDEELPSPMNSDIVKRYYV

SEQ ID NO: 95463 - protein, 62 aa, Glycine max
  Coding DNA Sequence Number=SeqID_3778
MVMQWLRRSFLLKMARKATAGEGSRAAPQAEIEFEEHRFQSEEHQCRFKAIKDWSFLKGGIL

SEQ ID NO: 95464 - protein, 123 aa, Glycine max
  Coding DNA Sequence Number=SeqID_3779
  Gene Ontology: Mol. function=nucleic acid binding; Cellular component= nucleus; Biological process=mRNA processing
  Homolog annotation: Hit_ID=Q9FT01; Match level="QueryCoverage=54%, HitCoverage=17%, E-value=5e-26, Identity=86%"; Hit description =Putative splicing factor
MAKEDHDASLIDDGNPKCQGHQVNKPNGINQSTALSVPMAIALSGPLLLGQPIMVKPSEAEKNLVQSNASGGAASVTGPYGAVDRKLYVGNLHFNMIESSGLVSKQCSFVASVNGKEGSCGLK

SEQ ID NO: 95465 - protein, 214 aa, Glycine max
  Coding DNA Sequence Number=SeqID_3780
MGDYLLQLWGKSHIFVLFILCLIRFLLKIDGRVPATTRALEQETKRTRKEEHGHEKFRGALWGSNSELKLRREEKNQSRAHSMVLKEELAAYSRSKRNLSQRLCETETNMLAIVSKYQEELNLATTHEHKVADEYAQVYAEKEARGRVIDSLHQEATMWMDRFALTLNGSQELPRLLAKAKAMADTYSVPEEIHGLLSYCQHMIDLMAHIIRNL

SEQ ID NO: 95466 - protein, 149 aa, Glycine max
  Coding DNA Sequence Number=SeqID_3781
SFGVPVAPTKVIRPPITRDFIEKYCTQRQAQGDAPQVADVPPPHQAGQTGSFDMEWYLRHLVRQQAANHQAHVQTHDCLYQLSLSMQSQGFASFSCPTPDQFRAEVAWPGEWPEAQAGEAPEAPDDGEEAHEDEEMADLLDFLGGSGAT

SEQ ID NO: 95467 - protein, 146 aa, Glycine max
  Coding DNA Sequence Number=SeqID_3782
  Subcellular localization annotation: CTP_CleavageSite=57; ConfidenceScore=5.34e-01
MTTLTQIWMTLLLSNIPSSDHNAGLPLRKYQLGSRPQGTQWTRRSPTGSWGFQLKLRASVSSIECLSPPARSSGPLLTELSSRSTVSPGRHRAIHHNSPGMADSGQPMHRRHLQSPSAHLQRLERCPRPVDDRRATKSKAKDKQKY

SEQ ID NO: 95468 - protein, 36 aa, Glycine max
  Coding DNA Sequence Number=SeqID_3783
MGCHTIQLLEDTPTGIPRVSSAYWRMFTSSFKDPTR

SEQ ID NO: 95469 - protein, 237 aa, Glycine max
  Coding DNA Sequence Number=SeqID_3784
  Homolog annotation: Hit_ID=Q6WAY6; Match level="QueryCoverage=80%, HitCoverage=30%, E-value=4e-23, Identity=35%"; Hit description =Putative uncharacterized protein
MGTNQNGKRFYQVKIKGLDVTSLKELGRLMGPLQRQAYCKMYGRILDLTTTERKYLEGKPRDMANQEEWVPFADIIALLIFGVVLFPNVDGLVDLAAIDAFLAYHHSKESPVVAILADLFDTFDRRCEKNSARIVCCLPALSVWLVSHLFQQDIRHPCPLQSYHSCIEKRRVDWDQYLAGIGGSTINWFPRWKEGKEGVLFSCGDYPNVPLIGMRGCINYNPALAIRQLGYPMRGAP

SEQ ID NO: 95470 - protein, 241 aa, Glycine max
  Coding DNA Sequence Number=SeqID_3785
IGGDVATHARQQLAHYRIVDAHHRAAVERQVVQEIDKRLLQVLKVALVGVHVVGFDIGDHGHHRLQMQERRIALIRFRDQITAGPQSRVGARRLHQPAVDKGRVQAGFGVNARNHRRGGGFAVRAGDSDAVAKTHQLRQHLCAADHRDARFTGGDDLRVVGGDGGRHHHHARIQHVFRTVIEVNRRPERAQLLGDRIRRQVGAADLIPFVCQHFGDTTHAGTTDADKVNVPDATHLGHDST

SEQ ID NO: 95471 - protein, 84 aa, Glycine max
  Coding DNA Sequence Number=SeqID_3786
MMTFKNEFKIESRTLQGSRANLISRIKNQDSRFKDSRIIKIKIQDSEIQESREDLIKISIKKFFKTLSSTRKIQNEESHLLMCN

SEQ ID NO: 95472 - protein, 169 aa, Glycine max
  Coding DNA Sequence Number=SeqID_3787
STLEDPHRDVAADGNVRESGDVGGGPGKSYLFCLTACPPWKRLSRRTECLPRPVVLITASGLQGEQPLVDGTIPEPVGCRWTARAASAARAGRRVPVGGRIGNGPFGASSPGVEQSTQNCETTAKGTGLAESAGKEDPVELDSSRLRPVDPGGRLVRWGVGGRPSVKNA

SEQ ID NO: 95473 - protein, 193 aa, Glycine max
  Coding DNA Sequence Number=SeqID_3788
  Pfam annotation: Domain name=G-patch; Domain location=59-103; Score =35.7; E_value=1.6e-07; Accession=PF01585.14; Description=G-patch domain
MDPLSGSRFLYTPSEIEVPSGRAFGHRIGRGRHLGELPILYAICGGWRGVIRNRFLVFQGVIVARVMLGNGYEPGMGLGKDNGGITSLISAKGNRVKFGLGYKPTQADIRKSIAGRKSGGQGSRLRQEDEGSPPCHISRSFISTGLRDEGQVVAICKDDPPSGSDLVRPCPPDFQLGNWRVEERPGIYTISIM

SEQ ID NO: 95474 - protein, 312 aa, Glycine max
  Coding DNA Sequence Number=SeqID_3789
  Homolog annotation: Hit_ID=Q2HW90; Match level="QueryCoverage=50%, HitCoverage=31%, E-value=3e-10, Identity=26%"; Hit description =Putative uncharacterized protein
VTSLREVGTINGVNFNGKPSAKPMDFQLVPTVKEFEEILGCPLGGRKPYLFSGFYPSTTRVAKVVKTSAQELDRVKQNRNGVVGVPRKCLEEKGKGLGKIKANGLILLTSWRFLIFGVVLFPNMEGLVDLAVIDAFLAYHNHKESPVVAILAMYDTFNRGCKKSNARIVCCALALYVWLVSHLFLQEGRPVYPLQGHRSCVEKGKANWDQLLASMEGRLLIGSLARRKEESGLYLHAKDDKELRGSSNGIIGGYHKWLRARTQGFDWLPNLKTVRDDEVKASEESDEVQALKAELERARVVEEEFKSIAIKV

SEQ ID NO: 95475 - protein, 119 aa, Glycine max
  Coding DNA Sequence Number=SeqID_3790
MNCGYAAGEHGARPSVVRMGMASSVLPLQGHLRPAAHHVKKGWRRLKGAKQAQAIGRAFSIPAPHDLRWQQQRFEAVVGVLVAVFDSGSRPDAAAEVDAPSTRWQRWLTRSAMRSRAML

SEQ ID NO: 95476 - protein, 196 aa, Glycine max
  Coding DNA Sequence Number=SeqID_3791
MTSRDQVWSFCTQDTRRYLTVIRTLLSSRGGGPDDKQRPSLVILHPRYAEIPYDTRRYLTVIRTLLSSRGGGPDDKQRPSLVILHPRYAEIPYGYSHPFFCYLLTQSSAPFVPPGTTKSFTCGNFMVTRDSRQPRGAKLVSYADFRGPLFDDMRPFFGPCEVLGIHHQAVCEILGTTSHSHPRLSSTERSEISVIH

SEQ ID NO: 95477 - protein, 174 aa, Glycine max
  Coding DNA Sequence Number=SeqID_3792
MERSMIYASSGGALGDMTPVEARNLIEKMASNSQQFSSRSDAIVIRGVHEVATNSSSSSENKKLEGKLDALVNLVTQLAMNKKSAPVARLCGLCSSTDHHTDLCPSVQQSEAIEQLEAYAANIYNRTIMTSLATGTIPGGGIIPTLDGRILHNNSNNNLIFKMLLAQADHAFLH

SEQ ID NO: 95478 - protein, 93 aa, Glycine max
  Coding DNA Sequence Number=SeqID_3793
MFLVFNSALKGHDDTPQPKSKAGARWIFVQCNRQKGSTECSYYVKHWMPTIILGTFRNNWETYFNDVRPLEAKRLKALRIQWAQFSLKVTNQS

SEQ ID NO: 95479 - protein, 85 aa, Glycine max
  Coding DNA Sequence Number=SeqID_3794
AANHRGQVQIHECLYQLSLSQQGQGFIPFACPTPDQFRAEVAWPEDWPEAQAGEAPAEAPSDVEEACMDEEMTDLLGFLGGSRAT

SEQ ID NO: 95480 - protein, 96 aa, Glycine max
  Coding DNA Sequence Number=SeqID_3795
MYAYVLETSSKILESIQRLTNWIEGIVTGVFKVFCLCPVFLVVLGRIDGDPVLRETRIWATWEYVSSDGGGQQGMVGLCALCGCGKLVVHHRPTAT

SEQ ID NO: 95481 - protein, 66 aa, Glycine max
  Coding DNA Sequence Number=SeqID_3796
MGIAPTRHPVDPEKSNRALGFPALFYRVPVTSSKGIRPPTDQAFIKKYCVPRQAQGETPQQHWDGR

SEQ ID NO: 95482 - protein, 138 aa, Glycine max
  Coding DNA Sequence Number=SeqID_3797
MFGEGTDWENNKKPYFPLTGGFVLDNGGRMNSARQSIHGAPNKMVEDARTALGNQFRQAINSWDSGLDGGGCMNGNQFMGLRTRFDGGGYTNSARQSIRGAPDSMVEDARMAINSWGSEQDLMVEDARTALGNQFVGL

SEQ ID NO: 95483 - protein, 49 aa, Glycine max
  Coding DNA Sequence Number=SeqID_3798
MVELREGKSRRRIKGKKRENEEEESQDKSVLDVEWKRKGSEGTLSELIY

SEQ ID NO: 95484 - protein, 401 aa, Glycine max
  Coding DNA Sequence Number=SeqID_3799
  Gene Ontology: Mol. function=hydrolase activity, acting on acid anhydrides, catalyzing transmembrane movement of substances; Cellular component=integral to membrane; Biological process=metal ion transport
  Homolog annotation: Hit_ID=Q9SZW4; Match level="QueryCoverage=99%, HitCoverage=44%, E-value=1e-161, Identity=68%"; Hit description =Putative cadmium/zinc-transporting ATPase 3
  Pfam annotation: Domain name=E1-E2_ATPase; Domain location=143-362; Score=282.6; E_value=8.1e-82; Accession=PF00122.11; Description=E1 -E2 ATPase
MDKAEKAVQKSYFDVLGLCCSSEVPLIENILKPLEGIKEVSVIVPSRTVIVVHDTLVISQLQIVKALNQARLEANIRVYGDEKHQKRWPSPYSIASGAVAVGAYPIILKAIVSIRNLRLDINILMLIAVIGTIVMNDYLEAGTIVFLFSIAEWLESRASHKANAVMSSLMNITPQKAVIAETGEVVDADEVKIDTVLAVKAGEVIPIDGVVLDGTCEVDEKTLTGESFPVAKQKDSTVWAGTINLNGYISVKTTALAEDCVVAKMAKLVEEAQNSKTSIQRLIDKFAKFYTPGVVIISALVAVIPLALKQHNEKHWLHFALVVLVSACPCALILSTPVATFCAYSKAATSGLLIKGGDHLETLAKIKVMAFDKTGTITKGEFVVTHFQSLSDDIDLNTLAY

SEQ ID NO: 95485 - protein, 307 aa, Glycine max
  Coding DNA Sequence Number=SeqID_3800
  Homolog annotation: Hit_ID=A7QLC4; Match level="QueryCoverage=85%, HitCoverage=73%, E-value=8e-71, Identity=52%"; Hit description =Chromosome chr11 scaffold_118, whole genome shotgun sequence
MAEVNTLVVRKPCFGLPTGCPQCLSAYIYLKFAQFPFQLDFHLNNPHSDQIPYFEVGDYVAYNNEKEGIIECLKKDVGVVDLDSGVSSLPEWISTKAILTTWLADALTYELWLGCEGSSAYSIYYPDLPWPLGKILSWKKAHWVKLKHGITNDNAEVKKEEIYERAKSAYDALSSCLGEQNYLFENRAIIDFNLLVMYSYALFGLCRPSSLDAIFLAHGLVVLHALPESSMLRIKFSEHAHLVRYVQQCKTEFIEAAPSPSSAPRFHTGASSSASKSHSIVVFLTLMTSFDDAEVELDDDGGYDFDE

SEQ ID NO: 95486 - protein, 107 aa, Glycine max
  Coding DNA Sequence Number=SeqID_3801
MPGSNKFLAPLPGNFFLFGKSPTGNLVHLDLEIEATLRRNRAKRRRKLLQDRTVASILEEEAHFFYSTSSDSPSSRESVTYLPEAVIMADKHQQRVTLEDYSSSSIP

SEQ ID NO: 95487 - protein, 47 aa, Glycine max
  Coding DNA Sequence Number=SeqID_3802
MVGVPNVHGGALGDVATLQTQERLGLRIVKNHEIHVLRPIVRPVSRF

SEQ ID NO: 95488 - protein, 64 aa, Glycine max
  Coding DNA Sequence Number=SeqID_3803
MEKGEEVAAQLAQASWVASFRSNPASKNTLGYGNFTKALRVSRKPIFQQHRGGGCHLARPGELS

SEQ ID NO: 95489 - protein, 114 aa, Glycine max
  Coding DNA Sequence Number=SeqID_3804
LHTLHTRTSSSLHFSNSEHAIGIGLIAFSVEMMNKAKGKGKEAAEKGFSGKRKGAFDDDKTGGGRKRNKQGVLHFFSDDELNAAPRRMDMPDKGQSNSPRVVPKEEMLAQNQLF

SEQ ID NO: 95490 - protein, 142 aa, Glycine max
  Coding DNA Sequence Number=SeqID_3805
GPAAGRAPHVAWCPVRPRRPLKIRRTECLPRPVVLITASGLQGEQPLVDGTIPEPVGCRWTARAASAARAGRRVPVGGRIGNGPFGASSPGVEQSTQNCALNVKVKKFNQARVNGGSNYDSLKRNHSQGNGLGGISGERRPC

SEQ ID NO: 95491 - protein, 113 aa, Glycine max
  Coding DNA Sequence Number=SeqID_3806
MVAITLAKVHQPPFLREYDSNAMCACHGEAPGRSIEHCRALKRKVQVTMLNEMDKVDIFVPHPLTNASLLIQLSLEYGWKPLVRLLKRPALLSVDFQDRSIRDYSSCTLVGVP

SEQ ID NO: 95492 - protein, 112 aa, Glycine max
  Coding DNA Sequence Number=SeqID_3807
MALRFPTLFTSLCQSYRMPVPQARSCHRDIECPSPPAKSLGPLLTELLSRSTAPPGRRRARHHNSLGMAGSKQRTHHRHLQSPLAHLQRLERCLRPMADQQATKSKAKVLGP

SEQ ID NO: 95493 - protein, 299 aa, Glycine max
  Coding DNA Sequence Number=SeqID_3808
  Gene Ontology: Mol. function=aspartic-type endopeptidase activity; Biological process=proteolysis
  Homolog annotation: Hit_ID=A5BDA4; Match level="QueryCoverage=77%, HitCoverage=36%, E-value=2e-28, Identity=32%"; Hit description =Putative uncharacterized protein
MAIPFKTKDVNEEVTSKDIKSLMEQANYTNKYLQALGETIKTKVVPKQKSIEGASPSVPIEIEKPLFKPFKVSEKAKRKIRELRKTKSLTEGVGDNHSELLNKIGSLLKVISDTPQASENTSKMVTRSTSKLINVINEDSDQNSDNTTEIGSVSEKNINPINSKHWKTPSKLYYRRPTAPDLLLEERGENNFKSFSANNIYEWNIDAQTEYNIMNTLQHMTMVATAYQTSHECLEETFIDILVAGFSGQLKGCAVKTDLNGKVITNYDDKEIPDAVNTLIFTIAQHFIGDPSLWKDRSA

SEQ ID NO: 95494 - protein, 447 aa, Glycine max
  Coding DNA Sequence Number=SeqID_3809
MTKKSTETSRADVRPKKPTGVKIQEGKQEEKEEEERPLIRKRKLPSTSTKSAEQTETGNSQAQMPKKKKKGGEPSKKKKKKTKSSKEQGDNQPVDVQPPSTDIDGTEVEAAPSIAEMGNPVEQPNLSQEQPAVEVQQNVSAEEIPSCARTSPAPEADAVNVEEWGEGQGIGSSRPHGWAEVDDPHEPNQSDNTTPHESSQKSSSEENFFDEDAIKEAEAGGSDIYPVSSTSKLSASIGIAEDTFIQMQNEDPAAALRLLLNTSQANTSSEKIPGASTPSDAEINSSVRQDSLLLKLSTEYALKDVLKSIEENPSAAFGHLNFLKKLHNPLTSDETLGKVIQIEAIIDQFASAVQKKRENGTRLDAQKQAHTLLLEKARAAQHEVERLTKEAKEGSSEIKDCDDNISSWEATIMDLLFHVDDLRQKIVTEQAKRKELQEKAANSIQKL

SEQ ID NO: 95495 - protein, 108 aa, Glycine max
  Coding DNA Sequence Number=SeqID_3810
MLPFDFRCVTETYGLCINIFWFSGMSWNFTNCLMMDAKHLTRTKERSHVIKQRSPDEIRFRAKVAWPGDWPEAQAGEAPAEAPGDVEEARMDEEMTYLLGFLGGSGAT

SEQ ID NO: 95496 - protein, 118 aa, Glycine max
  Coding DNA Sequence Number=SeqID_3811
  Pfam annotation: Domain name=Transposase_23; Domain location=45-115; Score=-16.8; E_value=0.082; Accession=PF03017.5; Description =TNP1ENSPM transposase
MQSQLQSQIQSQGLALTSEPEVGPSAARVSTKGSCVDPSATNPNTGDSDKCGLYIEENPSHLVALGRVYEGSIAVHNIPLLHGQMKVGVEEVKDAKAPVPIPTDEAILVGQTLNIFLA

SEQ ID NO: 95497 - protein, 136 aa, Glycine max
  Coding DNA Sequence Number=SeqID_3812
MKDKRDEEEKLEKQKKNKDSKVLSSKAKGKEKEGNDSSKKIVKKENHFFNKRETYLSTTIPLELEVIPQVKELLDKGLVHKSLTPCALLVPKIGIMRHQIPMIGGMMNVLSGATLFCKITHASNIFMIHIHRDSLG

SEQ ID NO: 95498 - protein, 131 aa, Glycine max
  Coding DNA Sequence Number=SeqID_3813
MDSGRFQISIPGDGYPSKTFLEEMRQQFFIFRVSSHLPTVHLQMALGTNSHLVLVKVRHLKLGRCHTLISSRDHLFVGMRPSFDHFEGSANSNQAHLGLPGSSPEGGAFWRKQPSSLGRARWQAPPSFSYK

SEQ ID NO: 95499 - protein, 290 aa, Glycine max
  Coding DNA Sequence Number=SeqID_3814
  Gene Ontology: Mol. function=oxidoreductase activity, acting on the CH-OH group of donors, NAD or NADP as acceptor; Cellular component =cytoplasm; Biological process=electron transport
  Homolog annotation: Hit_ID=A6TGH5; Match level="QueryCoverage=100%, HitCoverage=69%, E-value=1e-157, Identity=96%"; Hit description=UDP -N-acetyl-D-mannosaminuronate dehydrogenase
  Pfam annotation: Domain name=NAD_binding_2; Domain location=3-158; Score=-70.0; E_value=0.0027; Accession=PF03446.6; Description=NAD binding domain of 6-phosphogluconate dehydrogenase
  Pfam annotation: Domain name=UDPG_MGDP_dh; Domain location=205-290; Score=139.8; E_value=7.6e-39; Accession=PF00984.10; Description=UDP -glucoseGDP-mannose dehydrogenase family, central domain
  Pfam annotation: Domain name=UDPG_MGDP_dh_N; Domain location=4-197; Score=311.0; E_value=2.3e-90; Accession=PF03721.5; Description=UDP -glucoseGDP-mannose dehydrogenase family, NAD binding domain
  Pfam module annotation: Pfam domain module=NAD_binding_2::UDPG_MGDP _dh::UDPG_MGDP_dh_N; Domain location=3-158::205-290::4-197
MSFSTISVIGLGYIGLPTAAAFASRQRRVVGVDINQHAVETINRGEIHIVEPDLASVVKTAVEQGYLSATTVPVESDAYLIAVPTPFKGGHEPDMAFVESAAKSIAPTLKKGALVILESTSPVGSTEQMAEWLAAMRPDLSFPQQVGEAADVNVAYCPERVLPGQVMVELIKNDRVIGGMSPVCSARASELYKIFLEGECVVTNSRTAEMCKLTENSFRDVNIAFANELSLICADQGINVWELIRLANRHPRVNILQPGPGVGGHCIAVDPWFIVAQNPQQARLIRTARE

SEQ ID NO: 95500 - protein, 147 aa, Glycine max
  Coding DNA Sequence Number=SeqID_3815
MALEDLEQLMQKIRGQLEESITEKGLALPPEPEVGPSVACVSTKESCVDLSGNDPDTSDSEIYGLYVEENSPRLVVIRKLYEGPTTVYNIPLHHDQVKVGVEEVRDADAPIPVPTEEVQLEGQTLNTFVACPTHLVKHLSEHVFHCH

SEQ ID NO: 95501 - protein, 56 aa, Glycine max
  Coding DNA Sequence Number=SeqID_3816
MSVEIKSESTDKSFKVNGHRLKPFLTNPSLVDLTNPSLVDVVVDETSLLHPTSLPP

SEQ ID NO: 95502 - protein, 110 aa, Glycine max
  Coding DNA Sequence Number=SeqID_3817
MTGHDWPRILFPTCRYIGTDASGDRVTTDRSLPLPGAKQAENIAARLARLGEQPLHPNYKNEGGECFGIQKLPPPPPSFKRKNTKACGSSSSHFRLPFAFIFGVIIHSNK

SEQ ID NO: 95503 - protein, 122 aa, Glycine max
  Coding DNA Sequence Number=SeqID_3818
MTFLGETSSQTIVNSRLAFIYPNGSIIHNDTGVYFQTSTPVPIRVPNWCDFASLKTRIHNTLQLSDKQFLNEIHYRKPFTDTGKNPKKFQIPSTCTIDELKNLIKKVAPKGIPPLGIHKSQT

SEQ ID NO: 95504 - protein, 365 aa, Glycine max
  Coding DNA Sequence Number=SeqID_3819
  Gene Ontology: Mol. function=nucleotide binding; Cellular component =mitochondrion; Biological process=response to cold
  Homolog annotation: Hit_ID=A7PTX4; Match level="QueryCoverage=83%, HitCoverage=83%, E-value=4e-60, Identity=37%"; Hit description =Chromosome chr7 scaffold_31, whole genome shotgun sequence
  Pfam annotation: Domain name=mTERF; Domain location=91-363; Score =37.3; E_value=1.6e-10; Accession=PF02536.5; Description=mTERF
RPTVLAYAFTLACIALPLHHIIDNVHSNLRGNKCSFTSGTSSDSELDGNQHKGDNFTVPYLINSCGVSPKLARKLSKKVNLKTPNGPNSVLDLLNNYGFDKTHLAKLVEKHPMVLVANAENTLLPKLKFFRSIGVSNTDMPKILLCNHVLLVSSLENYLIPRYEILRSVLRDDQEVVRALKNAPFGFTYGSFINSLVPNIKVLRQSGVPQASVSYLMIHSGAVVYSKHSRFVEAVNTAKEIGFNPLRISFINAIEMHLSRSKAVRESRFEVYEKWGWNGEMALQVFRKFPYVMKLPEETFTKKMSFLVKDMGWLSEDIAEYPQVLAYNLEKRIIPRFSKFVINYQKDLPFLPDFYNSLTNQQNVV

SEQ ID NO: 95505 - protein, 108 aa, Glycine max
  Coding DNA Sequence Number=SeqID_3820
  Homolog annotation: Hit_ID=Q2HTK5; Match level="QueryCoverage=87%, HitCoverage=38%, E-value=5e-07, Identity=31%"; Hit description=H+ -transporting two-sector ATPase, alpha/beta subunit, central region
MTKGLWWESMRWIRGIGALPTDPASHFIQFCDGFAASSNHSRRGMWWIALSITIWQHRNSLLFQGTLFEPQKVLEEALFLVWSWLKVGDKGFNTSYNHWSTNLVEAFG

SEQ ID NO: 95506 - protein, 180 aa, Glycine max
  Coding DNA Sequence Number=SeqID_3821
  Pfam annotation: Domain name=zf-C2HC_plant; Domain location=114-159; Score=24.0; E_value=6e-05; Accession=PF07567.3; Description=Protein of unknown function, DUF1544
MAVFRGGISKKRHRIAVALRVWDGGAMAAAIAMAVVVGWRKWRKWRISWPTHERTARDFYSLPSRTHENRRDEPTCSRDDTTQQPTCSRDTTQPPPRHHPLQHARTAATSEEEDPGNAVNARRRRRQEEDAGGITRAKQHLIGKSGNVAACKKTPPNVIEELKEYMATKKSGTTYSTSGS

SEQ ID NO: 95507 - protein, 100 aa, Glycine max
  Coding DNA Sequence Number=SeqID_3822
MAISFLQSTVVISVGEPDTPNKIVKQPDALKKPYTHNQYQSSYSLLTPSKFNKNHSSFADTNHSRGQSLDLGRENTASRSARNSDIDHALSQVSSCKSFI

SEQ ID NO: 95508 - protein, 130 aa, Glycine max
  Coding DNA Sequence Number=SeqID_3823
MVSREPLLSQPVIQDIFVDEDRGIETLNEDPMHIMINDAFGLSRLCANEESFPSSPEHSGGVKEGEDVDKEEHKTCHTSRWKQKKQNGRENEVDAGVKLIGTTSHFVIEGLVAVPIIEQMVNKVECSPSV

SEQ ID NO: 95509 - protein, 292 aa, Glycine max
  Coding DNA Sequence Number=SeqID_3824
LGRIDGDPVLRETRIWATWEYVSSVGGGQQGMVGLYVICGCGKLVLHHRPTATYGTWRYVAGVRRPWGRQVGRAPGSQQIKGTKTTKLKNEDRRLRWSLVIDYQGASGNRLPVCVIDYTEEWVTGIRLPSMCNRLHSAFFRFSCPEAIVMAAQLIHDRVEMECLEGAWETLEGNTRCRFRATIRFTATSLVHPDEPTRTLQRTEEWILPTPTPYRLVDPVQVIEVTSSEEDPEEDPEELPPEPAVDALDFLEGDEDPLPKVDSPEDVMSASEADSTEDSGPGEMAISGGSSS

SEQ ID NO: 95510 - protein, 315 aa, Glycine max
  Coding DNA Sequence Number=SeqID_3825
  Subcellular localization annotation: CTP_CleavageSite=31; ConfidenceScore=5.16e-01
MAEPSKKRKGSSSRSQRHSKAQETQIPSSISSSSLFSTEEQRIRYTNLFSSHSIIDPKFIDMDFFSNESFECIQAFENSNLIPFMSLKLSVYTELVKAFYSNLEIQEGTLISEVYGIKMVIDQSLFYDLTQLSSEGVPFEGTLNDDWKFDFSLHDVCRLVCTNQADMTGRLLAGSLAFESRILHYLIVRILLPRSSNLAQVSEEDLIVMPDNYLKGIINSALNGLDDTPQPKSKASARWIVVKESFYLYIFYCNRQKGSTECGYYVMHWMSTIILGSLRNNWETYFKDVRLLEAERLKAFRIQWTKHYLKVRNQT

SEQ ID NO: 95511 - protein, 146 aa, Glycine max
  Coding DNA Sequence Number=SeqID_3826
  Gene Ontology: Mol. function=ATP binding; Biological process=apoptosis
  Homolog annotation: Hit_ID=A7Q672; Match level="QueryCoverage=69%, HitCoverage=16%, E-value=1e-29, Identity=64%"; Hit description =Chromosome undetermined scaffold_55, whole genome shotgun sequence
MKHLEVLQLGRWLQDSQKHHIEVEIEEFLKELRGQKNLRHLSLRGISRVFEQPPFICQLENLQILVLKACHNLETLPSDILSLRNLIQLDLSECYLLDRMPKGIEPESASAQRMIHQEDSRFKNNQDQDSRLKDSRIKRRLNQDKY

SEQ ID NO: 95512 - protein, 90 aa, Glycine max
  Coding DNA Sequence Number=SeqID_3827
MISDSFTVGSSLNLSTRPPNKSHKNDNLEPVHRWIVVKFEYHVRNTIPSILTVGNFDIREKKESYEDSTSGGFNLFSVSLTFGNSIGAVG

SEQ ID NO: 95513 - protein, 247 aa, Glycine max
  Coding DNA Sequence Number=SeqID_3828
MAKFDPDIVLEFYVNAWPTKEGVRDMRSWVSQFLGDLLVLEEGQECEFSQRGNKVDGFDEEAIAQLLCTLGQDFARTAAGRRVQIMRTNMTTLTQMWMTLLLSNVLPSDYNSDLPLPKCQLVYVILTRMSVHVAQLIVYAIYLFEGMPPTRHPLDLDKSNRALGFPTLITDLCQSFGVSVTPSKVIRPPITWAFIEKYCTPRQAQGDALQAADAPPPPHQADPVGSLGMERYLQHLVRQQAANHRGQ

SEQ ID NO: 95514 - protein, 98 aa, Glycine max
  Coding DNA Sequence Number=SeqID_3829
MNDEGDENPFLLLLGKLEFQPPLPLAARLNPPYPLAAKVERGECRQYQWRYKPRRRERGECRQCKWRHTSYVGLAHSDGEIEPRGTRPQCWRDGPGFT

SEQ ID NO: 95515 - protein, 201 aa, Glycine max
  Coding DNA Sequence Number=SeqID_3830
  Homolog annotation: Hit_ID=A5AKU4; Match level="QueryCoverage=18%, HitCoverage=7%, E-value=2e-09, Identity=78%"; Hit description =Putative uncharacterized protein
  Subcellular localization annotation: CTP_CleavageSite=55; ConfidenceScore=5.09e-01
MAGGAISWRSVKQTSTTTSTMKAEFVPYFEATSHGAWKNQNKVALSWQWLEFATSQVKKFSLTSSNISCRDTSCGRLVMVAMTILAAIIEVALVTVMMMVTVIEVVLVGMVAMSMVLMVSVTMVVAGRWCDNGGGGGCIDDGGGGSNVSGDGNVGGDDEDNDNDGGGTKWWWLHRCCCSYVGGNGDANDDGDGGSGARSCW

SEQ ID NO: 95516 - protein, 78 aa, Glycine max
  Coding DNA Sequence Number=SeqID_3831
  Gene Ontology: Mol. function=DNA binding; Cellular component=nucleus; Biological process=regulation of transcription, DNA-dependent
  Homolog annotation: Hit_ID=A7PJT0; Match level="QueryCoverage=82%, HitCoverage=22%, E-value=6e-23, Identity=78%"; Hit description =Chromosome chr12 scaffold_18, whole genome shotgun sequence
  Pfam annotation: Domain name=NAM; Domain location=18-78; Score=3.1; E_ value=9e-08; Accession=PF02365.6; Description=No apical meristem (NAM) protein
MNVKVHSSDDTKKDEEVVLPGFRFHPTDEELVGFYLQRKVDKKPLKIELIKQVDIYKYDPWDLPNKLILLNETMRYGA

SEQ ID NO: 95517 - protein, 331 aa, Glycine max
  Coding DNA Sequence Number=SeqID_3832
ATVPYTSVNHGLHGPIGEASSFQLSVGEMIITLDDLSCLLHLPMTRRPLDHMPSFFVREAVKTLLMTHLGIPTETEAFMVANASAMVRLLGYNDLSHALDQQYDICHKFSTCIHVAYCQYLNNLDACHKYHGKVGGLCDEGCDNHQIETNERYQACPSSQDISSKGVGGILAMSRGFHASHLPVLPIIFVIEHGQSDNNISFLLGMLWHLRVLGLAPMTIYLDFTRFPIPMSFHRRMDNHHVVLYVYRQPRQPLIDYVPGGDYSCLGRRSNNNWNTTNASSDDGVNEGSNENFDGIGGGNWRGGYQGKVAPTKVTLEVDIFGVEENTMALV

SEQ ID NO: 95518 - protein, 112 aa, Glycine max
  Coding DNA Sequence Number=SeqID_3833
MDHEDEEEDDDNHNNNDDDDNDGYGSDDIHQQQQQTVTRDHPRTRRGRGRRIREQQSLTNQVGSIGPPRSSIPAQGEIGKLECVDGLDWVGFILTQLIWVKYEFNNLKCDSC

SEQ ID NO: 95519 - protein, 93 aa, Glycine max
  Coding DNA Sequence Number=SeqID_3834
MPCQNDFVDYSFTRKNLKKFDIPSGCSMDELKDLIKQVAPHGIPPYGYLGIKLIRNLAADQVDPQATRESSMSPTDQIFLLRINQNQCADQPQ

SEQ ID NO: 95520 - protein, 111 aa, Glycine max
  Coding DNA Sequence Number=SeqID_3835
  Homolog annotation: Hit_ID=A7NWL7; Match level="QueryCoverage=49%, HitCoverage=7%, E-value=1e-18, Identity=80%"; Hit description =Chromosome chr5 scaffold_2, whole genome shotgun sequence
MKVHGEVLPLYLNRNSDTQLVASKNLIAISYHDPKGMSGLSSEAQEMDEAALHEIVVVRHDSEVLNDFKRFEEMALVGLWCVHPNPALRPSMKHVMQMLDGTVEVGIPHLV

SEQ ID NO: 95521 - protein, 95 aa, Glycine max
  Coding DNA Sequence Number=SeqID_3836
  Homolog annotation: Hit_ID=A7NWL7; Match level="QueryCoverage=50%, HitCoverage=6%, E-value=5e-14, Identity=75%"; Hit description =Chromosome chr5 scaffold_2, whole genome shotgun sequence
LRRDIQIPNGENAPKWVLNMLFKFHDNPTVNKSEIIIFLRQVVMRHDSEELNDFRRFGEMALIGLWCVHPNLALRPSMKHVMQMLDGTVEVGILL

SEQ ID NO: 95522 - protein, 297 aa, Glycine max
  Coding DNA Sequence Number=SeqID_3837
  Gene Ontology: Mol. function=histone-lysine N-methyltransferase activity; Cellular component=nucleus; Biological process =multicellular organismal development
  Homolog annotation: Hit_ID=A7NWL7; Match level="QueryCoverage=61%, HitCoverage=26%, E-value=9e-42, Identity=45%"; Hit description =Chromosome chr5 scaffold_2, whole genome shotgun sequence
  Pfam annotation: Domain name=DUF260; Domain location=16-112; Score =204.9; E_value=2e-58; Accession=PF03195.5; Description=Protein of unknown function DUF260
MASASGNGVSNGSGSPCGACKFLRRRCAADCIFAPYFCSEQGPARFAAIHKVFGASNISKLLLHIPTHDCCEAVVTITYEAQARIRDPVYGCVSHIFALQQQSPPVELNSQVQFTYAKNLVVAYPIGTIAQTTYSGSGATSDHMQDDENFVMNDSNLESELQFKLLSLGNFMLQMQDDGNLVLKACQWSDPAYWYTSTTTRNVNLEFNATSALLHLVSGSKNSYPLTKNTSTPMEDYYHRATIYGKGNFHQYAYHRKNGTGWRRVWKAVEDPCRLNLVCGVYGLCTCKICENEPTFY

SEQ ID NO: 95523 - protein, 63 aa, Glycine max
  Coding DNA Sequence Number=SeqID_3838
  Homolog annotation: Hit_ID=A5APR4; Match level="QueryCoverage=65%, HitCoverage=11%, E-value=3e-08, Identity=65%"; Hit description =Putative uncharacterized protein
MSYSQDNRLTMNMGVKKLQEKDNHVETNGAFQGKAKLLFAHAGDKWDVEFYAKVNDDVYVNIG

SEQ ID NO: 95524 - protein, 233 aa, Glycine max
  Coding DNA Sequence Number=SeqID_3839
MARKDKLWSSAPFSKTQCLLTETVKSPLLSRDNQVRWHVETNMVICPLVEDSMSFDRDYCISLCHLETIEPNGMQRPSWPFAFICFQDYCSLPLSSRDTSPMACEDHYGYQSPLSRLQCLPYFARLQGNVQNTQKRGKMVTLGENVVDEATNSPGRARLLLEEASSSLGRAVMQPPPLIFLPWIFFIDGVFCFLRFDYNRMEKEKDDWRCHFNPVNPRSISRFSLSVLRCPEA

SEQ ID NO: 95525 - protein, 422 aa, Glycine max
  Coding DNA Sequence Number=SeqID_3840
MAMVTLGRMYQSPFPWWYNPNATNAYHGGVEAMSSKVILIMPKNQESSKFQRFKIQELGFKNQDSRFKNQGTSTWVVVTENKRGYISYGSVQVEGTSTWLFKENKGGYIPCGSLLVKAFTRLKRNLKDRRSLGDWIGYIYLGIVILRTREGTSLVDQFKWRVHPLGFFKENKGGYIPCGSLVCKGFYKVERNLKNHRLLGDWMPPDPTGGTPGHSIEQRVALKHKVQINAIEEYGLQRPKQIKDVVTSRRFIFEALQEAGMISFDGHKGDSCLMHPGASHDMETCSTTEELLQGMMDQARFEIGDASKGEQHVCMQLADKSPSKPKPLMIHFTRDAASQKPRGSQPIPGKKFVPFPCRSNKAVPWRYAPQKPNEKKDKAVGDDLSFAKVTYISGMSGVTRSGRVFAAPDPLVWSKDAKGKAK

SEQ ID NO: 95526 - protein, 620 aa, Glycine max
  Coding DNA Sequence Number=SeqID_3841
MTTVPYMQLGHDATNTKPMAAATLSPQQEHNEHDNDGWFKDSKHAGKERTMDVAKVGSKISHVKLRIVFVKRTRGETCKTKDFEAQGREFLEPPSMDKYCLMLRVVNMLLALRAGSDMSGNCIIVRKIRAPFQLLPVTEELCIHIKWNERMGSSDSGGSDAILSRKGPVTRVMSKRLQEDWARATKEGPRVLMNLRDLIEAQRSSLHRSSTSKLPSGSIQQPLVDPKVISIDTSCLCGRANPSVASLVGKPISATMILTPSISKGARKSGCGDVSVQGLESGSFLDLFPSDPARFKSFDEDLLTLVQGTILLRPWMVKCLTLFSFMSEVRPAGGTMPPSAAIPHAEEGGKTVVEVGLTIEVVEVSPSVPSFVLVKRKQDGNPRVSGRKKSRAPLSLCTLMQAASAPTVVFIYAPPPPPATPVHAIVAHLPTVDAPLLSVGVATMSAPEMLPPPSSASPVPPSIVLASTSPSTSSHHCVSLDHIYTSNDVDSLWCIGYKPEKKTLFGTPRKKNGQRHQEALSKVASLEAEVVSVTSVFAEALKSNQQLSSKDGSVLAREKNELADRVENTVAKKDEPSKVVANLEARLKESESRLEEFELRASKEMEARKELEEELLIYKK

SEQ ID NO: 95527 - protein, 91 aa, Glycine max
  Coding DNA Sequence Number=SeqID_3842
MPPSEKGNHHSYKPECLQESLRLANFTWCYKATTLSIKVSRLEKQRKGSPSHKGKKCLHQHGARPSTSMRKRTHYNKSHNKSPLRKNYRWR

SEQ ID NO: 95528 - protein, 195 aa, Glycine max
  Coding DNA Sequence Number=SeqID_3843
MQGLSLVSLTGLLNPRSALSESCFSKGLSKQRSILGESHKLIKPKAHQIQGLSLVSLIGLSNSRSTPDESYLSKGLSNPRSLLGESCFSKGLSNPRFILVESHRLVKPTVRPCLIGSSNPRSTLGGFQFSKGLSNPRSVLGESHFSKGSSNLRSILGESRFFKGLSNLRSALGRQVCKNNRNPRSSLGSEIQGSS

SEQ ID NO: 95529 - protein, 154 aa, Glycine max
  Coding DNA Sequence Number=SeqID_3844
MGREVLDSKGICKGGLFCYGCRQKQWRDHDAAITTGEKGGDVECAASTTGEKGGDVAVRWVCLQHHRREAFHVGSMQKPPTAMARHVPTWNVSHHCILRDLLPCNAAIASCETLASRPDLFVSHLHAGLVAAVQGSHGYSVPVQGSHGYSVPMQ

SEQ ID NO: 95530 - protein, 113 aa, Glycine max
  Coding DNA Sequence Number=SeqID_3845
MVRTRGLGRALGAGRGRGISEDVHQADVPRRRRPTASAQRPEDVPQLHEDVPHVSDATPKMTDAAYAVQTEGVATDGSLGSPAADEGFPGGPRDPSILTGFAEHVAHSIWSGQ

SEQ ID NO: 95531 - protein, 36 aa, Glycine max
  Coding DNA Sequence Number=SeqID_3846
MALLMGEGDKDEKVDGKREGSSFNATSNILEMEDDD

SEQ ID NO: 95532 - protein, 77 aa, Glycine max
  Coding DNA Sequence Number=SeqID_3847
MKTEVVFPQHHRTIAGLQKYQCDDPEKDTNTSVSDTQQMFVACNTFHGHAPAFFGNILPLQQSPFVCLCPEFQHLTE

SEQ ID NO: 95533 - protein, 461 aa, Glycine max
  Coding DNA Sequence Number=SeqID_3848
  Gene Ontology: Mol. function=aspartic-type endopeptidase activity; Cellular component=extracellular region; Biological process =proteolysis
  Homolog annotation: Hit_ID=Q9LYS8; Match level="QueryCoverage=93%, HitCoverage=76%, E-value=1e-135, Identity=57%"; Hit description =Putative uncharacterized protein F17J16_130
  Pfam annotation: Domain name=Asp; Domain location=194-460; Score= -170.5; E_value=0.0016; Accession=PF00026.14; Description=Eukaryotic aspartyl protease
MVLRVSLILVLLVLHCSCTVQSIFGHHNHNDLNKNGSSLAAVKFPDHAHFNAVSSSTETGCSFSKSEKFEPSVATMTSNGDTDGEEGEAFVAAKQHKQSVKLNLRHHSVSKDSEPKRSVADSTVRDLKRIQTLHRRVIEKKNQNTISRLEKAPEQSKKSYKLAAAAAAPAAPPEYFSGQLVATLESGVSLGSGEYFMDVFVGTPPKHFSLILDTGSDLNWIQCVPCYACFEQNGPYYDPKDSSSFKNITCHDPRCQLVSSPDPPQPCKGETQSCPYFYWYGDSSNTTGDFALETFTVNLTTPEGKPELKIVENVMFGCGHWNRGLFHGAAGLLGLGRGPLSFATQLQSLYGHSFSYCLVDRNSNSSVSSKLIFGEDKELLSHPNLNFTSFVGGKENPVDTFYYVLIKSIMVGGEVLKIPEETWHLSAQGGGGTIIDSGTTLTYFAEPAYEIIKEAFMRKIK

SEQ ID NO: 95534 - protein, 86 aa, Glycine max
  Coding DNA Sequence Number=SeqID_3849
MGSRRRTGTWQRTPPHPTTAFNTAQGMAQAFRAGEYFRRMMGSDNYSPTDGYDHRHEERVASSRMRFRKLSGGREDEGYKGNTRTF

SEQ ID NO: 95535 - protein, 164 aa, Glycine max
  Coding DNA Sequence Number=SeqID_3850
MYPSLELIHKRCTLSCSQYKNPSRCALYLCHKGCTLQCVRTKNSQAVSPLNLCKGKQKMSQAREKGDIKELRCFLDQTCVETKIHSESKVIQRCFDDNNDDDKGDDKKLKDQSMNNSRVQESRRIQDSRRKPRIKNQDSRFKISRIKIKIQDSSMKKILNQDKY

SEQ ID NO: 95536 - protein, 75 aa, Glycine max
  Coding DNA Sequence Number=SeqID_3851
MLRSLQALPRGATSPSNDPLHGIGGPMTRSKTKRMKQALQGLILKIKEKEDRCELRVALKWVALRQIDEDALRPT

SEQ ID NO: 95537 - protein, 212 aa, Glycine max
  Coding DNA Sequence Number=SeqID_3852
  Gene Ontology: Mol. function=hydrolase activity; Cellular component =mitochondrion; Biological process=metabolic process
  Homolog annotation: Hit_ID=Q56XU5; Match level="QueryCoverage=86%, HitCoverage=47%, E-value=9e-81, Identity=77%"; Hit description=3 -hydroxyisobutyryl-coenzyme A hydrolase
  Pfam annotation: Domain name=ECH; Domain location=40-209; Score=51.2; E_value=3.5e-12; Accession=PF00378.11; Description=Enoyl-CoA hydrataseisomerase family
MAPSSAVPDEQLPTTNVEFLQFLFEQDKMVVVGEEIEHVRVVTLNRPRQLNAISPELVSQLATYLEKWEKDEKAELVIIKGAGRAFCAGGDLRVFYDGRKIKDACLEVVYRFYWLCYHISTYKKTQVALVHGISMGGGAALMVPLKFSVVTEKTVFATPEASFGFHTDCGFSYYHSRLPGYLGEYLALTGGRLSGKEIVAVGVATHFVPYEV

SEQ ID NO: 95538 - protein, 874 aa, Glycine max
  Coding DNA Sequence Number=SeqID_3853
  Gene Ontology: Mol. function=protein binding; Cellular component =cytoplasm; Biological process=intracellular protein transport
  Homolog annotation: Hit_ID=A7PJU0; Match level="QueryCoverage=99%, HitCoverage=99%, E-value=0.0, Identity=76%"; Hit description =Chromosome chr12 scaffold_18, whole genome shotgun sequence
  Pfam annotation: Domain name=Vps16_C; Domain location=541-867; Score =186.5; E_value=6.7e-53; Accession=PF04840.3; Description=Vps16, C -terminal region
  Pfam annotation: Domain name=Vps16_N; Domain location=6-444; Score =186.6; E_value=6.3e-53; Accession=PF04841.4; Description=Vps16, N -terminal region
  Pfam module annotation: Pfam domain module=Vps16_C::Vps16_N; Domain location=541-867::6-444
MANVSVAAEWQLLYNRYYRKPELYPMPWKHVDLARTKVAAAPFGGPIAVIRDDSKIVQLHAESALRKLRLFSSSGRPLADAVWRHPGGRLVGMSWTDDQTLLCVVQDGTVYRYDVHANLIEPNLSLGKECFEDNVADCVFWGNGLVCITEANQLFCIADFRNPSAVKLADPEIEEMPHCMAVIEPQYTVSGNVEVLLGVDDAVVLAVEEDGVQRLGEGVLRGPLQKMVVSRDGKWLASFTHDGRLLVTTSDLTGVIIERECECLCGLWNSRDVQKDMIMDLEKVCDCDFGCNVKSALPPQQIAWCGMDAVLLYWDDMLLMMSPEGEPVHYLFDEPIILIPECDGVRILSNTRMEFLQRVPDSTVSIFTIGSTSPAALLYDALDHFDRRSAKADENLRLIRSSLPEAVEACVDAAGHEFDLSRQQTLLRAASYGQAFCSNFQRDRIQEMCKILRVLNAVRSPEIGVPLSIQQYKLLTPSVLIGRLINAHQHLLALKISEYLGMNQEVVIMHWACSKITASLAIPDATLLEILLDKLKLCKGISYAAVAAHADKNGRRKLSALLVEHEPRSSKQVPLLLSIGEEDIALMKATECGDTDLVYLVLFHIWQKRQPLEFFGTIQARPLARDLFITYARYVALNHIPEGKTVWLFLDVAFLLWKESWELGKNPMASKGSPLHGPRIKLIEKAHGLFAETKEHTFESKAAEEHAKLLRIQHELEVTTKQAIFVDSSISDTIRTCIVLGNHRAAMKVKTEFKVSEKRWYWLKVFALATIKDWVALEKFSKEKKPPIGYRPFVEACIEADEKGEAIKYIPKLADPRERAESYARIGMAKEAADAASQAKDGELLGRLKLTFAQNAAASSIFDTLRDRLSFQGA

SEQ ID NO: 95539 - protein, 85 aa, Glycine max
  Coding DNA Sequence Number=SeqID_3854
MGEGVSRQSCGRDPGCLASLVGESQVDCIASLGCIAICIDDTLLSPSYVAYIATGTGRTLLSPPLPPVGMAGLALPPMTMAASTQ

SEQ ID NO: 95540 - protein, 154 aa, Glycine max
  Coding DNA Sequence Number=SeqID_3855
MALVKEFYANLFNPEDKSPRQVRVRGRLIKFDGETLNAFLETLVVFGARGALLSLLQVLPYSSRPSGACFQALYSRTWSILSYSNIAPTSHTFDLNMDRARKNCWNLDDPMITFLGTRKTQARGPDTSAPTAPAPTPAPTPTPAPLPAPSGTST

SEQ ID NO: 95541 - protein, 100 aa, Glycine max
  Coding DNA Sequence Number=SeqID_3856
  Gene Ontology: Mol. function=acyltransferase activity; Biological process=response to oxidative stress
  Homolog annotation: Hit_ID=A7NZW0; Match level="QueryCoverage=51%, HitCoverage=2%, E-value=2e-10, Identity=60%"; Hit description =Chromosome chr6 scaffold_3, whole genome shotgun sequence
MEDRSTIGHPVAMQRFYADTNILWSYGNFVDIKGPTVMKIMTIEAIGGEVDMGYLGTLNSSAFFFLVVNNQMAKSIKELKKENQFLKSKSEKSDVTLRVS

SEQ ID NO: 95542 - protein, 180 aa, Glycine max
  Coding DNA Sequence Number=SeqID_3857
  Homolog annotation: Hit_ID=A7PJU2; Match level="QueryCoverage=80%, HitCoverage=91%, E-value=3e-52, Identity=64%"; Hit description =Chromosome chr12 scaffold_18, whole genome shotgun sequence
MKLKFMIAVLLATAGAIMSIKNFNNLFNNSHQRLGVALYGVIWLQVLLGIFRPQRGSKRSVWFFAHWILGTAVTFLGVLNVYLGLGAYHQKTSKGIKIWNILFTVQISLIVFFYLFQEKWVYIQNQGVVLGKEIKAPICQESRPDEKEKKWQSHSKMIIADKCTCGDNCGYFVVVDILTT

SEQ ID NO: 95543 - protein, 169 aa, Glycine max
  Coding DNA Sequence Number=SeqID_3858
  Subcellular localization annotation: CTP_CleavageSite=44; ConfidenceScore=5.12e-01
MGLFDAPDFNLRAICESNRRQVYFNMNLVLVVVTVYTTSTTTTSSMMRGVRDKSRGILGRCGKGSKGPRENHRTLHKEVSICFQQALLLVGTSVNFVLKINGIMVKVTMKLKANAVAMRKVPNHSQNNQMWPNSSQIDPNNAQTRSSKVEGHGIGGSLEEGTPEKACHA

SEQ ID NO: 95544 - protein, 143 aa, Glycine max
  Coding DNA Sequence Number=SeqID_3859
MCTQTYAHTREACVSKLELVGYIIIRPFTTSANDDSYSSKPHCAPNSAQSGASSSSDSCLRAATKRLRPRSTNRRRRRSKEVTTTPFSTCHALRDCPLRPSSTSSTSSALTSSPRSIYGCNAFDIVAVCGRGWVRNGGGGGPN

SEQ ID NO: 95545 - protein, 202 aa, Glycine max
  Coding DNA Sequence Number=SeqID_3860
  Homolog annotation: Hit_ID=A5BPB3; Match level="QueryCoverage=88%, HitCoverage=18%, E-value=4e-22, Identity=38%"; Hit description =Putative uncharacterized protein
ELDLSWSNGCKRKVKIEKFDANQPEGTKDEDWALLDRQPLGVIRLTLSCNIAFNIAKETTTTGLMAALSIRALTLLSSLPKSWNAIVITVSISLGSNKLKFNDSQEEEIQPEDMNVENQKTTGGPNPRIIEVPSTRKLSSVGIVEKSGITKINATLHQIIKRKKAEANVNSTLGGDNALIRSLENKKESWVLDFGASFHATS

SEQ ID NO: 95546 - protein, 88 aa, Glycine max
  Coding DNA Sequence Number=SeqID_3861
MEVKEEDRCSTKIGYKIEELIEILVFNMGLCGETKNLMAERRRTKHLNDSPYNAKETTLQGLLITKETSLPRLLIAKETSLQRLFIIG

SEQ ID NO: 95547 - protein, 111 aa, Glycine max
  Coding DNA Sequence Number=SeqID_3862
MYSDNWHLLESKSFTEMLSECSLDWSRQEKRGHGGGVGEDNEGFFGELEVHGFGLVVLKMLGFVKSKVILCDCEGEKVTRLAGRRECWKWKGGVHAKMGMVGVAFEKGSMG

SEQ ID NO: 95548 - protein, 118 aa, Glycine max
  Coding DNA Sequence Number=SeqID_3863
  Subcellular localization annotation: CTP_CleavageSite=58; ConfidenceScore=5.11e-01
MESKEAEATTSKSRQAQAAAKGEKINPTPIPQKSKKRKPNSNSPCKTSPISGNFNLVAANHRFNVEVCRKALATFVIVDEHPFKVVEGSVVNGRWRKSKIRHKNMADGVAKNGGRHGR

SEQ ID NO: 95549 - protein, 148 aa, Glycine max
  Coding DNA Sequence Number=SeqID_3864
MRVVVVGGYGGMMMSLVHSGGRRSFLRSRRAASECPVVNVDVVIVSADVEHVDYATDEIYEQPQETIAYDVVADAQGFPGGPHDTLVLTKYVHHEHPKLKLSSHGRRVEKFGRSAPNIEGIVATTRLSPLIACSLDTGDRRLISTFAE

SEQ ID NO: 95550 - protein, 102 aa, Glycine max
  Coding DNA Sequence Number=SeqID_3865
MLARQERRRKAKRLSRLVDYLTKRVGRKMVPFRGLKRDENEVHFFSFFLENTTNALSTSNVLREFIKRHAYTSTLLSLQYMPPTTYMHKHPTKSLVRATHAE

SEQ ID NO: 95551 - protein, 57 aa, Glycine max
  Coding DNA Sequence Number=SeqID_3866
MSYHQRKLCLENRVYDHGDDKEGGTGAVGASDGPWRQWPATAVVEDDPFRFFDDSAI

SEQ ID NO: 95552 - protein, 92 aa, Glycine max
  Coding DNA Sequence Number=SeqID_3867
MAWSHLRFDFNLVKGLVTHLVGLPSILWSFSLDGCEELVHFVELGPKKVVVIVAVSEQTKVVPWVFWKYVRRADLGFCRNMYQMLDKWPQLS

SEQ ID NO: 95553 - protein, 120 aa, Glycine max
  Coding DNA Sequence Number=SeqID_3868
MKGDKEGGGERELRGNQRVLDVAESLDEKCTLSAIPTEGNCAERPKAALSPIPTERKCVENPEDRPPKRKLQTTDGCHQPPLLAIGPPHQEEHFNRSGILRILLEDSMEKIPQSSISKFL

SEQ ID NO: 95554 - protein, 167 aa, Glycine max
  Coding DNA Sequence Number=SeqID_3869
  Subcellular localization annotation: CTP_CleavageSite=42; ConfidenceScore=5.50e-01
MKLHQNASNTAYLVCHRQRPLQHQRPSLPPPSPLPSSKRTKRGSTAHRRHNRTRECANGSIVPFLNAGGTIHGDTVYRDEEKEQQGHFGNFLKLLSAPAIMLGAPSNSLKQRRNTLVRFPLRLFLPTTKHATHSVCLSRRLPMARDSCLARVTAGAAMGGAVGGAVG

SEQ ID NO: 95555 - protein, 136 aa, Glycine max
  Coding DNA Sequence Number=SeqID_3870
MGAIISLELYVDPSMQAATQSLELWNSRIASAYGFHGQGQEAIKVFNEMEQENLPESEVIFLRWLTKEETGFDDVSCGGTFAICWIFLMLPWLPSIYASFESKYSVTSGGLYKPHKAEGLFPWEVPEQIGPLHYSP

SEQ ID NO: 95556 - protein, 34 aa, Glycine max
  Coding DNA Sequence Number=SeqID_3871
MEVFRGKANNEEISDLDETIVALIPKVEVVVNIK

SEQ ID NO: 95557 - protein, 36 aa, Glycine max
  Coding DNA Sequence Number=SeqID_3872
MKNIPDSGVIFTFEEGRQKRGSCSYVPSIEEEIKPT

SEQ ID NO: 95558 - protein, 168 aa, Glycine max
  Coding DNA Sequence Number=SeqID_3873
  Gene Ontology: Mol. function=Rab GDP-dissociation inhibitor activity; Cellular component=barrier septum; Biological process=regulation of GTPase activity
  Homolog annotation: Hit_ID=Q706C9; Match level="QueryCoverage=72%, HitCoverage=29%, E-value=7e-49, Identity=73%"; Hit description=GDP dissociation inhibitor
  Pfam annotation: Domain name=GDI; Domain location=1-168; Score= -124.2; E_value=4.1e-10; Accession=PF00996.9; Description=GDP dissociation inhibitor
  Pfam annotation: Domain name=TPR_1; Domain location=134-167; Score =29.3; E_value=1.4e-05; Accession=PF00515.19; Description =Tetratricopeptide repeat
  Pfam annotation: Domain name=TPR_2; Domain location=134-167; Score =31.4; E_value=3.2e-06; Accession=PF07719.8; Description =Tetratricopeptide repeat
  Pfam module annotation: Pfam domain module=GDI::TPR_1::TPR_2; Domain location=1-168::134-167::134-167
MDEEYDVIVLGMGLKECILSSLLSVDGLKVLDMDMNDYYGGESTSLNLIQLWKRFKGDDKPPPHLGASRDYNIDMNPKVLIHTDVTKYLSFKVMDGSFVFNKGKVHKASKLKLRDVKGALLDTEFAMCEGDDNAKALFHQGQAYMALHDIHVAVESFKKALTMEPNDG

SEQ ID NO: 95559 - protein, 59 aa, Glycine max
  Coding DNA Sequence Number=SeqID_3874
MAEHGRRPKFRHITCIVDCTLWCHQGKPLHKLPMAVDKKSATPFHHGSAMALTMQKLMS

SEQ ID NO: 95560 - protein, 133 aa, Glycine max
  Coding DNA Sequence Number=SeqID_3875
  Subcellular localization annotation: CTP_CleavageSite=48; ConfidenceScore=5.19e-01
MAPPLTYSPLSSTASPWWKITIEAQRSSLHRSPTSKLPSVPDQWKQLAANYLNCNLLAIPFVYLGIPIGANLRRCQLVPNRVVDKLVSLQQRFLWGGRPEHNKIAWIKWETVTTMGYGIGVKIWWLEEPGYNI

SEQ ID NO: 95561 - protein, 101 aa, Glycine max
  Coding DNA Sequence Number=SeqID_3876
  Subcellular localization annotation: CTP_CleavageSite=24; ConfidenceScore=5.28e-01
MVRNSSNSNQSGRTTIDIQSTFVRVTRFWVLPRGIDTTFLCADMSNRKTNLSLRCHLMEACLWGFYGGWIFELQWGPLMVIFHHGDAAKDKGKEVRGGAIH

SEQ ID NO: 95562 - protein, 95 aa, Glycine max
  Coding DNA Sequence Number=SeqID_3877
MARMKKIGQMTSEVTKEVADMIDSMEEQATLGSFVTHGRQDVLTTAIGPKAVDTKYQRSARGVDHAKSDDAILSRKGIGNLLKEASQGGELSYER

SEQ ID NO: 95563 - protein, 71 aa, Glycine max
  Coding DNA Sequence Number=SeqID_3878
MHPRVTRRPSAEGFNLLASSKSSYSICTYTFFTEKGFSSFAFCIRDDKGHFVQVLIVGLHFSAPKCKKVKP

SEQ ID NO: 95564 - protein, 272 aa, Glycine max
  Coding DNA Sequence Number=SeqID_3879
MAPKKLPAKKARKDATREGSSVAPQERQVQLRDGEYAEFQEQVARRQWTQLAAPMAKGQWIPFDEDAINQFLGHPLVLEEGQRCEFSQRKSQALGFDEEAISQLLCVPGMTTLTQIWMTLLISNAVYQFAGITPPRHPMDPEKSNKALGFPALITGLCQFYGVPGQQQPTVDALPPPLQEPPSLDSIFAHLQRIELQMHTYMQHVTSQQATNHRSQDLSPFPWPTPEQSGATVAWPGDEPDFQIGAGPAGPPGDEDGAQEYDDMVDVLEYFM

SEQ ID NO: 95565 - protein, 259 aa, Glycine max
  Coding DNA Sequence Number=SeqID_3880
MVEIKEVQEQMKVNMEAMKDQMTSMMEAMLSMKRMIESNVAAMAATSAAAEADPTHPSTINQANQPIPDMVGQGGEVLGSMGGPHMGHNRNSYPYGLPPNYTPPNENANHAVPIPFEGQQPQLGHTPFAQPVGDACDFEPYPTFAPEGPTCSAAEGMEKLELIEERLRAIEGIGDYPFADMAEFCLVPDVVRFVKEPGSFPYKSDKTVPWRYATQGSDGRKDASVVHAKDDLSSAKVTNISGTSNMTRSRWIFAAPEPP

SEQ ID NO: 95566 - protein, 175 aa, Glycine max
  Coding DNA Sequence Number=SeqID_3881
MGAAKATYEQLWKHKMQQIKDINEATYHWLYNLERTTWCKYDFSHYPKCGNWVATWGGDRHFEVTDIASVEEVEFKLVLFSIKRMILHKSNVQTKTIRKAFGPHQKQQAKPRNRHTMGHHGHNISANETLKKLAPKRKAPITNIRNSSKRIKGCQLPTIEKKVELGIGFLLHNTN

SEQ ID NO: 95567 - protein, 507 aa, Glycine max
  Coding DNA Sequence Number=SeqID_3882
  Gene Ontology: Mol. function=catalytic activity; Cellular component =nucleus; Biological process=metabolic process
  Homolog annotation: Hit_ID=A7R678; Match level="QueryCoverage=99%, HitCoverage=95%, E-value=0.0, Identity=46%"; Hit description =Chromosome undetermined scaffold_1179, whole genome shotgun sequence
  Pfam annotation: Domain name=PPR; Domain location=10-44; Score=45.3; E_value=2.2e-10; Accession=PF01535.11; Description=PPR repeat
  Pfam annotation: Domain name=PPR; Domain location=112-147; Score =12.4; E_value=0.27; Accession=PF01535.11; Description=PPR repeat
  Pfam annotation: Domain name=PPR; Domain location=215-249; Score =34.9; E_value=2.8e-07; Accession=PF01535.11; Description=PPR repeat
  Pfam annotation: Domain name=PPR; Domain location=250-284; Score =15.0; E_value=0.13; Accession=PF01535.11; Description=PPR repeat
  Pfam annotation: Domain name=PPR; Domain location=286-320; Score =16.4; E_value=0.09; Accession=PF01535.11; Description=PPR repeat
  Pfam annotation: Domain name=PPR; Domain location=352-386; Score=8.1; E_value=0.86; Accession=PF01535.11; Description=PPR repeat
  Pfam annotation: Domain name=PPR; Domain location=45-79; Score=7.5; E_ value=1; Accession=PF01535.11; Description=PPR repeat
  Pfam module annotation: Pfam domain module=PPR::PPR::PPR::PPR::PPR::PP R::PPR; Domain location=10-44::112-147::215-249::250-284::286 -320::352-386::45-79
MGEGGGRDEVSWNAMIVACGQHREGLEAVELFREMVRRGLKVDMFTMASVLTAFTCVKDLVGGMQFHGMMIKSGFHGNSHVGSGLIDLYSKCAGGMVECRKVFEEIAAPDLVLWNTMISGFSQYEDLSEDGIWCFREMQHNGFHPDDCSFVCVTSACSNLSSPSVGKQVHALAIKSDIPYNRVSVNNALVAMYSKCGNVHDARRVFDTMPEHNMVSLNSMIAGYAQHGVEVESLRLFELMLQKDIAPNTITFIAVLSACVHTGKVEEGQKYFNMMKERFRIEPEAEHYSCMIDLLGRAGKLKEAERIIETMPFNPGSIEWATLLGACRKHGNVELAVKAANEFLQLEPYNAAPYVMLSNMYASAARWEEAATVKRLMRERGVKKKPGCSWIEIDKKVHVFVAEDTSHPMIKEIHVYMGEILRKMKQAGYVPDIRWALVKDEEVEPDEKERRLLYHSEKLAVAFGLISTEEWVPILVVKNLRICGDCHNAIKLISAITGREITVRDTH

SEQ ID NO: 95568 - protein, 220 aa, Glycine max
  Coding DNA Sequence Number=SeqID_3883
  Gene Ontology: Mol. function=binding; Cellular component=nucleus; Biological process=regulation of transcription
  Homolog annotation: Hit_ID=A7PJW3; Match level="QueryCoverage=41%, HitCoverage=18%, E-value=5e-29, Identity=66%"; Hit description =Chromosome chr12 scaffold_18, whole genome shotgun sequence
  Pfam annotation: Domain name=LRR_1; Domain location=111-133; Score =13.3; E_value=0.93; Accession=PF00560.24; Description=Leucine Rich Repeat
  Pfam annotation: Domain name=LRR_1; Domain location=135-157; Score =12.1; E_value=1.7; Accession=PF00560.24; Description=Leucine Rich Repeat
  Pfam annotation: Domain name=LRR_1; Domain location=159-181; Score =7.6; E_value=12; Accession=PF00560.24; Description=Leucine Rich Repeat
  Pfam annotation: Domain name=LRR_1; Domain location=183-211; Score =4.5; E_value=46; Accession=PF00560.24; Description=Leucine Rich Repeat
  Pfam annotation: Domain name=PPR; Domain location=44-78; Score=7.4; E_ value=1; Accession=PF01535.11; Description=PPR repeat
  Pfam annotation: Domain name=PPR; Domain location=9-43; Score=36.3; E_ value=1.1e-07; Accession=PF01535.11; Description=PPR repeat
  Pfam module annotation: Pfam domain module=LRR_1::LRR_1::LRR_1::LRR _1::PPR::PPR; Domain location=111-133::135-157::159-181::183-211::44 -78::9-43
MSRIALLTISLKPMISGYVRNKRLMEALELFRKMQRQRVQPSEFTMVSLLGACAHLGALQHGEWVHDYVKKGHFELNVIVLTSIIDMHCKCGAIVKGIQGQSNTHNICGMNLEWLEVSGSGLKGTIPTEIGNLPKLTHLNLSRNYLDGATPLSLGNLILLQSLVISCNIVQGSIPYELVSLKNLTVLDLSHNKSMQPCPFTLQISHYYKSLTYPTIYLVP

SEQ ID NO: 95569 - protein, 181 aa, Glycine max
  Coding DNA Sequence Number=SeqID_3884
MVLSARVQLFQFVGSARAVKAGVDERDFLFGASQGNLFFTVNGVDMVIDVVMWKEVAGLNKGGVHMFDEIVDDYNKMQTYRGRLLDPARSSNHAQVTDDDLQIVYILKSDIMLKCLRLLDYEFPYVLDFTKASGEIIERHLKNLGMRFVGHKWIMVGEPTARNFEEMEEDDEAKAQHDPAP

SEQ ID NO: 95570 - protein, 148 aa, Glycine max
  Coding DNA Sequence Number=SeqID_3885
MAFLKISIQELYANLFDPEDKSLRQCRVRGKLIKFDVATLNEFLETPVVLEPGERYSAYSRFCQNHPDPQEFASRLCIPGRGFVLNAEGVPWKLLRKDLTTLAQTWSILSYSNLVPTSHTSDLNMGRARLVYRLVMKMDMDVGSIISG

SEQ ID NO: 95571 - protein, 139 aa, Glycine max
  Coding DNA Sequence Number=SeqID_3886
MADLGGGFAKKRHRIAVAWRVWDGGAMAAAIAMAVVAVMEGWRKMAGFAWFLSAVGVGPTRPNPTRLCIQLNVVPRRTSPLRPSLTPPHPAAAARDTLTRRRRPTSREPRQRSLPRPRRLFFLSREEDEEDEDADAVPF

SEQ ID NO: 95572 - protein, 49 aa, Glycine max
  Coding DNA Sequence Number=SeqID_3887
MWVSTERFPADFGREEKENNDFRQEDDKEKRLGNVDSIVRPLKMYLITP

SEQ ID NO: 95573 - protein, 87 aa, Glycine max
  Coding DNA Sequence Number=SeqID_3888
MEKKLVFATRDDVLHWAHSCGSNVFQGYFDDAKESRVKKNPKIQESSFKNQDSRFKNNQNQDSRLKIQESREDSIKISTKKVFQNIE

SEQ ID NO: 95574 - protein, 243 aa, Glycine max
  Coding DNA Sequence Number=SeqID_3889
MVMLTGFASEKHKGDSINDYGGEHGARKGRRLTGFGRILAALWWCGKRIPMVIVGVENKVENKVDNECCTRFANKSMTHVHVIFLDAFRDLNQIGSYTWGVVVLVHMYEKSNDASKISARQLTYEHFPTVASFIAVENYHERKPRACHWKSGKTLLCALDYNEWFYFISHPFMSLTQPEDPPRHPPMVHNDTFIELDPPQQSVTTTTMPQPPALADVDMPRHAVGMYMFGQDEGGIHRTHEDC

SEQ ID NO: 95575 - protein, 107 aa, Glycine max
  Coding DNA Sequence Number=SeqID_3890
MGLAMNSLSEPASLSEFIHFDEFLGFRMNSLSVPCSAKQLLFFCCHAKRALRAKPLAAISMASKKRCASSSRPHELYDTSRFVSETAWDRYERTSITGIFSQRGIWS

SEQ ID NO: 95576 - protein, 77 aa, Glycine max
  Coding DNA Sequence Number=SeqID_3891
MGCSCSNAGVDGRVSSEIATTESEANEKGSREVSSSSAAGVCSSASSGSWVVEVSPLQKEKAGLLAKPPECESLPCS

SEQ ID NO: 95577 - protein, 292 aa, Glycine max
  Coding DNA Sequence Number=SeqID_3892
  Gene Ontology: Mol. function=nucleic acid binding
  Homolog annotation: Hit_ID=A5AYU6; Match level="QueryCoverage=22%, HitCoverage=12%, E-value=5e-11, Identity=46%"; Hit description =Putative uncharacterized protein
MGEKTFLALVMFVMTYGLAATTFTVSQIPPSCNGDESLLTFCGPYMGNIQPNPTSDCCKAATSVFDKAMATGQGPGYRALIAHRCRSKLHDESRLIQRSFDDNKGDDKKLKGSRGNLISSIKNQDSKVQASKNQDQDSRLKIQESREDLIKITYIYLGLTENKRGYISCGSVLVEGTSTRLFKENKGGYIPCGSLLVKGFLQGWKRNLKDRKSLGDWMNRLFQDHDEDQVNLCLMTKSHDHNKEESVRKKWYIDSGCSKHMTGDVSKFATIFSKKSGHVTYGDNNISKISKE

SEQ ID NO: 95578 - protein, 171 aa, Glycine max
  Coding DNA Sequence Number=SeqID_3893
  Homolog annotation: Hit_ID=A5AG25; Match level="QueryCoverage=69%, HitCoverage=16%, E-value=8e-10, Identity=36%"; Hit description =Putative uncharacterized protein
  Subcellular localization annotation: CTP_CleavageSite=55; ConfidenceScore=5.64e-01
MWDKGTKTTNSNNPSSVRSSAGTSLAMSTGASLMSYIRTQTCLLGSNLTCRESIPALSATSSPFVPRKNRYHRRNGRWEKNDTKLLKKKWTNSSMPTSSENSDIPPGSPTFSWSKGQQQMANMLSFLNAYSRYNQIRMHAPDKEKMTFITKDPNFCDRVMPFCLKNASATN

SEQ ID NO: 95579 - protein, 135 aa, Glycine max
  Coding DNA Sequence Number=SeqID_3894
MASRKRKVAASRPQPHYDTHRFTSEDAWNRYALNVLGRNILPERNMKLFVTEFDEFRTKLVRRNWHRTLTNLMEGSIDVALVKEFYANLYVPGDKPPKQVRVRGHLIKFNADSLNTFLETPVVLESGETLQYYSQ

SEQ ID NO: 95580 - protein, 65 aa, Glycine max
  Coding DNA Sequence Number=SeqID_3895
MVVELGQQTVDVSTLVTLVAHDNSFDSLAALTNPRTYRERNGRSLGGYDLRPWTRLFSASTYPYV

SEQ ID NO: 95581 - protein, 448 aa, Glycine max
  Coding DNA Sequence Number=SeqID_3896
  Gene Ontology: Mol. function=transferase activity; Cellular component= cytoplasm; Biological process=flavonoid biosynthetic process
  Homolog annotation: Hit_ID=A7QLD4; Match level="QueryCoverage=100%, HitCoverage=51%, E-value=1e-113, Identity=48%"; Hit description =Chromosome chr11 scaffold_118, whole genome shotgun sequence
  Pfam annotation: Domain name=Transferase; Domain location=1-447; Score=408.4; E_value=1.1e-119; Accession=PF02458.6; Description =Transferase family
MVTIKASYTVLPNEPTPEGLLWLSDIDQVARLRHTPTIYIFHAKHNHDTLIERMRNSLSKILVHYYPIAGRLRRIEGSGRLELDCNAKGVVLLEAESTKTLDDYGDFLRESIKDLVPTVDYTSPIEELPSLLVQVTTFHGGKSFAIGVALCHILCDGVGAIQFINSWAKLARGDTLEPHEMPFLDRTVLKFPHPLSPPRFDHLEFKPLPLILGRSDNTVEKNKKVDATLLKLTPEQVGKLKKKANDDSTKEGSRPYSRFEAIAAHIWRCASKARKLDKNQPTLVRFNADIRNRLIPPLPKNYFGNALSLTTASCHVGDVISNSLSYAAQKIREAIEVVTYEYIWSQIDVIRGQEQLDNARALFFGQNEGKDALFYGNPNLLITSWMSMPMHEADFGWGKPVYLGLGSVSTQDRALIIQSPDGDGSIILSIHFQMEHMQLFKKYFYEDM

SEQ ID NO: 95582 - protein, 230 aa, Glycine max
  Coding DNA Sequence Number=SeqID_3897
  Subcellular localization annotation: CTP_CleavageSite=37; ConfidenceScore=5.03e-01
SLGDLNSIASASPLALFFDSSLSFHQLQCFKGYLDVSASEGSLSETDSLSESNTSLTDPLLGFPNTLSELLPTQRLGAKVVMKSSKWCSLLNFLLALRLVLVSPLSACNSSLLYHFITFPGPSKTPCPQGVGCRKIEPGSQIRMGVGMSECLLVARRQNQLAASVCKMTLPGSMDENSGSDTGRDDNHTACAALCIIGRGAPMMTTSAYPQGQVPPGVAGNFLAGVVAVD

SEQ ID NO: 95583 - protein, 142 aa, Glycine max
  Coding DNA Sequence Number=SeqID_3898
  Subcellular localization annotation: CTP_CleavageSite=53; ConfidenceScore=5.26e-01
MGPCGTPTPLRCSTLGIKWLIKPRPRGTRQYLRLPSKRTEFPMRSLGRSEVERPMERKNWSLGRMVFSGLILRTMGKRLTRRDNWSSENPKVLRSKEEKWVWVVSAFRCCDCNCMTHYEESPICGLHNTTVSCSITCQEIGL

SEQ ID NO: 95584 - protein, 332 aa, Glycine max
  Coding DNA Sequence Number=SeqID_3899
  Gene Ontology: Mol. function=aspartic-type endopeptidase activity; Biological process=RNA-dependent DNA replication
  Homolog annotation: Hit_ID=Q69F85; Match level="QueryCoverage=75%, HitCoverage=30%, E-value=1e-15, Identity=37%"; Hit description=Gag -pol polyprotein
MVSTRFGFIREIPFGGSNPPPIAMTDTDTLQKIQNRIGDEHSIHTLLKRTQGESHTRHIVNTQDDLSLSHMHRPVGQTTHRHPLVKCIMEVDIPLGWKPLNLKRYDWTTDLNEHLDDFLTQANLYTNDDVILCHVFPTSLKRAALTWPGKFADNSGMKSDKPDKPDKHQPLSKGSRYERYTPLTANHTTTLEEAFNLELHTIWDIDINYVDAPSPQSLLSITFTNVDFKGINPINQDDPMVVSIIIANFMVSKDQVKTRGYINLMTTFGQGTLSRSFTNSYLIIDVNTSYFSFIGNKTFNELGAIVSILHLKMKLPTLTGEIVTVKAGQKLA

SEQ ID NO: 95585 - protein, 114 aa, Glycine max
  Coding DNA Sequence Number=SeqID_3900
  Homolog annotation: Hit_ID=A5BEV8; Match level="QueryCoverage=53%, HitCoverage=7%, E-value=8e-08, Identity=44%"; Hit description =Putative uncharacterized protein
MSLLVDGLTKVTTDKWIDITDMEYVIASRYNVIVVSLSKQQSMTFFPLRSQLLANSSLYRIICIGHVYDSHFIEKVRDMTLHSKTTHADLMQDKAYHVIGVVDNTYRKHVHAHF

SEQ ID NO: 95586 - protein, 70 aa, Glycine max
  Coding DNA Sequence Number=SeqID_3901
MTNEKPWFGSLPRRWMVIKLPRRWTTSLLFAEASSMHLATSSRKPPIHGNNGGKLLNEEEEEEPVPTTSF

SEQ ID NO: 95587 - protein, 83 aa, Glycine max
  Coding DNA Sequence Number=SeqID_3902
MSFFLLERKNNSNDANTRRGASISEEEEDKEPVLGRGEGKLHRRIIRSIYSIGVKGILDFSPSLLVPQQKCWMHQDTPSSLES

SEQ ID NO: 95588 - protein, 59 aa, Glycine max
  Coding DNA Sequence Number=SeqID_3903
MEFVESNPLFQNPKYMSYFVLLLQLGVRLAFGGLICVDEDGGEGEGTLEVGEMGTCRDS

SEQ ID NO: 95589 - protein, 142 aa, Glycine max
  Coding DNA Sequence Number=SeqID_3904
MVSKHETRDKPLNNGFSSLTENRDIPSMASLGVLKPAQWISKIDSHPFRDSFLAQFSSSCESDQMLKQKDVPQSISGRDELGKDELHNVLTVTAGQGSLRQRQTQVEGERRRTTGFKRAGCAISDNHNALTIVSVWAPVVVV

SEQ ID NO: 95590 - protein, 204 aa, Glycine max
  Coding DNA Sequence Number=SeqID_3905
LRVESQHFATVHDDNPRVASMPYFGVIEEIWENKLNKYFMFKILVMKDDDDSTLDTCLTPFSMQMSSNANGEEEIDDVLANRTWLHHPAHLLILLLSQQHLLHRLRRRRQEKKHDSDQIVAHDKVDVTYDNWKQVPVAQKDLIWEDIRAKFDISESSDLRTKKKNTSDRRRAVEGEDDKVCEKYEISKEKWIQFCQSRREPSWE

SEQ ID NO: 95591 - protein, 133 aa, Glycine max
  Coding DNA Sequence Number=SeqID_3906
  Gene Ontology: Mol. function=RNA-directed DNA polymerase activity; Biological process=RNA-dependent DNA replication
  Homolog annotation: Hit_ID=Q2HRM6; Match level="QueryCoverage=40%, HitCoverage=13%, E-value=5e-09, Identity=48%"; Hit description=RNA -directed DNA polymerase
MTMITNSSSVPPKEILHGLSPSKSIEHQVDLLPKASLPNRPTYNSKPQETQHKDAQAKVEYVKRLYDQVKVQIAKKNESYAKQANKKRKEVVLEPGDDPGHLRANVFQEGGNDENPETGQIQAKGPSGEGQSP

SEQ ID NO: 95592 - protein, 27 aa, Glycine max
  Coding DNA Sequence Number=SeqID_3907
MGMRKQGESNSPRRAGQQPPPPFPINR

SEQ ID NO: 95593 - protein, 286 aa, Glycine max
  Coding DNA Sequence Number=SeqID_3908
  Homolog annotation: Hit_ID=A5BSR3; Match level="QueryCoverage=65%, HitCoverage=52%, E-value=2e-15, Identity=30%"; Hit description =Putative uncharacterized protein
  Subcellular localization annotation: CTP_CleavageSite=20; ConfidenceScore=5.45e-01
MASPLASPPSPLPRPPHPPSDASASPSAVKRTRRASLVHIDPATGKADGPHRKKLRTYLGIVARDKVDITYENWKKVSTAQKDLIWDDIQRLLTVGQKGSYFRLWARDGADHDGVDDTVCEKYGISKENWAQFRQTRRDPSWEKLLAENTKKKLEEAAQSGSIDGVIDPSSPVRRHVKWKMARTKKTGEMTKEAAKEIAEKIDSFKEQATQESFVPYGRQDVLTAAIRRSEHLDVSVLLEPVSPSSTTLVRLHGFFNKLMLVISNNIGYLYITDANIQTLTLVIYK

SEQ ID NO: 95594 - protein, 236 aa, Glycine max
  Coding DNA Sequence Number=SeqID_3909
MKKLEEVAQSGSVDGVINPPSPVRRHMKWKMACTKKTGEMTIEAAKEIAEKIASHFQLTIRIIFLYLVNAMCKCVFSVQDSFEEQASQGSFVPHGRQDVLTAAIGRPEHPGRVCAAGATTKKKAFYIAPLTSVIAKTDVNESASLFSFSSHLKSVGNRSLDTHIVFNTTGNPSLEPTEPPTLLLEVFLEENPTYTLGTRVLKHSCVLKAQSFLRKESFKFRAILLDLTAIVTVWVR

SEQ ID NO: 95595 - protein, 160 aa, Glycine max
  Coding DNA Sequence Number=SeqID_3910
  Subcellular localization annotation: CTP_CleavageSite=22; ConfidenceScore=5.12e-01
MQLQQVEKSRNSLEVFGSPILSSRSKSSSFDKKLAKTSSSSWDVAPKIEETNFSAISGGNYNDVDSDASSNFNVNIDSEKKKNSLGIKIAAGIATVASALAISAIIIFLISRRNMKYQKKIFRKRMLPLIPQWLQLLLKSSCQQIVLQDQSQILKPEAEE

SEQ ID NO: 95596 - protein, 93 aa, Glycine max
  Coding DNA Sequence Number=SeqID_3911
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=28%, E-value=2e-10, Identity=100%"; Hit description=LacZ protein
HPPFASWRNSEEARTDRPSQQLRSLNGEWDAPCSGALSAAGVVVTRSVTATLASADVRRCFCRYAPPPSVAEQEGQLIENRSHWEHLKNTIIH

SEQ ID NO: 95597 - protein, 170 aa, Glycine max
  Coding DNA Sequence Number=SeqID_3912
WHRSHLRPHSCSREKERKPQEANINLPYFHWKDNVEAYLDWEITIEQQLKRKSTSKSYDSHSYPKKDQGQGILGAAPSKPKDDKGKTIEKQPPNTSMQEKTSSIKCFKCLGRDINSQCPTKKTMIMRGQDIYSSQDEATTSPSSSESEEAKGEESSEEIYPQEEGQPLSG

SEQ ID NO: 95598 - protein, 43 aa, Glycine max
  Coding DNA Sequence Number=SeqID_3913
MEQVSIGHQNWGMAFVDNWVVGKEKGCYWLSNDIVELVGEFPL

SEQ ID NO: 95599 - protein, 195 aa, Glycine max
  Coding DNA Sequence Number=SeqID_3914
MTEFYFPRSSNLAQAFEEDLILMWAFLAGRQIDWAHLVRYRMHKALRANAPLPYPHLITLFLRHFQIPLDDEPFVQVKCSFAIGAGVMTSFGYHKDQNGQWLKKDTLPPQDERTPSPLPQCEDSALLNEVLTKLRGIRSYVGERFDSLDTRFAGMDIRLTQVEEDVSFIRTCFDPPHRLHHPLRLIVIIIMTESY

SEQ ID NO: 95600 - protein, 95 aa, Glycine max
  Coding DNA Sequence Number=SeqID_3915
SLPNRPTYNSKPQETQHKDAQAKVEGNGSYAKQANKKRKEVVLEFGDDLGHLRANVFQEGGNDENPETDQIQAKGPSGEGQSPRVEKDEGPSEKD

SEQ ID NO: 95601 - protein, 130 aa, Glycine max
  Coding DNA Sequence Number=SeqID_3916
MGDIEEVQEQMKVDMLALKDQMASMMEAMLSMKRMMESNAAVAAAANAAIEADPTHPSVTNQAHQPILDMVGQGGEVLGSTRMKNHRSRLKVTSTRIPYSLPRDQRLMLRLNPILRELLNPALCNRCISQ

SEQ ID NO: 95602 - protein, 57 aa, Glycine max
  Coding DNA Sequence Number=SeqID_3917
MGPEIYPKAHKNPRAFSCIFGPFYLGSSIQCPCRGIGKEDWCHPLKNLSQEARGQPP

SEQ ID NO: 95603 - protein, 176 aa, Glycine max
  Coding DNA Sequence Number=SeqID_3918
  Homolog annotation: Hit_ID=Q0KIL1; Match level="QueryCoverage=54%, HitCoverage=10%, E-value=4e-08, Identity=36%"; Hit description =Gag/pol polyprotein, 3'-partial, putative
  Pfam annotation: Domain name=G-patch; Domain location=43-82; Score =22.0; E_value=0.00042; Accession=PF01585.14; Description=G-patch domain
MPYVEAIEESLETAFQSFEVVSITSIDSFSGQPFLSDAAVMMARVMLGNGYEPGMGLGKDNGGITSLICAKGNRGKFGLGYKPAQADIKKGITGRKSGGQCSRLGQEVKEGPPCHISRSFISMGLGHEGQVVAICEDDSPSGSELNQTEDEEDEDVGLPPELEKIVAHEDQEMGPH

SEQ ID NO: 95604 - protein, 79 aa, Glycine max
  Coding DNA Sequence Number=SeqID_3919
MDLQVDMRFDAMDSRITKVEDVSFIPCLDFRDCHHQKEGDYRQRIKLNVLMMPKDHMFLKALFKTKKLKIFKMDDQDSL

SEQ ID NO: 95605 - protein, 17 aa, Glycine max
  Coding DNA Sequence Number=SeqID_3920
MDIRLRVIGDPMNGVQR

SEQ ID NO: 95606 - protein, 261 aa, Glycine max
  Coding DNA Sequence Number=SeqID_3921
MASLVDWLAKLKVVSKENFEAPEEDEEVQALKSELGKAKLAKEKFKLAATHVRKECAGLREENAITARALEQETKRARKEEYGRNKFRGALWGSNSELELQREERDQSRAHSMVLKEELIACSRSKRSLSQRLCETETNMLAIIAKYQEELGLATAHEHRIVDEYAQVYAEKEARGRVIDSLHQEATMWMDRFALTLNWESRTSPLVSQGQGDGRHLLHPRRDSWASRLLSAYDRLNGPHNQKSLGNLYGLSDLDWIRLPF

SEQ ID NO: 95607 - protein, 39 aa, Glycine max
  Coding DNA Sequence Number=SeqID_3922
MNFRSQRASAKRNIYWLSARKNMEEDELYKFAEHTASSH

SEQ ID NO: 95608 - protein, 105 aa, Glycine max
  Coding DNA Sequence Number=SeqID_3923
MMAHHCCSEGFDMGEYSGCAKKTQAIQKQNAAPHVLSLGGYEYLEQKLMAEKTKKKLEEAAQFGSTDGVINPPSPIRRHVEWKMARTKKIGQMTSEATKEIAEKI

SEQ ID NO: 95609 - protein, 46 aa, Glycine max
  Coding DNA Sequence Number=SeqID_3924
MAEEARRVTLEDYSSSNTIRLSLFSFSLSGEAKRWLHSFKGNTLKT

SEQ ID NO: 95610 - protein, 221 aa, Glycine max
  Coding DNA Sequence Number=SeqID_3925
PIFFRGLHVHAIRGLHALAFRGSHTLAFIGLHALTFRGLHALAFRGLYVLTFRGMHTLAFRRTIRPHLQRTTHTRLQRTTRPCHQRTTRLHALTFRGLHVLHLHRATCPHLSKDYTSPPSEDAPHLQRTTRPPFRGLHVLAFRWLHVLAFRGLHSSPSEDCTPSSSEVYTSSSSEVYTSSSLEDYTSSPSKGYMSPPLEGCTSSPSEGYVLLPSVGSISAP

SEQ ID NO: 95611 - protein, 27 aa, Glycine max
  Coding DNA Sequence Number=SeqID_3926
DYVEILHRSSAFFTVLHPFFVRSSFFN

SEQ ID NO: 95612 - protein, 63 aa, Glycine max
  Coding DNA Sequence Number=SeqID_3927
MSRGSGDLGDVRWGAIAQNQAWPIPTQPRHSQPGLKIETERSVAAGNRLPFVCNRLHSAICCW

SEQ ID NO: 95613 - protein, 215 aa, Glycine max
  Coding DNA Sequence Number=SeqID_3928
MDRARLVYGLVTNMDMNIGALISGQISSIAQSNSARLGSLALITALCRARGVTSNSLTYESLSPAINLAYIKKNCWNMDDLTVNFRGARKARVRPADVPSSSTLPAPSTSATPTPAPLGSSTQDSQRFEAMLQSIHQGQILLLQSLQVIAPLGSILSIEQFIEKVSWPGTLPSVVREGEGPSAQVPQQASRAQVRQEAATLERLIEPSKCTRSRK

SEQ ID NO: 95614 - protein, 143 aa, Glycine max
  Coding DNA Sequence Number=SeqID_3929
  Gene Ontology: Mol. function=transcription factor activity; Biological process=regulation of transcription, DNA-dependent
  Homolog annotation: Hit_ID=A6T6U2; Match level="QueryCoverage=69%, HitCoverage=53%, E-value=2e-41, Identity=86%"; Hit description =Putative DEOR-type transcriptional regulator
  Pfam annotation: Domain name=TetR_N; Domain location=14-60; Score =47.6; E_value=4.3e-11; Accession=PF00440.14; Description=Bacterial regulatory proteins, tetR f
MTRRPNDPQRRERILQATLDTIAAHGIHAVTHRKIASCAGVPLGSLTYYFSGIEALIEEAFRNFTVEMSAQYQQFFNGVGSRQQACDAIAELIFSAQQPTGAESGHAELDAAQPADAGAVVRTGDGARAGCVYRGDDATLRDR

SEQ ID NO: 95615 - protein, 111 aa, Glycine max
  Coding DNA Sequence Number=SeqID_3930
VVAVRLLPATGHPNATVVFRPAPVWGAVLLDESSISRGPDALAGGDRILLSSNVIYVRVVMLVRMIRTRLFAAARVKSCPSMHSSSVIASLSSCARTVGPPPISGGGPGTV

SEQ ID NO: 95616 - protein, 36 aa, Glycine max
  Coding DNA Sequence Number=SeqID_3931
METTKGEELATQLAQASQVASSRSNRLLEEHLGRPK

SEQ ID NO: 95617 - protein, 53 aa, Glycine max
  Coding DNA Sequence Number=SeqID_3932
MEQKEQSVRKEAQSMMPRRRFRGRDKAQGYIDACVSIGEWTFRGLISNQLSSF

SEQ ID NO: 95618 - protein, 325 aa, Glycine max
  Coding DNA Sequence Number=SeqID_3933
MTVGYMEELFFMAKQARQVFYIQDPNDSRLSVVIQGRPIGIREQNDHATLDILNNLRWMTYMRFIMIMMKVYGRTFMLNCVVSMVMGTPPRSPPQSDGNSEATPKKTRQSTRLRRLTLRTLYQPRPTVSVDPATRRGSSPKKQKFHSYLGVVAQQKIPIVHSNWKDMLKTLKDLVWDDILSLLTTKFVYVDTEGQQKEDPSIKYGMDQQTWDEFTASRKTPTWQCITGVATYPSVGGRRVTRGMRVPRKEYARSRHQRLFEENVEKTGKDAIYELLSERFGSCIYARGRRETLRHWTINDLLGWSTKAGLLLLRILNCDEEIRPT

SEQ ID NO: 95619 - protein, 96 aa, Glycine max
  Coding DNA Sequence Number=SeqID_3934
  Homolog annotation: Hit_ID=A5AZ88; Match level="QueryCoverage=78%, HitCoverage=7%, E-value=2e-07, Identity=29%"; Hit description =Putative uncharacterized protein
MKNRYIHSDPIVVEDIEEDADIPLILGHPFMSTASCMVNMGKKILQMGIEDQKISFDLFHEDKDPPHQNVCLKVHVMEEKRPEKKVPEVRTLLDPG

SEQ ID NO: 95620 - protein, 59 aa, Glycine max
  Coding DNA Sequence Number=SeqID_3935
GQNHLRPQSEVETKLKAKTNQGVVGDDLRPRVHPEAGGYATLPPLSCYSYLNMRPPSAQ

SEQ ID NO: 95621 - protein, 29 aa, Glycine max
  Coding DNA Sequence Number=SeqID_3936
MKIRKRGPMNPKRIRVLRKKAQSFKNLGI

SEQ ID NO: 95622 - protein, 27 aa, Glycine max
  Coding DNA Sequence Number=SeqID_3937
DSVEILHRSSSFFTVLHPFFVRSSFFN

SEQ ID NO: 95623 - protein, 220 aa, Glycine max
  Coding DNA Sequence Number=SeqID_3938
  Homolog annotation: Hit_ID=Q6WAY6; Match level="QueryCoverage=49%, HitCoverage=18%, E-value=2e-08, Identity=30%"; Hit description =Putative uncharacterized protein
EQYLAGIGGRAIKWFPRWKEGNEGVLFSCGDYPNILLIGTRGCINYNLALAIRQLGYPMRGAPTEESLSPFLVRDFGAQSFKIVQRVHKAWEIPLRKDKELRGIHNCIIGAPEENEEVRALKTELGKARLAKEKFKLVATDELAACSRSKRSLAKHLEATEQRRLEDVATSRRFIYQSLQAACMVSGGGDKSDECLFHLGELHDMETCPAVEELLQRLLD

SEQ ID NO: 95624 - protein, 103 aa, Glycine max
  Coding DNA Sequence Number=SeqID_3939
  Subcellular localization annotation: CTP_CleavageSite=41; ConfidenceScore=5.04e-01
MNCVFVHVSSTVEFGAMRSDCLVQFSILNLFRSPMNCVFVHASSTHEFGAMRSDCLVQFSILNPFSEPMNYVFVHVSSTHEFGAMRSDFLVQFSILNPFFGAP

SEQ ID NO: 95625 - protein, 211 aa, Glycine max
  Coding DNA Sequence Number=SeqID_3940
  Homolog annotation: Hit_ID=A5C0V9; Match level="QueryCoverage=69%, HitCoverage=27%, E-value=2e-07, Identity=27%"; Hit description =Putative uncharacterized protein
MTLTIPELFLRPYQAIWDATVFGVVNPDFPLYIKHEDLSEIAHGGQCLSISVLQLWILNLTETCMRVGNSDIYGFLEPQSIQRSGQSQFESESYIKSWMQSSQRDVYLGAYLNGPDNYLKGIINSAIKGLDDAPQAKSKASAWWIVVKCNRQKGSTECGYYVMHWMSTIILGTFRNNWEVYFNDPRPLELERLKALRIQWAQFYLRVRDQP

SEQ ID NO: 95626 - protein, 110 aa, Glycine max
  Coding DNA Sequence Number=SeqID_3941
MTRAFSLNPWVSYPNFVRGPLLDDVRPFFGPREHPGPLGPSRIFLQKAVASGGSNLARLGELSSPGRAGRQPPPLFAINRGGSEEEKGSAPLALLSLSNLLGKIVSVKKI

SEQ ID NO: 95627 - protein, 105 aa, Glycine max
  Coding DNA Sequence Number=SeqID_3942
MSIQSFGFNNSNHVYTPHRERPRSCQDVQRYGRSIDIIGKGLALVALPHMDVTIIFHSELVIPCSQNLLGHGMCCKGSLMHFYQHLLSLSGIHTSKQNHIMVPLV

SEQ ID NO: 95628 - protein, 52 aa, Glycine max
  Coding DNA Sequence Number=SeqID_3943
MSLPSAVHVSPLSSAKLLKKKEGMEMRVVITERAGRTKSVSYLCFPLISDER

SEQ ID NO: 95629 - protein, 48 aa, Glycine max
  Coding DNA Sequence Number=SeqID_3944
MTLSLRKTRQQVSISPCRAQATTLHGDQPESQGSSKSSDMPPRMLKTL

SEQ ID NO: 95630 - protein, 105 aa, Glycine max
  Coding DNA Sequence Number=SeqID_3945
MTPTHDALLYYNGRWNMPCQNEFVGYSFTGKNPKKFDISFGCTMDELKDLIKQVVPHGIPPYGIHETQMVLAQSNYWKKFGPTEFLVVFSKYVMEMEDDLFLSQN

SEQ ID NO: 95631 - protein, 129 aa, Glycine max
  Coding DNA Sequence Number=SeqID_3946
SLHYSVKHALRPNELSQMPAMDVASKGRNFRTIIKKMENFVIVEEQRVETRGPIGICIFANGKETSKQGLGFRRFILRSRLKPETLFFIVGRSMSLSSSSNAYNVPWVEKYRPIKVADIVVNEDAISRK

SEQ ID NO: 95632 - protein, 67 aa, Glycine max
  Coding DNA Sequence Number=SeqID_3947
MLVRAAIDSLLCWIYEHFPSVVESLSNPDYDEMSPRVCQWIATKASSKSLLASTYRKRLDGLTIADV

SEQ ID NO: 95633 - protein, 90 aa, Glycine max
  Coding DNA Sequence Number=SeqID_3948
  Homolog annotation: Hit_ID=A2Q274; Match level="QueryCoverage=67%, HitCoverage=31%, E-value=4e-07, Identity=46%"; Hit description =Ovarian tumour, otubain, putative
MRWWLAALVDDNMLGGVKRKRRKRGRGVENAHLSLKRLLQNSLGDICSVWEAMNNMMTLQHTQIQASFETSTHMVEHVFKVALYKKLLGM

SEQ ID NO: 95634 - protein, 108 aa, Glycine max
  Coding DNA Sequence Number=SeqID_3949
MTRGNSFDLQPFDPEIDRTFHRLVRHHFVPFEHPEHFVIGNFEHPDFEHYSFEHSENMSQPPTHERTLREMAAPDFTYESLCIQYPDEDAPYVLKTGLIHLLPKWDPL

SEQ ID NO: 95635 - protein, 78 aa, Glycine max
  Coding DNA Sequence Number=SeqID_3950
  Subcellular localization annotation: CTP_CleavageSite=61; ConfidenceScore=5.04e-01
MKVKHKRYATNTLDSSLHAMWFHFSVKNLVRGLRVHDRTCLIMGRPVRVTLFCENAPTICDQHMLKGILKPGVFTPKA

SEQ ID NO: 95636 - protein, 55 aa, Glycine max
  Coding DNA Sequence Number=SeqID_3951
MLPSLKLEKTSIFLLDDFDTHEAFLQVMISLFKIYRGLAGLFNYDPQGCIAKVQD

SEQ ID NO: 95637 - protein, 160 aa, Glycine max
  Coding DNA Sequence Number=SeqID_3952
MAFLGETSSQTIVNSRLAFIFPNGSIIHNEFSVYFQSSTSIPIRVPNDCGFETLKSRMHNTLQLTNDQYLDEIYYRQPFADAAIMTPTHDALLYYNRRWNMPRQHDFVGYSFTEKNPKRFDISSGCSIDRLKDVIKQVEPQGILPYGIHESQTIRRLFFR

SEQ ID NO: 95638 - protein, 91 aa, Glycine max
  Coding DNA Sequence Number=SeqID_3953
MEAIKEQMATMIKAMMSMKKIMEANAVIVAAISAVAKVNPMLPSGLKQMNRPIWTLSFAQTTTIAFCGGKSPSCYGRKGKGGSSKGKAQGH

SEQ ID NO: 95639 - protein, 121 aa, Glycine max
  Coding DNA Sequence Number=SeqID_3954
GSRLQDTQWTRRSPTGSWSCQALITGLCQFYGVPVTSSKGIRPPTNRAFIKKYCVSRQAQGETPQQPGDGRQQETDTPPPPLEFTSAHPQKGLSIAYTTWPTNRRPSPKPKVERYLRCACM

SEQ ID NO: 95640 - protein, 139 aa, Glycine max
  Coding DNA Sequence Number=SeqID_3955
LITGLCQSFGVPVTPSKVIRPPIIRAFIEKYCKPRQALGNAPQAADAPPPPHQADPAGSLGMERYLQHLVRHLSQQGQGFVPFACPTPEQFRTEVAWPGDWPEAQAGEAPAEAPGDAEEARMDEEMTGLLGFLGGSGAT

SEQ ID NO: 95641 - protein, 81 aa, Glycine max
  Coding DNA Sequence Number=SeqID_3956
MTINSWGSGLDGGGRRNSARHSIRGARDSMAINSWGSGLDGGGCMNDNQFMGLQIRFDGGGCTNNARQSICGAPDSMVEDA

SEQ ID NO: 95642 - protein, 138 aa, Glycine max
  Coding DNA Sequence Number=SeqID_3957
  Subcellular localization annotation: CTP_CleavageSite=23; ConfidenceScore=5.49e-01
MDDLTVNFRGARKARVRPADVPSSSTLPAPSTSATPTPAPLGSSTQDSQRFEAMLQSIHQGQILLLQSLQVIAPLGSILSIEQFIEKVSWPGTLPSVVREGEGPSAQVPQQASRAQVRQEAATLERLIEPSKCTRSRK

SEQ ID NO: 95643 - protein, 186 aa, Glycine max
  Coding DNA Sequence Number=SeqID_3958
RNEWAPFIDILALLIFGGVLFSNVDGLVDLAAIDAFLAYHNHKESPVVAMLADLYDTFDRGCRPVYPLQGHRSCVEKGKANWDQLLASMEGRLLIGSLARRKEESGFYLQAKDDRELRGSSNGIIGGYHKWLRVRTQGLDWLPNLKTVRDDEVKASEESDEVQALKAELERARVVEEKFKSIAIKV

SEQ ID NO: 95644 - protein, 23 aa, Glycine max
  Coding DNA Sequence Number=SeqID_3959
MATPMSIACYLDKDETEINEALA

SEQ ID NO: 95645 - protein, 593 aa, Glycine max
  Coding DNA Sequence Number=SeqID_3960
  Gene Ontology: Mol. function=protein dimerization activity; Cellular component=endoplasmic reticulum lumen; Biological process=proteolysis
  Homolog annotation: Hit_ID=A1HNK0; Match level="QueryCoverage=44%, HitCoverage=70%, E-value=1e-73, Identity=53%"; Hit description =Amidohydrolase
  Pfam annotation: Domain name=Gate; Domain location=174-273; Score =43.6; E_value=7.2e-10; Accession=PF07670.5; Description=Nucleoside recognition
  Pfam annotation: Domain name=Gate; Domain location=80-167; Score=6.4; E_value=0.78; Accession=PF07670.5; Description=Nucleoside recognition
  Pfam annotation: Domain name=M20_dimer; Domain location=434-543; Score=23.5; E_value=0.00077; Accession=PF07687.5; Description =Peptidase dimerisation domain
  Pfam annotation: Domain name=Peptidase_M20; Domain location=338-570; Score=34.2; E_value=4.9e-07; Accession=PF01546.19; Description =Peptidase family M20M25M40
  Pfam module annotation: Pfam domain module=Gate::Gate::M20 _dimer::Peptidase_M20; Domain location=174-273::80-167::434-543::338 -570
MSEEKIMAAPQSVTASAGNYLALILAILFFSGLLYKVEGFSWLGAFDFTTLGGSFGTIKESGSTFLGAGGISAKAGFLFALSLAPTVMLALGVLEIFTHYGAIRAAHTLLTPLLKPLMGLPGRCGLALITDLQSTDAGAALTKRWRISSKLTRVNNNPFDIFIVGARKGFHIAIHNLMPNVVMAYVLAEVLNLLGIMQFLGHAFAPLMGIFGLPGEAITVLLTAWLSSSASVGVAVSLMAKGLLSGTDITILAPAIFLMGSQLQYMGRLLGVADVPKKYWPLLMLTSIINAVIAMKLKLRPTSPASWNRLALRSRAASTRPPASWQEIDSGVPGPVLALRADMDALGHVIDGVACARHTCGHDGHSSVVLTAAQELLQEGAIKKGRLKLLFQPAEELGAGALAMIEGGALDDVEMILGFHLRPLEECQVGQATPAVIYSACSTLEVTIKGVPAHAARPHLGVNALDAAVQAVQAVNSIHLAPGLTWSVKATRFLCDAGVTNSVPDEARVVWDLRSQENAPMELLKEKVSQAIQHSVAALGATAEVVVLKEMPAAEIDADATALLSAAIVDVLGEQGLLAAKTTPGSEDFFYYP

SEQ ID NO: 95646 - protein, 86 aa, Glycine max
  Coding DNA Sequence Number=SeqID_3961
MQRVASCPYSRDLYGRELTRLLVIIPKVVISLLMVSRVESPTVATYPFSRRSMRDSWVRVPRTEYAWSRHQCLFEENVGKTGKDVI

SEQ ID NO: 95647 - protein, 74 aa, Glycine max
  Coding DNA Sequence Number=SeqID_3962
MPFCGRARRGSRVSLPKEENARSRHQRLFVENVWKSRRKPIIKNIPDLGVVFTFEEGRQKRGSCSYVPSIEEEI

SEQ ID NO: 95648 - protein, 65 aa, Glycine max
  Coding DNA Sequence Number=SeqID_3963
MEVEEEVLKRKPHAKRIFCYALSGESLALSAQSLHLKLIWSAKLTKAELSLFQLDLNSAKRWPAR

SEQ ID NO: 95649 - protein, 83 aa, Glycine max
  Coding DNA Sequence Number=SeqID_3964
MRDDAGHVPSPILEREPPRQSDEVHEDRREYAQGGIDFYPPVPVEGLAPNILPQPNLPALPIFLSTEGPPSAAEERRKLDLIE

SEQ ID NO: 95650 - protein, 163 aa, Glycine max
  Coding DNA Sequence Number=SeqID_3965
  Homolog annotation: Hit_ID=UPI00006A2D9E; Match level="QueryCoverage =80%, HitCoverage=85%, E-value=4e-13, Identity=17%"; Hit description =UPI00006A2D9E related cluster
MDTSEPYTGAMKGTITLALRGLHVLVFKGLHVLAFRGLHVLTFRRLHVLAFRGLHTLIFRGLHVLTFRVICALAFTGLHILAFRGLHALAFRGLHALAFRGLHVFTFRGLHALAFIGLHAPAFRGLHALAFRGLHVFAFRGLHALAFRGLCSQRQVCRIAQVV

SEQ ID NO: 95651 - protein, 192 aa, Glycine max
  Coding DNA Sequence Number=SeqID_3966
  Gene Ontology: Mol. function=phosphoprotein phosphatase activity; Biological process=intracellular signaling cascade
  Homolog annotation: Hit_ID=A7PI29; Match level="QueryCoverage=100%, HitCoverage=61%, E-value=1e-23, Identity=31%"; Hit description =Chromosome chr13 scaffold_17, whole genome shotgun sequence
LRVDGAPLIGQTNLDWADLCDELLGVRPQEGELQGSVVKLSWSAQHFSQLNNHDGDVQQLQRFTHAWILRFIGGVLFVDKSTSKVSLREMCSATDYKTKSIGDICILIQMWAWERFTTLAPKRTPPVIEKKPLRHRWLRRGNQHIGNDDLIVFRRKLDITKRHEFLWEPYTTIVMSALPPICLVGSVAWCTV

SEQ ID NO: 95652 - protein, 182 aa, Glycine max
  Coding DNA Sequence Number=SeqID_3967
  Homolog annotation: Hit_ID=UPI00016621D1; Match level="QueryCoverage =71%, HitCoverage=40%, E-value=1e-11, Identity=34%"; Hit description =UPI00016621D1 related cluster
GYTPSPLEDYTSSPSEDYTSSPSEDYASSHQRTTRPHLQRTTRPHLRGPHVLTFRGLRVLTFVGLHALTFRGLHALAIRGLHVLTFVGLHALTFRGLHALAIRGLHVLTFVGLHALTYRGLHVLAFKGLHSLTFRGLHVLTLRGLHVLTLRGLHALSFRGLCILIFSVLHIHTLREFKVLCP

SEQ ID NO: 95653 - protein, 166 aa, Glycine max
  Coding DNA Sequence Number=SeqID_3968
MFFASGLYFQNIIEVPSVYHKQWAPDYPNYVVLDYNGKKHHIRVRKFSNRVYIGDGLKHFRRDMGIYEGVMITFAAPDKNWKFDIHFSPPLHTQTCGRLAHSAREYVFTVDVDNRMIVRLYPLVLSLDAVSYVNARDEYVTVLGVHGRRHFWKLSMHNGLQCFAEP

SEQ ID NO: 95654 - protein, 413 aa, Glycine max
  Coding DNA Sequence Number=SeqID_3969
GLVDRAAINAFLAFYDRKEGSVVAILADLYDTFDRRCEKNNARIVFCTPALYVWLISHFFCQEMRHVCPLESHRLCTEKKEENWDRLLASKEGAPVNWFPQWKEGRAGILISWAPSEEGLTPFIARGFNSTNAGVFRSPQGMGDGAKEGQGIRGSSNGPIGGYHRWLKAYMQGLDWLPNLRTTKGVEVEAPEEDEEVQALRTELEKAQTVKEKFKSTALRIRKENVKLRDINIATTKALEQETKRACREEHDRNKFRGALWGSNSELKLWREKRDQTRVDSLILKDELRICLRSNRSLSQRLCETETNMLAIISKYQEELNIATAHEHKVADEYARVYVEKEARGRVIDSLHQEATMWMDQFALTLNGSQELPRLLAKSKAMADAYSAPEEIHGLLSYCQHMIDLMAHIIRNH

SEQ ID NO: 95655 - protein, 120 aa, Glycine max
  Coding DNA Sequence Number=SeqID_3970
  Subcellular localization annotation: CTP_CleavageSite=8; ConfidenceScore=5.11e-01
MQVSSPVRAELTWVSNPCTKRVKKGEGEGFCTQKTLPPPSFKKQRLTGFTSFASLRSPFFAFLIPFCSIIHLRQEMAPKKLSVKRSRRDTAAEGTSAAPEFDSHRFRSTEHQQRFEAIKG

SEQ ID NO: 95656 - protein, 94 aa, Glycine max
  Coding DNA Sequence Number=SeqID_3971
MAPRKLASKRSRKDKATKGTSSAPEYDSHRFRSAEHQQHFEAIKGWDDEYTDFQEEIVHRRWASLVTPKAKFDPDIVLEFYANAWPTEEGVRDM

SEQ ID NO: 95657 - protein, 165 aa, Glycine max
  Coding DNA Sequence Number=SeqID_3972
PTYNNKPQETQHKYAQAKVEYVKRLYDQVKVQIERRMKAMPSKPSRKGRKWLKAQVEKDESPRVEKDEGPSPYDEDITKGKDHEALEGPMTRGRLKQAQHVIETRLTYQGNPCGVYPDLSSFTGSGVYPDLSSFTGSGVIQIFVTCIKRSAPTQVHIIWYQSFGS

SEQ ID NO: 95658 - protein, 44 aa, Glycine max
  Coding DNA Sequence Number=SeqID_3973
EKKGEACHPARPGELGCFFQKAPPSGELPGRPKWAWLLFAPLVY

SEQ ID NO: 95659 - protein, 159 aa, Glycine max
  Coding DNA Sequence Number=SeqID_3974
  Homolog annotation: Hit_ID=Q6UUU1; Match level="QueryCoverage=37%, HitCoverage=40%, E-value=1e-18, Identity=78%"; Hit description =Putative uncharacterized protein
MPERGEARGNSVSLTIAGIKLIDTVDLEGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 95660 - protein, 448 aa, Glycine max
  Coding DNA Sequence Number=SeqID_3975
  Gene Ontology: Mol. function=nucleoside-triphosphatase activity; Cellular component=integral to membrane; Biological process=protein catabolic process
  Homolog annotation: Hit_ID=Q9FIM2; Match level="QueryCoverage=72%, HitCoverage=33%, E-value=2e-84, Identity=53%"; Hit description=Cell division protein FtsH
  Pfam annotation: Domain name=FtsH_ext; Domain location=160-373; Score= 28.4; E_value=9.7e-07; Accession=PF06480.6; Description=FtsH Extracellular
  Subcellular localization annotation: CTP_CleavageSite=63; ConfidenceScore=5.31e-01
MLPLEHHFRYHPPLTLTKLKPFSRANSRVSLPHIDNSFHRFNPNPCRFRCPISSNDSLRFGLRVGHRASWVCRSTGEPDSAADSGEKKTGSSSSDEDADSNRRKGGWWSRWRRWRWQPLIQAQEIGVLLMQIGIAFFVMRLLRPGIPLPGSDPRSSTVFVSVPYSEFLSRINSDQVHKVEVDGVHIMFKLKAGVGTSNDDGGDVVASSTSSTTRLQESESLAKSVAPTRRIVYTTTRPSDIRTPYEKMLDNKVEFGSPDKRSGGFFNSALNEAIVLFYQKNFTQSMLNINNYDEGAGVKSRYFGVYFFLKRRAVRDVDAAPILWLLHRFPVSFSQHTAGQIWNRKSGPSAGTKSSEQGETITFADIAGVDEAKEELEEIVEFLRNPDRYVRLGARPPRGVLLKHSAGIILSKTETELQQLESEYSLKQAKILRAWFSPSQGLNHTSSG

SEQ ID NO: 95661 - protein, 35 aa, Glycine max
  Coding DNA Sequence Number=SeqID_3976
MSDTMLKAQVEKDGGLSGEGQSPQVEKDEGSSGDG

SEQ ID NO: 95662 - protein, 97 aa, Glycine max
  Coding DNA Sequence Number=SeqID_3977
MGEVEEVQEQMEADMEAMKEQMATMMEAMMSVEKIMEANAVAVATTRAVTKHAFPPYGLRLNYTPPNVAYTPNKNVNNSTSIPIESQQPQTDHAHVS

SEQ ID NO: 95663 - protein, 113 aa, Glycine max
  Coding DNA Sequence Number=SeqID_3978
  Homolog annotation: Hit_ID=A6N1H4; Match level="QueryCoverage=25%, HitCoverage=26%, E-value=4e-09, Identity=96%"; Hit description =Retrotransposon protein
MGDKLHRREGNSPDHQLRPLNDRSVIKEMNGAKRSAEAVGCKKESVGERSALEGRTRASSAGRSGSENVGLSNANVGENPMPRKPKGPKIRPKGVVDGQQEARLAESGIGQDA

SEQ ID NO: 95664 - protein, 141 aa, Glycine max
  Coding DNA Sequence Number=SeqID_3979
  Pfam annotation: Domain name=Transposase_23; Domain location=3-73; Score=-5.6; E_value=0.0048; Accession=PF03017.5; Description =TNP1ENSPM transposase
PKTGHSDRCGLYIETDPARLVTLGRVYEGSTIVHNTPLLSGQVKVGVEEVTDADAPVPVPTDEVSLVGQILHTFLAWSTHLVKSLSQQVVVSLPKPPPKPDPEVDDPLYLMTLTIPELFLRPYQVTWDATVFGVFNPHFSL

SEQ ID NO: 95665 - protein, 148 aa, Glycine max
  Coding DNA Sequence Number=SeqID_3980
MVLKTSRRFVPVEIRFSCEVGLRQYVGCRPLDGDQGVEIDVSLGILSTILVNLVQLSRRLPFKDAGRDDVSSIGACRPRIFFINGFLCFLEDEWQRNGERKREKRRHFKEKMSLEEAHHHRRSWIRAWRKKEMNEGRGREEHEILCSK

SEQ ID NO: 95666 - protein, 133 aa, Glycine max
  Coding DNA Sequence Number=SeqID_3981
MGPDGCRETRGTGTREAACKPRHDFSIQKVKFFSFVAEYEVKSREKANFISFSPSFHIAFLLPSSPPLLSIEAPKSLLISTQNCKEKPFLESWSTPLHRGTSNFRHGWTSSHMKFVGVGFLGVMMGSSTRLLP

SEQ ID NO: 95667 - protein, 112 aa, Glycine max
  Coding DNA Sequence Number=SeqID_3982
MAAQLIRDRVEMECLEGAWETLEGNTRCRFRGTIRFMATFFVIEVTSSEEDPEEDLEELPPEPAVDALDFLEGDEDPLLEVDSPEEVMSASEADSTEDSGPREMAISGGSSS

SEQ ID NO: 95668 - protein, 72 aa, Glycine max
  Coding DNA Sequence Number=SeqID_3983
  Subcellular localization annotation: CTP_CleavageSite=18; ConfidenceScore=5.05e-01
LSFTTANWRCCGSALIISLKPRTQGWAKPFSSCLLRKFPLVGILSLINRQANIVGFKGILSCHRSSKASSTV

SEQ ID NO: 95669 - protein, 83 aa, Glycine max
  Coding DNA Sequence Number=SeqID_3984
MNRPTRGERRFAYWALAECILAYYVGTDEAAPVRQQEYVIQDIFPLPRSLTRYARRSTAASGNGLRTGRRFPGRCQERYLTGE

SEQ ID NO: 95670 - protein, 137 aa, Glycine max
  Coding DNA Sequence Number=SeqID_3985
MIGKRVCFYVGLVLLKRQPSDFYQILDLVFKGQALFGGVAQGFPMVCTGCIRVIPLWERRLVDLSRRYHNHLVGDEGWQEVFVRHWDRGECWPRGKVPYRVGNGAKVGIAGQASRGWSRSLGGLPLDGHRCPSLYGC

SEQ ID NO: 95671 - protein, 159 aa, Glycine max
  Coding DNA Sequence Number=SeqID_3986
MEVSVGLCRSDIDKDHAHKTPSGPGEVQQGPRVSSSSYGPLLVLQGARSPHFTECPSPPARSCHHDIGIAPARHPVDPKKSNRVLGFPALITCLCQFYKVPVARSKFIRSPINRAFIKKYSAPRQAQGETPQHPRDGQQRATNALPPPLEFTSAHPQKG

SEQ ID NO: 95672 - protein, 168 aa, Glycine max
  Coding DNA Sequence Number=SeqID_3987
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
MASISEVMLKLQKTIKDKATATASSTVREAESVLQPALNPGLDRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 95673 - protein, 84 aa, Glycine max
  Coding DNA Sequence Number=SeqID_3988
MEQVSKWNLLQELGFPHALLDAIQDKEQLDDRTKLLGGYGDWLQVWSGLGKALLEEKTCSLMMEEWKQMLNIQNFLRHDSQVPF

SEQ ID NO: 95674 - protein, 85 aa, Glycine max
  Coding DNA Sequence Number=SeqID_3989
MSNEELKLKDPRCRIQCPDILLENTGSAVQCKIKIFRKKIDLLQHQELAAQNRTRLYNHGGCTSSDLSVFVSHLDGILTSSVGPE

SEQ ID NO: 95675 - protein, 49 aa, Glycine max
  Coding DNA Sequence Number=SeqID_3990
MKNWMQSSKWDAYLGAYLNGALKGVDDTSQPKSMAAGARWIVVKLTLNI

SEQ ID NO: 95676 - protein, 200 aa, Glycine max
  Coding DNA Sequence Number=SeqID_3991
MVKRMRRKGWLRFVSLTVAAHTIEREKRMSKRRMLRLDGFVWDRLLAVGRGSEESVWCLLTGRWEVAMGRGGNVVSTVGGGSMVFAVGGGLAEEEDGLVTLGSKGDIDGDFSKAEDGEGCLGTMVFSIRRMSSSLEAMEVWAAVVEVWIAASLAMAASRRSTQAVESSVSAIEEWQVGPIVSGGSLKFETKGSLQEEERK

SEQ ID NO: 95677 - protein, 107 aa, Glycine max
  Coding DNA Sequence Number=SeqID_3992
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=55%, HitCoverage=47%, E-value=6e-21, Identity=81%"; Hit description =Putative uncharacterized protein
MPGRYLTGNESYYNSLAVLLQRLDWKNPGVTQINRLAAHPPFASWRNSKEARTDGPSQQLRSLNDEWDAPCSGAITAAGVVVTLSVTATLASADVRRCFCRYPPPRL

SEQ ID NO: 95678 - protein, 170 aa, Glycine max
  Coding DNA Sequence Number=SeqID_3993
MGKVKEVQEYMEADMEAMKEQMAAMMEAMMSVKKIMEANAVAIAATSVVAKVNPTSPSDINQMNHPTSDKTHEIRHHNLADFEPWLRYAIEGQTVGGIPLENTSEGPQYHPQLYLLHSTTSKNPRAMAEMEKLDHLEERLRAIEGGEDYAFANLKELFLEPNIITPPKFK

SEQ ID NO: 95679 - protein, 141 aa, Glycine max
  Coding DNA Sequence Number=SeqID_3994
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
MYEQHTDTQLRHLGCKNDHAHNPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 95680 - protein, 100 aa, Glycine max
  Coding DNA Sequence Number=SeqID_3995
MEYRDKPITTLLEGIRFYISSKIVKLRTILMRYEGSICPKVQEIIEKNKKACEAWQAHWCGDVDLSLFKVSKGMKSTVLTTYSFIVYPCNGLNLRELTRG

SEQ ID NO: 95681 - protein, 170 aa, Glycine max
  Coding DNA Sequence Number=SeqID_3996
MAKFDPEIVMEFYANAWPTEEGVRDKHSWVRGQWIPYDEDAINQFLGHPLVLEEEQHWITPPRHPVDPEKSNRALGFLALITSICQFYGMPVMPTKLIHPPINRHNSRGRTPSLESISAHMQRMELYMQHWAYQQVANHRGQVQLNETFYQYTLHQQRQDPSPYPWPTPE

SEQ ID NO: 95682 - protein, 62 aa, Glycine max
  Coding DNA Sequence Number=SeqID_3997
MTLRHVTRFGTPLRLRLITMGGVACARQGDLDTCCLVFLSESVVWTCLGYFLDEWYHIAFEN

SEQ ID NO: 95683 - protein, 925 aa, Glycine max
  Coding DNA Sequence Number=SeqID_3998
  Gene Ontology: Mol. function=nucleic acid binding; Cellular component= cytoplasm; Biological process=stem cell maintenance
  Homolog annotation: Hit_ID=A7PEX3; Match level="QueryCoverage=100%, HitCoverage=99%, E-value=0.0, Identity=74%"; Hit description =Chromosome chr11 scaffold_13, whole genome shotgun sequence
  Pfam annotation: Domain name=DUF1785; Domain location=211-263; Score =95.3; E_value=1.9e-25; Accession=PF08699.1; Description=Domain of unknown function (DUF1785)
  Pfam annotation: Domain name=PAZ; Domain location=264-401; Score =187.4; E_value=3.5e-53; Accession=PF02170.13; Description=PAZ domain
  Pfam annotation: Domain name=Piwi; Domain location=568-889; Score =531.1; E_value=1.2e-156; Accession=PF02171.8; Description=Piwi domain
  Pfam module annotation: Pfam domain module=DUF1785::PAZ::Piwi; Domain location=211-263::264-401::568-889
MKDPEEHPVKSRRPLQKSAERRRRCRRRSQCKIEKMQETELDSHLGFSSATCKSLVFHQRPGFGQLGTKCVIKANHFLADISVSDLSHYNVIITPEVTSRKTSKAIIAELVRLHRNTDLATRLPVYDGGRNLYTAGLLPFTYKVFNVTLSVDDDATGGTRERDFKVVIKFATRVSMHQLRELLSGKQVNNPQEALSVFDIVLRELAAQSYVSIGRFLYSPDVRKPQQLGGGLESWRGFYQSIRPTQMGLSLNIDMSSMAFIEPLPVIDFVAQILGQDVHSKLLSDADRIKIKKALRGVKVEVTHRGNFRRKYRISGLTSQPTRELVFPLDEQMNMKSVVDYFQETYGFTIKYSHLPCLQVGSQRKVNYLPMEACKIVGGQRYTKGLNEKQITSLLKISCQRPREQETDILQTIQQNNYENNPYAKEFGISIENKLASVEARVLPAPWFFHYDYIIFWLFLSLKLKYHDTGREKEYLPQVGQWNMMNKKVINGSTVRYWACINFSRSVQESTARGFCQQLVQMCQISGMEFSQDPVIPIYSARPDQVKKALKYVHSAAIDKLDGKELELLIAILPDNNGSLYGDLKRICETDLGLISQCCLTKHVFKINRQYLANVALKINVKMGGRNTVLLDALSWRIPLVSDIPTIIFGADVTHPESGEDSCPSIAAVVASQDWPEVTKYAGLVCAQPHREELIQDLFRCWKDPQRGVVYGGMIRELLLSFKKATGQKPLRIIFYRDGVSEGQFYQVLLYELDAIRKACASLEPSYQPPVTFVVVQKRHHTRLFANNHDDRNSTDKSGNILPGTVVDSKICHPSEFDFYLCSHAGIQGTSRPAHYHVLWDENNFTADEIQSLTNNLCYTYARCTRSVSVVPPAYYAHLAAYRARFYMEPDVAEITKLRGTRLKEGPVRPLPALKEKVKNVMFYC

SEQ ID NO: 95684 - protein, 43 aa, Glycine max
  Coding DNA Sequence Number=SeqID_3999
MKMFFIPHDVPPMWSFGMERRRHFKEKMSQEEAHHHRKPWIRP

SEQ ID NO: 95685 - protein, 418 aa, Glycine max
  Coding DNA Sequence Number=SeqID_4000
  Homolog annotation: Hit_ID=Q6WAY4; Match level="QueryCoverage=45%, HitCoverage=34%, E-value=2e-18, Identity=30%"; Hit description =Putative uncharacterized protein
MGTNQTGKRFYQVKVKGLDTTSIKELGRLMEPLKMQAFRKIYGKILELTIAEISIEAIASLTQYYDQPLRCFTFGDFQLVPTIEEFEEILGCPLGGRKPYLSSGCLPSLSRIATVVKDSARGLDRIKQTRNGIAGLPRRYLEDKARGMANQGDWVPFMDVLALLIFGVVLFPNVDGLVDLAAIDAFLAYHHSKESPVVVVLADLFDTFNRRISAHKISRLYKAIHKAWETPLRKDQELRGIHNGIIGGYHEWLKVHIRGLDWLAKLKVVSKESFEAPEEDEEVQALKSELGKAKLAKEKFKLAATHIQKECAGLREENATTTRALEQETKRARKEEYGRNKFRGALWGSNSELKLRREERDQSRAHSMVLKEELVACSRSQRSLSQRLCETETNMLAIIAKYQEELGLAMAHELRIAD

SEQ ID NO: 95686 - protein, 198 aa, Glycine max
  Coding DNA Sequence Number=SeqID_4001
MGAKHLTRTKERSHVIKQRSPDEIRRATPPRLKRVAHPRLQKTTGPLHLKGCSPSPLEDWMSSPSGGVHVLDFRGLHVLALSGLHVLPLRGLHVLALRGLHILAFRGPHIQTSMASEHSCSLPLEDYTSSTLEGCTSFPSRGLHILPFKGLHLLTFRGLHALALRGSAHPHLQRTTAPLTLKGCTSSPLEDYVLDFGG

SEQ ID NO: 95687 - protein, 68 aa, Glycine max
  Coding DNA Sequence Number=SeqID_4002
MCKLLHSKATLSIMDLMYQKQIQMGVDADVAPEFSPLKTVQFGNPSQDTVDPRDGGFGGRLWRWKWEK

SEQ ID NO: 95688 - protein, 113 aa, Glycine max
  Coding DNA Sequence Number=SeqID_4003
MEDRVTTDRSSSLSRRWASGGRRCKAAQYPLNSQLARLGELSSPRRATPVRKYERGGGGTFSSPKTLPPHFKNSQAHGNYKNSSPQASVVEFCFSFHALIHSPQGKALACVVF

SEQ ID NO: 95689 - protein, 150 aa, Glycine max
  Coding DNA Sequence Number=SeqID_4004
LKTPEEVIELIENMSANDHGHFALQSSSTHKENLVTGCTICGEAYETSQCIPIEENTQEVHYMGNQQRQGYTQGGFLGFQPIQQGPNIFQRTSKLEETLTQFMQVTMSNHKSTESALKNLEVQAEDEDSVVSKKKAARKKGTDEKKNDVR

SEQ ID NO: 95690 - protein, 118 aa, Glycine max
  Coding DNA Sequence Number=SeqID_4005
MVKEECKKVSVSSKRLAKKESHFAIKTNIIETSLLRQSPHLFLCKRTLVSSAIPLKLEVIPQVKELLDEGLVHKNLNLCALLVPKICIIRHQIPKIGGIMNVLSGATLLCKITHATSS

SEQ ID NO: 95691 - protein, 254 aa, Glycine max
  Coding DNA Sequence Number=SeqID_4006
  Gene Ontology: Mol. function=hydrolase activity; Biological process =proteolysis
  Homolog annotation: Hit_ID=Q1CVN3; Match level="QueryCoverage=94%, HitCoverage=90%, E-value=5e-66, Identity=50%"; Hit description =Hydrolase, alpha/beta fold family
  Pfam annotation: Domain name=Abhydrolase_1; Domain location=32-238; Score=95.5; E_value=1.7e-25; Accession=PF00561.11; Description =alphabeta hydrolase fold
  Pfam annotation: Domain name=PGAP1; Domain location=2-161; Score= -89.6; E_value=0.085; Accession=PF07819.4; Description=PGAP1-like protein
  Pfam annotation: Domain name=Peptidase_S9; Domain location=21-247; Score=-74.5; E_value=0.037; Accession=PF00326.12; Description=Prolyl oligopeptidase family
  Pfam annotation: Domain name=Thioesterase; Domain location=6-240; Score=-48.8; E_value=0.096; Accession=PF00975.11; Description =Thioesterase domain
  Pfam module annotation: Pfam domain module=Abhydrolase_1::PGAP1::Pepti dase_S9::Thioesterase; Domain location=32-238::2-161::21-247::6-240
PGGEKPTLIALHGLTGSGACWSQMARELEPHYDIIMPDARGHGMSSAPQHGYTYQDHANDVIELIRTLDIKNPYLLGHSMGGMTAAMVASRLGFAISGIILADPTFISPEWQDQVYESGIVDQHRQMLKSTREALFKEAKAKHRFRSSELLEHIVEARLQTSVKAFDVLIPPNPEFEELIRNIYVPTLLVLGSEGIVSSETARELHEINPDLQYKLIPDVGHGLPYDEPVRLAAAIDAFLKPRFKTKQRMKTPS

SEQ ID NO: 95692 - protein, 236 aa, Glycine max
  Coding DNA Sequence Number=SeqID_4007
  Gene Ontology: Mol. function=aspartic-type endopeptidase activity; Cellular component=small subunit processome; Biological process=DNA integration
  Homolog annotation: Hit_ID=A5ARL5; Match level="QueryCoverage=61%, HitCoverage=9%, E-value=8e-20, Identity=33%"; Hit description =Putative uncharacterized protein
MVSNREGRGGHGNRGGRAGRGGLPQCSFYKRVDHTQDTCYSIHGFPRKSVNISKSETSEIKFSKTDYQEYLQLKAAKESQTSSSISGHNSTACISQSGNNQSPWIIDSGASNHIASNSSLFSSLSPPKIPHFFTLADGSRVAATGIGHERGTGRTIGVGHESHGLYYLKPNLSWRRCEMLLMNSLSETDWLSKPHSLSEATNSLSGCKTLEEDKSESNALNTQPACLARTLSLLVA

SEQ ID NO: 95693 - protein, 138 aa, Glycine max
  Coding DNA Sequence Number=SeqID_4008
MNFAARKPVEFTLIPVSYAELLPYLLDNSMVAITLAKVHQPPFLREYDSNATCACHGEAPGRSIEHCRALKLTMLNEMDKVDIFVPHPLTNASLLIQLSPECGCKPLVCLLKRPALLSVDFQDRSIRDYSSCTLVGVP

SEQ ID NO: 95694 - protein, 234 aa, Glycine max
  Coding DNA Sequence Number=SeqID_4009
  Gene Ontology: Mol. function=chloramphenicol O-acetyltransferase activity; Biological process=response to antibiotic
  Homolog annotation: Hit_ID=P62577; Match level="QueryCoverage=81%, HitCoverage=86%, E-value=1e-111, Identity=100%"; Hit description =Chloramphenicol acetyltransferase
  Pfam annotation: Domain name=CAT; Domain location=6-196; Score=430.3; E_value=2.7e-126; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQFIMPFVMASMSAECLMNYNSTAMSGRRGVIFLRQLLVPRNILSD

SEQ ID NO: 95695 - protein, 215 aa, Glycine max
  Coding DNA Sequence Number=SeqID_4010
CWIYEYFSSVHQCVTDDGYAETTPRASRWLTMKAHMNGIKGALYRARLDALTITNVSWLPYTEHRAGQLRWGHVVVYVRLKRVVRQFGYIQTIPPPPVTGSLSYEDIDDRWMHLRDHLAPASEICVAHNQEGDEPRHPPAPNVDAYVEPHIPEVPVAADFPRHSVVACEGCEAITERLERVLNLRMVTVGTELYEIMEDCLRIARGDASDGSLRA

SEQ ID NO: 95696 - protein, 132 aa, Glycine max
  Coding DNA Sequence Number=SeqID_4011
MVAWPGTQPSLHREDEGPTAQVPQHMEDESSEATIPEPFDIGEEAEETQVRQVATATPERSLKATSKPFAPVVNLPSPQPAANPFTPLLEMPEDPTTPFLAMDTSPPTTPVLQLIDEEDGQTQDTQDQSYEF

SEQ ID NO: 95697 - protein, 250 aa, Glycine max
  Coding DNA Sequence Number=SeqID_4012
MDMNLGSFISSQITLMAQHDSSKLGFPALITALCKAQGVHSNSLTHERLSRAINLAYIKKNYWNLDDPTVTCRGPRKARGKRFEAPSTSASEAPTPPSSTVPPSSSTQIPVIPPVPLQMPLLASLSTGPSDFIFTPQMLHFMLQSIHRGQSIIMQSLQGLGLPSIMSMEEFETQVTWLGDQPSSFGGGGASAAQEPVTEEPPTPTPAAAEEQTTPDQTPQPSPSSALAPEETQPSTLDHNEDHPQEEQDV

SEQ ID NO: 95698 - protein, 106 aa, Glycine max
  Coding DNA Sequence Number=SeqID_4013
MSRSPCHVQATPSPPTHGDQPESQGSSKLSDMPPSTSIPPHEKLQRCLKLFNHSISSTKDIQQGHCTPHVHTEHNIITVHFQHHQHFISTSTSSHLNDINNNIISY

SEQ ID NO: 95699 - protein, 120 aa, Glycine max
  Coding DNA Sequence Number=SeqID_4014
MKKLRKHIGLDFILFPLLSQPSKVKYAYLGLRGFYESITVATYPSTGGRRETRGMRVPRKEYARSRHQRLFEENVGKTGKDAIYELISERFGSCIYARGRGETLRRWTINDLLSLKGEKR

SEQ ID NO: 95700 - protein, 94 aa, Glycine max
  Coding DNA Sequence Number=SeqID_4015
  Subcellular localization annotation: CTP_CleavageSite=71; ConfidenceScore=5.20e-01
MTSFPVLPTFSSNKRWWRLRAYSFLGTRTRESRIALPPKGRLQHISLKILTSLQACSRTQCLLKGNGRRSRGSESKNQNIRSPSEEYTSQSLNV

SEQ ID NO: 95701 - protein, 115 aa, Glycine max
  Coding DNA Sequence Number=SeqID_4016
MVKVGTSYVPINVSFSPKVGPGLPGIIKQLGFELVVNAWVVCTRIKLIDTVDLEGGPVKCFMWQEKKGCTGASAEYVIQNIPLPRSLTRYARSFTAASGKWLTRGGIRFPGMPVL

SEQ ID NO: 95702 - protein, 345 aa, Glycine max
  Coding DNA Sequence Number=SeqID_4017
  Gene Ontology: Mol. function=homocysteine S-methyltransferase activity; Cellular component=intracellular; Biological process=folic acid and derivative biosynthetic process
  Homolog annotation: Hit_ID=A8GKE4; Match level="QueryCoverage=100%, HitCoverage=28%, E-value=0.0, Identity=95%"; Hit description =Methionine synthase
  Pfam annotation: Domain name=B12-binding; Domain location=222-344; Score=93.9; E_value=5.1e-25; Accession=PF02310.10; Description=B12 binding domain
  Pfam annotation: Domain name=B12-binding_2; Domain location=132-215; Score=160.2; E_value=5.5e-45; Accession=PF02607.8; Description=B12 binding domain
  Pfam module annotation: Pfam domain module=B12-binding::B12-binding _2; Domain location=222-344::132-215
MLAVATGIEEHNIYAVDFIEACADIKTHLPHAMISGGVSNVSFSFRGNDPVREAIHAVFLYHAIRNGMDMGIVNAGQLAIYDDLSAELRDAVEDVILNRREDGTERLLELAEKYRGSKDNDVAVQQAEWRGWPVEKRLEYSLVKGITEFIELDTEEARQQAERPIEVIEGPLMAGMNVVGDLFGEGKMFLPQVVKSARVMKQAVAYLEPYIEASKQQGTSAGKILLATVKGDVHDIGKNIVGVVLQCNNYEIVDLGVMVPTEKILRTAREENVDIIGLSGLITPSLDEMVNVAKEMERQGFTLPLLIGGATTSKAHTAVKIEQNYSGPTTYVQNASRTVGVVSAL

SEQ ID NO: 95703 - protein, 129 aa, Glycine max
  Coding DNA Sequence Number=SeqID_4018
MGKNVSALIGKSVPHIPEKCKDPGRPFMKTARTKIDVYAGTLSMEFGDIVVHLNILDAMKHPSEDHSIFRAKIIDQIVDDYMFDFDNVLHGRKHPFLSDLHTCHSLCIVSESEFEFDPVIEAIPESNKH

SEQ ID NO: 95704 - protein, 735 aa, Glycine max
  Coding DNA Sequence Number=SeqID_4019
  Homolog annotation: Hit_ID=Q5XV54; Match level="QueryCoverage=98%, HitCoverage=98%, E-value=1e-161, Identity=46%"; Hit description =Putative uncharacterized protein
  Pfam annotation: Domain name=DUF630; Domain location=1-60; Score =104.3; E_value=3.7e-28; Accession=PF04783.3; Description=Protein of unknown function (DUF630)
  Pfam annotation: Domain name=DUF632; Domain location=290-649; Score =437.2; E_value=2.3e-128; Accession=PF04782.3; Description=Protein of unknown function (DUF632)
  Pfam module annotation: Pfam domain module=DUF630::DUF632; Domain location=1-60::290-649
MGATNSRAEKNEALSLCKERKRFIKVAIDSRYALVAAHVSYIQSLRNVGIALRRYAESQVEVESSLSISNKTPSQTSYPSPSSPSHVAEVEVLESPLHTESPLSPPVATTLSYMRSGGSAAVTVRINAFGNNNYLDDESTVVPMPPPPPPPPESGASWDFFEPAEDSDSFRFAVHCSESREFRDEEKGDQWLHVGSDRHCMMQPLLDEKFSGNFSSAAMGNECGNSYAHCLDNSTVSRGVEGGKGMVDGEVRELELPSAAGDVSRAVANKGAGGRSSAKREQNMAGKNASTEREDPSEFITHRAKDFLSSIKDIEHRFIRASESGREVLRLLEANKIKVGYSEAKGKSSTTALLSAVQPVCCGRKASPVFQEPAQKIISWKRTASSRSSSSRNALATKTKEDIDDSGSDFVEEFCMIAGSHSSTLDRLYAWERKLYDEVKASEFIRKDYDRKCHQLRHQFAKDQGTHVIDKTRSVVKDLHSRLTVAIYSVDSISKRIERMRDEELLPQLLELTEGLIRMWKAMLECHHAQYITISLAYHSRSTPGTLQGDALREIMTRLLEEVEFFGLSFANWINSLTSYVEAVNAWLQNCILQPRERTKSRRPFSPRRVLAPPIFVLCRDWSAGIKALPSEELSQAIRNFLSDLHLQTEQHNDQLLKKQNSVNASMAETESKTNEENEDESTNLSCIHARLTKVLDRLTKFSEASLKMYEDIKQKSESARNAYHNCRTIRAEKF

SEQ ID NO: 95705 - protein, 111 aa, Glycine max
  Coding DNA Sequence Number=SeqID_4020
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=41%, E-value=5e-18, Identity=100%"; Hit description=LacZ protein
MKHFTDTLISANISGRHRGGAPIRPIVSRITIHWPSFYNVVTGENPGVTQLNRLAAHPPFASWRNSEEARTDRPSQQLRSLNGEWDAPCSGALSAAGVVVTRSGDRYTCQR

SEQ ID NO: 95706 - protein, 72 aa, Glycine max
  Coding DNA Sequence Number=SeqID_4021
  Homolog annotation: Hit_ID=A5AUB4; Match level="QueryCoverage=51%, HitCoverage=3%, E-value=1e-08, Identity=78%"; Hit description =Putative uncharacterized protein
MQNHLLALTFKYYMTILLCNRPIIQVDGTHLYGKYRGTLLMATSQDGNGGVLPLAFVGRDANSMVMVFGPLA

SEQ ID NO: 95707 - protein, 78 aa, Glycine max
  Coding DNA Sequence Number=SeqID_4022
  Homolog annotation: Hit_ID=A5BSC1; Match level="QueryCoverage=98%, HitCoverage=4%, E-value=1e-14, Identity=39%"; Hit description =Putative uncharacterized protein
MTGDSSKFTHISPKKSGHVTYGDNNKGRILGVGKIGYRVNNVYMIDLSQKLDNNKCFLSKDDDPWLWHKRIAHINMEH

SEQ ID NO: 95708 - protein, 67 aa, Glycine max
  Coding DNA Sequence Number=SeqID_4023
MEEFMAQVAWPGVQPSPLGGEVSEGEEDAEDTDYAADLQEAQSTWEPWPTAAQETPQSAQDTSSPHG

SEQ ID NO: 95709 - protein, 67 aa, Glycine max
  Coding DNA Sequence Number=SeqID_4024
MAPYSGVFRLSSAGRDDNLSVVTLAFICIRPKYLKVGSDNAWQIVTASSTYLDWFLLLALSRPPIVA

SEQ ID NO: 95710 - protein, 112 aa, Glycine max
  Coding DNA Sequence Number=SeqID_4025
  Homolog annotation: Hit_ID=A7PAC9; Match level="QueryCoverage=50%, HitCoverage=44%, E-value=5e-10, Identity=58%"; Hit description =Chromosome chr14 scaffold_9, whole genome shotgun sequence
MLTLLAEPTPQQLAGHCRAYILGLIGGVLMPDKSSNTVHPMYLPLFVDLDQVGWCSLGLGCLTHLYREMCRVIYPTSKKYGDVHYFYSLGHGIAYHSFNQGSSTSCHIHLLI

SEQ ID NO: 95711 - protein, 75 aa, Glycine max
  Coding DNA Sequence Number=SeqID_4026
MPSHIGIAPAGHPVDPKKSNRVLGLSALITGLCQFYGVPVTPNKVIRPPTNQAFIKKYCAPRQAEGETPQKPGDG

SEQ ID NO: 95712 - protein, 72 aa, Glycine max
  Coding DNA Sequence Number=SeqID_4027
ATKSKAKDKQNYYAYDRQVITRSAQDVKEALLGGNLELATKKLPAKWSMKGIIEEDSSVAPQADTGFDKHRF

SEQ ID NO: 95713 - protein, 34 aa, Glycine max
  Coding DNA Sequence Number=SeqID_4028
MDPFGGSRSLYTPPKIEVHMEGHLVIVSGEEDIL

SEQ ID NO: 95714 - protein, 227 aa, Glycine max
  Coding DNA Sequence Number=SeqID_4029
  Homolog annotation: Hit_ID=Q6UUU1; Match level="QueryCoverage=26%, HitCoverage=40%, E-value=3e-18, Identity=78%"; Hit description =Putative uncharacterized protein
GHQDYLFCEVISVTGIYSAQSASAVPPVQLLTGWCVTAKAPPDISAGKCSGHAARRVPFAIQAAQLLGRAIGAGLFAITPAGERGMCCKAIKLAITSFGYRKDDDGRWVWIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 95715 - protein, 277 aa, Glycine max
  Coding DNA Sequence Number=SeqID_4030
MLAIIRQYKEELNQSLAHEQKLVEDFAQAYAEKEARGRVIDALHQEATMWMDRKLTITKKAQRHPYNTRSKSKMGNEEGVQEQMKADMSTLKDQMASMMEAMLKIQKSIEDNATAVATNITREAKPVLQPAMNSGRDRSTTGFNLRYSPQAYPYGLHPNFTPRTAPDNLSQAPTFEGQLPPHANYPLEEDDEGDAHLGPLLPPREPTPHKLPQPNIIYHAPSQSTPVREPVPISKEKGKIDLLEERLRAVEGLGNYPFSDIADLCLVPDIIIPPKFK

SEQ ID NO: 95716 - protein, 90 aa, Glycine max
  Coding DNA Sequence Number=SeqID_4031
IHSYINIRNNATSRGLRSHTLNKPKLIHNGLSVTLISKIIERPQGHDVFDDAHHIGQHRLKGAFTQTRDPQANNIPKILKATLPPDSVQP

SEQ ID NO: 95717 - protein, 242 aa, Glycine max
  Coding DNA Sequence Number=SeqID_4032
MFPQQQTSAIQQIPTASSAPSSSEIIFEFLFLLCYHLPAALGESPCPQGDDLVLADPNPPKTFHPKTVLAIELILPMEHPGQRMNDGSPEWLRETVKLQTISHSADPIKYLEGTVEVFGQFVRNCLRSLGGPLPVRSEFQENPIPRLISYLPTLDISVVIHDSLGLDQLFSNAVKHFIHVIQHVVNDVYVQGSQEVFWEIEGLADKGNLIWGGPYSHVPRSIVGPFNPREKLSPRSGPAMNK

SEQ ID NO: 95718 - protein, 71 aa, Glycine max
  Coding DNA Sequence Number=SeqID_4033
MTKVDIVVAAGGWLRGPVPPREKGQGRRTEKKQERIFSLTELVRNVPSAVDKRYLANPNFQLSTFVRRHNL

SEQ ID NO: 95719 - protein, 65 aa, Glycine max
  Coding DNA Sequence Number=SeqID_4034
MTLKNFMLENAGTQCFDRIGCHTVVRRQVTVARDGHQWSWVVEEEVLGLGWAFEEKKVKIVFFSP

SEQ ID NO: 95720 - protein, 65 aa, Glycine max
  Coding DNA Sequence Number=SeqID_4035
  Subcellular localization annotation: CTP_CleavageSite=49; ConfidenceScore=5.31e-01
MVKSYPFELQSKKRRTSLKCTAVTSSFLSPIWRLPMTLPTSLSCMPWALANVVNGGSWWKAKNPP

SEQ ID NO: 95721 - protein, 51 aa, Glycine max
  Coding DNA Sequence Number=SeqID_4036
MAMAEVASGNVGSGNGDNSVVCGGMVVVVESAKARCNGGGMVEALTMMEWW

SEQ ID NO: 95722 - protein, 169 aa, Glycine max
  Coding DNA Sequence Number=SeqID_4037
MAPKKLSAKRCRRGAATEGTSAAPEFDSHRFKSAEHQQHFEAIKGWSFHRERRVQLRDDEYTDFQEEIARRHWTSLVTPMAKFDPDIVLEFYANAWPTEEGVQDMRSWVRGQWIPFDADALSQFLGDPLVLEEGFHPDRCREAGEDHAHQYDHLDPDVDDFAAQQCPAQ

SEQ ID NO: 95723 - protein, 259 aa, Glycine max
  Coding DNA Sequence Number=SeqID_4038
  Gene Ontology: Mol. function=motor activity; Cellular component=cell projection
  Homolog annotation: Hit_ID=UPI00016621D1; Match level="QueryCoverage =86%, HitCoverage=40%, E-value=3e-16, Identity=30%"; Hit description =UPI00016621D1 related cluster
LKGLHVFAIGGLHVVTFRGLHSLTFRGLHALTLNGLHVLGFRGLQTLAFRGVHALAFIGLHTLTFRVLLVLTFKGLHVLAFRGLHVPAFRELHVLSFSGLHVLSFKRLHVLAFTGLDALTLRVLNVLAFLGLHALAFVGLHALPIRGLHVLTFRGLHALTLSGLHMVHALTLKGLQVLAFRGLHTLAFRGVHALAFRGLHVLTFRVLHVLTFRGQHALTLKGPHALAFRGLTPSPLVDYSSLPSKDYTSSLSEDYTSSP

SEQ ID NO: 95724 - protein, 142 aa, Glycine max
  Coding DNA Sequence Number=SeqID_4039
MAQARIKNKGIGHHKVNDQAQNIDFNIRDSSEDESSESTQVSSPENQNYMSSSNEPAINRKGYSDLGDQLMQCSVTVMQICGMMKESQKIKELQIQDSVYVLEMARLNFHCYRIHLNISTNFCMILVYLIVKITNRTYGHIT

SEQ ID NO: 95725 - protein, 154 aa, Glycine max
  Coding DNA Sequence Number=SeqID_4040
MSAGREKAIYLFLRFYPFMARVAKALADRGEWAFFIDVFALLIFGVVLFPNVEGLVELVAIDAFLSYHHSKESPVIAILADVYDTFDQRCPPIHCKVTAYAPRKERQTGRFPNVPLMGTRGCINYNHVLAKTTWLLHERSTIGGKHHAFHCTGF

SEQ ID NO: 95726 - protein, 116 aa, Glycine max
  Coding DNA Sequence Number=SeqID_4041
TSIWPQLKPWNEEAIIDKCKEKLNLAATHEQRLEDEYAKISAEREVRERVIDSLHQEATMWTDRFALTLNRSQELPRFLAKAKAMADTYSAPKEIHGLLCYCQHMIDLMDHMIRNR

SEQ ID NO: 95727 - protein, 163 aa, Glycine max
  Coding DNA Sequence Number=SeqID_4042
  Homolog annotation: Hit_ID=A5C5C1; Match level="QueryCoverage=50%, HitCoverage=10%, E-value=5e-19, Identity=55%"; Hit description =Putative uncharacterized protein
MKDKWNVHELHNMLVQEETRLKNQGSHSVYYESHQGNQGARKKFMKKHDKSRGKSGHFQKDYLKCKSWFEKKSGLNAHRFLTIQTISPNEKFIFMGNGVKVPVETIETYCLKLDTGHRLDLLETPYGKQAKHTKKGATRSTQLLEIVRTDICGPFDVSSFRKE

SEQ ID NO: 95728 - protein, 67 aa, Glycine max
  Coding DNA Sequence Number=SeqID_4043
MPKNQELSKRFQAKIQESSFKNQDSSFKNQDYRFKNQVSRIKNQVSRIIKIKFQDTRFNNQEKTQSR

SEQ ID NO: 95729 - protein, 259 aa, Glycine max
  Coding DNA Sequence Number=SeqID_4044
  Homolog annotation: Hit_ID=A7UQU7; Match level="QueryCoverage=52%, HitCoverage=22%, E-value=1e-18, Identity=37%"; Hit description=IMP dehydrogenase/GMP reductase, putative
MYDQLDEACRTTTRQLAGYLTLLQCWIYEHFPSVHQCVTDDTYQETSPRASRWLTSKAHMKGITGAPYRARCDGLTVTYVSWLPYTEHRGVRAFQEISSFQGQLRWGPMIVTVRPERVVRQFGYIQSIPPPPVSARLSQDQIDDRYLRITLSGFFRISHPFMTPTQAADQQRDAPAADPEDYIQPPSPQVPVAFDPPPYVDDYEGYEAIAQRLERVLNLRIVTAGTELYDIMQDCLTIARGGPSADGTVRARQRRRTDH

SEQ ID NO: 95730 - protein, 202 aa, Glycine max
  Coding DNA Sequence Number=SeqID_4045
VEFEIPEASDSRTKRKLLQTVADQDGVEDTVCEKYSISKEKWVQFCQTRRDPSWEDVRKKAQAIQKQNTAPHVLSHGGYDYLEQKLLAEKTKKKLEEATQSRSIDGVIDPPSPVRHHVKWKMARTKKIGEMTTEAAKEIVAKIILELAQRGVVLIPKETILRRVTQIGAACTSKQILPAWLPWGEFMRDPLLFIILLCCLAK

SEQ ID NO: 95731 - protein, 50 aa, Glycine max
  Coding DNA Sequence Number=SeqID_4046
  Subcellular localization annotation: CTP_CleavageSite=27; ConfidenceScore=5.01e-01
MTEARQKGGIKRRSLSPSSPKRAQLAQASKVASSRSNSLLEESSGGPKWA

SEQ ID NO: 95732 - protein, 56 aa, Glycine max
  Coding DNA Sequence Number=SeqID_4047
MNIPVSDSNHFAQHESQSVSVTADHDPLLGLPLMPTKRQAFQDCDDEAGTSQISPA

SEQ ID NO: 95733 - protein, 74 aa, Glycine max
  Coding DNA Sequence Number=SeqID_4048
MEAMKEQMTTMMEAMMSMKKMMEVNTTTMVATSIAIEVDPTHPSGLNQVNRPASDMVGQGGKAIGSAGGPHFVQ

SEQ ID NO: 95734 - protein, 63 aa, Glycine max
  Coding DNA Sequence Number=SeqID_4049
MGPLQRQAFRKVYGKILDLAAAEVFTEAIVSLAQYYDQPLRCFTFGDFQMQKSWIARSKLGTA

SEQ ID NO: 95735 - protein, 53 aa, Glycine max
  Coding DNA Sequence Number=SeqID_4050
LGGVDGDPVLRGTRIRATWECVSLVERVVPGDMSRGSGDLGDVRWGAIAQNQA

SEQ ID NO: 95736 - protein, 85 aa, Glycine max
  Coding DNA Sequence Number=SeqID_4051
MRLKNQGSHSVHYVSHQGNQGAGKKFMKKHDKGRRKSGHFQKDYLKCKSWFEKKSEFNAHRLLTIQTISPNEKFVFMGNKVKAPV

SEQ ID NO: 95737 - protein, 72 aa, Glycine max
  Coding DNA Sequence Number=SeqID_4052
MPIGWTSHKSGADIEEEELTDLRSNPIQGEGDDAILPRKGPVTRAMSKRLQEDWARAVEEGPRVLMNLRVDF

SEQ ID NO: 95738 - protein, 92 aa, Glycine max
  Coding DNA Sequence Number=SeqID_4053
  Subcellular localization annotation: CTP_CleavageSite=58; ConfidenceScore=5.19e-01
MWYQAHDYNSMAQPPIALPTPDDARHSSLYSWCIVGSSGNGARNMLSNHVSFSVAHLRAFSGGTSPSNSWHNSSQCKKLGPATTRLSTLMLR

SEQ ID NO: 95739 - protein, 125 aa, Glycine max
  Coding DNA Sequence Number=SeqID_4054
MGEVEEIQEKMKADMEAIKEKMATMMEAMMSVKKIMEANAVATAATSVVAKETHEIPHHDLANFEPCLGYAAEGQAVGGIPLQNTLEGPQYLPQPQPSRSTAVKNPHDYGRNGKVGSSRGEAQGH

SEQ ID NO: 95740 - protein, 45 aa, Glycine max
  Coding DNA Sequence Number=SeqID_4055
MAPKKLSTKRSRRDAAAKRSNAAPEFDSHRFQSVEHQQRFEAIKG

SEQ ID NO: 95741 - protein, 46 aa, Glycine max
  Coding DNA Sequence Number=SeqID_4056
NPLMKKILGLQAPMELASVECTNLVGWPRRGWQAWLKNLSISEGML

SEQ ID NO: 95742 - protein, 149 aa, Glycine max
  Coding DNA Sequence Number=SeqID_4057
  Gene Ontology: Mol. function=RNA-directed DNA polymerase activity; Biological process=RNA-dependent DNA replication
  Homolog annotation: Hit_ID=Q5NRP4; Match level="QueryCoverage=41%, HitCoverage=3%, E-value=7e-09, Identity=45%"; Hit description =Putative gag-pol polyprotein, identical
MAGAGDNGGVYHQLHGFQRLLLDAMTTQMQRLLNRNNEELYRRIEGLEHQMNPNAGRPYGGNRRVNDGSNRIEGQDRIEGVKLNMKIQLAFSYNDCPEEQKVKLAAATFSDYALVWWKKNQREMKKEEGREIDTWTEMRKVMRKMYVSN

SEQ ID NO: 95743 - protein, 61 aa, Glycine max
  Coding DNA Sequence Number=SeqID_4058
  Subcellular localization annotation: CTP_CleavageSite=52; ConfidenceScore=5.51e-01
MAAIQMTSLVSMTCWACLSLPLVMGPSSVSWSLPLVMSSSSGSHHLVSSGIRASTLDTDFV

SEQ ID NO: 95744 - protein, 38 aa, Glycine max
  Coding DNA Sequence Number=SeqID_4059
MGPVLPDSQRPLLRGCAEKGTGHPETEHCPLRFVSWGL

SEQ ID NO: 95745 - protein, 54 aa, Glycine max
  Coding DNA Sequence Number=SeqID_4060
MYHPGLGGPMTRARARKAKEALQQVLSILFEYKPMFQGEKSKVVSCIMAQMEED

SEQ ID NO: 95746 - protein, 133 aa, Glycine max
  Coding DNA Sequence Number=SeqID_4061
MVPNAWLTKKRCFFGHLNCIITFSMHSIRIPEYFISMKCCRSIGDQIVILWIMGLNQAHAFTKRTRARARVMGEVEEVQEHMKADMEAMKEQMATMMKAMMSMKKIMEADTVAIAATSAVAKVNPMPPYDLNQ

SEQ ID NO: 95747 - protein, 207 aa, Glycine max
  Coding DNA Sequence Number=SeqID_4062
MDWDQLLAGIGGRTIQLVPPMEGRKRRSPFLMWKIPKHSAGREVQALKSKLGKAKLAKEKFKLAATHVRKECAGLREENAITARALEQETKRARKEEYGRNKFRGALWGSNSELKLRREERDQSRAHGMVLKEELMTCSRSKRSLSQRLCETETNMLAIIAKYEEELGLATAHEHRIADEYAQVYAEKEARGRVIDSLHREATMWVG

SEQ ID NO: 95748 - protein, 169 aa, Glycine max
  Coding DNA Sequence Number=SeqID_4063
MLTSPERVKMTTLVSACQSGLGSPNDGVRITGRCLRMLPDSWVRRTKGGAVDKSEAFAPTVLFLNNHLEETLGPTKIEENHSKCINLTQCEAKKSPTHRILVGNQRERTTSGRGQGWAFSPWVKVYGELGFWLKACRLAGHDICQSVGLASDSGKKEMSHIISTIHMQH

SEQ ID NO: 95749 - protein, 26 aa, Glycine max
  Coding DNA Sequence Number=SeqID_4064
MAVGYDLIEDAAARAWRQGEQKADIT

SEQ ID NO: 95750 - protein, 47 aa, Glycine max
  Coding DNA Sequence Number=SeqID_4065
MADSALGNDIHGSPKKSGEWRIGEQRYAITSRGSRLEGGGHMNSARQ

SEQ ID NO: 95751 - protein, 126 aa, Glycine max
  Coding DNA Sequence Number=SeqID_4066
LRGDEGPTSQVPQHVEDESSEATIPKPFVVGEEVGETQVRQVVAATPERSLEATSESPAPVVDLPSSQHKADPSTPILEIPEDPTTPVLTLDTSPPTTPIPCLDSRRAYVSRKIYPKFGGVELIGM

SEQ ID NO: 95752 - protein, 93 aa, Glycine max
  Coding DNA Sequence Number=SeqID_4067
QQGLGFPALVTGLCSPTGCPFPPARSCHHDIGIAPARHPVDPKKSNRVLELPSSNYRPRQAQGETPQQPEDGRQRATDAPPSPLEFTSAHPQK

SEQ ID NO: 95753 - protein, 281 aa, Glycine max
  Coding DNA Sequence Number=SeqID_4068
  Homolog annotation: Hit_ID=A7QUI1; Match level="QueryCoverage=95%, HitCoverage=61%, E-value=4e-51, Identity=45%"; Hit description =Chromosome chr10 scaffold_179, whole genome shotgun sequence
LALKLSSALLFSAATGMLLATNKIQPSQLAEEQRNVARLFKQLQTQIQTEIAIGNPSEGDVRDAIEKVLALYKAYPLPLLGGAMLKKFPAKFEAARWWPESRLSSNDKDKIMEIKNNNNNGWNVELEEEMREVIEVLKRKDVEDYERLGNIALKINKGFAVSAPLLTGIAALGSVFSGDGLVLALAGVLAMVVNAFEHGGQVGMVFEMYKTCGGFFQLLEETIEAAIEEKDLDKRENGELFEMKMALQLGRSVSQLRELATKSASCRIEGREIHEFANKLF

SEQ ID NO: 95754 - protein, 69 aa, Glycine max
  Coding DNA Sequence Number=SeqID_4069
MAGSTQRFEIGEKTSRGYKYVGSKWGCKVYKRKHLRNHDNKVKKKVKFSNVVKVFGDISVGRRVCSLSN

SEQ ID NO: 95755 - protein, 70 aa, Glycine max
  Coding DNA Sequence Number=SeqID_4070
MEAEGRLKSKIVCINQLLEEAQQLWDLGTTIGLEANTCHLCFIQSFADMEARDRNEAMEFDAILLRKGIG

SEQ ID NO: 95756 - protein, 57 aa, Glycine max
  Coding DNA Sequence Number=SeqID_4071
MKVMPSKPTRIGRKWYLNQGPMTRSRTKQSVDTLQQMVAGIHNKAQVEKDEGPEAED

SEQ ID NO: 95757 - protein, 55 aa, Glycine max
  Coding DNA Sequence Number=SeqID_4072
MKEQIEEAKEHHLDEDAMIPHNVAPCRACRPWIFFINGVLCFLKINGSGMEKVER

SEQ ID NO: 95758 - protein, 57 aa, Glycine max
  Coding DNA Sequence Number=SeqID_4073
MPGANLLAMGSSSAASPRSMRTSGAVVPLVDDGDDGTEVNQEMKYLLLVNMLQCDNF

SEQ ID NO: 95759 - protein, 392 aa, Glycine max
  Coding DNA Sequence Number=SeqID_4074
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=99%, HitCoverage=38%, E-value=0.0, Identity=93%"; Hit description=DNA -directed RNA polymerase subunit beta
  Pfam annotation: Domain name=RNA_pol_Rpb2_3; Domain location=42-111; Score=135.4; E_value=1.6e-37; Accession=PF04565.7; Description=RNA polymerase Rpb2, domain 3
  Pfam annotation: Domain name=RNA_pol_Rpb2_6; Domain location=191-392; Score=33.3; E_value=1.3e-15; Accession=PF00562.19; Description=RNA polymerase Rpb2, domain 6
  Pfam module annotation: Pfam domain module=RNA_pol_Rpb2_3::RNA_pol _Rpb2_6; Domain location=42-111::191-392
MVRGTICGAIRHKLIPTPQNLVTSTPLTTTYESFFGLHPLSQVLDQTNPLTQIVHGRKLSYLGPGGLTGRTASFRIRDIHPSHYGRICPIDTSEGINVGLIGSLAIHARIGSWGSIESPFYEISERSKRIRMLYLSPSRDEYYMVATGNSLALNRDIQEEQTVPARYRQEFLTIAWEQVHLRSIFPFQYFSIGASLIPFIEHNDANRALMSSNMQRQAVPLSQSEKCIVGTALNAKIFLFGNGDTLSIPLTIYQRSNKNTCMHQKPQVRRGKCIKKGQILADGAATVDGELALGKNVLVAYMPWEGYNSEDAVLINERLVYEDIYTSFHIRKYEIQTHMTSYGSERITNKIPHLEAHLLRNLDKNGIVILGSWVETGDILVGKLTPQMAWIL

SEQ ID NO: 95760 - protein, 86 aa, Glycine max
  Coding DNA Sequence Number=SeqID_4075
MNEGSFGILFNYVRKFLSRLIPYGVTVTYLPSLEVATLVVNIPVSNVPPRKVHFRYELQPIFQLMWKVDTLYNQFQNLSPPIDHSH

SEQ ID NO: 95761 - protein, 406 aa, Glycine max
  Coding DNA Sequence Number=SeqID_4076
  Gene Ontology: Mol. function=motor activity; Cellular component=cell projection
  Homolog annotation: Hit_ID=UPI00016621D1; Match level="QueryCoverage =99%, HitCoverage=41%, E-value=5e-23, Identity=34%"; Hit description =UPI00016621D1 related cluster
HILAIRGLHAITFRGQHVLAFRGLHALAIRGLHALTFRGLHVLAIRGIHALTFRGLHVLTFKGQHVLAIRGLHVLTIRGLHVLTIRGLHVLIFRGLLVLAFRGLHVLTFRGLHFLAIRALHALTFRGLHVLTFRGLLALTFRGLHVLAIKGLHALTFRGLHVLAFRGLHALAIRRLHALTFRGLHVLAIKWLHALTFRGLHVLTYRGLHVLAIRGLHVLIFRGLRVLAIRGLHALTFRGLHVLAFRGLHVLAFIGLHILTFRGLNILIFRGLHVLIFRGLHVLTFRGLHALTFRGLNVLAIRGLHTLTFRELHVLTLRGLRVLAIRGLQALTFRGLHVLAFRGLHVLTFRGLHLLAFRGLHALAFRGLHVLSFKGLNVLIFRGLHVLIFRVLHVLTFRGLHALTFR

SEQ ID NO: 95762 - protein, 534 aa, Glycine max
  Coding DNA Sequence Number=SeqID_4077
  Homolog annotation: Hit_ID=Q3JRH4; Match level="QueryCoverage=54%, HitCoverage=24%, E-value=7e-48, Identity=40%"; Hit description =Putative uncharacterized protein
RWHAPRCVDRRDLGAAGGSVRLAQQAHGQPRGSAHGHRTGAGCGHPHPDPAGTADALPAAGAGQPAVGGSGPARRHPAAGPGRVLHAAAVRPGPGRAAPPERLHGAAGDQPGTGLCGGAGGGAAARAARGHPVVLPGRGDHRRRGVPASAAEPPQAGAASGNPWHGRGTQHRRLSASTQGVDGRINAAASAMPAHPAGPARSAACGPVPCAGAANDSRALAPRSSQQQEAQRTVGQFGHRQRPQQPRLVEAQGQSTVQLFEADRGAGERIVDAACQRDRISDFENGHPGCRQIPTVVMQHRRARGHRRLSRRGIGIAAEMVVEAPATDVLTQGDGFRHALRIADLSEQAVEQRQPVIHEIPAARMTLPHHCPTAINQQVGAAQERPGPDRLHLDLRIQRKRRMAGRRVAQVDGIAEFVGGEAELQSHRCLPRATLQRDLAGRDPAIDGFGAGPQRRTQPPFAGQHRRNAALCGLRQQAQRAVQAGLATAVVTGHHVQLLQRQDQPVQRTIVGDGQGLQHGRRPWEQERHIRRAQ

SEQ ID NO: 95763 - protein, 136 aa, Glycine max
  Coding DNA Sequence Number=SeqID_4078
MITARGKTRAVFCSGGCKLPSWRCELPSWRCELPSWWVRTLVRTASAATQSDDVDIQLPRVQSQIEEVLHTTPAAGSGTILIAPTLVLRGISHHRISTIKTRKGNVAAMGVGPYFISIAVHYKKVRDVHDSPGSLG

SEQ ID NO: 95764 - protein, 123 aa, Glycine max
  Coding DNA Sequence Number=SeqID_4079
MAPTRHPLDPDKSNRALGFPLLITGLCQSFGVPVVPTKAANHRAHVQTHDCLYQMSLSMQSQGFASFSCPTPDQFRAEVAWPEDWPEAQAGEAPPEAPGDGEEAHEDEEMADLLDFLGGSGAT

SEQ ID NO: 95765 - protein, 41 aa, Glycine max
  Coding DNA Sequence Number=SeqID_4080
MTKLGLCLSSGPPPLDDKRVRITIRYLRVSWSLHTNGSRVT

SEQ ID NO: 95766 - protein, 117 aa, Glycine max
  Coding DNA Sequence Number=SeqID_4081
MGVYLVNRGVLIAIRPTWVFQDVPTEGGAFWWKQPSSPGRVWRQPLRKIVSVKKIQAEALPQRFRDVSVGDFVKIFHRYSSFFVLSSSFFGLQPDKNNLTNAYDGSLLVGLLWRLDL

SEQ ID NO: 95767 - protein, 108 aa, Glycine max
  Coding DNA Sequence Number=SeqID_4082
MEHFLEQVAWPESQPPLVGPNLAAPPKPTPARVEPVPTDPQSPVVSSPSSPELEVVPPSPPLIILSDSPSGEVADPPDSPVGGAAYLSDSSSGEVVVVSYSTVFPSDR

SEQ ID NO: 95768 - protein, 120 aa, Glycine max
  Coding DNA Sequence Number=SeqID_4083
MHNYYEKGRAPDLESVLEDFMTYQASSKGDCYSMQQQGAQFERDYSSVDYQWESKWKPYYHNEVEGLSNLDDLLMQFKDTIDSMQQAFKRTETQLGKLVDDMTKVVVRREEEYEKIEAHQ

SEQ ID NO: 95769 - protein, 919 aa, Glycine max
  Coding DNA Sequence Number=SeqID_4084
  Homolog annotation: Hit_ID=Q3JUP4; Match level="QueryCoverage=61%, HitCoverage=72%, E-value=2e-59, Identity=33%"; Hit description =Putative uncharacterized protein
ALCGLWRLSLKAGADVVEKTGEARRQLGVVVIHRVDRLAHVQRLPHQQRYQPARFPIAAGHEVRQLDNARSAQRQLTQRLPAGGRDRRFDGEMPRLPVTQRPLVQRFWVGESQQAMAVQIFHAARFAMPLQVIRAGEDAQPAVPQQARMERGVTQRADADRDIGAFLQQVDIAIVGVQLQLNLRITTAELRHHRHQHVRHERGGGVDPQPTGGQLAPQRHQFFGLIHRTQYFARRRQEALPFFGQAQATRGAAQERSVEFRFQAAECAADAGGGLAEPIGGGGDRTAVHHRSERQQLFEGDLHAVRPRLTGAACNALRESRPGVSPGQASCGDLPNASWPTACPSRQRLIDVILCHRQLHQTAGVRIEGGFAQLQRVHLAQPFKALYVRLALLALQLFQHAGFLFFIQRVEHLFTEIDTVQRRHGDIDMAAFHQRTEVAHEQRAQQRGDVQAVGVRIRQDADFTVAQLAEIFAVRIDADRHGNVVHFLRGQHFVRRHFPSVQDLALERHDRLIFAIARLLGRSARRVPFHQEQFGHGQILRGAVRQLARQRRPAGQLFAHHFLGGAQAALGAGDRQLGQLFRRLNVLVQPQAEGVFHHAGNEGRTLARGETLFGLPGELRILHLHRQHVGAAIPDIFRRQLHAARQNIAEFAELAHRVQQPLTQAVDVGAALHGRDQVDVAFGQQLAAFRQPQQRPVHRFGVPGEIADERRFRQGDQAVDRFHQVVGQAVLIAPALFGVVHLVDEIDLDAGAQHRFGFQQVSQARYREARAVEELLVRPEVHAGAGVAFAAGAGHRQILHLVAVFEGDAVDVAVAAHVDFHPLRQGVDHRDPNAVQAAGELVVFIREFTAGVQPAQDQLNRRHALFRVDVHRHAAAVVDHFQRLIGVQNHVDALGVTGQRFVDAVIDHLLAEVIWARRV

SEQ ID NO: 95770 - protein, 204 aa, Glycine max
  Coding DNA Sequence Number=SeqID_4085
IPNYNPALAIRQLGYPMRGAPTEESLSPFLVRDLGAQSLKVIQRVHKAWRSPLKKDKELRGIRNGVIGGYHGWLRVHTQGLDWLSKLKVINEENFEAPEEDEEVQSLKLELGKVRLAKEKFKSAATHIRKEYTENSEEHCGVATTSSSSEGRKETGHGSKRSLAQCLEATEQSMLAIIGQYKEELNQSVTHEQKLVEDFDGPYN

SEQ ID NO: 95771 - protein, 130 aa, Glycine max
  Coding DNA Sequence Number=SeqID_4086
MDHHGKIGEKLASQLAHASRVASSRSNNLLKESSRGPKWACFSKKLVEKASQRSHEEASGGSLLMKLLEKATWSCLGKNDAQRLLTVGFSQNLVCNSTRQFSIIGPLGSLRRCLECARSLLMKLLKEASK

SEQ ID NO: 95772 - protein, 120 aa, Glycine max
  Coding DNA Sequence Number=SeqID_4087
SKHDTKLSGETRRYRFSALLSFRNDKLSGNDKLSGSSEAGDKHAETNSAPFVIQKQQVERWAETNYGHSAHLFAVQRRSCPVAHRDKLWLFCVTPPRLDCVQQNAETNYGSADREVHWPS

SEQ ID NO: 95773 - protein, 156 aa, Glycine max
  Coding DNA Sequence Number=SeqID_4088
MADEKPRRVTLEGYSSTSNSLRTWDEVVEKFLKKYFLESKTAEGKAAISSFHQFPDESLRGKIKLKTPEEAMELIENMAASDHAILCDRTHYPTKKSCTLCGGAHESSCCVPTKESIHEVNYMGNHPRQNFNVGGFFGFQRGQHYNQQQNLWTTHP

SEQ ID NO: 95774 - protein, 97 aa, Glycine max
  Coding DNA Sequence Number=SeqID_4089
MKAQVEKDEGPEAETLSRLLIVAEGPSNPCGVYPDLSSLTGSGVYPDLSSFTGSGVYPDLSSLFGSGVIQISVTCIKRSAPSQVHITTFVKKLRNVG

SEQ ID NO: 95775 - protein, 119 aa, Glycine max
  Coding DNA Sequence Number=SeqID_4090
  Subcellular localization annotation: CTP_CleavageSite=81; ConfidenceScore=5.01e-01
GLGVSSSGYGPLSVLQGAHSPSKESHPQRHPVDPEKSNRALGFPALGSRPQDTQWTRRSPTGSWRCQALITGLCQFYGVPVAPSKAGAGLNTTAAWGWLAADNRRTAITSRVHLSSSTK

SEQ ID NO: 95776 - protein, 18 aa, Glycine max
  Coding DNA Sequence Number=SeqID_4091
MENWRTALRNNFAGLQTR

SEQ ID NO: 95777 - protein, 130 aa, Glycine max
  Coding DNA Sequence Number=SeqID_4092
MAFIMFSFTHIILKFRDSCKDYYSQLAIHSQSNVTLLPVLVQAFLSQSICLLTNNSTREFAKRDTQWLSARKKPEDDELSGSLSAPLQVIKHTASAHSLSERSALSHNPLMHAKRFKITLSTRARTNPPI

SEQ ID NO: 95778 - protein, 134 aa, Glycine max
  Coding DNA Sequence Number=SeqID_4093
MVLKDKLKAVKWQESLMEQLSRTKENMLITINQYKKNVNLAASHGQRLEDEHAMVSTLQIEMEARERVIESLHVDAMKWMDRFALTLNRSQELPRLLARAKAMADMYSALDEVHDLFDYCQHMVEIMTHIIRNC

SEQ ID NO: 95779 - protein, 44 aa, Glycine max
  Coding DNA Sequence Number=SeqID_4094
MTSWCLRGLPALGSWQQKAGVVDKSEALAPTYPPMRNSDLRSSG

SEQ ID NO: 95780 - protein, 246 aa, Glycine max
  Coding DNA Sequence Number=SeqID_4095
  Homolog annotation: Hit_ID=A5BSR3; Match level="QueryCoverage=32%, HitCoverage=25%, E-value=5e-10, Identity=46%"; Hit description =Putative uncharacterized protein
  Pfam annotation: Domain name=Transposase_23; Domain location=167-237; Score=-3.9; E_value=0.0032; Accession=PF03017.5; Description =TNP1ENSPM transposase
SGSVDGVIDPPSPVRRHVKWKMARTKKIGEMTTEAAKEIAEKIDSFEEQTTQGSFVPHGCQDVLAAAIGRPEHPGCVRVAGAGVTIKQYFGPAPRTSRNASSLPPEELQQLTQQIRDQLEESITEKVTRQMQSQGLAVPPEPLVGPSGPRVSTKGSCVDPSGNDPEMGDSDRCGLYIETDPACLVAMGRVYEGSTIVHNTPLLPGQVKVSVEEVTDANALVPVPTDEVSLVGDAILPHKGIGYKTP

SEQ ID NO: 95781 - protein, 80 aa, Glycine max
  Coding DNA Sequence Number=SeqID_4096
MIEVSVEAIASLTQYYDQLLRCFTFGNFQLAPTIEEFKRILGCPIGGRKPYLFFRVLSFYGESSKSGQDLGMKIRSSKAK

SEQ ID NO: 95782 - protein, 285 aa, Glycine max
  Coding DNA Sequence Number=SeqID_4097
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIKDEVVANGRQDRSSGVIQDRDSGLGQDSCGSSKHADHRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 95783 - protein, 90 aa, Glycine max
  Coding DNA Sequence Number=SeqID_4098
MLVATPCIFPPLESAPSSAPSDLSDSEWRLLSLAEIAYSGWSFVSLTHLRKVQEEPQLLVVFVMTIVVAADVLEEEHMACLDQQHSEMEG

SEQ ID NO: 95784 - protein, 145 aa, Glycine max
  Coding DNA Sequence Number=SeqID_4099
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=21%, E-value=9e-46, Identity=83%"; Hit description=DNA -directed RNA polymerase subunit beta
  Pfam annotation: Domain name=RNA_pol_Rpb2_7; Domain location=56-133; Score=144.1; E_value=3.8e-40; Accession=PF04560.11; Description=RNA polymerase Rpb2, domain 7
MPYLQDGRPVDMVFNPLGVPSRMNVGQIFECSLGLAGVDIMHFVTQQPLRGRAKQGGQRVGEMEVWALEGFGVAHILQEMLTYKSDHIKTRQEVLGTTIIGGTIPKPTDAPESFRLLVRELRSLAMELNHFLVSEKNFRIHRKEA

SEQ ID NO: 95785 - protein, 174 aa, Glycine max
  Coding DNA Sequence Number=SeqID_4100
  Homolog annotation: Hit_ID=Q6UUU1; Match level="QueryCoverage=34%, HitCoverage=40%, E-value=1e-18, Identity=78%"; Hit description =Putative uncharacterized protein
MNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYPGNYRLESNPERHAKSTTGQQPLAKLKGQVLGDCAPPASYLGSRVGSSENLRKPPCKA

SEQ ID NO: 95786 - protein, 93 aa, Glycine max
  Coding DNA Sequence Number=SeqID_4101
MRDGKRSSYVIGIRVNSRIGLGGKFLITLEMAPKWALPAGRVVVGAGAWGPPFGWGRALYAVRVLNSKSSQHELRSSGDVAHTDGHHDRSAVA

SEQ ID NO: 95787 - protein, 126 aa, Glycine max
  Coding DNA Sequence Number=SeqID_4102
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q37953; Match level="QueryCoverage=49%, HitCoverage=60%, E-value=2e-24, Identity=88%"; Hit description=LacZ protein
MFKTIMLKITNNRMLKMLKSPGDPLVLERPPPRWSSNSPYSESYYNSLAVVLQRRDWENPGVTQLNRLAAHPPFASWRNSEEARTDRPSQQLRSLNGEWGRALYGALSAAGVGGYAQRDRYIASAD

SEQ ID NO: 95788 - protein, 333 aa, Glycine max
  Coding DNA Sequence Number=SeqID_4103
  Homolog annotation: Hit_ID=Q2HST2; Match level="QueryCoverage=65%, HitCoverage=49%, E-value=2e-08, Identity=24%"; Hit description =Peptidase aspartic, active site
  Pfam annotation: Domain name=G-patch; Domain location=282-323; Score =3.0; E_value=0.082; Accession=PF01585.14; Description=G-patch domain
IVTTTQRPRGFQPFTVKKPALFPYKSDKAVPWKYAAQGPNGRKDMFIIHVNDDFPSAKVTNISGTSGMTGSGRIFVAPELPVRSKDKGKAKADLGENDKAGLTPNDEVTIGKIVEEGADFSKKGISAEEETKFLRTIQQSEFMSITSWPTITSLSPMKRYPSKTGDTTKPFTWSVKCLGHILAKVVIDNGSSHNIMPNSTLDKLPFNASHLRPSSMVVRAFDGSCRDLLIRPTLDSFGWGGPVNAALEVKIRGCRGVIGNILPGTGSYEQCLCGVSSGAILMVARVMLGHEYKPRMGLGRNGNGIASLVEFAENRRRFRLGYEPSVPTRGGSP

SEQ ID NO: 95789 - protein, 113 aa, Glycine max
  Coding DNA Sequence Number=SeqID_4104
MPQGFPSLVIDYTALVIDYQRPNSSYTASGHGNLHYPLCNRLHMTVLVIDYQRPPQHTVSISKPGNRLHPLVIDYQKPSQLPDPIFRPGNRLHTLGNRLLETILTSCLHFYAL

SEQ ID NO: 95790 - protein, 143 aa, Glycine max
  Coding DNA Sequence Number=SeqID_4105
MAAQLIHDRVEIECLEGIWETLEGSTRCRFWGTIRFTVTSLVHPEEPARTLQRTVEWILPTPTPYRLVEPVQVIEVTSSEEDPEEDPEELPPEPAVDALDFPEDDEDPLPEVDSPEDVMSASEADSTEESGPEGIATSGGSSS

SEQ ID NO: 95791 - protein, 71 aa, Glycine max
  Coding DNA Sequence Number=SeqID_4106
MEGTSTWLFKVNKEGYIPCGSLLIKVFYKVEKKSQGPQVAWGLNVGTEAKLHGESKVIQRCFDDNNDDNKR

SEQ ID NO: 95792 - protein, 291 aa, Glycine max
  Coding DNA Sequence Number=SeqID_4107
  Homolog annotation: Hit_ID=Q6WAY4; Match level="QueryCoverage=80%, HitCoverage=41%, E-value=1e-28, Identity=34%"; Hit description =Putative uncharacterized protein
MPYTFIHAFIHFTYDRCRSLDLHWFLFHFGKNIGLSKAPSLKKRFYQVKVNSLGITSLKELGHLMGQLQRQAFRKAYGKIWDLIMAEVSTEAIASLAQYYDQPLRCFTFADFQLTPTVEEFEEILGFPLGGRKPYLFSGFYPSLARISKIVKVSTQELDRGKQVKNGVVGVPRKCLEARARVLASQGEWAPFMDILALLIFGVVFFPNVDGLVDRAAIDAFIAFYDRKESPVVAILADLYDTFDRRCEKNNARIICCMPALYIWLVSHLFRQEMRHVCPLEGHRSCTEKKE

SEQ ID NO: 95793 - protein, 30 aa, Glycine max
  Coding DNA Sequence Number=SeqID_4108
MAFVDNWVVGKEKIPLVRLDSTQAAYESLA

SEQ ID NO: 95794 - protein, 159 aa, Glycine max
  Coding DNA Sequence Number=SeqID_4109
MCVHLTGECNEDFSRSPEWTRMCAAKVDVSLSELNALSECHPLREASTRLADRRNQEGNLSCWHALRASLARSVSRLSPSRLSASLALSDYSLTRTKRENGIKCDVEVSEPFFMPDLWRIDCEVPRGGGDIPTPFIERCIVSLELDRAGLGYRMFGHGG

SEQ ID NO: 95795 - protein, 195 aa, Glycine max
  Coding DNA Sequence Number=SeqID_4110
  Subcellular localization annotation: CTP_CleavageSite=27; ConfidenceScore=5.10e-01
DIVSDIVDPAASLLHLTFILHCTTTPVFSGRMSGHCIRHRGSCNFTSALDFYLALYSNSSILGQDRDSKVNMTDLVSAEDDRAKVYTDNHSGISARQRDSKDSMTDLVGAEDDVYLRVSTGFSSYRQQKVYTDNHSGISARQRDSKVSMTDLVSAEDDVNHRVQQKVYTDNHSGISVHQRDSKVSMTDLVSAEDD

SEQ ID NO: 95796 - protein, 131 aa, Glycine max
  Coding DNA Sequence Number=SeqID_4111
MRVEEAHHYRRPWIRTWRKKEMNEGRGREEHKILCSKRALKSEGGKRVFSLVFLDPSPPRLASHSLGPPNSFMVKKPTRQGKLIASALSDVSSIGACRPRIFINGFLCFLEDEWQQNREGRERGDVTLRRR

SEQ ID NO: 95797 - protein, 92 aa, Glycine max
  Coding DNA Sequence Number=SeqID_4112
MDAHPCQDGVHQLALRHGEVGIMIGGQDVAEEQSHPYLSQGGHICAHDSHSPPCSSPGQNPASWPSSNIRRVAQRTVKRETTGPLTGSASLG

SEQ ID NO: 95798 - protein, 151 aa, Glycine max
  Coding DNA Sequence Number=SeqID_4113
MSRTPSLYGPSISVKLQDYLRVKLSHGSHQRRLMSAGYPLLKICVLILPELDAPLSMERPSFDGLEALLVHDTSETMAIELGGSIGPFSRGVSPRFLCGKLFRSHFLRGQTLRQSYSVRALGRRLQVDWARDPRKGPRVLMSLRVDFEPMG

SEQ ID NO: 95799 - protein, 307 aa, Glycine max
  Coding DNA Sequence Number=SeqID_4114
PWKIKANGLSFMDILALWIFGVVLFLNMERLVDLEVIDAFLAFHHGEESPVVAILAMYDTFDRGCEKSGARIVCCALALYVWLVSHPFLQEGRPVYPLQGHRSILSHGVSVTTTRGYSKEFSRHGMRREERTESLGEATVRDDEVKASEESDEVQALKAELERSRVVEEKFKSIAIKLKPWNEEVKGIITGQRHDLRRGERIITGQRHDIEGRAKGNMWAIIDKCKEKLNLAATHEQRLEDEYAKISAEREARERVIDSLHQEATMWTDRFALTLNRSQELPRFLAKAKAMADTYSAPKEIHGLLSY

SEQ ID NO: 95800 - protein, 159 aa, Glycine max
  Coding DNA Sequence Number=SeqID_4115
MGTNQTGKRFYQVKVKGLDVTSIKELGWLMGPLQMQAFRKTYGKILDLTIAEVSIEAIASLTQYYDQPLRCFTFGDFQLNCNCGQGFSKRFGPRKTNSKRHSGPTTEVPRRQGEGYGKSRRVGPVYGCVSIANLWGRPLSKRGWFGGPSRNRRFPCIPP

SEQ ID NO: 95801 - protein, 87 aa, Glycine max
  Coding DNA Sequence Number=SeqID_4116
  Homolog annotation: Hit_ID=Q1J7G7; Match level="QueryCoverage=34%, HitCoverage=42%, E-value=7e-09, Identity=96%"; Hit description =Transposase
MVKVGTSYVPINVSFRQKLARASRYQQGHQDLFILRSDLPSQWLLFLSAVPPVQLLTGCCVTAKAPPDISAGKCSGHAARNHHTRRA

SEQ ID NO: 95802 - protein, 111 aa, Glycine max
  Coding DNA Sequence Number=SeqID_4117
MPFCGRARRGSRVRFPKEERCVESPPTFICGKRRKNRRIPVKMKILSSGVVFTFDEAGLFAPMYPPLERKSDLRSSFLKSESSDSFYLKGDHFKALDLKNDPFYLIRREMT

SEQ ID NO: 95803 - protein, 106 aa, Glycine max
  Coding DNA Sequence Number=SeqID_4118
MGKAKEVQEKVKADMEAMKEKMATIMEAMMSMRKIMEAKRVNQMNHPTSAMVGKDLGSTGGPHDVQIQNEHAFPPYGLPLNYTPPNVAYTPNENVNKATPILVESQ

SEQ ID NO: 95804 - protein, 123 aa, Glycine max
  Coding DNA Sequence Number=SeqID_4119
  Subcellular localization annotation: CTP_CleavageSite=5; ConfidenceScore=5.14e-01
MSLPNAVHASSTNESGAPRMSLPSAVRQFSILHFFSEPHEFHCLALFMCPPPSSLEASRMSLPSAVRQFSIVHFFSEPHECHCLALFMHPPPTSLEPRECHCLAFFANSPFSTVFRSPMNVIA

SEQ ID NO: 95805 - protein, 306 aa, Glycine max
  Coding DNA Sequence Number=SeqID_4120
  Homolog annotation: Hit_ID=A5AH08; Match level="QueryCoverage=79%, HitCoverage=69%, E-value=2e-07, Identity=23%"; Hit description =Putative uncharacterized protein
MAEPSKKRKGTSSRSQRHSGSQETPIPSSIPSRSLFSSEEQQIHEGTLMSEVYGIKIVIDQSLFYDLTQLPSEGVPFEGALIDDWKFDFSVHDARRLVCTNQADMTGRLLAGSLAFESRILHYLIVRILLPRSSNLAQVYEEDLIVMWAFHKGLQIDWAHLVRYHMHKALRLNAPLPYPHLDTLFLQHFNIPLDSKPYVPIKRSFLIGASVIASFGYQKEHDGSWVKKGARHVGEEGHDGEDSSLLSKIMDRFDGLQTFVGERFDTLELQVDIRFNEMESRITKVEEDVSYIRSSFDLPPPPPPSS

SEQ ID NO: 95806 - protein, 284 aa, Glycine max
  Coding DNA Sequence Number=SeqID_4121
  Homolog annotation: Hit_ID=A5B5V0; Match level="QueryCoverage=77%, HitCoverage=49%, E-value=1e-09, Identity=25%"; Hit description =Putative uncharacterized protein
MSLKLPIYSELVKAFYSNLEIHEGILMFEIYGIKMVIDQSLFYDLRKLPSEGVPFEGALIDDWKFDFSVHDACQLVCTNQADMTGRLLAGSLAFESHILHYLIVCILLPRSLNLAQVSEEDLIVMWAFHNGLQIDWAHLVRYRMHKALRLNALLPYPHLVTLFLQHFNILLDSEPYVPIKRSFLIGASVIASFGYIKEHDGSWVKKGARNFGEEGNEGEDSSLLSKIMERFDGLQTFVGERFDTLELQVDMRFNEIESRMTKVEEDVSYIRSSFDLPPPPPPSS

SEQ ID NO: 95807 - protein, 257 aa, Glycine max
  Coding DNA Sequence Number=SeqID_4122
  Homolog annotation: Hit_ID=A5BC53; Match level="QueryCoverage=83%, HitCoverage=23%, E-value=2e-07, Identity=22%"; Hit description =Putative uncharacterized protein
MDFFSDESFECIQAFENSNLIPFMPIKLPVYSDLVKAFYSNLEIKEGTLISEVYGIKMVIDQSLFYDLTQLPSEGVPFEGTLIDDWKFDFSVHDARRLLRILHYLIVRILLPRSSNLAQVSEEDLIVMWAFHKGLQIDWALLVRYRRHKALRLNAPLPYPHLVTLFLQHFNIPLDSEPYVPIKRSFLIGASVIASFGYQKEHDGSWLKKGARHIGEEGHDGEDSSLLSKILDRFDGLQTFVGERFDTLELQVDMHFH

SEQ ID NO: 95808 - protein, 31 aa, Glycine max
  Coding DNA Sequence Number=SeqID_4123
MECKPSRLSEEPVGTSKGSSKPSHRKPSSLL

SEQ ID NO: 95809 - protein, 137 aa, Glycine max
  Coding DNA Sequence Number=SeqID_4124
  Homolog annotation: Hit_ID=Q6UUU1; Match level="QueryCoverage=43%, HitCoverage=40%, E-value=1e-18, Identity=78%"; Hit description =Putative uncharacterized protein
MAQIHSVLLTQPKLKKLIQWIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 95810 - protein, 31 aa, Glycine max
  Coding DNA Sequence Number=SeqID_4125
PQLSTTTQLHHRHHVGNSENKKEFNKTTSRN

SEQ ID NO: 95811 - protein, 316 aa, Glycine max
  Coding DNA Sequence Number=SeqID_4126
RRTALHADRVLDAAEIFHMRVVELARAVADPDHVARRRVPVAGGGIDAGQRLLVTEQQRLVAGEEVGFTQARIAVCRDADRLHEIHGFGDAVGQLAVTVRLRAVLDEAEHPLVNVFEVGITTHRESAQQVQRRGRLAVGVELTLRVRNTRSLVEFDAVDDVATVGRQGNAILHFHVGRARLGELASNASYLHDRQLRAIGQHDGHLQESAEEVADIVRAMLKEAFSAIAALQQEGVAFSHIGKLLFQTTGFTGKNERRIGRKRGFRCRKRCRVRIFGNLLDWLLPPAAGGPILCHVLTLFSPAQQRRDRLEKLSGL

SEQ ID NO: 95812 - protein, 221 aa, Glycine max
  Coding DNA Sequence Number=SeqID_4127
  Homolog annotation: Hit_ID=UPI00016622DC; Match level="QueryCoverage =64%, HitCoverage=67%, E-value=3e-09, Identity=20%"; Hit description =UPI00016622DC related cluster
MDTSEPYTGMISPLNESISCFLIRVDPWVLVPYSSSEGCSPSPSEDYTSSPSEGCKPSPLEDYMSSPSEDYTSSPLEDYTSSPLDGYTPSPSGLHVLAFRGQHVLAFAFVGLHALTFRGLHVLAFRGLHVLAFRGLHVLAFRGLHVLAFRGLHVLAFRGLHVLAFRGLHVLHFRGLHILAFKGRHVLNFRGLHALAFRGLRVLTFSGLHIHTLREFKVLCP

SEQ ID NO: 95813 - protein, 85 aa, Glycine max
  Coding DNA Sequence Number=SeqID_4128
DLEATTTPEEEPRSSEASSSFPIAGNSHIEPVEDPIMAEEPRRVTLEDYSSSIVPQFFTNPYAHLATYIEICNTIRLAGVLADAI

SEQ ID NO: 95814 - protein, 82 aa, Glycine max
  Coding DNA Sequence Number=SeqID_4129
  Gene Ontology: Mol. function=protein dimerization activity; Cellular component=nucleus; Biological process=regulation of transcription, DNA-dependent
  Homolog annotation: Hit_ID=Q9M4H1; Match level="QueryCoverage=96%, HitCoverage=15%, E-value=2e-18, Identity=64%"; Hit description =Putative ripening-related bZIP protein
  Subcellular localization annotation: CTP_CleavageSite=24; ConfidenceScore=5.07e-01
MNFRNFGDNNSNHPTWDAMHGKTPANNVTTLLRQPSTIYSLTFDEFQSTMGGIGKDFGSMNMDELLKNIWAAEETQAMAFSA

SEQ ID NO: 95815 - protein, 459 aa, Glycine max
  Coding DNA Sequence Number=SeqID_4130
  Gene Ontology: Mol. function=peptidase activity; Cellular component =cytoplasm; Biological process=response to oxidative stress
  Homolog annotation: Hit_ID=A7P9K6; Match level="QueryCoverage=86%, HitCoverage=99%, E-value=1e-135, Identity=56%"; Hit description =Chromosome chr3 scaffold_8, whole genome shotgun sequence
  Pfam annotation: Domain name=DJ-1_PfpI; Domain location=303-440; Score=111.2; E_value=3.2e-30; Accession=PF01965.15; Description=DJ -1PfpI family
  Pfam annotation: Domain name=DJ-1_PfpI; Domain location=89-238; Score= 100.5; E_value=5.3e-27; Accession=PF01965.15; Description=DJ-1PfpI family
  Pfam module annotation: Pfam domain module=DJ-1_PfpI::DJ-1_PfpI; Domain location=303-440::89-238
  Subcellular localization annotation: CTP_CleavageSite=66; ConfidenceScore=5.71e-01
MSLLLLPQPPTPLSTVTFSAAARAPFAAVTPPRPRTLTPKPALSLSAPITTTAPNNAIPPKKVLVPIGLGTEEMEAVIMIHVLRRAGADVTVASVEPQLQVEAAGGTKLVADTDISACSDQVFDLVALPGGMPGSARLRDCDVLRKITCRQAEENRLYGAICAAPAVTLLPWGLLKKKKLGLICSILSCKITCHPAFYDRLPRFWAVKSNLQVSRGLTTSRGPGTTYQFALSLAEQLFGDSVANEVAESMFMRTDDDHAAKEFNKVEWSVGHHTPSVLVPVAHGSEEIEVVTVVDILRRAKAKVIVASVEKSLEVLASQGTKIVADILIGDAQESAHDLIILPGGTAGAQRLSKSRILKKLLKEQNSAERIYGAVCSSLAILQKQGLLKDKRATAHASTLDKLKDKEINGAKVVIDGKLITSEGLATVTDFALAIVSKLFGNGRARSVAEGLVFEYPKK

SEQ ID NO: 95816 - protein, 173 aa, Glycine max
  Coding DNA Sequence Number=SeqID_4131
MDIIGGDYSSQCLMNRIVAMKDGFKKRHHKVSNLDDLVSCLDKMTLLAEEEDRIIEAREEAPPLVPQFERQQFDMLGRSVETQGLGRHRESVDAEAHVIPMMPERQHGMYYTPDQFTQDPSQMSPLYLYPYQSETSSRAIGEGIQIDKLGDGSDHVGRPPAITHIMMMMMMID

SEQ ID NO: 95817 - protein, 83 aa, Glycine max
  Coding DNA Sequence Number=SeqID_4132
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=Q8MBP6; Match level="QueryCoverage=91%, HitCoverage=15%, E-value=7e-32, Identity=93%"; Hit description=ATP synthase subunit beta
MTYILDDLTDHALATTFAHLDATIVLSRGLAAKCIYPAVDPLDSTSTMLQPRIVGEEHYETAQRVKQTLQRYKELQDIIAMAQ

SEQ ID NO: 95818 - protein, 477 aa, Glycine max
  Coding DNA Sequence Number=SeqID_4133
  Homolog annotation: Hit_ID=A7P9L9; Match level="QueryCoverage=77%, HitCoverage=94%, E-value=7e-89, Identity=47%"; Hit description =Chromosome chr3 scaffold_8, whole genome shotgun sequence
MALEGASVKRTPELQAALLCGRSGQFNLAAPWLSGVWIWWGWKKVEHVTRAAEMEGSKKAEPCAEMEATILSSLISQLLLLLLHNIFPFPPNSVPPNNSTDSILPLLLFSHQLAATLSLSPKHRKNKRKRDFQHPNPLTRTPDSFRNTFLMSSSSFEWLSGLLEPLLECRDPAPLFHSLHLSSGARLAIGLSRLAEGQDYQQISARFAVSDPVAKFCVKQLCRVLCTNFRFWVSFPSPSDLPSISQSFQSLSGLPNCCGAVLCTRFNIVVNANSTTTTTTTNDKVSVSQVAAQIVVDSSSRILTIAAGFLGHKSDSQILQASTLYNDIQQGTLLNAPCNQFLIGDSEYPLLPWLMVPYANPAPASAEENFNSAHEIMRLPALRAAASLRNWGVLSRPVCEELKTAVAYIGACSILHNSLLMREDFSALASEFEDCNQGCYGEPCNAMLDGEAVSSKALALRDNLAAVAKKIRDSKNS

SEQ ID NO: 95819 - protein, 176 aa, Glycine max
  Coding DNA Sequence Number=SeqID_4134
  Gene Ontology: Mol. function=helicase activity; Biological process =viral genome replication
  Homolog annotation: Hit_ID=Q9LX60; Match level="QueryCoverage=74%, HitCoverage=7%, E-value=1e-34, Identity=51%"; Hit description =Putative uncharacterized protein F4M19_60
MVESERLSYIRNNQKKLRVDKYCSLQNSLDIGTAKGLTKGKRVILPSTFVGGPRYIDQLYFDGMAICNHVGFPNIFITLTCNPNWPEIRRLLSPLNLKPTDKPDIVSRIFKLKYEQMLSDLTKGQLLGKVVAYTFLPVKLLGEYLLFQSTGESLLLRDCIFIFQINTMFFMKIMMI

SEQ ID NO: 95820 - protein, 125 aa, Glycine max
  Coding DNA Sequence Number=SeqID_4135
MARCYRPYSSIGKSINHVPSLFDREAVKILLMSHMHIPTETEAFAATNVGVKMRLTWLEDLYHRYINIGYSEGEDYVVDKSVATRLKPLRGSGRALLIMERLDDLHMDAIMWCPYKAHRAVRPFG

SEQ ID NO: 95821 - protein, 17 aa, Glycine max
  Coding DNA Sequence Number=SeqID_4136
MGVEKRQFQGMCGGLWR

SEQ ID NO: 95822 - protein, 68 aa, Glycine max
  Coding DNA Sequence Number=SeqID_4137
  Gene Ontology: Mol. function=cellulose synthase (UDP-forming) activity; Cellular component=membrane; Biological process=cellulose biosynthetic process
  Homolog annotation: Hit_ID=B0I545; Match level="QueryCoverage=80%, HitCoverage=5%, E-value=1e-14, Identity=70%"; Hit description =Cellulose synthase Z632
MMVIAWEQCQRSSRNDTSEYHVFLGENGVHDIEGNELPRLVYVSCEKRAGYHHHKKGGPMNALVRVLA

SEQ ID NO: 95823 - protein, 222 aa, Glycine max
  Coding DNA Sequence Number=SeqID_4138
MVAILKEFQLRLDLDLLVDGLEIKNQAGGEASYTVEAENDGKVSKLYDGAWKKIGGKQSLPMGNNPNKSERKGKNSSLCGSLVTDFCGRIAEEVPMEMVARKLQQLNCSHVPMGKVQQNKEEDLGNHQLRPCALVQFAREPTQPRDLLDITIKALMLCFMTNWSRRWAAGRRYFDSPQPHCGRISCIFPPLPKRQQPQDVHLEDKKMQARGEDREKGGLMED

SEQ ID NO: 95824 - protein, 84 aa, Glycine max
  Coding DNA Sequence Number=SeqID_4139
  Gene Ontology: Mol. function=nucleic acid binding
  Homolog annotation: Hit_ID=A2WY88; Match level="QueryCoverage=91%, HitCoverage=16%, E-value=2e-22, Identity=67%"; Hit description =Putative uncharacterized protein
  Pfam annotation: Domain name=RRM_1; Domain location=5-58; Score=20.5; E_value=0.0019; Accession=PF00076.13; Description=RNA recognition motif. (a.k.a. RRM, RB
MCPKFGIICALNTLTIVYDKDSGRSRGFGFVIFSNEDDAKCAKDAMDGKALLGRPLRINFALEKARGVPVVVPRLSDIGHVNRH

SEQ ID NO: 95825 - protein, 205 aa, Glycine max
  Coding DNA Sequence Number=SeqID_4140
MSELKVSLSRLCAYASKGVARMRKDKLVSTTEFLSQIDWGSIWVRIPVWRFIKKVIPFLEDKFWCPVCHLEDESIWHCLLLCPRVPRLWKRGYMVLIIFWVVWCSRNRTVFEEVIDLEWTLLTKIFSQEEYHPSLCIPQQAQFSLYHSDRVNWASRDLRIKTRVGNMFGSGYKGVNVRNRLSSHPSVGLRSLLLVDALGTSFPRL

SEQ ID NO: 95826 - protein, 124 aa, Glycine max
  Coding DNA Sequence Number=SeqID_4141
  Homolog annotation: Hit_ID=A2Q4L4; Match level="QueryCoverage=71%, HitCoverage=9%, E-value=5e-10, Identity=35%"; Hit description=RNA -directed DNA polymerase
MDFKSHLEQRKTLHSRNQSSPNLLEEAIAQWELAKELGIKRALWESIRQLKNLEPCGLWCILSDFNNIRHPSERVSVTQREGDLNNIIEFNDSLADLEVEEAPCIGRKFTWFRPNGAAKSKLDR

SEQ ID NO: 95827 - protein, 49 aa, Glycine max
  Coding DNA Sequence Number=SeqID_4142
MGKGGVRGINSTIQRRDLSRWMREEVGPEGRDRGLRKQNKDEENSYYYE

SEQ ID NO: 95828 - protein, 140 aa, Glycine max
  Coding DNA Sequence Number=SeqID_4143
  Homolog annotation: Hit_ID=A7PLE7; Match level="QueryCoverage=42%, HitCoverage=27%, E-value=2e-21, Identity=84%"; Hit description =Chromosome chr7 scaffold_20, whole genome shotgun sequence
  Pfam annotation: Domain name=CBS; Domain location=1-105; Score=2.1; E_ value=0.026; Accession=PF00571.19; Description=CBS domain
MGRSGSGGKALPWWGLLILLSVKHLILWYLVSVLPPTFNELQKLLSKTNGQVVGDLMTPTPLVVHESTSLEEAARLLLETKYRRLPVVDDDGKLICLKVVLATVSVTSILLATDNVNTIANVYGRPKEELEATFDGLVRS

SEQ ID NO: 95829 - protein, 102 aa, Glycine max
  Coding DNA Sequence Number=SeqID_4144
MSWLFTFLLTLLLSFHSLLWFQGHKAQPMDDESLNGSSRVPSPTTMSFKATNDAWDVLYAVVGQVARLKMKDLVSSKFDFENSGVLDDLPPPIAEENAFFPN

SEQ ID NO: 95830 - protein, 229 aa, Glycine max
  Coding DNA Sequence Number=SeqID_4145
MELSNQLLSCTLRDDYCLQFLEYLDEHESESPIIVLLTNARIKEGQGSYPSSVSNSLKASKLAINQQVAPIQEFNQSLHSVPQKIDEYTEPFACACGKHNDRAVLRSFYPFSNFCTTIFIFDFNTIIYVCKHNENARFLLWDRECTELIGQSADETCSKIKVTMLGSNDPAQHASQSMSMTADHDPLIGLSLTSTKRQPSDECDDEARSSQISPAQLSSNKLGKHEQIE

SEQ ID NO: 95831 - protein, 251 aa, Glycine max
  Coding DNA Sequence Number=SeqID_4146
MELSNQLLSCTLRDDYCLQFLEYLDKHESESPIIVLLTNARIKEGQGSYPSSVSNSLKASKLAINQQVAPIQEFNQSYFAHVVVNICLLFFPLALALIHLHSVPQKIDEYTEPFACACGKHNDRAVLRSFYPFSNFCTTIFIFDFNTIIYVCKHNENTRFLLWDRECTELIGQSADETCSKIKVTMLGSNDPAQHASQSMSMTADHDPLIGLSLTSTKRQPSDECDDEARSSQISPAQLSSNKLGKHEQIE

SEQ ID NO: 95832 - protein, 56 aa, Glycine max
  Coding DNA Sequence Number=SeqID_4147
  Gene Ontology: Mol. function=transferase activity, transferring glycosyl groups; Biological process=metabolic process
  Homolog annotation: Hit_ID=Q8S9A1; Match level="QueryCoverage=91%, HitCoverage=9%, E-value=5e-09, Identity=58%"; Hit description =Glucosyltransferase-8
MEVEKAVKRIMTGEEAIEMRNRTKMLSHLAKGAIEEGGSSISEFKALIGELSSLSH

SEQ ID NO: 95833 - protein, 382 aa, Glycine max
  Coding DNA Sequence Number=SeqID_4148
  Gene Ontology: Mol. function=protein binding
  Homolog annotation: Hit_ID=A7NTE2; Match level="QueryCoverage=98%, HitCoverage=100%, E-value=1e-145, Identity=67%"; Hit description =Chromosome chr18 scaffold_1, whole genome shotgun sequence
  Pfam annotation: Domain name=DUF620; Domain location=123-372; Score =537.4; E_value=1.5e-158; Accession=PF04788.3; Description=Protein of unknown function (DUF620)
MRKLCPNFDNEDGLDTVLEVPIPEEMLSGMGSNGSNRWKNMRTLMNAQFVDKSSGLSTPSNNEFMVLLKLVGAPLIPLQVPSDHNLTRPLKDCSIRDSSAKYIVQQYVAATGGVAALNSLESMYAMGQVRICGSEVRRQGDGYEESVQSRGKTEVGGFVLWQKNPDLWCLELVVSGFKVSAGSNGKLAWNHSSSQPFHANKGPPRPLRRFFQGLDPRCTANLFLDAECVGENNINNEVCFMLRLQTDQHILQAQSMSNTEIVMHTMLGYFSQRTGLLVKFEDTKLVKMKAVKGKESVFWETSIESMIDDYRYIDGINIAHGGRTIATLYRYGAAHNHKHMIEETWTIEEVDFNIVGLSMDCFLPPSDGEREHEGAEQAVGMG

SEQ ID NO: 95834 - protein, 245 aa, Glycine max
  Coding DNA Sequence Number=SeqID_4149
MTLSSVNAIVYYDGVIITTKHGSTSVSDSPKIVQLDNKMSFDALKKAIGNMISLPKDSQAFDATEDQLHPYLSTSAVDPTSSTQPNESDFTVEPELPNEVFGAFSEDEDEIPNTTIAWIAKKSNIQWGLSLKGCFFWQNKKYNMLYNSIMYGRGERNIANATTRRSSSRGLHDIPLSFLGFQIVYQWISILQARGLGRWNMVVWERIAVMLASNQGYMQVLNKVIEDAQGKTNVHTVLEFDRCDT

SEQ ID NO: 95835 - protein, 612 aa, Glycine max
  Coding DNA Sequence Number=SeqID_4150
  Homolog annotation: Hit_ID=A7P3K9; Match level="QueryCoverage=79%, HitCoverage=90%, E-value=5e-64, Identity=36%"; Hit description =Chromosome chr1 scaffold_5, whole genome shotgun sequence
  Pfam annotation: Domain name=TPX2; Domain location=390-464; Score =28.3; E_value=2.8e-05; Accession=PF06886.2; Description=Targeting protein for Xklp2 (TPX2)
VDSIHSGSISFGRFENEPLSWERRSSFSHNRYLEEVEKCAKPGSVIEKKAYFEAHFKRKGMLGFIPSTGHEGSSDRATSENDGSERNAKQEDFESNDGHYVQFDEMSQKDFELDEGDHYIEMDQSSQEDFVTIEDGHYVQFSEIPGNSNYHEERGMDEYEREETITEYPMVSFSGLQMESAVNNSNDLEDDSKKNITLDEAHQSETSNILSDSGKIVIEVKRDDDVTINTDESSTNMIMPVDEPARGVEETISHDPANPSAKETKLKPQQNSEDNNVRVRKSTPSRSAKDPARIPGRESPRRSNMENNLSKLATPTTWSASKSTKEVSKSAEKLIRENKSENASRVRKGAESQLSASKTAPKGIQEAERLNQASDSTKSNVKPRAAAFNFKCSERAERRKQAKKMHAKEAEMNQMQAISQVSNEFLFLLLYVYGAEEARHIGVEKTEADIKKLRKSLNFKATPMPSFYRTPSPSQTRGNKAVSNNTRSNKEQINKPKCPGSEADAALPSKSKVGNDIDTNESVTGREPSTNHSHLADSMTSNHTSGKKEGAKVSSQKHRVSDSCKGARQLSNERNRNVEPTKQRNDMMRKGVGNVGLRNCSKSGNLAVRVAS

SEQ ID NO: 95836 - protein, 344 aa, Glycine max
  Coding DNA Sequence Number=SeqID_4151
  Gene Ontology: Mol. function=metal ion binding
  Homolog annotation: Hit_ID=A5BSH1; Match level="QueryCoverage=39%, HitCoverage=18%, E-value=2e-13, Identity=40%"; Hit description =Putative uncharacterized protein
MSLPEYSPYMAMSSGIPITSVFGNVEREKIVIIHSRLPLAEKFVQMARAKSMMIFWSVSAAMNRKFISYGLFMEMKWNERSGTAKIATKRFMPEHWSGENIFHHRTEPYARIIATYSGITADITVVIEKGKEVNEFRGIGGPLGNSVKLVANPHGLTQLVPSLPHSLMSCPHFVPHSSVVEGASIVIEDFVGIRIPLMPSPTPSQKKVNFLVTYHFVNALKPHSSSSRAKLSMRNILPKFGFKNRAPSILLDVEKGVTIATQEGSFSVHQEKSSIPRSVSFTKMFTPKIKRTSSLPIEELGCANVECFVWNSWLRAMSRSAHKSGLAQEGPRGEAQCMLSARSA

SEQ ID NO: 95837 - protein, 114 aa, Glycine max
  Coding DNA Sequence Number=SeqID_4152
MLQPCGIGTDLKEYSNRMTPKAYTSKSPSGHLLPDSGPTPKIIFCMQSLKHSSLSIVAFLMLSRAPPPVALLGFPNVREKEKRLNPPFHDPTCDASFSFHKHYFANRNGEDVRK

SEQ ID NO: 95838 - protein, 45 aa, Glycine max
  Coding DNA Sequence Number=SeqID_4153
MAGIWVDHDDKVTVMESFILVWFWPLQYTVHWSKWLYPPRHVLAF

SEQ ID NO: 95839 - protein, 72 aa, Glycine max
  Coding DNA Sequence Number=SeqID_4154
MAKEMDKDQWIYDNIIFEEVNMNEDNGEKPSVFENIDCSDSLSTSQVFATCDDVLHWASSVAYDIGFVVVIM

SEQ ID NO: 95840 - protein, 88 aa, Glycine max
  Coding DNA Sequence Number=SeqID_4155
MVAMQGCRQHQQRYNFHVHKPSTPMARHAQAADTNGETCANVDQSRHCFLLRLAAVQGSHAYSVACRGSHACFNGQTSCNFPLNRSTL

SEQ ID NO: 95841 - protein, 440 aa, Glycine max
  Coding DNA Sequence Number=SeqID_4156
  Gene Ontology: Mol. function=serine carboxypeptidase activity; Cellular component=extracellular region; Biological process =proteolysis
  Homolog annotation: Hit_ID=A7P3L9; Match level="QueryCoverage=90%, HitCoverage=90%, E-value=1e-164, Identity=71%"; Hit description =Chromosome chr1 scaffold_5, whole genome shotgun sequence
  Pfam annotation: Domain name=Peptidase_S10; Domain location=37-433; Score=422.7; E_value=5.1e-124; Accession=PF00450.13; Description =Serine carboxypeptidase
  Subcellular localization annotation: CTP_CleavageSite=60; ConfidenceScore=5.34e-01
MESTIINQVFFFFCFFLCSLLVSDSSPSASKPTPSFPKEALPTKHGYLPISPTSTSSIFYAFYEAQNSTLPLSQTPLLIWLQGGPGCSSMIGNLYELGPWRITESLTLQRNLGAWNRVFGLLFLDSPIGTGFSVASTTQEIPTDQIGVAKHLFAAITRFVQLDPLFKHRPVYITGESYAGKYVPAIGYYILEKNANLKISERVNLAGVAIGDGLTDPETQVVSHAVNAYYVGLINQRQKDGLEKAQLEAVRLAQMGNWSKATGARNKVLNMLQNMTGLATLYDYTRKAPYEDDLVEQFLNIAEVKKALGVNESFVYELCSDVVGDVLHADVMKSVKYMVEYLLGRSRVLLYQGQHDLRDGVVQTEVWVKTMKWEGIVDFLNAERKIWKVNGELAGYVQNWKSLTNVVVLGAGHLLPTDQPVNSQAMIEDWVLEKGLFKSV

SEQ ID NO: 95842 - protein, 248 aa, Glycine max
  Coding DNA Sequence Number=SeqID_4157
  Gene Ontology: Mol. function=phosphotransferase activity, alcohol group as acceptor; Biological process=cAMP biosynthetic process
  Homolog annotation: Hit_ID=A5BL07; Match level="QueryCoverage=97%, HitCoverage=20%, E-value=3e-86, Identity=67%"; Hit description =Putative uncharacterized protein
  Subcellular localization annotation: CTP_CleavageSite=17; ConfidenceScore=5.02e-01
VGRMTLGGLLALGYIVVVSYKRASTTVNNGKVSMSFETIDVLGETFMVMRGTNRKTVGTEALRMGINGPWITKSYLEMILERKGVPRLSTPPLVSNTTVPGSQETVIAAPKPIRVTPNLVTGLDDLPQPWTRSPTKSKMEPVVAEWHFISSDSSLPDNSVLGIFLELEDVANFGDDFLHAYLRFPLCQDFSHEATTDPSSFRDSVRLAPMPDSFDLDRGLLLAVQAIQALLENKGVPVIVGIGNMDVS

SEQ ID NO: 95843 - protein, 261 aa, Glycine max
  Coding DNA Sequence Number=SeqID_4158
  Gene Ontology: Mol. function=secondary active sulfate transmembrane transporter activity; Cellular component=integral to membrane; Biological process=sulfate transport
  Homolog annotation: Hit_ID=A7YGH1; Match level="QueryCoverage=94%, HitCoverage=47%, E-value=8e-83, Identity=58%"; Hit description =Sulfate transporter
  Pfam annotation: Domain name=STAS; Domain location=150-234; Score =22.2; E_value=0.00033; Accession=PF01740.12; Description=STAS domain
  Pfam annotation: Domain name=Sulfate_transp; Domain location=1-127; Score=-35.4; E_value=8.4e-09; Accession=PF00916.11; Description =Sulfate transporter family
  Pfam module annotation: Pfam domain module=STAS::Sulfate_transp; Domain location=150-234::1-127
  Subcellular localization annotation: CTP_CleavageSite=37; ConfidenceScore=5.57e-01
MAIGFMNVVGSTTSCYVTTGSFSRSAINHNAGAKTAMSNLVMSVTVLVTLLFLMPLFQYTPNVILGTIIITAVIGLIDLPSAYLIWKLDKFDFVVMLTAFFGVIFISVQLGLAIAVGLSVFRILLQVTRPKTVMLGNIPATTIYRNIHHYNEATRVPGFLILSIEAPINFANITYLNERILRWVDEEEATINDNLCLQFVILEMSADVIEKLQKADEVDDFVREDYLFMTVGEAVTSLSSLMKGQSPTMEEEEAQKIVTEY

SEQ ID NO: 95844 - protein, 337 aa, Glycine max
  Coding DNA Sequence Number=SeqID_4159
  Gene Ontology: Mol. function=secondary active sulfate transmembrane transporter activity; Cellular component=integral to membrane; Biological process=sulfate transport
  Homolog annotation: Hit_ID=A7P3M8; Match level="QueryCoverage=84%, HitCoverage=52%, E-value=1e-104, Identity=63%"; Hit description =Chromosome chr1 scaffold_5, whole genome shotgun sequence
  Pfam annotation: Domain name=Sulfate_transp; Domain location=197-337; Score=-71.4; E_value=6.5e-07; Accession=PF00916.11; Description =Sulfate transporter family
FSFTERNSDFMEVALDKVTMDQVPNEVHQVVAPPYKSSLQKFITKVKETFFPDDPLRQFKGQPLKRKLILGAQYVFPVLQWAPSYSFKLFKSDLISGLTIASLAIPQGISYANLANLPAILGLCEYVDFASNSSFVPPLVYVVLGSSMDLAVGPVSIASLVLGSMLTEEVSPSEQPDLFLQLALTSTFFAGIFQAALGILRLGFIIDFLSKAILIGFMAGSAVIVALQQLKGLLGIKHFTKKMALSIRKPKLFWVSAGAPLVSVIISTVLSSVIKAQLHGISVIGKLPQGVNPPSVDKLLFQGSHLGLAIKTGLVTGLLSLTVRFILLIYTLLFIGT

SEQ ID NO: 95845 - protein, 150 aa, Glycine max
  Coding DNA Sequence Number=SeqID_4160
MEVIYLSLMEEELKNTWESLEEEWLIRVSPNDQIIEYDYVKGCTWVNHSKWGPAATCPSMGGRRGAHGCVFQERKMHGVATNVYLRKTLKKPERCGLRTLIVKGSGVIFTHGEGCFPRSYVSSIAMRKSNLRSSFRAKRWLSCFDLFPQD

SEQ ID NO: 95846 - protein, 1098 aa, Glycine max
  Coding DNA Sequence Number=SeqID_4161
  Gene Ontology: Mol. function=nucleotide binding; Cellular component =Golgi apparatus
  Homolog annotation: Hit_ID=A2Y5F5; Match level="QueryCoverage=37%, HitCoverage=77%, E-value=1e-153, Identity=65%"; Hit description =Putative uncharacterized protein
  Pfam annotation: Domain name=DUF246; Domain location=705-1035; Score =495.3; E_value=7.2e-146; Accession=PF03138.5; Description=Plant protein family
MKLTDKIGWVSLNNVSNKLFEFDSNVFCRFKDRFFKVLAIDAMVDGLPLMFNRDKEYRFPFYWQSNPTKFKSFDENLLTLVERVDKAILEQLPSSLDMRVILSFPSTSDPLLALDGIMDDFAWRPLVKDARLAGGIVPPFTIALVAGERGQPTGEVGHVVGTVEVAPGRKKLGVHLSLRALRQAAGLTPGSSHPSSLQDVPPALVIVETFASTVVVTVTLARCSGATTSAHVMPPSAASAPSIPPFVVLAATCLPRLIVPMSLWITYTPPAMLIHCGNLIRLAGVQNAIDSAKVFLKRSLMILEENRQQHQEALRKVSSMETKVAKWRATACTVWRQERPKLLRTRSDGDELSTHCKSLQEEKKDLGGKVRDIVTKRDELPKVVVELKARLKESKSWLEESELQVAKEKEASKEVEEELIMCKKDAMEQHEKGFQKVVRQTGLYAKDLDLSFFYPFKDVTDNFLLDEKDIVVEEEVGEEQGADDADVLSTSLVVVRLVELGPLTVDLPRVDLGFDEADMVAAGGLEPSKGVSRMRPDRVLTIDVKERGKTHNPPQNGVVFWDHFREKKRERELCCDAETLIPNAPVQPATEQRALDAVTAAVSAPVAEAPPRRAVQGRAGVFLFAPLIYISGMLLYMGTASFDVVPVIKHRPAPGSVYRSPQLFAKLRLDMDSDNSSADAAIDDELSVRMKGYSKLDIETHKGSNLTRSLGKEAGCKFRDIYDEEFFVNTLKNDVRVVDKIPEYLMERFGSNMTNVHNFRIKAWSSIQYYKDVVLPKLLEEKVIRISPFANRLSFDAPPAVQRLRCLANYEALRFSSPILTIGESLVERMRKHSAINGGKYVSVHLRFEEDMVAFSCCVFDGGKQEREDMIAARERGWKGKFTKPGRVIRPGAIRINGKCPLTPLEVGLMLRGMGFTKNTSIFLASGKIYNAEKTMAPLLQMFPNLHTKETLASEEELAPFKVYICTLMMAAIDYTVCLQSEVFVTTQGGNFPHFLLGHRRFLYGGHAKTIKPDKRKLALLFDNPNIGITTCTSQHNAHNNIGVTNDDMVVVETHKGVEVIDSRERRARVMFGGLIVLVVVIGGRFDGDGARVVAIMG

SEQ ID NO: 95847 - protein, 333 aa, Glycine max
  Coding DNA Sequence Number=SeqID_4162
  Gene Ontology: Mol. function=sequence-specific DNA binding; Cellular component=nucleus; Biological process=regulation of transcription, DNA-dependent
  Homolog annotation: Hit_ID=A7PH59; Match level="QueryCoverage=87%, HitCoverage=86%, E-value=2e-33, Identity=34%"; Hit description =Chromosome chr17 scaffold_16, whole genome shotgun sequence
  Pfam annotation: Domain name=Homeobox; Domain location=76-137; Score =66.3; E_value=1e-16; Accession=PF00046.20; Description=Homeobox domain
  Subcellular localization annotation: CTP_CleavageSite=29; ConfidenceScore=5.16e-01
MSDSFGSTFHSSAPNSTLNSHAPPKITTFCSIAQPYCICTHCNHILTFNHHVGNLAEEGTNSTGSHNNNVQSQPQHSTRWSPTPVQLLVLEELYKQGTKTPSAEQIQQIASQLRQFGKIEGKNVFYWFQNHKARERQKRRRREMEENNNNNAAASSSSGEGLKETGCGVKETKKWASTSNCSGHAEESALDIAEKGSNGWTQFEERGSIQVLRRNISEKQAKLQEMEMPCFLPITIAAPTTTSHRTTTHNTQLLSPQNYNNLSSSLINRESLNYYGGDENADSRTLDLFPHKRDDQDGISLAERKSSSMLCASASMDTEITSNQFFEFLPLRN

SEQ ID NO: 95848 - protein, 178 aa, Glycine max
  Coding DNA Sequence Number=SeqID_4163
  Subcellular localization annotation: CTP_CleavageSite=41; ConfidenceScore=5.25e-01
MEESSKKRKGSSSSTAAAGHRRHRPSEAPTAPIHPSLSSPRSSTLFSSDDQRLRYLSQFSFRIILDPKYLDIDFFNDETFDCYQVFQNSGLVDFMSLKLSYNPELVKVFYSNLKTQDDIISSEVHGISMIIDQSLFFSLTKLPSQGAPFEGTIVNDWRFDYSSHDACRMVCNDQAEMT

SEQ ID NO: 95849 - protein, 170 aa, Glycine max
  Coding DNA Sequence Number=SeqID_4164
  Gene Ontology: Mol. function=ARF GTPase activator activity; Biological process=regulation of ARF GTPase activity
  Homolog annotation: Hit_ID=A5BXZ0; Match level="QueryCoverage=97%, HitCoverage=99%, E-value=4e-59, Identity=63%"; Hit description =Putative uncharacterized protein
  Pfam annotation: Domain name=C2; Domain location=8-87; Score=71.6; E _value=2.6e-18; Accession=PF00168.21; Description=C2 domain
MENILGPSISLIKRGTNLKACDTRTSDPYVFVTMAEQKLKTGVVKDNINPEWNEELTLYVSDVNIPVHLTVSDKDTFTVDDSMGDAEIDLKPYLQCVKMNLSDLPDGHVIKRVQPDRTNCLAEESNCIWKNGKVTQEMSLRLRNVKSGEITVEIEWVNLPDSKGLSEIEF

SEQ ID NO: 95850 - protein, 63 aa, Glycine max
  Coding DNA Sequence Number=SeqID_4165
MRDDSALMTEVLSELWGLRTYVGEQFDSLDGRFAGMDIRLTQLEEDVGYIRQSFDLPPPPPPS

SEQ ID NO: 95851 - protein, 473 aa, Glycine max
  Coding DNA Sequence Number=SeqID_4166
  Gene Ontology: Mol. function=hydrolase activity, hydrolyzing O -glycosyl compounds; Cellular component=anchored to membrane; Biological process=carbohydrate metabolic process
  Homolog annotation: Hit_ID=A7Q143; Match level="QueryCoverage=74%, HitCoverage=94%, E-value=1e-147, Identity=72%"; Hit description =Chromosome chr10 scaffold_43, whole genome shotgun sequence
  Pfam annotation: Domain name=Glyco_hydro_17; Domain location=32-350; Score=347.2; E_value=2.7e-101; Accession=PF00332.9; Description =Glycosyl hydrolases family 17
MATFIRRMAISYILLTLFFSADIGFFGRVASFGINYGQVANNLPPPDKVLELLTNLKVTRTRIYDTNPQILTAFANSNIEVIVTVENNMLGQLNDPQQALQWVSGHIKPYLPDTKITGIQVGNELFTNGDTTLIQYLVPAVVNIHNALVQLGLDSNIHVSTPSSLEVLQESYPPSAGSFKSEISGIMSQFLNFLATTKAPFWINAYPYFAYKDDPNRIPLDYVLFNPNEGMVDSNTNLHYDNMLYAQVDAVSFAIAKLGFSGIEVRVSETGWPSKGDPNEVGATVQNAQTYNRNLLRRQMANEGTPLSPRMRLEAYFFALFNEDMKTGATSERNYGFFQPDATMAYNVGLAAFADSSTSSTSISLTSSATKTKDNMGGCGRPRRRRRGGGQWRPFSGAFSMAKGGNGVVGGAKGGNGVSSDGDRLHLRRLGVTELELEWRCGRGRSVAAMALLHGHSYSAHGKGCVATVKSIQ

SEQ ID NO: 95852 - protein, 51 aa, Glycine max
  Coding DNA Sequence Number=SeqID_4167
MAREGGGTCQLRWRWRKVGLTDDEETSPVVLVVTASAQRNMVRVLAFFVKA

SEQ ID NO: 95853 - protein, 73 aa, Glycine max
  Coding DNA Sequence Number=SeqID_4168
MMITKDDDKGDDKKLKDQSKNNSSESRTIREFKIRIKKNSRSQESRSRFKTQDSRIKRRLNQDKYEKVFSKIE

SEQ ID NO: 95854 - protein, 318 aa, Glycine max
  Coding DNA Sequence Number=SeqID_4169
RVIKRALGREDNRDSDEALQRRRPTTFACRQQEVAAVVENVHHIDDATEEVFQQPQEVVVDVQGFTGGSCDTSILTVYVDHVTERLELKLSSHGRKVKKFGRHPTEIEGLVVVTGLSLLITCSLDTSDWGLISTFAERAFHSFETLHVDEAVLMLVELPEVSVDEARAETVQCYGAYAIIAEDYYERKPCACRWTSTKALPVSMYRKRLDRLTSNDIYWIPYSDHRRGLCDSLGMFRRFFHTLDSRLCLEDIDDRWMHFSDYLAAVGQICLVPGQCAPDYMDWFYIISHPFMGPAQPGYPVIHPLVIQDDTYVEPDMP

SEQ ID NO: 95855 - protein, 110 aa, Glycine max
  Coding DNA Sequence Number=SeqID_4170
MNFDDVKEESNKVATKDKYCFKINTRLLQQTKPCFKITLRSSLASKQSVSKTCKDLKPVSYPNFVRGPLFGGMQPSLDRLDQFESRSFRNIMEVGLLKEEATGRQAPPRF

SEQ ID NO: 95856 - protein, 166 aa, Glycine max
  Coding DNA Sequence Number=SeqID_4171
  Homolog annotation: Hit_ID=A2Q1D6; Match level="QueryCoverage=63%, HitCoverage=16%, E-value=6e-10, Identity=35%"; Hit description =Ovarian tumour, otubain, related
MALRSSLAAKNKADTDQVDLYVDIKHTDQLDPIMFQDVDMDDQNEQECGVNEPHVDCSDAFNISQMFDSRDDVLQWARSVAHENIFVAVIIRSNTNTGSRGRTSFVLIGCEMSGEYRCRKKEFVRRDTGTRKFGCPFKLHGKLVVGGQGRMVKLMCGIHNHELAKS

SEQ ID NO: 95857 - protein, 573 aa, Glycine max
  Coding DNA Sequence Number=SeqID_4172
  Gene Ontology: Mol. function=unfolded protein binding; Cellular component=chloroplast; Biological process=cellular protein metabolic process
  Homolog annotation: Hit_ID=Q2MGR4; Match level="QueryCoverage=96%, HitCoverage=89%, E-value=0.0, Identity=82%"; Hit description=GroEL -like chaperone, ATPase
  Pfam annotation: Domain name=Cpn60_TCP1; Domain location=37-558; Score=497.2; E_value=2e-146; Accession=PF00118.15; Description=TCP -1cpn60 chaperonin family
MAFGVRKMPRFVVCAGPKKILFGKECREALQAGIDKLADAVSLTVGPKGRNVILSESGNLKVINDGVTIARSIELSDAIENAGAILIQEVASKMNELAGDGTSTAIILARAMIESGLLAVAFGANPISLKKGMEKTVKELVKFLKERSVPVEGREHIRAVASISAGNDEYVGNLIAEAMEKIGSDGVISIESSSSSETSVIIEEGMKFDKGYMSPHFITNQEKSIVEFDWVKVLVTDQKISNVKEIVPLLEKAMQLSVPLLIIAEDITRQVLETLVVNKMQGLLRVAVVKCPGFGGAKKALLQDIALMTGADFLSGDLGLTLDGATSDQLGTALKVTITSNATTIIADPSMKAEIQARISQIKKDLSETDNANLSRKLSERIAKLSGGIAVIKVELNTSVRSVPCLVTWNKVGAHTEVELEDRKLRIDDAKNATFAAISEGIVPGGGATYVHLLDLIPTIMNSMEDLEEQIGADIVAKALLEPAKSIATNAGVDGDIVVQKIRTHDWRIGYNAMTGTYEDLLNAGVADPSRVARCALQSAVSVAGAVLTTQAILVDKIKKTKPPVPLVPGITP

SEQ ID NO: 95858 - protein, 297 aa, Glycine max
  Coding DNA Sequence Number=SeqID_4173
  Gene Ontology: Mol. function=ATPase activity, coupled to transmembrane movement of substances; Cellular component=integral to membrane; Biological process=transport
  Homolog annotation: Hit_ID=A7Q1J8; Match level="QueryCoverage=37%, HitCoverage=7%, E-value=2e-38, Identity=74%"; Hit description =Chromosome chr7 scaffold_44, whole genome shotgun sequence
MRSKLSVLESVWGDALVWGEANGDADVNLSLLIVTAAQGLAWILGGGVLNIYVLVLLQMLLSHQPALAFLCLVAIRGVTSIRVCRNSDLQEPLLVNEEPGSLNVNPYRDTGLFSLATLSWLNPLLSIGAKKLLKLKDIPLVAPRDRAKTSYKVLNSNWERLKAENENPSKQPSLTYFKNRRNDKLIMRKKLHKTKYFHCLSTMHVRNGVKAKLQRPTHVEEEEDDARRSTAGQEEVKKHEHVREEARRRWVHDWVREEEKKLGQGKWRRATVAWDCRLREGGHNLEKVQEACDECKK

SEQ ID NO: 95859 - protein, 253 aa, Glycine max
  Coding DNA Sequence Number=SeqID_4174
TALVHMYDHLNDACIRSSRQLAGYITLLQCWIYEHFLSVAECIANPNYDEVSPRACRWIATKPTVKTISIAMYRQRLDRLRIPDTSTRAGHALVRILQSILAQFVDSWVSFDEINDGCMHYLDHLAPAGEICVVSGQCALEYMNWFFVISHPFMIAAQPLDPPRDAPATHDASFVEPHIPQVPKPVAASTHARSDEACHAITERLKCLLNLRIVTEGIATHEVMEECIRIARGVTEDRIVDVRSRRRRRTDQP

SEQ ID NO: 95860 - protein, 122 aa, Glycine max
  Coding DNA Sequence Number=SeqID_4175
  Homolog annotation: Hit_ID=A5AWZ0; Match level="QueryCoverage=45%, HitCoverage=4%, E-value=8e-07, Identity=50%"; Hit description =Putative uncharacterized protein
MATYLLNILPHKLLNYKSPLRVLYHKDPTYSHLRTYDFLDDGPNPYVVHHLVSQSTTPNAQTPGLVPFGPNSPNIATGPTIEPKKNIVNCTNCPATASPPPSLALLHVLAHLFGLLHAANMG

SEQ ID NO: 95861 - protein, 132 aa, Glycine max
  Coding DNA Sequence Number=SeqID_4176
MAPRREKTTMENGELRINLLGRTRLQKKESREEEKPIAGCKYDLNPYVDQLNPYKLHYTSKNGSTNTKEREKRLTSTSMKQHEQKKNVHSRGEKHHEHANNNAEEERVVEERAQEEHAEEELAVVERRRRGS

SEQ ID NO: 95862 - protein, 81 aa, Glycine max
  Coding DNA Sequence Number=SeqID_4177
MSSSKYCSLDLGLALSLLSSAERLLSLFLTLTIHAINFFPHIPILASIQQFLLVFNNEGRERALRVKANAEPDLKPWKLGI

SEQ ID NO: 95863 - protein, 158 aa, Glycine max
  Coding DNA Sequence Number=SeqID_4178
  Homolog annotation: Hit_ID=A7UQU7; Match level="QueryCoverage=70%, HitCoverage=22%, E-value=1e-10, Identity=34%"; Hit description=IMP dehydrogenase/GMP reductase, putative
MVRTRGLGQALGRAIGKVLGKRDETRRQRQQQVVVEDPPTAEEELVNDQPKAPIEEGAADVEGFPGGPHDTSVLSDLENHIALKVWNGEERPELKLSSHGRKMVEFGRPTPEIEGLVVASGLSPLIACSLDTGDRGLMSTFVECWPKETSSFHLPVGE

SEQ ID NO: 95864 - protein, 83 aa, Glycine max
  Coding DNA Sequence Number=SeqID_4179
MQEQNKKIEEAKEHHLDKDALIQHDVAPCGACRPWIFFINEILCFLKIMAAKWRRKKDDWRRHFKEKMSQEEAHHHRKPWIRV

SEQ ID NO: 95865 - protein, 142 aa, Glycine max
  Coding DNA Sequence Number=SeqID_4180
MSRFKNKVRQARQKRDKREGSTKNDSHKSNKRHKPDKHQPLPKGPRFEHYTPMTTNRTTILEEAFNLEVPIKLSSTKPLRPRLDVTKYYSLLKDWTTTKQERDPEDTKRSNIGVTTWTEEEIEQKIKVDRDTSNKYVSQQPP

SEQ ID NO: 95866 - protein, 223 aa, Glycine max
  Coding DNA Sequence Number=SeqID_4181
  Gene Ontology: Mol. function=DNA binding; Cellular component =chromosome; Biological process=nucleosome assembly
  Homolog annotation: Hit_ID=UPI000155FD81; Match level="QueryCoverage =22%, HitCoverage=25%, E-value=4e-10, Identity=68%"; Hit description =PREDICTED: similar to histone H4
MAAIRDENGSDCLVGIFGLTCLSIEPVPAPFLCLAVARGSTGNSNFCSNGCKPQRELTKLKRCYCSQTNAGYGGGGGSGFDGGGGGGGFSGYNHGDGGYGGEGNDIKCGGHGREAKTRTVLKNFLENVLCDVVTYIEHVKRKTSTTMDVVGALKRQVRVLYGCSGRRGGYNHDGGMVDKEFPWYRTRLASGSGYSQNQSQGIELDVHREKDAMERGGLAGGVD

SEQ ID NO: 95867 - protein, 656 aa, Glycine max
  Coding DNA Sequence Number=SeqID_4182
  Gene Ontology: Mol. function=catalytic activity
  Homolog annotation: Hit_ID=A2Q289; Match level="QueryCoverage=99%, HitCoverage=99%, E-value=0.0, Identity=79%"; Hit description =Peptidase, trypsin-like serine and cysteine proteases
MNQNRLDLRAHHSGSTQSEESALDLERSYYGHPNPSCPSPLQPFAGGAQHSESNAAYFSWPTLSRWNDAAEDRANYFGNLQKGVLPETLGRLPTGQQATTLLELMTIRAFHSKILRRFSLGTAIGFRIRGGVLTDIPAILVFVARKVRRQWLNHVQCLPAALEGPGGVWCDVDVVEFSYYGAPAQTPKEQLYTELADGLRGSDSCVGSGSQATPKEAATKVASQETYGTLGAIVRSRTGNREVGFLTNRHVAVDLDYPNQKMFHPLPPSLGPGVYLGAVERATSFITDDLWYGIFAGTNPETFVRADGAFIPFAEDFNMNNVITTVKGVGEISDVNIIDLQSPINSLIGRQVVKVGRSSGLTTGTIMAYALEYNDEKGICFLTDFLVVGENQQTFDLEGDSGSLILLTGQNGEKPRPVGIIWGGTANRGRLKLKVGQPPENWTSGVDLGRLLDLLELDLITTNEALQVASGTVYHCSTTSCKCSAAGHPCPLFLTDDYPIRISQAICVHTLSPAAAVLEQRNGSAAGIDSTVGESSPTVPIKEKLEESFEPFCLNIPLAQVEDEPSQRVNPSIRPCDFHIKSEIETAPNVEHQFIPSYAGKSPACQSYLKEDMELKSLAELRNGPDEDNFVSLHLGEPEMKRRKISNSSFCIKELK

SEQ ID NO: 95868 - protein, 441 aa, Glycine max
  Coding DNA Sequence Number=SeqID_4183
MVDVDKVDFWTSYVGLRVTFVRRTRGRACKTKDSDAQGSKELDTYRSGMELRVLVCRGRYSPWPDVRASVLGLAWRVDTCLGVPCRMPHGDEFVKPPSMDKCCPGCFVKLSKVDMLLGLQAKSNVLGERDELVKVVADLEAWLKELESRLEEFEHRAAKEREASKELAMYKKKAVEQHEKDFQKAVRQDVKDGVLLDLGHHDESEIFDGIGSKTLWGGGKTLVGGASFLLWGAFPLIDTWLKVLSTDLLIGCLGLWTFSTDGYEEYVWLAPGWRSCQLVWGVALRLTKDGLGFCEPGLTKGELWFNELGTHGVACTGVVAACSCTHVTHGVARTGVVAACSCIRVTRGVLHTGGMVACSCIRVTHGMVRIIDVHVTRGVVCTGEMVSCSCIHVTCEVMRSGDFVSCSCIRGTREVTCTRDVVSCPCIRGTYEVMLLHTWHL

SEQ ID NO: 95869 - protein, 298 aa, Glycine max
  Coding DNA Sequence Number=SeqID_4184
  Gene Ontology: Mol. function=transferase activity; Cellular component= cytoplasm; Biological process=autophagic vacuole formation
  Homolog annotation: Hit_ID=Q2MGR6; Match level="QueryCoverage=95%, HitCoverage=88%, E-value=1e-119, Identity=73%"; Hit description =Intracellular chloride channel
  Pfam annotation: Domain name=GST_C; Domain location=175-269; Score =7.3; E_value=0.019; Accession=PF00043.16; Description=Glutathione S -transferase, C-terminal domain
MARFSLDEISDTGAFVRSASTFRNWISRDLNSQFPPESGRYHLYVSYACPWASRCLAYLNIKGLNKAISFSAVKPIFERTNESDDYKGWVFPESETEVPGAEPDMLNGAKTIRELYEIASANYTGKYTVPVLWDKKLKTIVNNESSEIIRMFNTEFNSIAENPTLDLYPTDLKPQIDDTNEWIYTSINNGVYKCGFAKKQEPYNEAARQLYGALDKCEDILSKQRYICGNTLTEADIRLFVTLIRFDEEREKVIAQRQYKWRLQFLLYLSDVWELYRSSQTKKLEESQGTARDAVIAV

SEQ ID NO: 95870 - protein, 122 aa, Glycine max
  Coding DNA Sequence Number=SeqID_4185
MGCYNSNPLKKSFVLKTLPKDREERDYISGSQYQAMCLVEAPFSDFDHETPLHLATKSGDPRNTDDNLKRTSRYKETRLTTWLTFFFKHETIKRKGNLDTSILTPLYKFARKVEGPIAVYDV

SEQ ID NO: 95871 - protein, 297 aa, Glycine max
  Coding DNA Sequence Number=SeqID_4186
  Homolog annotation: Hit_ID=Q9SIQ5; Match level="QueryCoverage=64%, HitCoverage=13%, E-value=4e-08, Identity=29%"; Hit description =Putative non-LTR retroelement reverse transcriptase
MVKKVRMPRKGKEKDQGETSRDGFVGGPRFGVLGNQIDEERASINDNDKAITRNIGGIVIISKVVDGGRPTLAGRDPKIGHTKKESQRGLDQGHPYARGRNKGNMSRCSIRRGENINGVVKDMECVAETLSLSNGVFFGARGFLGGICVARRMDKVNVIINLKHLHFIHLRVRFENQDWWWFSLVYASPIKGVRGELRNYLHNISTSNPDRWWMMADDFNDILIQEEKKGGAPTYVRKCFIFHQRINGNNLMDLAFCNAHWHMAFPTASIKVLTRVSFSDHHPILVSMNDGCNFSNK

SEQ ID NO: 95872 - protein, 385 aa, Glycine max
  Coding DNA Sequence Number=SeqID_4187
  Gene Ontology: Mol. function=zinc ion binding; Cellular component =cytoplasm; Biological process=cellular response to starvation
  Homolog annotation: Hit_ID=A5ALR8; Match level="QueryCoverage=85%, HitCoverage=90%, E-value=1e-116, Identity=51%"; Hit description =Putative uncharacterized protein
  Pfam annotation: Domain name=zf-ZPR1; Domain location=142-295; Score =169.0; E_value=1.2e-47; Accession=PF03367.4; Description=ZPR1 zinc -finger domain
MKKKKRKQNSNEYMANQKKWEAYPGLGSLSRPKALSFLGLQNLSKLTRFAPSSDPSLTIKFYERTPEQQASLGYLVDSTHIEGIHDETPEGGEAVTADQVRREPHGSIGATAGHRAIAQSNSSEIAEALFRYTAPEEVMTFPSSCGACAASYIPYFQEVIVMASTCDSCGYRNSELKPGGRIPEKGKRITLNVKNVNDLSRDVIKSDTASVKVPELDLELASGTLGGIVTTVEGLITKISESLERVHGFTFGDSLDEQRKGKWIDFKARLNKLLSLEEAWTLILDDALANSFVAPATDDLKEDNQLSWARVSTFCVTVLSNLHNWNHVTNGFNELYFSVWQFCHDISSVEEYERSWEQNEELGLNDIDTSSADVAYESTNTTKTE

SEQ ID NO: 95873 - protein, 71 aa, Glycine max
  Coding DNA Sequence Number=SeqID_4188
MGEGCCTQPYPCICKEAVSGFEPMTNKSPRHNFTAAPGLALISAQGPTKNRKAFDIKEKLSLETREHLQAH

SEQ ID NO: 95874 - protein, 145 aa, Glycine max
  Coding DNA Sequence Number=SeqID_4189
MANKLKLLSGLIDPYMASYVVLIGLKQSQIHMASSKWRSDDSFNSAYLATLQCVRRRSWRVCGRGRVGMREEGRGKGRGFRHRGKRESKREMKGERVKGRQKRLGVGKRMGSGKEGRGKGDRWGNIWGEGEEGRERVEGNDYGKG

SEQ ID NO: 95875 - protein, 356 aa, Glycine max
  Coding DNA Sequence Number=SeqID_4190
  Gene Ontology: Mol. function=metal ion transmembrane transporter activity; Cellular component=integral to membrane; Biological process=metal ion transport
  Homolog annotation: Hit_ID=O65348; Match level="QueryCoverage=100%, HitCoverage=100%, E-value=1e-139, Identity=71%"; Hit description =Root iron transporter protein
  Pfam annotation: Domain name=Zip; Domain location=44-353; Score =368.8; E_value=8.9e-108; Accession=PF02535.13; Description=ZIP Zinc transporter
MATSLTLFKTIFVFLIIFTLLTPQATADCEAESRNSCNNKKKALPLKIIAIFTILASSIIGISLPLVTRSVPALSPENNLFIIVKCFAAGIILGTGFMHVLPDSFDMLWSDCLKEKPWHEFPFSGLAAMFSAIITMMVDSLSTSIYTKKYRTTEVVPGESNRAGGGDQLEMAAVNLGHFHGHHHAHETKIEGKEAQLLRYRVVAMVLELGIIVHSVVIGLGMGASNNTCAIRGLIAAMCFHQMFEGMGLGGCILQAEYKFLKKVIMVVFFSVTTPFGIALGIAMSTTYKENSPSALITVGLLNASSAGLLIYMALVDLLSADFMSPRLQGSIKLQLKSYVAVFLGAGGMSLMAKWA

SEQ ID NO: 95876 - protein, 153 aa, Glycine max
  Coding DNA Sequence Number=SeqID_4191
MQGVWLWVILRALQSVLQGYTNNCLPFSGISEARLEVGEIVVGHFMCLPHGLRDMCVIKLRLLAPNEYRNGVIDILIGWSIVRRLRPDGGVGSTPETVLTVATATVLTSIIFFMLIKASIIVPIYSFMASMSAFIRSCTSSTSAITPALACVW

SEQ ID NO: 95877 - protein, 195 aa, Glycine max
  Coding DNA Sequence Number=SeqID_4192
MKHASTGGLHIRAFKELKVANCANTARGGGYRPATMHIGARFCPDRCRETSADHVHQHMDDVATYSTECPSLLARSSGPLLTGPSSRSIASPGRRRARHHSNLWTTSSGRQAHCHYLQSPPQLIYKGRSVAYDTWPTSRRPTTRAEVLLGGNLELATKKLPAKHSRKGTIEEGYSVAPQADTGFDKHRFQSAKHQ

SEQ ID NO: 95878 - protein, 291 aa, Glycine max
  Coding DNA Sequence Number=SeqID_4193
MVRGDKSWSSAFLYHPETIKSDGMRRQIMVIRFPLPSRDNQVRWRAKTNYGHFPPIVEDYMSFDQDYCSLLCHPETSESIGMQRQIMVICLLLSKTPCLSTETIAVSFAIQRQVSSLACRDKLWSSAPFCRRLHVFRLGLLQSPLPSRHKRVYWHIETKMFIFPSCRRLNVFRPRLLKFPLSSRDNQVRWHAETNIVICPLVEDSCFRRLLQSPFVIQRQSSLMARRHHETSESIGTRRISWSSIFIVFETIEVSLAIHTQVSLIELVVGRAERSIELNRSSLHLSFWKNI

SEQ ID NO: 95879 - protein, 120 aa, Glycine max
  Coding DNA Sequence Number=SeqID_4194
MAAILSVWTVEDWHLNLLHHDEPARTLQRTVEWILPTPTPYCLVEPVQVIEVTSSEEDPEEDPEELPPEPAMDALDFLEGDEDPLPEVDSPEDVMSASEADSTEDSGPGEMAISGGSSSL

SEQ ID NO: 95880 - protein, 47 aa, Glycine max
  Coding DNA Sequence Number=SeqID_4195
  Homolog annotation: Hit_ID=Q2HSY4; Match level="QueryCoverage=91%, HitCoverage=10%, E-value=1e-07, Identity=55%"; Hit description =Cyclin-like F-box
MRRIRLSRKNTGEQGDPRSGYYGGIRKLHNEDEIEKWKKLFPSQVQA

SEQ ID NO: 95881 - protein, 81 aa, Glycine max
  Coding DNA Sequence Number=SeqID_4196
MAEVHIPQVFKQHNFLERKSACNRDRQILIARFPNPNYGVKTGFSKELKLARRRLRSQDYLRETMKWRIEGFSPSNLQGGF

SEQ ID NO: 95882 - protein, 110 aa, Glycine max
  Coding DNA Sequence Number=SeqID_4197
MMITKDDDKKLKDQSKNNSSESRIIQEFRIRIKKNSRIKRNLRNKHNNNGRNDDKKPKRMTSRLSQEQFKNQEKFDFKNQESSFKFQESRIIKIKTQDSRIKKRLNQDKY

SEQ ID NO: 95883 - protein, 138 aa, Glycine max
  Coding DNA Sequence Number=SeqID_4198
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=63%, HitCoverage=73%, E-value=5e-25, Identity=68%"; Hit description=LacZ protein
  Subcellular localization annotation: CTP_CleavageSite=10; ConfidenceScore=5.28e-01
MTTSGTWHNSAMSTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 95884 - protein, 21 aa, Glycine max
  Coding DNA Sequence Number=SeqID_4199
MAGKLAVIVAQRLPFRNAGAQ

SEQ ID NO: 95885 - protein, 445 aa, Glycine max
  Coding DNA Sequence Number=SeqID_4200
  Homolog annotation: Hit_ID=UPI00006A2D9E; Match level="QueryCoverage =39%, HitCoverage=85%, E-value=9e-14, Identity=17%"; Hit description =UPI00006A2D9E related cluster
ITIKGPIEAQRSSLHRCPTSKLLSLHVLAIRGLHALAIRGLHALAFRGLHVLAIRGLHALAIRGLHTLAFRGLHVLAFRGLHTLTLRGLHALTFRGLHVLAIRGLHALAIRGLHALAFRGLHVLTFIGLHAFTLRGLHVLAFRGLHVLAIRGLHALAIKGLHALASEGYTSSPSEDYTGLHVFTFRGLHVLTFKGRNVLAFRGLHICAFRELKFLGHPLDLGGGPTMRAQLEREAIMQLLCVPGQDFAQTTIGRQVRIMLTTTTSISPCQSGSRPQDTQVDSEESNRALGFPALVTDLYQSYRVPVPPAGDRIRKTPNGPGEFQQGPGVSNSDYGPLARHHNSQGMADSGQQCTTTTSRAPQLIYKGWSIAYDPWPTSRRPSPKPKARDRQVIARPTQDVKEALLGGSQELATKKLPAKWSKKGTIEEDSSVTPQADTGFEKHRF

SEQ ID NO: 95886 - protein, 72 aa, Glycine max
  Coding DNA Sequence Number=SeqID_4201
MSTPIFREEIARRHWSSLATPMAKFNPEVVLEFYANSWPTEEGVRDMRSWVRGINEALGLNLELGLDLKRAD

SEQ ID NO: 95887 - protein, 113 aa, Glycine max
  Coding DNA Sequence Number=SeqID_4202
MPLKGKQLVVYPLKTLWRALSIIHNHNPHVPQWLKTLITMAEMGKLDHLEERLRAIEGGEDYSFANLEELFPIPNIITPPKFKVLDFDKYKGDYLPQEPSKDVLSEDGGMRKR

SEQ ID NO: 95888 - protein, 341 aa, Glycine max
  Coding DNA Sequence Number=SeqID_4203
  Gene Ontology: Mol. function=motor activity; Cellular component=cell projection
  Homolog annotation: Hit_ID=UPI00016621D1; Match level="QueryCoverage =62%, HitCoverage=40%, E-value=1e-18, Identity=33%"; Hit description =UPI00016621D1 related cluster
GLHTVTFSGLHIITSRGLHALTFRGLHVLAFRGLHVLAFRWLHALTFKGLHLLAFRRLHVLAFRGLHVLTFDGLPVLAFRGLHGLTFRGLHALTLKGQQVLAFRGLHTLAFRGVHALAFRGLHVLTFRGQHILTFRGQHALTLKGLHALTFRGLHTLTFRRLLVPSIKGLHVLAFRGLHFLAFRGLHVLSFRGLHVPAVKGLHVLSFRGLHILSFRRLHDSTPSFSWGYTPSPSEDYTFSPSEGYTPSALEDCTPSPSEDYMSSPSEEYNNSHSEDNTSLPLEDYTCSPSEDYTSLPSDGYTPSPSEGYMSSPSEDYTSSPSKDYTSSPLEDYTSSPSEDY

SEQ ID NO: 95889 - protein, 283 aa, Glycine max
  Coding DNA Sequence Number=SeqID_4204
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIFMPKPVPNEVSFCHPGWSAMLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 95890 - protein, 139 aa, Glycine max
  Coding DNA Sequence Number=SeqID_4205
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=79%, HitCoverage=96%, E-value=1e-24, Identity=56%"; Hit description =Putative uncharacterized protein
  Subcellular localization annotation: CTP_CleavageSite=44; ConfidenceScore=5.19e-01
MTMITPSSKLTLTKGNKSWYRAPPRESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVR

SEQ ID NO: 95891 - protein, 208 aa, Glycine max
  Coding DNA Sequence Number=SeqID_4206
  Gene Ontology: Mol. function=chloramphenicol O-acetyltransferase activity; Biological process=response to antibiotic
  Homolog annotation: Hit_ID=P62577; Match level="QueryCoverage=100%, HitCoverage=100%, E-value=4e-88, Identity=75%"; Hit description =Chloramphenicol acetyltransferase
  Pfam annotation: Domain name=CAT; Domain location=6-198; Score=307.4; E_value=2.8e-89; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDSGSFYTYIRKMWRVTVKTWPISLKANPWVSFTSFDLNVAIWTILRPRFHHGQILYARRQGADALAIQVHHAVCDGFHVGRMLNELQQYCDEWQGGA

SEQ ID NO: 95892 - protein, 178 aa, Glycine max
  Coding DNA Sequence Number=SeqID_4207
  Gene Ontology: Mol. function=transferase activity, transferring glycosyl groups; Cellular component=cytoplasm; Biological process =purine ribonucleoside salvage
  Homolog annotation: Hit_ID=A4TPU7; Match level="QueryCoverage=100%, HitCoverage=98%, E-value=8e-80, Identity=84%"; Hit description =Hypoxanthine phosphoribosyltransferase
  Pfam annotation: Domain name=Pribosyltran; Domain location=3-149; Score=137.3; E_value=4.2e-38; Accession=PF00156.18; Description =Phosphoribosyl transferase domain
MKHTVDVMISEQEIATRIAELGKQISEHYRNSGSEMVLVGLLRGSFMFMADLCRAIDVAHEVDFMTASSYGSGMSSTRDVKILKDLDEDIRGKDVLIVEDIIDSGNTLSKVREILQLREPKSLAICTLLDKPERREVEVPVEFVGFTIPDEFVVGFGIDYAQRYRHLPYIGKVTLLDE

SEQ ID NO: 95893 - protein, 84 aa, Glycine max
  Coding DNA Sequence Number=SeqID_4208
HALRRPYRTRARARVMGEAEEAIKEQKATMMKAMMSMKKMMEANAVIVVAISAVAKGEPDAPIWPQANESSNLKYGRQRFGKYG

SEQ ID NO: 95894 - protein, 145 aa, Glycine max
  Coding DNA Sequence Number=SeqID_4209
ELMDKLQRLRQGSMSIEEYRQQMELLLLRARLREEERTSIASNNLKESLLQNLTALTLIPRKDQAHEILGAVPSKSKEDKGHIASQCPTNKTMIMRGQDIYSSQEETTSCPSSSGSEDEVRGVESSEEVHPHEDCDLLMVRRLLG

SEQ ID NO: 95895 - protein, 76 aa, Glycine max
  Coding DNA Sequence Number=SeqID_4210
MRKNHGLEAGNAAQKHKPKRVESVNADAEAFGDHWKTGDSTVLKIGDSAKVVIKQDMKGGEHKYGYNNNKREKPEK

SEQ ID NO: 95896 - protein, 232 aa, Glycine max
  Coding DNA Sequence Number=SeqID_4211
MASGNRLPRLCNRLPGLKMGSGSRDGFWKSRWLLSNKPLVIDYQLCVIDYTVHFTGFHVLKLCNSCLASGNRLPRLCNRLPEMKSLEIVMAAQVIHDQVEMECLEGAWETLEGNARCRFRGTIRFTATSLVHPKEPACMLQRTVEWILPTPTPYRLVEPVQVIEVTSSEEDPEEDPEELPPEPAVDALDFLEGDEDPLPEVDSPEVVMSVSEADCTEESGLGEMATSGGYSS

SEQ ID NO: 95897 - protein, 90 aa, Glycine max
  Coding DNA Sequence Number=SeqID_4212
MTIVSQIALRGRAKARLTGALSKGGKMRGVATNVYLWEKRRKNRRKPVKMKILSSGVVFTLEEGRHQAELLLLRTLLWRGNQTYIVLSYA

SEQ ID NO: 95898 - protein, 205 aa, Glycine max
  Coding DNA Sequence Number=SeqID_4213
MGEVEEVQEQIKANMEAMKEQMATMVEAMMSMKKIMEANAVTVAATSAVAKVKSMPPSGLNQMNHPTSVMVGKDFGSMSGPYYVQIQNKHTFPPYGLPLNYTPPNMAYTPSEDVNNSTPILIESRQPQTDHAHVSQPMGETHEMPHHNLADFEPCLGYATEGQAVGYIPLQNTLESPQYHTQPHPLHSTPGKTLMLWKKWKSWII

SEQ ID NO: 95899 - protein, 107 aa, Glycine max
  Coding DNA Sequence Number=SeqID_4214
  Subcellular localization annotation: CTP_CleavageSite=60; ConfidenceScore=5.40e-01
MHTRSFTIPHFPKIGLTHKNSPQWSHQLSQPTLLRASEARLTGASSKGGKCAESPPTFICGKRRKNRRKPVMKNISDSGVVFTFEEGRQKRGSCSYVSSIEEEIRPT

SEQ ID NO: 95900 - protein, 61 aa, Glycine max
  Coding DNA Sequence Number=SeqID_4215
LREFYGSITGVLEAPESHFSTKRGVWWPPSELGCFNLKQEIAQKPLEGPRFKNYYLHLPFY

SEQ ID NO: 95901 - protein, 341 aa, Glycine max
  Coding DNA Sequence Number=SeqID_4216
  Gene Ontology: Mol. function=5-methyltetrahydropteroyltriglutamate -homocysteine S-methyltransferase activity; Cellular component =cytosol; Biological process=methionine biosynthetic process
  Homolog annotation: Hit_ID=Q5PKP9; Match level="QueryCoverage=100%, HitCoverage=45%, E-value=1e-179, Identity=90%"; Hit description=5 -methyltetrahydropteroyltriglutamate--homocysteine methyltransferase
  Pfam annotation: Domain name=Meth_synt_1; Domain location=4-316; Score=667.8; E_value=8.6e-198; Accession=PF08267.3; Description =Cobalamin-independent synthase, N-termina
MTILNHTLGFPRVGLRRELKKAQESYWAGKATREDLLAVGRELRARHWEQQKQAGIDLLPVGDFAWYDHVLTTSLLLGNVPARHQNKDGTVDIDTLFRIGRGRAPTGEPAAAAEMTKWFNTNYHYMVPEFVQGQQFKLSWTQLLDEVDEALALGHKIKPVLLGPVTYLWLGKVKGEQFDRLSLLNDILPVYQQVLGELAKRGIEWVQIDEPALVLELPQAWLDAFKPAYEALQGQVKLLLTTYFEGIADNLDIITALPVQGLHVDLVHGKDDVAELHKRLPADWLLSAGLINGRNVWRADLTEKYAQIKAIVGQRELWVASSCSLLHSPIDLSVETRLDAE

SEQ ID NO: 95902 - protein, 91 aa, Glycine max
  Coding DNA Sequence Number=SeqID_4217
MAKAHQKGVRKVNETRIKENRGGACHPARPGEPEEHPERLKWAWLRNLTGHVITPFLAFGMLRKLTDCVTILPFDFRHVTEFHGLRNNASF

SEQ ID NO: 95903 - protein, 65 aa, Glycine max
  Coding DNA Sequence Number=SeqID_4218
MEVNEPWLGLWLPLNYQVDMGASQHRTPKLGYQVVPLYLSKSSTLNLGGVMILGTRNNSSRLAKE

SEQ ID NO: 95904 - protein, 27 aa, Glycine max
  Coding DNA Sequence Number=SeqID_4219
MEESLSYPNIVRGPLLDDMRPFFGPRE

SEQ ID NO: 95905 - protein, 283 aa, Glycine max
  Coding DNA Sequence Number=SeqID_4220
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDKVPCVSRQWWASRCIQRTVTLLPWGNCDQCPDGRLSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 95906 - protein, 60 aa, Glycine max
  Coding DNA Sequence Number=SeqID_4221
MEKGTSLPMEKGKALQWHSAYVKNMGLDKLSSWNDYTKILIERFGEVYEDPMAELMRLRQ

SEQ ID NO: 95907 - protein, 125 aa, Glycine max
  Coding DNA Sequence Number=SeqID_4222
MGSTILCVRLERGIHAPGKGLTRRIDVHIGAPRDHPVSRVVALTSRRVYQAPQPKQVLSVLLLLSCPGGYGFRFAGRVRRVKQVHRTLVTLAYMSPKEWARTEDVVKQPAHLGEQVASGGSNQFA

SEQ ID NO: 95908 - protein, 72 aa, Glycine max
  Coding DNA Sequence Number=SeqID_4223
MDSLAMGVKRPGVINQGYDNRFAFTLNGSQELPRLLVKVKVMADVYSAPEEVHRLLNYFQHMIDLMAHIIRS

SEQ ID NO: 95909 - protein, 174 aa, Glycine max
  Coding DNA Sequence Number=SeqID_4224
  Gene Ontology: Biological process=transposition, DNA-mediated
  Homolog annotation: Hit_ID=Q1J7G7; Match level="QueryCoverage=17%, HitCoverage=42%, E-value=3e-10, Identity=100%"; Hit description =Transposase
MPLGYINGGISIGTSYVPIKVSSSPKVGPGLPGYQQGHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDVDGIQEFDPRGTRNNDDLET

SEQ ID NO: 95910 - protein, 176 aa, Glycine max
  Coding DNA Sequence Number=SeqID_4225
  Homolog annotation: Hit_ID=Q6WAY4; Match level="QueryCoverage=88%, HitCoverage=28%, E-value=9e-18, Identity=36%"; Hit description =Putative uncharacterized protein
MGTNQNGKRFYQVKVKSLDVTSLKELGRLMGPLQRQPFRKVYGKILDLTAVEVFTEAVESLAQYYDQPLRCFTFGDFQMVPTIEEFEEILGCLLGGRKPYLFSGFLPSLSKIAVVVGDSAKELDRMKQTRNGVVGLPRKYLEGKARDMASQEKWGPFADILALLIFGVVLFPNIDG

SEQ ID NO: 95911 - protein, 72 aa, Glycine max
  Coding DNA Sequence Number=SeqID_4226
  Gene Ontology: Mol. function=protein transporter activity; Cellular component=integral to membrane; Biological process=protein transport
  Homolog annotation: Hit_ID=Q1GYS8; Match level="QueryCoverage=100%, HitCoverage=32%, E-value=5e-28, Identity=88%"; Hit description =MotA/TolQ/ExbB proton channel
  Pfam annotation: Domain name=MotA_ExbB; Domain location=1-62; Score= -8.3; E_value=4.4e-05; Accession=PF01618.7; Description=MotATolQExbB proton channel family
MNAFRGLSNVAQATLSQVAPGIAEALVATAIGLFAAIPAVIAYNRFAAGVDRLSVRYESFIEEFTNILQRRA

SEQ ID NO: 95912 - protein, 66 aa, Glycine max
  Coding DNA Sequence Number=SeqID_4227
  Gene Ontology: Mol. function=aspartic-type endopeptidase activity; Biological process=DNA integration
  Homolog annotation: Hit_ID=A5B7I7; Match level="QueryCoverage=69%, HitCoverage=5%, E-value=1e-15, Identity=78%"; Hit description =Putative uncharacterized protein
MVVNTMADMTVQVNNIRGLLPAKARPYKPNERKLDSRTVSSYFIGYSERSRGYKFYDPKLKTIFET

SEQ ID NO: 95913 - protein, 242 aa, Glycine max
  Coding DNA Sequence Number=SeqID_4228
  Homolog annotation: Hit_ID=Q2HW90; Match level="QueryCoverage=80%, HitCoverage=39%, E-value=3e-22, Identity=35%"; Hit description =Putative uncharacterized protein
MGPLQRQAFRKVYGKILDLTVAEVFTKVVVSLAQYYDQPLRCFTFGDFQIPTVEEFEEILGCPLGGRKPYLFFGFLPSLSKIAAVIGDSARELDRMKQTRNGVVGLPRKYLKGKARDMASQEKWVPFADILALLIFGVVLFPNVDGLVDLAAIDAFLAYHHSKKSLVVAILANLFDTFDRRCEKNSARIVCCLPALCVWLVSHLFQQDIRHPCPLQIYHSCVEKRRVDWDQHLAGIGGSTIN

SEQ ID NO: 95914 - protein, 141 aa, Glycine max
  Coding DNA Sequence Number=SeqID_4229
LFVLQTAKKNVYTDNHSGISARQRDSNVSMTDLVSAEDDTAKKNVYTDNHSGISARQRDSNVSMTDLVSAEDDTAKKNVYTDNHSGISARQRDSNVSMTDLVSMEDDTAKKNVYTDNHSGISARQRDSNVSMTDFVSAEDD

SEQ ID NO: 95915 - protein, 89 aa, Glycine max
  Coding DNA Sequence Number=SeqID_4230
MMMKEERRRFLFSPKMLSAINLGTGRFNCPMFKRRMEKFDKINFKEKKEKKGKRRPHFSPKKSEYVIYGDNKQRPLDQQPQQTVLDDCD

SEQ ID NO: 95916 - protein, 152 aa, Glycine max
  Coding DNA Sequence Number=SeqID_4231
MAPDRTQLQNMVKRESESLKKYAQRGSEQLGQRRRKEIPMSSLQRPHGSTPNITQASWLTPGTPPTQHSYKLGHSRPSRGSPPSSGSNPNSRGQQYPLWRRFQHDKELSPKANSEIHPNPNDVRRPLTIPYRQPDGCDISRKDLPASFPKVV

SEQ ID NO: 95917 - protein, 85 aa, Glycine max
  Coding DNA Sequence Number=SeqID_4232
VVPGDMSRGSGDLGDVRQAPGSQQIKGTKTTKQGGLCGGWPAVNLEAKMVSGNRLPQGVVKASGNRLPVCVIDYTEEWATGNRLP

SEQ ID NO: 95918 - protein, 112 aa, Glycine max
  Coding DNA Sequence Number=SeqID_4233
GLARSPAFSSGGGGASAAQEPASEEPTVVATEGEDELTPPEPSYFDAGIHMAKEEDASTDQIPEPSPTPIPDDATPFALAPDLEQPISQDSPTAQVLDLNDAQEQPQDEQDI

SEQ ID NO: 95919 - protein, 96 aa, Glycine max
  Coding DNA Sequence Number=SeqID_4234
  Gene Ontology: Mol. function=xylose isomerase activity; Cellular component=cytoplasm; Biological process=carbohydrate metabolic process
  Homolog annotation: Hit_ID=Q8U7G6; Match level="QueryCoverage=100%, HitCoverage=22%, E-value=4e-47, Identity=95%"; Hit description =Xylose isomerase
LRRQSLDPQDLLIGHIGGMDCCARGLKAAAKMIEDGALSKPLKERYAKWDSPEAQKMLRGELKLDEIAALVEREDINPEPKSGRQEYLENVVNRYV

SEQ ID NO: 95920 - protein, 188 aa, Glycine max
  Coding DNA Sequence Number=SeqID_4235
  Gene Ontology: Mol. function=oxidoreductase activity; Cellular component=membrane fraction; Biological process=electron transport
  Homolog annotation: Hit_ID=Q7CV28; Match level="QueryCoverage=85%, HitCoverage=77%, E-value=5e-87, Identity=97%"; Hit description =Nitroreductase
  Pfam annotation: Domain name=Nitroreductase; Domain location=1-147; Score=39.4; E_value=1.3e-08; Accession=PF00881.15; Description =Nitroreductase family
TSSGLQPFEVIVVTDPEVRAKIREIAWNQAQVTEGSHLLVSAAWDNYTEERINHMFDLVNEERGIKNEGWEAYRQMLLNTYPQRDQQVNFEHAARQAYIGFGMAVAQAAFEGVDSTPMEGFDPAKLDEILGLREKGLRSVTILPLGYRQPEGDWLVNLKKIIEKTSLLKGGVCGQVCAIELPIPGISE

SEQ ID NO: 95921 - protein, 197 aa, Glycine max
  Coding DNA Sequence Number=SeqID_4236
  Homolog annotation: Hit_ID=Q6WAY4; Match level="QueryCoverage=85%, HitCoverage=30%, E-value=7e-21, Identity=36%"; Hit description =Putative uncharacterized protein
MGTNQNGKIFYQVKVKGLDVTSLKELGRLMGPLQRQAFCKVYGKILDLTAAKVFTEAIVSLAQYYDQPLRCFTFRDFQMVPTVEEFEEILGCPLGGRKPYMFSGFLPSLSKIAVVVGDSAKELDRMKQTQNGVVGLPQKYLEGKARDMASQEKWGPFADTLALLIFGVVLFLNVDGLVDLAAIDAFLAYHHSKESPV

SEQ ID NO: 95922 - protein, 39 aa, Glycine max
  Coding DNA Sequence Number=SeqID_4237
MWQVERPCGSFGPADQSFSEPHELPFRSCVLRLRVWSYA

SEQ ID NO: 95923 - protein, 116 aa, Glycine max
  Coding DNA Sequence Number=SeqID_4238
MQKFTRDVYLGAYLNGFHCSGHCAIKGLDDAPQPKSKASARWIVVKCNRQKGSTECGYYVMHWMSTIIIGTFRNNWEAYFNDPRPLEPERSGLGFRDIIFCFNLLWFNIFYIFYVT

SEQ ID NO: 95924 - protein, 185 aa, Glycine max
  Coding DNA Sequence Number=SeqID_4239
  Gene Ontology: Mol. function=hydrolase activity, acting on acid anhydrides, in phosphorus-containing anhydrides
  Homolog annotation: Hit_ID=P83843; Match level="QueryCoverage=72%, HitCoverage=64%, E-value=3e-65, Identity=92%"; Hit description=ADP -ribose pyrophosphatase
  Pfam annotation: Domain name=NUDIX; Domain location=1-140; Score =67.9; E_value=3.4e-17; Accession=PF00293.19; Description=NUDIX domain
RGHAAVLLPFDPVRDEVVLVEQIRIAAYDVSESPWLLEMVAGMIEEGESVEDVARREALEEAGLVVGRTKPVLSYLASPGGTSERLSIMVGEVDATTAEGIHGLADENEDIRVHVVSREQAYQWVEEGKIDNAANDAPVRNQFRTIAPPAAEKRRTRRNGKLSGEQCAVSVNDNRINALHYAGGD

SEQ ID NO: 95925 - protein, 68 aa, Glycine max
  Coding DNA Sequence Number=SeqID_4240
MATGAIQLPMPFFPGPELHVEIPKQGFGQQQQGATTAGSSTFASGTKGKLQSFVGSPDPGNNLDPGFG

SEQ ID NO: 95926 - protein, 542 aa, Glycine max
  Coding DNA Sequence Number=SeqID_4241
  Gene Ontology: Mol. function=protein binding; Cellular component =ribonucleoprotein complex; Biological process=RNA processing
  Homolog annotation: Hit_ID=A7NSQ5; Match level="QueryCoverage=82%, HitCoverage=75%, E-value=1e-82, Identity=43%"; Hit description =Chromosome chr18 scaffold_1, whole genome shotgun sequence
  Pfam annotation: Domain name=Extensin_2; Domain location=2-390; Score= -125.0; E_value=0.02; Accession=PF04554.4; Description=Extensin-like region
  Pfam annotation: Domain name=La; Domain location=375-432; Score =111.5; E_value=2.5e-30; Accession=PF05383.8; Description=La domain
  Pfam module annotation: Pfam domain module=Extensin_2::La; Domain location=2-390::375-432
  Subcellular localization annotation: CTP_CleavageSite=16; ConfidenceScore=5.56e-01
MVTTTVDSSSNHYSPTAATAAADTSNNFPRKNLPSPWAQVVRGADAEPNHQSPPSSSSSSFSSLDSINSNGPAVQTSDTTVKPAWKKPESNGVSEVGPVMGAHSWPDLSESTKPTAKLTSDSSVKTAADEESLTTTPQDPVNSDSPQKQAIGNANPSPTPAMNYGMANRQRSMKQRGGSNGYNVGSGPVQNNFSGATQNLPPPPPPPPFPVLPMPPRTFAHGIPGVPVPTPRDPYRNNNWDARPPHGGFMPPMSEHRSPSRRGNAGHHPRGDGPYHNSYGSRRDQDRGGYANTRDAHVNQQRMPPRGLMRPPPPNPAPFMGPQPMRPFANPAGFPEFYYFPTLQFEPFGGMPFFTHAPPPAMFFPVAETPLTNTIANQIDYYFSDANLVKDEYLRSNMDEQGWVPITLIASFPRVRSLTSNIKLILDSLRTSTVVEVQLSLITLSTHLISVHCHVSDAVEGDKLRRCNEWMKWLPSAQLRANSGSISPSGSSSNNLAADFEKITVDEAISHKVNTEPTTNEDAAGESSTQSQVPNDATVSSN

SEQ ID NO: 95927 - protein, 226 aa, Glycine max
  Coding DNA Sequence Number=SeqID_4242
  Gene Ontology: Mol. function=nucleic acid binding; Cellular component= outer membrane-bounded periplasmic space
  Homolog annotation: Hit_ID=Q2XTB4; Match level="QueryCoverage=88%, HitCoverage=89%, E-value=5e-64, Identity=59%"; Hit description =Putative uncharacterized protein
  Pfam annotation: Domain name=DSBA; Domain location=42-217; Score= -13.2; E_value=0.00045; Accession=PF01323.11; Description=DSBA-like thioredoxin domain
MEIRRFIREKVYRLSGGADYIPPSRLDGFVYQNGYLDLDTVLIEAFYDPVCPYSRDSWPPLKQALHHYSSRVSFLLHLLPLPYHDNAFVATRALHIVNTLNASATFPLLEWFFKHQEKFYGAQTRNLSRASIVDEIVKSATEAAGSSYYNAIKHGFNDTKTDYQTRVSFKYAASRGVYGTPSFYVNGFLLPDTGATADYKTWRKVIDPLVGVKKSIQNEESLRFFL

SEQ ID NO: 95928 - protein, 167 aa, Glycine max
  Coding DNA Sequence Number=SeqID_4243
MSCLVIITPTFLCRSVSWCMPPTRHPLDPDKSNRALGFPTLITGLYQSFRVPVTPSKVIRPPITRAFIEKYCTPRQTQGDAPQAADASPPPHQADPAGSLGMERYLQHLVRQQGANHQGQNSLGLRSHGPEAQAGEAPAEAPGDAKEARKDEEMTDLLGFLGGSRAT

SEQ ID NO: 95929 - protein, 63 aa, Glycine max
  Coding DNA Sequence Number=SeqID_4244
MGAMDNSVMHKRFMQKSLLNVIRSLIINDHTFTGLRLMRSFTINLTNQLTSFSHDHNSMFFLF

SEQ ID NO: 95930 - protein, 308 aa, Glycine max
  Coding DNA Sequence Number=SeqID_4245
  Homolog annotation: Hit_ID=A0H8K9; Match level="QueryCoverage=58%, HitCoverage=65%, E-value=2e-19, Identity=38%"; Hit description =Putative uncharacterized protein
MVQLNGKSGVLSQKVTQDPAGTPVADALLTFVKTHGKQGENGRQKLPPSLPQADRPFVSTRPSLPLIGAILRQAIGAQVAGGALAAAVTLDAVVAGQRILAHAIQLVVIVRQRPGLGLVQPHQRRFEADIAGDAQRHRLVQRFNELVAAIGVAGEIGFTHAGDHRFRFHLVGVDRRQRQEQDVAARHEGARQRIFLIGVVGGNRDIVACQAADGQLVEQRYVQHLVRLGAEGHRQLLSHFNLGAMALAVIERDAVNFVILLQCLDQAGRGVLSTAENDNRALHKITFLGFGLSRYTFGRQDKIALRRQ

SEQ ID NO: 95931 - protein, 92 aa, Glycine max
  Coding DNA Sequence Number=SeqID_4246
MGSSQKPSLKKRFYQVKIKSLEITSLRKLGQLMGQLQRQAFCKAYGIRPPKASRKWGGRNTEKIFGGSPLSKCGWVGGPGSDQSALRNMYVG

SEQ ID NO: 95932 - protein, 96 aa, Glycine max
  Coding DNA Sequence Number=SeqID_4247
MAKFDPEIVLEFYANAWPTEEGVRDMRSWVRGQWIPFDADALSQFLGDPLVWRKASKCGFSQRRNRANGEAGADHAHQHDHFDPDMDDTTTQQCLA

SEQ ID NO: 95933 - protein, 69 aa, Glycine max
  Coding DNA Sequence Number=SeqID_4248
MKILSSGVVFTLEEGRQSGAFAPTYPPLERKSDLRSSSLYVNQVILFYLKGDHFKALDLKNDPFYLVRN

SEQ ID NO: 95934 - protein, 91 aa, Glycine max
  Coding DNA Sequence Number=SeqID_4249
MVEKKEEEKQRGRRGRSFTCHKSHFKWSKRGPPFSLDLTSYSVTKEKNLTFWMLKSCLGLHAASLVPIPRVSLHPLGPVFESRQYISKRSE

SEQ ID NO: 95935 - protein, 162 aa, Glycine max
  Coding DNA Sequence Number=SeqID_4250
  Subcellular localization annotation: CTP_CleavageSite=38; ConfidenceScore=5.04e-01
TYQGNPCGVYPDLSSFIGSGVYPDLSSFTGSGVYPDLSSFTGSGVYPDLSSFTGSGVYPDLSSFSGSGVYPDLSSFTGSGVIQNLRSLYQVIRPVRLIKVILVASTLTYLPSLEVASTQTYLPSPEVASTQTYLPSPEVASTLTYLPSPEVASSKNSTACIK

SEQ ID NO: 95936 - protein, 242 aa, Glycine max
  Coding DNA Sequence Number=SeqID_4251
MGNPVKERSRTLGAFVMASFGGYHEWLKVHIRGLDWLAKLKVVGEESFEAPEEDEEVQALKSELGKAKLAKEKFKLAATHIRKECVGLREENATTARALEQETKRARKEEYGRNKFRGALWGSNSELKLRREERDQSRAHSMVLKEELVAYSRSKRSLSQRLCEMETNMLAIIAKYQEELGLATAHEHRVVDEYAQVYVEKEARGRVIDSLHQEATMWMDRFALTLNGSQELPRLLAKAKAM

SEQ ID NO: 95937 - protein, 349 aa, Glycine max
  Coding DNA Sequence Number=SeqID_4252
  Gene Ontology: Mol. function=motor activity; Cellular component=cell projection
  Homolog annotation: Hit_ID=UPI00016621D1; Match level="QueryCoverage =100%, HitCoverage=41%, E-value=2e-22, Identity=34%"; Hit description= UPI00016621D1 related cluster
TFRGLHVLTLKELHALAVRGLHTLTFRGLLVPSFKGLHVLTFRGLHVLTLRVLHALTFRGLHVPAFRGATWINGLTFRVLHVLAFRGLHALAFVGLHTLTFRGLLVPAFKGLHVLTFRGLHVLTLRVLHTLTIRGLHVPDFKGLNVLSFTGLHVLTFRRLHVLAFTGVDALTFRVLHVLAFQGLHALAFVGLHALPFRGQHALTFRGITVLTFRGQHAFTLKGLHALAFRGQHTLTFRGLLVLTFRGQHALSLKCLHVLAFKALHVLPFSGVHVLTFRGLHILAFRGLHMLTFRGLHLLAFRGLDSLTLRVLHVLAFRGLYALTFVGLHALPFRGLHVINFRGLHALTF

SEQ ID NO: 95938 - protein, 67 aa, Glycine max
  Coding DNA Sequence Number=SeqID_4253
MVSKAKSVGDDPWKLRRIICQTAKTFRSFAILCSQDCGRCSNRILVAHTWRRCTGDILGIFVRISQV

SEQ ID NO: 95939 - protein, 28 aa, Glycine max
  Coding DNA Sequence Number=SeqID_4254
MARRLQEDCARDAREGPRVFMSLRGSIV

SEQ ID NO: 95940 - protein, 69 aa, Glycine max
  Coding DNA Sequence Number=SeqID_4255
MEDCLEGPHLGDHETQLQSRKWRTHEQPKAITFMWLRKRVRMEDCLEGPYLGNHETQLQTRKWRTHEQR

SEQ ID NO: 95941 - protein, 169 aa, Glycine max
  Coding DNA Sequence Number=SeqID_4256
  Homolog annotation: Hit_ID=A7R311; Match level="QueryCoverage=21%, HitCoverage=10%, E-value=2e-07, Identity=72%"; Hit description =Chromosome undetermined scaffold_470, whole genome shotgun sequence
  Subcellular localization annotation: CTP_CleavageSite=74; ConfidenceScore=5.69e-01
MPHLNFSLPPRISTICLFSSPSPSFPLLPFVTPLLLPPSPPQAPFLLRLRLHRSLSFPFKRMFLHVGLSQQVVIAKHKGYVSGSLSDEGKVELGGDSGKSESSLEKGLVDRSDASHVDAKVDNMARCFRTNQRILVLSAAKVAKKMKLKFTKEWIAYLRLPLPIDVYKE

SEQ ID NO: 95942 - protein, 78 aa, Glycine max
  Coding DNA Sequence Number=SeqID_4257
  Subcellular localization annotation: CTP_CleavageSite=38; ConfidenceScore=5.56e-01
MQVSTPGRATPARNKLKRGKGEGFCTKNSPPPPSFKKKATGITNFAAPRSPFFAFLIPFCSIIHLQRGMALGLGRVLR

SEQ ID NO: 95943 - protein, 245 aa, Glycine max
  Coding DNA Sequence Number=SeqID_4258
MASRKRKSTASRPTTHSENQASKQARVRGHLIKIDAKRLNEFLQTPVVLEEGESLPTYFRFCRLRTNHQEIVARLCIPRKGFILNADSQTRKLLKKDLTTLAQTWSVFSYSNIAPTSHTSDLNMDRARLVYGLVTNMDMNIGALISGQISSIAQSNSSRLGFPALITTLCRARGVTSNSLTCESLSPAINLAYIKKKFWNMNDLTVNFRGARKARVRPADVPSSSTPPAPSTSSSRPIRSGLSAL

SEQ ID NO: 95944 - protein, 90 aa, Glycine max
  Coding DNA Sequence Number=SeqID_4259
MLVKGLMLWNNKWTCDFDAMDSRITKDCHHQKGGDCGSNVFQGYFDDAKESRVKQNPKIQESSFKNHDSRIIKIKIQDSRFKNQEKTQSR

SEQ ID NO: 95945 - protein, 230 aa, Glycine max
  Coding DNA Sequence Number=SeqID_4260
  Homolog annotation: Hit_ID=A5C9E2; Match level="QueryCoverage=48%, HitCoverage=15%, E-value=5e-08, Identity=36%"; Hit description =Putative uncharacterized protein
MITISKFEYEYLTNHAASVEEIADKKVAAAEAWIEALKASEKEILMETKIAQRQLKESKLEQELEVYTKEKMLSRRVSSSEELHNSYAYFTLRWHHPVFSLQLHEPQKKMQDTMVWKADPSGFYSTKSAYSLLMTFNRPVPQRRILQTIEACNAHKKFSIETKWGTMMGSYPFSEEQPIPVGWEEILIEVAAEILADPSFSRQETSLSMLCSIRENEKLITSYYLGSEYN

SEQ ID NO: 95946 - protein, 87 aa, Glycine max
  Coding DNA Sequence Number=SeqID_4261
  Subcellular localization annotation: CTP_CleavageSite=57; ConfidenceScore=5.04e-01
MRLHCPQGSQRPSMTTDRPPFLMAHIDPGIGPNISMCLRGVGVMLNSLTSPVESPTVATYPSAGERCKTHRCVFQGRKTSESPPTFI

SEQ ID NO: 95947 - protein, 135 aa, Glycine max
  Coding DNA Sequence Number=SeqID_4262
MVGYTPSNFADMVFTDERIKVGLKKGKFSHPAWTNEKTGANEEGEDEGEARAVTAIPIQPSFPPTQQCHYSANNKPSPYPPPSYPQRPSLKQPQSLSTALPMMNITFSTIQKHQPRNEFCSKKACRIHPNSSFLC

SEQ ID NO: 95948 - protein, 102 aa, Glycine max
  Coding DNA Sequence Number=SeqID_4263
  Subcellular localization annotation: CTP_CleavageSite=38; ConfidenceScore=5.10e-01
LETPGPCWTSSGPLGVFVGAIPGNCRRILLSSNVIYVRVVMLVRMICFRLFAAHGVKSCPGMHSSCVIASLPGCARTVGPPPISGGGPGTGVDMEPTESEDA

SEQ ID NO: 95949 - protein, 58 aa, Glycine max
  Coding DNA Sequence Number=SeqID_4264
MKAQVEKDEGPETYQGNPRGVYPDLSSFTGSGFYPDLSSFTRSGVIQISVTCIKRSAP

SEQ ID NO: 95950 - protein, 397 aa, Glycine max
  Coding DNA Sequence Number=SeqID_4265
  Gene Ontology: Mol. function=oxidoreductase activity; Cellular component=microsome; Biological process=aromatic compound metabolic process
  Homolog annotation: Hit_ID=A5C4W7; Match level="QueryCoverage=95%, HitCoverage=96%, E-value=1e-163, Identity=76%"; Hit description =Putative uncharacterized protein
  Pfam annotation: Domain name=FMO-like; Domain location=45-397; Score=- 430.0; E_value=0.00011; Accession=PF00743.10; Description=Flavin -binding monooxygenase-like
  Pfam annotation: Domain name=Pyr_redox_2; Domain location=44-360; Score=-41.4; E_value=0.027; Accession=PF07992.5; Description =Pyridine nucleotide-disulphide oxidore
  Pfam module annotation: Pfam domain module=FMO-like::Pyr_redox_2; Domain location=45-397::44-360
MDYCLRELEGKQAHDPLFLQKMKNSSSQSTTTSSERCVWVPGPVIVGAGPSGLATAAYLKEKGLPSLILERSNCIASLWQLKTYDRLHLHLPKNFCQLPLMGFPCDFPTYPTKQQFIEYLESYAESFDIRPRFNETVRRAEFDATLGFWRVKSFNKKEVATEFVCRWLIVATGENAEAEVPEIEGMGEFGGAIKHTSFYKSGEEFRGKRVLVVGCGNSGMEVCLDLCNHNATPSLVVRDTVHILPREMLGKSTFGLSMWLLKWLPIRFVDWFLLIVSWLMLGDTARFGLDRPKLGPLQLKNLSGKTPVLDVGTLAKIKSGHIKEDDMFSKEDGFPTKPFPDGWKGENGLYAVGFTKRGLLGASMDAERIGEDIERCWKEKHSSTSFSLSLNVPQSNS

SEQ ID NO: 95951 - protein, 89 aa, Glycine max
  Coding DNA Sequence Number=SeqID_4266
MSEIEEVQERMKTDMEAMKEQMATMMEAMMSMKKIMEVNAAVVAATSVVVNVDMIPPSGLNKINHPTSYMVGQGGKKLGSTGGPHFMQV

SEQ ID NO: 95952 - protein, 169 aa, Glycine max
  Coding DNA Sequence Number=SeqID_4267
  Homolog annotation: Hit_ID=Q2HW90; Match level="QueryCoverage=43%, HitCoverage=14%, E-value=1e-08, Identity=42%"; Hit description =Putative uncharacterized protein
VWVYYLCLISTYLIRVRPRSPGMPTGRKEAYLFSGFYPSMARVAKEYQGSVWKKRRRPWQIKANGLPLLTSCALLIFGVVLFPNVEGLVDLAAIDAFPTFHQSKESPVVAILADMYDTFDRRCEKNGTRIVCCTPALYVWLVSQLFHQEGRPVCPLQGHRSCAEKGKAN

SEQ ID NO: 95953 - protein, 241 aa, Glycine max
  Coding DNA Sequence Number=SeqID_4268
MEAVEKDLTTLAQTWSVLPYFNLAPTSHTLDLNLDKARGVTSDSLSFESLSPTINLAYIKKNYWNLDDPTVSFPRTCKARAKGLESPSFAAPQTSTAPAPIPSAPVPATSGPSTQSTDLMMAMLQSIHQGQYLVMQSLHSLAQHQPIMSMEEFSLQVAWPGVHPSSHGGGEASAAQEDDLEATPPESFVPETDPVIAEASPQASPVSTPVLELNTPQGSPAGTPVLLLTDDEAMDQDPPQD

SEQ ID NO: 95954 - protein, 24 aa, Glycine max
  Coding DNA Sequence Number=SeqID_4269
MAPKTCSNPASAPDRASSIKWYVN

SEQ ID NO: 95955 - protein, 454 aa, Glycine max
  Coding DNA Sequence Number=SeqID_4270
MASRKRKSIGARPTAQYDTRRFHSLDAWNRYTDNVLGRSILPERKVEIYQTEFDDFKTELERRNLHKRLTNLADGTIDVALVKEFYANLYSSEDPSPKQARVRGQLVKIDVDNFNIFLETPVVLEEGETLPTNSRYCRLPTDHREIEVALCIPGRGFILNVEGHPGRTLLLQLGPYISYIRSYCGQSQLIFGLVSHMDMNIGALISGQMTFIAQSNSCRLGFPTLITALCQARGVVSDSLTFERLSPTINLAYISKNCWNLDDLTVAFRGTRRARERPADIPSSSAAPTPTSAAPSVPTHVDSQHNEAMLQRSILLVEQFLERVAWPRAQPSLDREDEGPTAQVPQQVQDASSETTIPEPFILHPKAEEEQARPETTTTPERSLEGTSEPPTPVADLSSPQPAVDPSTPILDILKDQTTPVLTLNTSPPATPVLHLTNEEDAQTQDTQDLSQGF

SEQ ID NO: 95956 - protein, 75 aa, Glycine max
  Coding DNA Sequence Number=SeqID_4271
  Subcellular localization annotation: CTP_CleavageSite=50; ConfidenceScore=5.04e-01
MVLLAASPSLGDCNTLNCSLLDGSRTTTLHTMTLHSTYRWSKSSTGTHLSASYTFRDKSGYLHIPIPREWEEEKS

SEQ ID NO: 95957 - protein, 337 aa, Glycine max
  Coding DNA Sequence Number=SeqID_4272
MPPKKLSTKRSRKEATGEGSSAALEFDSHWFQSAEHQQRFEAIKGWSFHRERHAISQFLGDPLILDEDQQCEFSQRRNQENGFDEEAIAQLLCIPGQDFAQTAAGRRVWIMCTSMTTLTQIWMTLLLSNVLPNDHNSDLPLPKCQLVYAILTRMSVHVAQVIVDAIYLFAGMAPTRHPLNPEKSNRALGFPALITGLCQSFGVQVTPSKVIRPPITRSFIEKYCTPRQAQGDAPQGTGAPPPPRQADPVEPLGVERYLQHLVCQQAANHRGQVQIHECLYRFSRSQQGQGSSPFVCPTPEQFAVEVAWPGDWPNAQVEEEPVDPPMGWMNPTWTRIC

SEQ ID NO: 95958 - protein, 126 aa, Glycine max
  Coding DNA Sequence Number=SeqID_4273
MHLHDQGRKHDKKIFTSRTYKEDPTEVLAFHNWEASFTTKRRELKDYRNTSSGDVSSTSRTSQSLTNSSQALKTASSSSSGLCRSSHNKFSQTLWNLDLSLSRTLQICRSFKKRPNSPPKSDFRLK

SEQ ID NO: 95959 - protein, 64 aa, Glycine max
  Coding DNA Sequence Number=SeqID_4274
MTKARQKGVRKENGGDACHPARPCEQGDFLQKQPPSGGIFWRAQVGLVAICTPIFSKYTPCPFF

SEQ ID NO: 95960 - protein, 75 aa, Glycine max
  Coding DNA Sequence Number=SeqID_4275
MHLFINEEPKVKLLNNNTTSLTSTANCQVKWKILLNGGNIENTFCNKEDKVLPLQIQIYIVKSVDEPHHVKHTLL

SEQ ID NO: 95961 - protein, 100 aa, Glycine max
  Coding DNA Sequence Number=SeqID_4276
MGDATLLPFSCNLCPNMRPPSSIRGLSKNVPIPKWHKNASQMNIRCRIAPQELGRWHEGFFSNASVCETKWPRGSSPQRDLGRIKRLKEPVPLPSMIVTV

SEQ ID NO: 95962 - protein, 30 aa, Glycine max
  Coding DNA Sequence Number=SeqID_4277
MAIYRKEPRGAEKFAQASWLLMTEEILLAQ

SEQ ID NO: 95963 - protein, 143 aa, Glycine max
  Coding DNA Sequence Number=SeqID_4278
MGLGKDNGGITSLINTQGNRGKYGLGYKPTQADMKRSIAGRKNSGQSSRWRQESEGSPPCHISRSFISVGLGDKGQVFAICEDDVPSALDLVRPCPPDFQLGNWRVEERPGVATYPSAGGRRVTRGMRVPRKEIRAESPPTFI

SEQ ID NO: 95964 - protein, 166 aa, Glycine max
  Coding DNA Sequence Number=SeqID_4279
GYNKMKPCKVSYQNIKQKMKFGNQELPVLTNEFHYPGREAVNNKFNCLIDNIWNIPKHTNNNEQFVCSVKKGIICALYNFCIVDNQGVPLLTKASPFGKGYTAFVLLSRPHKGVYTNFKDLCLEKEGIQSPIYKGFYSREEAEKALELNTTDINKIKRPLSQKTRL

SEQ ID NO: 95965 - protein, 73 aa, Glycine max
  Coding DNA Sequence Number=SeqID_4280
MGDLNGLRHFCRRALRQFADHFAGRRIVDRNGFVAGAVRDFAADKVSYDSHVVASLMCKRPGSHFSASVSGLV

SEQ ID NO: 95966 - protein, 164 aa, Glycine max
  Coding DNA Sequence Number=SeqID_4281
  Homolog annotation: Hit_ID=A5BUU3; Match level="QueryCoverage=43%, HitCoverage=8%, E-value=8e-07, Identity=36%"; Hit description =Putative uncharacterized protein
  Subcellular localization annotation: CTP_CleavageSite=35; ConfidenceScore=5.81e-01
MGSPPASTPPPPSPPQSLPTSNASASTSAVKRTRKASRLRSLSTRPPGVKRPVVHVDPATGKADGPHKKKLRIYLGIVARDKVDITYDNWKEVPTTQKDLIWEDIQDVRNKAQAIQKQNTAPHVLSRGGYDYLEQKLLAEKTKKKLQEAAQLGSVDGIIDPPSP

SEQ ID NO: 95967 - protein, 117 aa, Glycine max
  Coding DNA Sequence Number=SeqID_4282
LGHARPIRLDGINYSPSMIGERVYFHVGPILLKRQPSGVYQMLDLVFKGQAFFGGDEGWQEGMFLIALESAPKWALPARRVVVGAGAWGASLWMGAGTLGCTGAELEEFPMRAKKLG

SEQ ID NO: 95968 - protein, 489 aa, Glycine max
  Coding DNA Sequence Number=SeqID_4283
  Gene Ontology: Mol. function=transporter activity; Cellular component= integral to membrane; Biological process=transport
  Homolog annotation: Hit_ID=A1G208; Match level="QueryCoverage=100%, HitCoverage=46%, E-value=0.0, Identity=92%"; Hit description =Transporter, hydrophobe/amphiphile efflux-1 (HAE1) family precursor
  Pfam annotation: Domain name=ACR_tran; Domain location=1-489; Score= -110.0; E_value=0.0095; Accession=PF00873.10; Description =AcrBAcrDAcrF family
MFALVLAIGLLVDDAIVVVENVERVMTFEGLAPKPATLKAMGQITGALVGIVLVLTAVFLPMAFFSGVTGVIYRQFSVTIAAAMILSVLVAMTITPALCGSILHQIPKGGHPHGDHGGEPSLLGKFFIWFNHRFERTSNGLRHRVDGFLGQRTLGVLFYLVLSVATGLLLWHLPGAFLPDEDQGMLNALVKLPAGSTLEQTRAVMDRLSAAAVKDDSVLSIQATAGFSVTGSGQNVGQAFIRLKDWDDRKDDADTIAARLTAAMASVPDAQVFITSPPAILGLGDAGGFSLELQDEGGAGHAAAVAARNTLLKEAAKDPKLVNVRYASLEDAPVYAVKVDDAKAQAMGVNPQDINDTLNAALGGDFVNNFIYKGRIKKVFIQGTAEARMQPQDIERWSVRNQAGQMVPLSSLVSTHWTSAPAALQRYNGISAMEITGQPAPGVSSGEAMAEIARLADTLPEGFSHAWSDMAYQEQLSGNQAPMLYAISL

SEQ ID NO: 95969 - protein, 69 aa, Glycine max
  Coding DNA Sequence Number=SeqID_4284
EVFEDLVVPCSVFEVLLVAVVPILSEVRNDHFRMKVFRKLRKPIPEEVLPETISGRPSSGIGLLNFRKK

SEQ ID NO: 95970 - protein, 95 aa, Glycine max
  Coding DNA Sequence Number=SeqID_4285
  Gene Ontology: Mol. function=aspartic-type endopeptidase activity; Biological process=DNA integration
  Homolog annotation: Hit_ID=A5AY93; Match level="QueryCoverage=70%, HitCoverage=14%, E-value=4e-12, Identity=48%"; Hit description =Putative uncharacterized protein
MGSLSTKQNIARNSSRNSEWRTPKHLATPMSIGCYLDKDESGQPVDEKQYREYIFVGSCCAQILWMKQQLSDYGIVLDHIPIKCDNTSAILESST

SEQ ID NO: 95971 - protein, 162 aa, Glycine max
  Coding DNA Sequence Number=SeqID_4286
  Subcellular localization annotation: CTP_CleavageSite=39; ConfidenceScore=5.44e-01
MSIFPCGRIAPPTRSPLDPKKSNRALGFPALIIRPPLTRLSSRSTAPPGRRRARHQSSLGTDSSGQQSHCHHLQGPPQHIYKGWSVAYDTWLTSRRPTNQAGTSRRLTQDVKEALLGGNLELATKKLPAKRSRKGTIEEDSSVAPQADTGFDKHRFQSVEHQ

SEQ ID NO: 95972 - protein, 61 aa, Glycine max
  Coding DNA Sequence Number=SeqID_4287
MEWILSTPTPYRLVEPIQVIEGDEDPLPEVDSPEDVMSASEADSTEDSGPGEMAISGGSSS

SEQ ID NO: 95973 - protein, 78 aa, Glycine max
  Coding DNA Sequence Number=SeqID_4288
MAGTFFLLKQQNSLEIMSGTPQLVVSEQKLDPSEPVMVLLCECCVSLKLGSRFRGVTLSHTLCVFLPSCLEHECVTDS

SEQ ID NO: 95974 - protein, 180 aa, Glycine max
  Coding DNA Sequence Number=SeqID_4289
MVARVMLRNGFEPGMGLSKDCLENADVVDIKGNPYKYGLGYEPGMPGRRNVLSRFRANRVWPGRISQCFTSAGMVSEEEVAAIKEVFPQDPPSFVQPCHPGSQVGNWRVISQSEVYTADSISSLSQRALRGRARARLTGALSKGGKIRGVATNEGISTSYVDKSGAFAPTYPPLERNQTY

SEQ ID NO: 95975 - protein, 101 aa, Glycine max
  Coding DNA Sequence Number=SeqID_4290
  Subcellular localization annotation: CTP_CleavageSite=64; ConfidenceScore=5.17e-01
MAPRKLPQRDPGKTKRLKEPVPLPNMTAIVLGALSTSNTSRPSKDGHSSGSDASSSGTTKEGVRDMRSWVRGQWIPFDADAPSQFLGYPLVLEEGQECEYG

SEQ ID NO: 95976 - protein, 151 aa, Glycine max
  Coding DNA Sequence Number=SeqID_4291
MMTMIVDTLPVFYYEKMVSYTPSSFDDMVFTDERIDVGLKRGKFSHPAWTNEKTGANKEGEDEGEARAVTAIPIQPSFPPTQQRHYSANNKPSPYPPPSYPQRPSLKQPQSLSTALPMTNITFSTNQERQPRNEFCSEKACRIHPNSSVLC

SEQ ID NO: 95977 - protein, 31 aa, Glycine max
  Coding DNA Sequence Number=SeqID_4292
MERERKKTLKPKIKEGINNKGQNQTNWNLKG

SEQ ID NO: 95978 - protein, 253 aa, Glycine max
  Coding DNA Sequence Number=SeqID_4293
  Gene Ontology: Mol. function=transcription factor binding; Cellular component=intracellular; Biological process=regulation of transcription, DNA-dependent
  Homolog annotation: Hit_ID=Q9FJH0; Match level="QueryCoverage=56%, HitCoverage=65%, E-value=8e-70, Identity=92%"; Hit description=GTP -binding protein, ras-like
  Pfam annotation: Domain name=Miro; Domain location=65-165; Score= -2.4; E_value=0.017; Accession=PF08477.4; Description=Miro-like protein
  Pfam annotation: Domain name=Ras; Domain location=97-212; Score =110.1; E_value=6.6e-30; Accession=PF00071.13; Description=Ras family
  Pfam module annotation: Pfam domain module=Miro::Ras; Domain location= 65-165::97-212
MLWHPATPPGLLYCAWPEQPEHVFHSQNCRKSTRKLLLDCNKFPGLTVNQGQQQHDFPLVDECKRSSICVTAEQDLQLVPSLKSRCSATSSEAKWLGAEEMAADGRKKLGYRAITSAYYRGAVGALLVYDVTRHVTFENVERWLKELRDHTDANIVVMLVGNKADLRHLRAVSTEDARTFAERENTFFMETSALESLNVENAFTEVLTQIYHVVSKKALEIGDDPAALPKGQTINVGSRDDVSAVKKSGCCSA

SEQ ID NO: 95979 - protein, 228 aa, Glycine max
  Coding DNA Sequence Number=SeqID_4294
  Subcellular localization annotation: CTP_CleavageSite=61; ConfidenceScore=5.27e-01
MPHLRWSTRARAMHSPRRFFQGGYNQGGPAGFNQGRNFTQGSSWRNHPRNQFIKEQGSQPAQNSNQGIDLYEKTSRLEEMLNKFIQVSMSNHMSTEVAIKNLEIQVGQLAKQAAERPTSSFGFNTEMKPKEECKVIFTEKGEKEKKIEDDVRDKEGEKKEERERNEDKTQQWEKCSQVEVQQKIILQVNTPPHQLIVKEERHGEHDRSLSVILSLITNTSLGMCFQNI

SEQ ID NO: 95980 - protein, 272 aa, Glycine max
  Coding DNA Sequence Number=SeqID_4295
  Homolog annotation: Hit_ID=Q5XM22; Match level="QueryCoverage=42%, HitCoverage=79%, E-value=4e-30, Identity=49%"; Hit description =Resistance-like protein HAAS-2
MYQSRCRARQWVAAARTCLLHLVGCTLFANKSATHVHVVHLQAFRDLGLAEAFSWGAAALVHLYDQFNEASQAPPRQMAGYISLLQCWIYEHFPSVHRCVVDDGYVEASPHACRWLMGKAQMTGIKGAPYRACIDALTVTDVCWMLYAEHQGVRGYELISSYTGQVRWGQIIVYIRPERVVRQFGYIQTVPPPPVRDSLTGTDIDDRWVHFSDHVVPIGELSVVPGQISHPFVTPTEDTAEPRPVPPPLPHDDDFVEHCPEVQSRRSPMHLW

SEQ ID NO: 95981 - protein, 121 aa, Glycine max
  Coding DNA Sequence Number=SeqID_4296
MKEREWKIFRPDKFSARLPFSTGDIPPHMNKEEKTETPSFLSKNTTLEKILLVRDPLFMCPPPSSLEPLECHCLALFAIILGTFRNNWETYFNDPSSLEPERLKALRIQWAHYYLRVRDQT

SEQ ID NO: 95982 - protein, 90 aa, Glycine max
  Coding DNA Sequence Number=SeqID_4297
MEREMITMIVDTLPVFYYDKMVGYMPSSFADLVFAGERIEVGLRRGKFDYAASASTSNRRSGMGGAKKKEGDTHAITWAPTWPKIPTNPS

SEQ ID NO: 95983 - protein, 87 aa, Glycine max
  Coding DNA Sequence Number=SeqID_4298
  Subcellular localization annotation: CTP_CleavageSite=29; ConfidenceScore=5.11e-01
MTGGIVFLPRPTVFGGGWGAVARRVGSASAAELTAATVDTFFFMSCLIPSMASIIEAICSFEAYMSAFICSYVSSWSPIVLDLDPVR

SEQ ID NO: 95984 - protein, 51 aa, Glycine max
  Coding DNA Sequence Number=SeqID_4299
MVAHILDPRVDPSQYRDLKISNINKRSRSKYEDLHCMGTNNLPRRIHEMIG

SEQ ID NO: 95985 - protein, 188 aa, Glycine max
  Coding DNA Sequence Number=SeqID_4300
NVLPSDHNFDLPLPKCQLVYAILTRMSVHVAQVIADAIYLFAGMPPTRHPLDPDKPNRALGFPMLITGLCKSFGVPVTPNKVIRPSITWAFIEKYCTPRQAQGDAHQATDALPPPRQADPAGSLGMERYLQHLVLQQATNHRGQVQIHECLYRFSLSQLGQGSPGEAEEARMDEDMTDLLGFLGGSGA

SEQ ID NO: 95986 - protein, 143 aa, Glycine max
  Coding DNA Sequence Number=SeqID_4301
  Subcellular localization annotation: CTP_CleavageSite=87; ConfidenceScore=5.57e-01
MARTCSPLKARMCSPLMARNHNPLMARTCSPLKVRACSPLKARTCSPLKVRACSPLMTRTYSPLKIDCPFERGDNSCNLVLSFANLSGNSLRGLCRSFGILVTPSKVIRLPITWAFIEKYCTPRQAQGNAPQAADARDQCWKP

SEQ ID NO: 95987 - protein, 349 aa, Glycine max
  Coding DNA Sequence Number=SeqID_4302
MTKKSAETSRADMRPKKPTGVKIQEGKQEEKEEEERPLIRKRKLPTTSTKSAEQTETGNSQAQTPKKKKKVKQVETEPSVAVEGGEPAKKKKKKTKSLKEQGDNQPVDVRPPSTDIDGTEVEAAPSIAEMGNPVEQPNLPQEQPAVEVQQNVSAEKLPSCARTSPAPEADAVNVEEWGEGQGIGSSHPHGWAEVDDHHEPNQSDNTTPHESSQKSSSEENFFDEDAIKEAEAGGSDIYLVSSTSKLSASIGIAEDTFIQMQDEDPAAALRLLLNTSQTNNSSDKIPGASSSSDAEINSSVRQDSLLLKLSMEYAQKDVLKSIEENPSAAFGHLNFLKKLHNPLTSDETL

SEQ ID NO: 95988 - protein, 116 aa, Glycine max
  Coding DNA Sequence Number=SeqID_4303
MVILRPLSFRSSESSDKRAETNYGHSTPFVIQKQRAKSSESSGGQRQIMVILHTFSSSRGDHVRWHAETNYGHFAPFHPGPIVSDGVQRQIIVILRLVSTKRNEFGSIRMMLVVRC

SEQ ID NO: 95989 - protein, 240 aa, Glycine max
  Coding DNA Sequence Number=SeqID_4304
MRTSMTTLTQTWMILLLSNVLPSDNNSDLPLPKCQLVYAILTRMSVHVAQVIADAIYLFAGMPPTRHPLDPDKSNRALGFPGLITGLCQSFGVPVTPSKVIRPPITRAFIEKYCTPRQAQGDAHQAADALPPPHQTDPVGSLGMERYLQHLVRQQAANHWGQVQIHECLYRFSLSQQGQGFAPFACPTPKQFGAEVAWPGDWPEAQAGEEPAGSPGEAEEARMDEEMTDLLGFLGGSGAT

SEQ ID NO: 95990 - protein, 223 aa, Glycine max
  Coding DNA Sequence Number=SeqID_4305
  Homolog annotation: Hit_ID=A2Q4S5; Match level="QueryCoverage=47%, HitCoverage=17%, E-value=8e-11, Identity=36%"; Hit description=IMP dehydrogenase/GMP reductase, putative
  Pfam annotation: Domain name=DUF1723; Domain location=69-118; Score =47.1; E_value=6.3e-11; Accession=PF08330.1; Description=Protein of unknown function (DUF1723)
DAPDMTEDLHAHAEEAVDDAEGFLVNERPELKLFFHGRKVQKFGRPAPESQGLVAVTGLSSLIACSVDTCDRELIFAFVERWHKKTSSFHPPVGEVTITLDDVTSLLHLSIIGAFQSFETLHVDKAVLMLVELLEVFGEEARVETAQYLSHLGSYAWGAAALVHMYDNLNDACKSDNRQLAVVGQICVMPGQYASDYMQWFFMISHSFMTPTQPANLARHPPV

SEQ ID NO: 95991 - protein, 66 aa, Glycine max
  Coding DNA Sequence Number=SeqID_4306
MICPLRCHEEMHDVIKEQAIGLSVTMHQLKRKTLDEASLLSSESETHHDHRSTSTPYGSHRLGYRA

SEQ ID NO: 95992 - protein, 65 aa, Glycine max
  Coding DNA Sequence Number=SeqID_4307
GLVDNDRRREALRVRFTVDGEADASEGAGGGGGEAGGEAMILYTSSKCKFQLQTNIDINSSLNKM

SEQ ID NO: 95993 - protein, 121 aa, Glycine max
  Coding DNA Sequence Number=SeqID_4308
MAENTHSQASLCEMEERLSSRMESRFVELTASMQQTIHEMFQQRQQDSPAASNPPRGERSRPYSCGTRLARLDFPRFNGEGIKQWLIQCETFFRSIIHLMNSRSHGGFNEAQADKIYHRVS

SEQ ID NO: 95994 - protein, 58 aa, Glycine max
  Coding DNA Sequence Number=SeqID_4309
  Homolog annotation: Hit_ID=O64438; Match level="QueryCoverage=75%, HitCoverage=18%, E-value=3e-16, Identity=90%"; Hit description=ARG10
MFCLFQHITSKVIILLKGFCGKSLASFPRGSFYSTGVGGLRCYENPKNKITAVPAEEE

SEQ ID NO: 95995 - protein, 186 aa, Glycine max
  Coding DNA Sequence Number=SeqID_4310
  Homolog annotation: Hit_ID=Q5CDC4; Match level="QueryCoverage=22%, HitCoverage=32%, E-value=1e-15, Identity=100%"; Hit description =LacOPZ-alpha peptide from pUC9
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSINSADVLMEEDEPESAKLLRSDPSKWKDQDHYDQAYRYRRPRGGARYQLLFPLVRVNFELGVIMVIAVSCVKLLSAHNSTQHTSRKHKV

SEQ ID NO: 95996 - protein, 214 aa, Glycine max
  Coding DNA Sequence Number=SeqID_4311
  Subcellular localization annotation: CTP_CleavageSite=45; ConfidenceScore=5.52e-01
MNSLPSAFHAYSTNESGAARIDCLALFANSPFSTFMRSPMNSLPSAFHASSTNESGGPRIDYQALFASSSFSTFIRSPMNLLPSAVHVSSTFESGAPRIHCLAKFANSPFSTFIRSPMNSVPSAVHVSSTFESGVPRIDCLALFANSPFSTFIRSPMNSLPSAIHVSSTFESGAPRIDCLALFANSPFSSFIRSPMNILPSAIHASSTNESGGP

SEQ ID NO: 95997 - protein, 83 aa, Glycine max
  Coding DNA Sequence Number=SeqID_4312
MLLSSNVIHICVRVVMLVRMIRTRLFAVAWVKSFPGMHSSCVIASLSGCVRTVGALQYQGVAQELIKGNYSPFNRECKSWLRI

SEQ ID NO: 95998 - protein, 146 aa, Glycine max
  Coding DNA Sequence Number=SeqID_4313
MLVLSSSLSPALKRSSSICCLYSSTHTPLSKPLELVHMLPLIVGGNVSLPKGTLKIIPILYWRIPMNPPFPNKGSPPIEGIPLKAKGSQWKFSLLANMMASKELFNLHFPISIGLNIIFSMEIWEANVNLLRPSILFSSSGVMFSM

SEQ ID NO: 95999 - protein, 65 aa, Glycine max
  Coding DNA Sequence Number=SeqID_4314
  Homolog annotation: Hit_ID=A5C4I3; Match level="QueryCoverage=55%, HitCoverage=14%, E-value=2e-09, Identity=83%"; Hit description =Putative uncharacterized protein
MAARALGVPRHLRAPGVGLWAPHSARLETRTKESDMCASQRASNPESILSGPKMVTMLSGRAEEL

SEQ ID NO: 96000 - protein, 56 aa, Glycine max
  Coding DNA Sequence Number=SeqID_4315
MAMSNCEGIPIGVNPKRKVVWDPIISKFQDRLNRWKMGRANQILSRKMLGLRMGFP

SEQ ID NO: 96001 - protein, 133 aa, Glycine max
  Coding DNA Sequence Number=SeqID_4316
MGTRGCINYNLVLAIRQLGYPMRGTPSEEGLIPFITRSFNSTNVGVLQRVHKAWEMSQRKDKELRGCSNGPIGGYHRWLKAYAQDLDWLPSLRTTKGMEGETPKEDEEVQALKTELEKAQTVKEKFKSIAVRI

SEQ ID NO: 96002 - protein, 142 aa, Glycine max
  Coding DNA Sequence Number=SeqID_4317
MARASHQWSWVVEKKISLSELVSLSESLLFAVRVTIHVERNSSCAKRENSCSAQFLFGVLQLSHPFRNFIPEIYLTQIRLDRLLASDSNSHVASSSDAPPQITLTNGISFPLRCFVRLSSILKGNVSYVKFSFTYTSSNSIT

SEQ ID NO: 96003 - protein, 98 aa, Glycine max
  Coding DNA Sequence Number=SeqID_4318
  Subcellular localization annotation: CTP_CleavageSite=27; ConfidenceScore=5.11e-01
MNLEVQAVHLASLTLAQHTCTGHLLPGSSMRSTNHAASSGSCAQPEEDGSANCKNHTSPNLLILPEIEMGSFACPQANKEQLTGPQVIKHAVIVYKGV

SEQ ID NO: 96004 - protein, 185 aa, Glycine max
  Coding DNA Sequence Number=SeqID_4319
  Homolog annotation: Hit_ID=Q2HTA0; Match level="QueryCoverage=57%, HitCoverage=15%, E-value=8e-12, Identity=41%"; Hit description=IMP dehydrogenase/GMP reductase, related
  Pfam annotation: Domain name=DUF1723; Domain location=57-106; Score =47.0; E_value=6.6e-11; Accession=PF08330.1; Description=Protein of unknown function (DUF1723)
QWEAAAIAQDVHHVDDTTKEVFQQPQEAAVDAQGFLGESRDTSVLTAYVDHVVVIVWNGEGLISAFTERWHKETSSFHLPVGEVTITLDDVASFLHLPIIGTFHSFKTLHVDEAMLMLVELLEVSADEARAETVQCHGAYYDYHGYETFIITNCNTCACGALGQLSRPHPEWNLRMGSCRPSAYV

SEQ ID NO: 96005 - protein, 126 aa, Glycine max
  Coding DNA Sequence Number=SeqID_4320
MPRQCSPDYMDWFYMISHPFMRSAQPEDLVRHPPIVQDDTYVEPDMPQYPVAAIAMEVAHAHAPSHVEQPRHAMEACQAIAERLERLLNLRIVTKGTETYDVMQDCLRIARGVIVDRNVYVRSRRR

SEQ ID NO: 96006 - protein, 58 aa, Glycine max
  Coding DNA Sequence Number=SeqID_4321
MASTSGDATPLSPKNARSSEALSVRIENIERRREDKSSKSSHGEDEGYEKDEEGRRNE

SEQ ID NO: 96007 - protein, 85 aa, Glycine max
  Coding DNA Sequence Number=SeqID_4322
MVIFHHGDAAEDKGEEVAESLSFNEVLQWKRGERRRHPLGNKLWKKELCHQKCALDKKLGDDASMEEKKERGGSTRLKEEKGERS

SEQ ID NO: 96008 - protein, 108 aa, Glycine max
  Coding DNA Sequence Number=SeqID_4323
MCVDVAPEGYLHFLFCDNQSAVAIAHNPILHGESSDQAASFVHHIPALDQLGRCSHQATLSKQIHLHSVRILLMEANEGGILIVKISPDGVVALPCSSGTMELSKGVC

SEQ ID NO: 96009 - protein, 275 aa, Glycine max
  Coding DNA Sequence Number=SeqID_4324
NAHERHAEMKGQEETNDNVTIPTETTAIHRPPGIAGQNQATNANQTSPSEMAENHRASGDEAHNQAPRSAGHDDHLDPADKHADRWVCVPDQGKDKQTLGTCTSDGRRENMHEKGKWEAERTVGVVGKGALCSEKPRDQEAEDTSSPSSSKVGQNNYYRLFYRKRRCRKQNATFPEDAMGQQVTPTPPNMQGSEHRPQRVREQKDHYLSSQQSALEEALLVNNKMQEAEKLWEMTKELGVTGGNVQRNKLQQIIIDMEDRDIKEAARLGSKKRTP

SEQ ID NO: 96010 - protein, 151 aa, Glycine max
  Coding DNA Sequence Number=SeqID_4325
  Gene Ontology: Mol. function=voltage-gated potassium channel activity; Cellular component=voltage-gated potassium channel complex; Biological process=potassium ion transport
  Homolog annotation: Hit_ID=A7QRJ1; Match level="QueryCoverage=74%, HitCoverage=41%, E-value=2e-13, Identity=46%"; Hit description =Chromosome chr8 scaffold_150, whole genome shotgun sequence
  Pfam annotation: Domain name=Pentapeptide; Domain location=109-148; Score=47.9; E_value=3.5e-11; Accession=PF00805.13; Description =Pentapeptide repeats (8 copies)
  Pfam annotation: Domain name=Pentapeptide; Domain location=37-76; Score=14.2; E_value=0.13; Accession=PF00805.13; Description =Pentapeptide repeats (8 copies)
  Pfam module annotation: Pfam domain module=Pentapeptide::Pentapeptide; Domain location=109-148::37-76
MTLKKLLPQLYYAMTTIKQQQTKAKQFPIPVPKLDYSTLCNADLTNANLEGAVLEGANLKYTLHTYSSIDSSVLTDVVYYVINSSLMFDITLTSSNKTLGKVIMPREGAKLNKANLKGANLQRAYLCRVNLRDTELEGARLDGANLHGAIR

SEQ ID NO: 96011 - protein, 121 aa, Glycine max
  Coding DNA Sequence Number=SeqID_4326
MAERPTSSFGANTENNLKEECKALWTRGPQRTEEDQSEEGKANKDGEEEKKEEEEGEKTVLIPKTKSQLAREARKKEPPVPLKEPPYPLVPSKKGKERYFKRFLEIFKGLEITMPFGEALQ

SEQ ID NO: 96012 - protein, 39 aa, Glycine max
  Coding DNA Sequence Number=SeqID_4327
MENGEKREVVAAQLAQASWVASIRRHRLLVEHPGRPKWA

SEQ ID NO: 96013 - protein, 213 aa, Glycine max
  Coding DNA Sequence Number=SeqID_4328
  Homolog annotation: Hit_ID=A5B6Y9; Match level="QueryCoverage=19%, HitCoverage=8%, E-value=1e-13, Identity=83%"; Hit description =Photosystem I P700 chlorophyll A apoprotein
MVIGSRTQGAPAFSGRYSAEVIHAILPGKARTTFNKWVPVPETDTGVPPHKGGRSDQARATVYQKHRSPQSREPTTEAPVNGGRNYNGPKVAKFLVGCGLPAPGTERPYEASLFPGIGFGLFLRSLGGGQRRPPSGGARAISLPKGNGGVQRFPRARRRLALECKGRRELDCKTHPSSRDETHIDGKVWHLDVGSSPPGAVVCSKGWAVHPLK

SEQ ID NO: 96014 - protein, 132 aa, Glycine max
  Coding DNA Sequence Number=SeqID_4329
MTSQRINSGRYTIFNSKLIEHILHDTDDELDITQGDIVTNYSFDDIATEDFAHTDYDDNLEAPYDNENTGFYIHCANYVELSFITFDNVQVTKILEILFGNASNVKRRCGMMRGLTKINRQKIQSFHYVVVM

SEQ ID NO: 96015 - protein, 112 aa, Glycine max
  Coding DNA Sequence Number=SeqID_4330
  Homolog annotation: Hit_ID=Q5QJQ3; Match level="QueryCoverage=67%, HitCoverage=89%, E-value=3e-27, Identity=58%"; Hit description =Putative uncharacterized protein
MAYERGGDFLEDARKILNREVRGPRQSRFSIGSAPLTSITKSDAQISGGETRQDYKDTRRFPLAAPSQFAPSWTVCTNPPFSPTAAPYPETIVLSPTRKDMQKHHWAAATGN

SEQ ID NO: 96016 - protein, 38 aa, Glycine max
  Coding DNA Sequence Number=SeqID_4331
MLHLAPPSRLAQVSGFELSASHALGLAKGNHRAYFSKI

SEQ ID NO: 96017 - protein, 130 aa, Glycine max
  Coding DNA Sequence Number=SeqID_4332
MVSGNRLPRGVIDYQAQKRGQEAKRASGCVIDYTEEHATGNRLPVRCNRLHSAFLQIVMAAQLIHDRVEMECLEGAWETLEGNTRCRFRGTIRFTATSLVHPDEPACTLQRTVEWILPTPTPYRLVEPVQ

SEQ ID NO: 96018 - protein, 37 aa, Glycine max
  Coding DNA Sequence Number=SeqID_4333
MCVYDLWVAGILQEMASKKLSTKRSRIAKKQHACERR

SEQ ID NO: 96019 - protein, 83 aa, Glycine max
  Coding DNA Sequence Number=SeqID_4334
MALEEEKSTDQIPEPSPAPIPNDAIPSAPASDFYISVLLNFSTFSCLLPLEENEHVIGSMTENVSQFVRLIVKECINRIPVRV

SEQ ID NO: 96020 - protein, 297 aa, Glycine max
  Coding DNA Sequence Number=SeqID_4335
  Gene Ontology: Mol. function=motor activity; Cellular component=cell projection
  Homolog annotation: Hit_ID=UPI00016621D1; Match level="QueryCoverage =83%, HitCoverage=40%, E-value=6e-17, Identity=30%"; Hit description =UPI00016621D1 related cluster
LTFRGLHVLAIRGLHAISFRGLRVVTIKGLHALTLRGLHVLAIRGLHAFTFRGLHLFAIRGLHVLTFRGLHILAFRELDVITLKVLHVLAFRGVHVLAIRGMHAVTFRGLHVLAIRGLHTLTFRTLHVVTFRGLHALIFGGLHALTFRGLHVLAFRGLHVLAFSGRHVLAFRGLHILTIRRLYVLAIRGLHVLAIRGSHALTFGGLHVLDISGLHALTFRVLHVLTIRGPHVIADYTPSSSEGYTPSTLEVQHVLAFRGLHVLAFRGLHVLVFRGLHVLAIKGLYALAIRDYMSSPS

SEQ ID NO: 96021 - protein, 120 aa, Glycine max
  Coding DNA Sequence Number=SeqID_4336
MVKSWNLLRADQRLIFAKKLAQGFPGINRDTRIYLFLRSDLPSPGILFGAKVRRGDAAQLTDLVYDGVFEVLQWLLFSISCPSCSATDGGGCVNGKKHPPDISAGKCSGPAARNHHTRRA

SEQ ID NO: 96022 - protein, 110 aa, Glycine max
  Coding DNA Sequence Number=SeqID_4337
  Subcellular localization annotation: CTP_CleavageSite=34; ConfidenceScore=5.74e-01
MGSPPASTPPPPPPPPPPPSDASASPSAVKRTRKASRLRSLSTRPPGAERIMVHVDPATGKADGPHRKKLRTYLGLWRVIRWTSLIEAVPESKAILLSWVMENSSLTVNH

SEQ ID NO: 96023 - protein, 162 aa, Glycine max
  Coding DNA Sequence Number=SeqID_4338
  Subcellular localization annotation: CTP_CleavageSite=41; ConfidenceScore=5.05e-01
MADGELDALMWSFAPRGSASPGILRRRSRPSPQVDGPEQGVASRVPSSADHHVRPLMQSAGMVDINRRCAGGPDRGHDRASRPAPQQWGNLPIEHCISGTRLGCTRCSVGRRALCGSELRVSPWGGTGHEGVVMDARATEDVGVRRRRHRRRHRHHHDGLHV

SEQ ID NO: 96024 - protein, 95 aa, Glycine max
  Coding DNA Sequence Number=SeqID_4339
MKTSTITHYTSIARTLVLTLGLLPSSLEPLLHGLEASLFFRRRQDLQMLGVLPKEMEEELRMMKTWWIWFIISLEETELLNQDLQKFVNLSLPSQ

SEQ ID NO: 96025 - protein, 67 aa, Glycine max
  Coding DNA Sequence Number=SeqID_4340
MVPKTCTQSDKCTGSHNTTTHPALSRTLESDQFPLLNNPNKACIYMMKVPTGKIPTEDLAFHTRKPS

SEQ ID NO: 96026 - protein, 128 aa, Glycine max
  Coding DNA Sequence Number=SeqID_4341
MAKFDPEDGVRDMRSWVRGQWIPFDADALSQFLGDPLVLEEGQECEFSQRRNRANGFDEEAIAQLLCTPGQDFARTAVGRRVRIMRTSMTTLTQMWMTLLLSNVLPSDHNSDLPLPKCQLVCHPLGTL

SEQ ID NO: 96027 - protein, 171 aa, Glycine max
  Coding DNA Sequence Number=SeqID_4342
  Gene Ontology: Mol. function=helicase activity
  Homolog annotation: Hit_ID=Q2A9I1; Match level="QueryCoverage=86%, HitCoverage=20%, E-value=1e-12, Identity=45%"; Hit description =Putative uncharacterized protein
MVYNSNDTAQNVNIQNDELKEYLDCRYISPCEAAWRIFAFPIHGRKPAVERLHFHLPGVMSKPEEVWNQCWHLLADDIAYRHSRSTMNPELHINDDTLRNLTLIEIEQLLHINQRSLKDYPTMPYPQGINLTSYLENNLILSELDYNDDATRSEFEHLFASMADNLPIHIL

SEQ ID NO: 96028 - protein, 200 aa, Glycine max
  Coding DNA Sequence Number=SeqID_4343
GYTPSPWVLVTLTVERTTRPRLERTTRPHHQRAARPHHQRTACPRLERATRPHLGGLHVLTIRGLHALTSRGLHVLALRGLHTLTLGTSYPRLERTTRPRQQRAARPHLQRTTCPRLERATRPHLGGLHVLALRGLHVLALRGLHVLTIRGLHALTSRGLHVLALRGLHTLTLGTSYPRLERTTRPRQQRAARPHLQRTT

SEQ ID NO: 96029 - protein, 33 aa, Glycine max
  Coding DNA Sequence Number=SeqID_4344
MAQSNSSRLGFLALITALCFLVWKAKSSVGSSL

SEQ ID NO: 96030 - protein, 213 aa, Glycine max
  Coding DNA Sequence Number=SeqID_4345
  Homolog annotation: Hit_ID=Q6UUU1; Match level="QueryCoverage=28%, HitCoverage=40%, E-value=2e-18, Identity=78%"; Hit description =Putative uncharacterized protein
APVASVSISCPSRSATDGGGRVPFAIQAAQLLGRAIGAGLFAITPAGERGMCCKAIKLGNARVFPGELELHRGGGRSRTSGSPGLQEFDITGLEQCIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 96031 - protein, 183 aa, Glycine max
  Coding DNA Sequence Number=SeqID_4346
MYNHHEKGRTPDLESVLADFMTYQTSSKEWQPCYQNEAEGLSNLDDLLMQFKGTIDSMQQAFKRAETQIGKLVDDMTKVVVRREEEYAKIETHHESILQVNTIHHQLITKEEKDEVSIIPEYSCMATTGYVVGKDKELDHVTDYLACDKELDDPKDNSVGHVENETKPVIISSSLQKKEDDQL

SEQ ID NO: 96032 - protein, 107 aa, Glycine max
  Coding DNA Sequence Number=SeqID_4347
MGAKYLEVVKRGSHPNHGWSSDEIRAHNDHNLPLRVVGHDRAWVARRRLTIICLCVPPDTIASGWRKGVRNDHNLFPPTYRLTVPERQRAQNDHNLSLRVYHLTCEI

SEQ ID NO: 96033 - protein, 128 aa, Glycine max
  Coding DNA Sequence Number=SeqID_4348
  Homolog annotation: Hit_ID=Q5NRP4; Match level="QueryCoverage=53%, HitCoverage=4%, E-value=6e-07, Identity=37%"; Hit description =Putative gag-pol polyprotein, identical
  Pfam annotation: Domain name=zf-CCHC; Domain location=74-91; Score =25.2; E_value=0.00023; Accession=PF00098.14; Description=Zinc knuckle
MKEGIGHILDLTPIGEKRKESLKRLTLTSHTFMGRTIPRSSILGVTPSKPKDDKGKTIEKQPLKASMQEKTSSMKCFKCLGRGHIKSQCPTKKIMIMRGQDIYSSQDEATTSPSSSESEEVKGEEFSE

SEQ ID NO: 96034 - protein, 64 aa, Glycine max
  Coding DNA Sequence Number=SeqID_4349
MAGAGDNGGVYHQLDGFHRLLLDAMTTQVQHLLKRNNEELYRRIEGLEHQMNPNVGRPYDGNRR

SEQ ID NO: 96035 - protein, 93 aa, Glycine max
  Coding DNA Sequence Number=SeqID_4350
MAKGAEFVYARLPLDSLLLNDKGHKICPCAFVATYPSVGGRRVTRGMRVPRKEYARSRHQRLFEENVGKTGKDAIYELLSERFGSCIYTRGRC

SEQ ID NO: 96036 - protein, 104 aa, Glycine max
  Coding DNA Sequence Number=SeqID_4351
MSCSRPSSSRWTSLNEELEQFLATVPKHGEWREMANMMQNVAVPPNTIFQTVHARDQIFGEVSKVYALRWKDVLDGIWHLVDKDGNYHNVVYNKDLDQPAIVVG

SEQ ID NO: 96037 - protein, 156 aa, Glycine max
  Coding DNA Sequence Number=SeqID_4352
MASMMEAMLGMKRLRESNAATVATASTTAEDEGEAHRGMSATPIRGKTEVLTPTIYHPTTHHQPCMKTWVTLLPSSSKGSLLGILTGSTRILESALRETSTLTPCFPLRVQCPMHYLNQTSRESLETTQRSQCFYPWEGRPRQRKERKNSISSKRD

SEQ ID NO: 96038 - protein, 102 aa, Glycine max
  Coding DNA Sequence Number=SeqID_4353
MTQVNEKQTPLHSVNINIASQFEGSAKLQNTVGDVKTVKCIRCMFLAPGYYLFVWMRNLPASAPGRQVCSISRHLQIEIMIVNESKNMFYSNYKAINVSKLK

SEQ ID NO: 96039 - protein, 302 aa, Glycine max
  Coding DNA Sequence Number=SeqID_4354
GLHVLAITGLHVLTFRGLHALTFRGLHVLTFRGLHVLTFRELHALAFRGLHRTTRPRLQRIARPHLQRTTRPQLQRATRPRHQRAACPHHQKTAQPHLLRIARPHLQRVAHPQLQRAARRRLQKDYMSCTLEVYTPSPLEGCPPSPSEDYPPSPSKGDMSSTLVGYTPYPLEHYTSSAHQSTRGLHVLTLRGLLHVLNFRGLHALAFRGLHVVISRRAACPYAFRGLHLQRAACPRLRGLHVLTFRGLHALAFEGTTRPRHRGLHVLAFRGLHVLTFRGLHAFAFVGLHVLNFTGLHTLTFQ

SEQ ID NO: 96040 - protein, 84 aa, Glycine max
  Coding DNA Sequence Number=SeqID_4355
MMAHQATTTPEKSLEATSEPSAPVVNLPSPQPAADPSTPLLQMLKDPTTPLLVVDTSPPTTPVFQLTDEEDGQTQDTQDQSQEF

SEQ ID NO: 96041 - protein, 90 aa, Glycine max
  Coding DNA Sequence Number=SeqID_4356
MVVILPKENVVIGFCSLHNKPYNYLKEIINSALKGFDETPQSKSKVAARWIVVKASHLNNYFNDARPLEPERLKALRIHWTNYYLKVNLE

SEQ ID NO: 96042 - protein, 78 aa, Glycine max
  Coding DNA Sequence Number=SeqID_4357
LLEIADTKPYTCEQRKTPALCGKDHWKKEELRPLIALKHSELALSVQLTAGAERGVKHEARDLNALSARCGAERDYEG

SEQ ID NO: 96043 - protein, 22 aa, Glycine max
  Coding DNA Sequence Number=SeqID_4358
DKKREESKNSQALGSNESALRL

SEQ ID NO: 96044 - protein, 40 aa, Glycine max
  Coding DNA Sequence Number=SeqID_4359
MKQGQANILIARFPDPNYGVKTRSLLFTLVRPNASLYMPK

SEQ ID NO: 96045 - protein, 153 aa, Glycine max
  Coding DNA Sequence Number=SeqID_4360
  Subcellular localization annotation: CTP_CleavageSite=56; ConfidenceScore=5.50e-01
LPSLGTDVWGANTFPVHKYNSRTFHLKVRRSRLFRFFRRFPQINVGGDSARIPFVEHASRESRVALPPKGRLRQLATPLGKESMLMKPPITINEILDVSISFLNDHLEETLGSTKIEEIHSKCIKLAQGKVYGESGFWLKACRMARPDTYQGL

SEQ ID NO: 96046 - protein, 183 aa, Glycine max
  Coding DNA Sequence Number=SeqID_4361
MASRKRKTTTLVSQAGYDRSRFVSQEAWDRYSDNELARNILPERNEFYQNLYVLDDKFPKKVRVRGHLIKFDVDSLNTFLEIPVVMEQGESLPSYSKFVRLRPDPQGLVARLCIPGRGFVLNVKGLPWKLLRKDLTTLAQTWSVLSHSNLAPTSHTFDLNLDRAKLVYGLVMKMNMNLGSLIS

SEQ ID NO: 96047 - protein, 81 aa, Glycine max
  Coding DNA Sequence Number=SeqID_4362
MEAKAQKWWPRGKNLQNPWVLRFFNEGGEFWVERNSPSPRFYVSRILGYLPAALPACPELGMGRRSIDHGPSLYSRPSLST

SEQ ID NO: 96048 - protein, 159 aa, Glycine max
  Coding DNA Sequence Number=SeqID_4363
SPTSNLVPLDLKIEATLRRNRAERRRKLLQDRTVASILEEETHFSDSLSPDSPSSRESATQLPEAAIMADEQHQRITLEDYSSSSVPQFFTSIARPEVKAHNINYPSITVATYPSAGGRRVTRGMRVPRKEYARSRHQRLFEENVGKTGKDAIYELLSE

SEQ ID NO: 96049 - protein, 158 aa, Glycine max
  Coding DNA Sequence Number=SeqID_4364
MSKQLEALTETLSCTLCGGAHRSGLCIPIEETSHEVDFLDCNMANLTRNIINGELTLVPLTNHKSTKSAIKNLKVQVGQLAKQLAEKSSSTFGANTEQNPKEECKVVMIRGRKVAMEEEKKMQKMVEDDKQQLVIEPTLEPVQPFCELIEEEEEGDDE

SEQ ID NO: 96050 - protein, 70 aa, Glycine max
  Coding DNA Sequence Number=SeqID_4365
MGSSTVLSYPNFVREPLLDDVRPFFAPRPIWALQKVPPEGGCFWRKQPCSPGRAELAWASWAASISPILL

SEQ ID NO: 96051 - protein, 188 aa, Glycine max
  Coding DNA Sequence Number=SeqID_4366
MAPKKFTSKRVRKTTTGEGSCTATPVEFEVDGHRFRSEEHQCHFEVIKDWSFLKERRVQLAKDEYIEFKTEIARRHWTQLVEPMPKYDPEVVMEFYANVWPTEEGVIDKHSKVQGQWIPFDTYAINQFLGNPLISEEGQQCEYTTRRSQTTGFDEEAIDAIHQFVGTEPPRHPVNHHEPPPLVVRPLQ

SEQ ID NO: 96052 - protein, 194 aa, Glycine max
  Coding DNA Sequence Number=SeqID_4367
YIHLVVQREPGRVHPLWIFACKGFYKVEKKTQGPQIAWELDVGTELPWEATMGSDADLGAELGGLGVGHGIIGDIGRGGGTSECAVDRGADDSGAGGCTDKGNEKRWRNIMVCSCWLMRSSLKSMEAWNKSRWRLAWAAARLAMTASRRSRLAAEAAASVIEERRGGQASDNGVLPYKISPPAQNILRWAKKKR

SEQ ID NO: 96053 - protein, 290 aa, Glycine max
  Coding DNA Sequence Number=SeqID_4368
  Homolog annotation: Hit_ID=Q5XM22; Match level="QueryCoverage=34%, HitCoverage=71%, E-value=2e-18, Identity=40%"; Hit description =Resistance-like protein HAAS-2
KVLGKALGRQVSGDSEEAPQRRSPTTSTCRQWAAAVVDHVDYAADELASHGRKVEKFGRPALKVEGILAATGLREVTITLDDVASLLHLPIIGVFHTFDALDVDQVVELLVKLIEVATQEAKDESCTIFANKSVTHINMVFLDAFHDLSQSGSYSWGVAALVHMYDNLNDASKHMTKHLAGYITLFQCWIYKHFPTIASIVADEDYHERKPCTCRWKFGKALPVSTYRKHLDRLTPDVVCWIPYVQHSLGSLLDMEHDDTFIIPDPLLQLVHVVAMPEPHAPTAADADMP

SEQ ID NO: 96054 - protein, 87 aa, Glycine max
  Coding DNA Sequence Number=SeqID_4369
  Subcellular localization annotation: CTP_CleavageSite=48; ConfidenceScore=5.08e-01
GLHVLAIRGLHVLAFRGQHVLTFAFVGLDALTFRGLHVLTFRGRHTPRLQRATRPHLQRTARPSEGCTLSPLEGYTSSLSVGSISTP

SEQ ID NO: 96055 - protein, 137 aa, Glycine max
  Coding DNA Sequence Number=SeqID_4370
MVIDQSLFYDLTQLPSEGVPFEGTLDDDWKFDFSVHDARRLVCTNQADMTGRLLADSLALESHILHYLIVRILLSRSSNLAQVSEEDLIVISFLIGAAVVASFGYRKERDGSWVKKGTQPNDDEGQLPVEGDSSLLQ

SEQ ID NO: 96056 - protein, 27 aa, Glycine max
  Coding DNA Sequence Number=SeqID_4371
LSEELTKCTYCAKRVHPLSGSILSAFR

SEQ ID NO: 96057 - protein, 131 aa, Glycine max
  Coding DNA Sequence Number=SeqID_4372
  Gene Ontology: Mol. function=endonuclease activity
  Homolog annotation: Hit_ID=Q9AY32; Match level="QueryCoverage=48%, HitCoverage=95%, E-value=7e-27, Identity=96%"; Hit description=RRNA intron-encoded homing endonuclease
  Subcellular localization annotation: CTP_CleavageSite=51; ConfidenceScore=5.42e-01
MVVTVKKLVVGPWVGSIGPAPVCTRSARPFCRRCAPVLKLAGSCLRRTTAKAFAKDVFINQERKLGARRRSDTVLVSTINDADQGSADVAFRTPLAPYEKSKSLGSGGSMVARLKLKGIDGRAPPGVEPAA

SEQ ID NO: 96058 - protein, 263 aa, Glycine max
  Coding DNA Sequence Number=SeqID_4373
DRTTPPILEEPQSSESSSIFPQPREPELGASEANIMAAYQPRRVTLEDYSSSVVPQFFTSIARPEGNLFHDLPNEDLYAHLATYIEIYNTVKIAGNNLKTWDEVVEKFLKKYFPESKITEGKAAISSFHQFPDESLRGKIKLKTPEEAMELIENMAASDHAILHDRTHIPTKRSLMELSSQDALLAQNNICGGAYESECCIPIDDTAQEHGSNYNQHQGQWRSHPGNQFNKDQGGPSNRPKQQGPSLYDRTTKLEETLAQFMQ

SEQ ID NO: 96059 - protein, 95 aa, Glycine max
  Coding DNA Sequence Number=SeqID_4374
MSACAIFGTPKCFEYACMKWPRGSLPQRGPGRTRQPKELVPLRSMIVTALGVLYTSNASRPSRDGRFSGSDASSFRDDEYTDFQEEIGRRRWASL

SEQ ID NO: 96060 - protein, 171 aa, Glycine max
  Coding DNA Sequence Number=SeqID_4375
MSILTLGSKKEEKENFQSKEKRKQGNSQSKSGRKEKEKKENSQPKNGRNGENTETFSSLTSYPELRRSEFLIGGYVGARASLLSTTPPFVAMTQELVARGDTLRLSAPRHSVTPSVIDEQRPIWSSAPFLEMSAFSDGDFSSLTNYLELRRSEFLIGGYVGARALLLSAAP

SEQ ID NO: 96061 - protein, 118 aa, Glycine max
  Coding DNA Sequence Number=SeqID_4376
  Gene Ontology: Mol. function=ATPase activity, coupled to transmembrane movement of substances; Cellular component=integral to membrane; Biological process=transport
  Homolog annotation: Hit_ID=A7QER8; Match level="QueryCoverage=80%, HitCoverage=8%, E-value=2e-25, Identity=62%"; Hit description =Chromosome chr16 scaffold_86, whole genome shotgun sequence
MTAVMSILFGSISLTYVAPGMQKFNQAKAAGYEVFQVIQRKPLIGDIQLQEVYFFYPSWLEKAILQGLSLSILAGKTIALVGSSGYEKSTVISLVEHVSKGGPLMARPIAIGKLKSRV

SEQ ID NO: 96062 - protein, 68 aa, Glycine max
  Coding DNA Sequence Number=SeqID_4377
MKKHDKGKGSLKNNPEEGHFQKDCLKCKSWFEKNGELNAHRFLTIQTISPNEKFIFHGEWSESSSGNS

SEQ ID NO: 96063 - protein, 255 aa, Glycine max
  Coding DNA Sequence Number=SeqID_4378
  Gene Ontology: Mol. function=motor activity; Cellular component=cell projection
  Homolog annotation: Hit_ID=UPI00016621D1; Match level="QueryCoverage =80%, HitCoverage=41%, E-value=1e-22, Identity=36%"; Hit description =UPI00016621D1 related cluster
GLHALTFIRLHALTFRGLCVLAFVGLHALTIRGLHVLTFRGLHVLTLRELQVLAFKGLHVLTFIGLHALTFRGLDIITFIGLDVLAFKGLHALAVRGLHVLPFRGLHALAFIGLHALTFRGLCVLAFVLTFKGLHVLTFRGLHVITFKGLHALAFRGLHVLTFGGLHVLAFRKLHLLHFRGLHVLAFRGLHALAFSGLHIHTLIEFKVLCPAPTVRIQPEREAITQLLCIPGQDFTRATAKRRVRIMRTNMTTLT

SEQ ID NO: 96064 - protein, 124 aa, Glycine max
  Coding DNA Sequence Number=SeqID_4379
MKLGIRQCRNLPFGGRAMRGLTGASSKEGKCAESPPTFIQGKCRKNRKRRGLRTLSVKCSRVVFTHGEDIFSLNKCRLRNWTIKRFFVFERREMLRRWTINDLLEWSTKAVKLHVDFMLLNGPC

SEQ ID NO: 96065 - protein, 73 aa, Glycine max
  Coding DNA Sequence Number=SeqID_4380
MKGAMISSDGAPLIGIIINTTPRPIKGTFGNPSHEHYTPANPSFHHGNQLMDTPIMPAKSSSQFALPFSEHMR

SEQ ID NO: 96066 - protein, 131 aa, Glycine max
  Coding DNA Sequence Number=SeqID_4381
MDSPGTSLPQLGTFKEGAYTIMRDKREMLSISQKQIPPPPHAPTVRLPRNRKGGPGARASWVGRVWIREGNRSDVPLTQPGNGPEGTAAWGMSASRRKAHFSFLVIGRADLSDQGRGTRVLVLSRCEEPRR

SEQ ID NO: 96067 - protein, 59 aa, Glycine max
  Coding DNA Sequence Number=SeqID_4382
  Subcellular localization annotation: CTP_CleavageSite=26; ConfidenceScore=5.19e-01
MECPSPQQGHAIVTYGPRPQDTKWTRSSPTGSWGFQLSLQASINSTECPSPPARSSGPL

SEQ ID NO: 96068 - protein, 92 aa, Glycine max
  Coding DNA Sequence Number=SeqID_4383
PRKLASKRSRKNAAAAGTSAAPEFDSHRFRSAEHQQHFKAIKGWSFHQERRVQLRDDEYTDSRVLRQCLAYRGGRTGPPVMEVGIVGARYAG

SEQ ID NO: 96069 - protein, 279 aa, Glycine max
  Coding DNA Sequence Number=SeqID_4384
  Gene Ontology: Mol. function=sequence-specific DNA binding; Cellular component=intracellular; Biological process=positive regulation of transcription, DNA-dependent
  Homolog annotation: Hit_ID=A6TGB0; Match level="QueryCoverage=99%, HitCoverage=98%, E-value=1e-139, Identity=85%"; Hit description=HTH -type transcriptional activator rhaR
  Pfam annotation: Domain name=AraC_binding; Domain location=14-159; Score=82.5; E_value=1.4e-21; Accession=PF02311.10; Description=AraC -like ligand binding domain
  Pfam annotation: Domain name=Cupin_2; Domain location=18-85; Score =16.4; E_value=0.0069; Accession=PF07883.2; Description=Cupin domain
  Pfam annotation: Domain name=HTH_AraC; Domain location=177-223; Score= 21.1; E_value=0.0041; Accession=PF00165.14; Description=Bacterial regulatory helix-turn-helix proteins, araC family
  Pfam annotation: Domain name=HTH_AraC; Domain location=229-273; Score= 55.1; E_value=2.4e-13; Accession=PF00165.14; Description=Bacterial regulatory helix-turn-helix proteins, araC family
  Pfam module annotation: Pfam domain module=AraC_binding::Cupin_2::HTH_ AraC::HTH_AraC; Domain location=14-159::18-85::177-223::229-273
QLVLRKDEFFASPSQAVAVADRYPQNVFAEHTHEFCELVLVWRGNGLHILNDRPWRITRGDLFYIRAEDKHSYASVNDLVLQNIIYCPDRLRLNFDWAAHIPGLFGTPWQPHWRIGSSGMAQVRQVITQLEHESARQDAQADSMAELLFAQLVLTLQRYRYATDNLAATQSETQLDKLLTALAGSLNRPFNLDSFCLREGCSERALRQQFRQQTGMTITHYLRQLRICHAQYLLQHTERLIGEIAMQCGFEDSNYFSVVFNREIGMTPGQWRQRSRAAA

SEQ ID NO: 96070 - protein, 356 aa, Glycine max
  Coding DNA Sequence Number=SeqID_4385
  Gene Ontology: Mol. function=cation transmembrane transporter activity; Cellular component=integral to membrane; Biological process=cation transport
  Homolog annotation: Hit_ID=A6TGB7; Match level="QueryCoverage=74%, HitCoverage=88%, E-value=1e-134, Identity=91%"; Hit description =Cation-efflux pump fieF
  Pfam annotation: Domain name=Cation_efflux; Domain location=103-356; Score=290.3; E_value=3.8e-84; Accession=PF01545.12; Description =Cation efflux family
  Pfam annotation: Domain name=DUF975; Domain location=91-296; Score= -98.9; E_value=0.036; Accession=PF06161.2; Description=Protein of unknown function (DUF975)
  Pfam annotation: Domain name=LTXXQ; Domain location=13-35; Score =20.3; E_value=0.0073; Accession=PF07813.3; Description=LTXXQ motif
  Pfam module annotation: Pfam domain module=Cation_efflux::DUF975::LTXX Q; Domain location=103-356::91-296::13-35
MAQEQVARQVEMAKVRNQMYHLLTPEQQAVLNAKHQQRMDQLREVARMQKGSAMMLSSSSSTVQPNRRMPVHLPGKSSGYTKRIAGKGAFMNQSYGRLVSRAAIAATAMASVLLLIKIFAWWYTGSVSILAALVDSLVDIAASLTNLLVVRYSLQPADEEHTFGHGKAESLAALAQSMFISGSALFLFLTGIQHLIRPEPMQAAGVGMVVTLIALISTLMLVTFQRWVVRKTQSQAVRADMLHYQSDVMMNGAILIALGLSWYGWHRADALFALGIGIYILYSALRMGYDAVQSLLDRALPDEERQEIISIVNSWPGVSGAHDLRTRQSGPTRFIQIHLEMEDNLPLVQAHVIADQ

SEQ ID NO: 96071 - protein, 89 aa, Glycine max
  Coding DNA Sequence Number=SeqID_4386
MRHMSAFLGRNMSEFRCISLHVSKASAIYVPTFLQGNLYEHVYDFGLGSSSSRDSFASWKMNDNRMEKEEREEMPLQGEEDESRRSSPP

SEQ ID NO: 96072 - protein, 80 aa, Glycine max
  Coding DNA Sequence Number=SeqID_4387
MASRKRKNTASKPSAQYDTRRFQSLEAWNRYTDNILGRRDTGKAGGCYSREVTTDFTRSTLASGGSIFSSVASRPSYTSA

SEQ ID NO: 96073 - protein, 29 aa, Glycine max
  Coding DNA Sequence Number=SeqID_4388
MDILTLGQGLCGSGKKEMSHIISMIHMQH

SEQ ID NO: 96074 - protein, 104 aa, Glycine max
  Coding DNA Sequence Number=SeqID_4389
MEREERERVIESLHAEAMKWMDRFAFTLNGSQELPRLLARAKAMADVYSAPDEVHGLFDYCQHMVQEQMKADMEAMKDQMTSMMEAMISMRRMMEDNAAAVATT

SEQ ID NO: 96075 - protein, 142 aa, Glycine max
  Coding DNA Sequence Number=SeqID_4390
MTTADVCWMPYSDHRAVKDFDLISCFSGHIRWCPVIVIHRPKRVVWMFGWMHFSYYLTPVGQICVVPEQRAPDYMDWFYMISHPFMRLTQPGDPPRHPPVMQDETYFEPDMPQYSVAATTMKETPSHAPSDVEHPRHAVEAC

SEQ ID NO: 96076 - protein, 139 aa, Glycine max
  Coding DNA Sequence Number=SeqID_4391
MVLTTQPDQPVKEYMLPAIAGHLPPPKTSLDPFLTLNSTQPLLLVFPGATCKPHSSLTGLENMRDLAFPKKDLESRIKNNATDDSIFNQWTPPLQFLVSLFIAQGKYKLDYTKKVSTGSTICNHKENFTEIWVQWYLNG

SEQ ID NO: 96077 - protein, 1308 aa, Glycine max
  Coding DNA Sequence Number=SeqID_4392
  Gene Ontology: Mol. function=protein binding; Cellular component =cytoskeleton; Biological process=regulation of transcription, DNA -dependent
  Homolog annotation: Hit_ID=A7PIS6; Match level="QueryCoverage=47%, HitCoverage=86%, E-value=0.0, Identity=70%"; Hit description =Chromosome chr13 scaffold_17, whole genome shotgun sequence
  Pfam annotation: Domain name=Actin; Domain location=488-1304; Score =40.0; E_value=1.1e-16; Accession=PF00022.10; Description=Actin
MAVVGGGKPPGQIFLRLGRAPCKAWQVVMIEYATSTEEEPCRYCGIKGGGLPYVISKGNNSVLECMNYSVENLSLSISFRVAARKAMQFAYDFYKKKGDHVGRVSRWQGPEMRSFRVSIDDKQRLKQIDGFSVVVFHLLACEAIGDIATDEFGQIMLLLKGLDDLGHELFETLIISKDHKVVTQEVIGCACCDRTPPITTPKAFVSSEKGIEKSGGVSTVGKGCRHDCIPTDEMLVESSQAQETSQVSESRSRAQLVDELINGWHGKYVFDERTVAYADKSGIEHGECDGLSGMSEGDKVWLVTGIGVIWKKVDMAWVCNRRLSWWAEVKGGLKEIFTNSWMGWPKWVKVIESEVSSELVSLDEKWNLRMEELCDTGLYKVMCVVAVNKNGEFVVANDVIHTKGFRGRHFWHCIETELKIGLDGVWLLVFGDEGFVADNGVFGGDCDDDRGFYPSTIWQEQQPEAETFGYSSCTSQRSSRVRSEIKQFNRNGGASSTIRMGQSETPVPGAWRAKKSGTRSSTSTGTISRVVCKGLDDGGLGEGGVELIDNFLETLEGSLASGMLWHGVVEHRAAVSTSPDPYSSSGYPTGTELTMSVTYVVQHAEVVVSPKHTTKATSSSVSPTQCLSSPKFSAKPITPSLVPPLPSSSTMAPPISALDGQERLNPVLFSATLSKGHATKPPILDFGFDRLGATGSEQIDHPVLITECVSNPVQSRSKMGELLFETYGVPSIAFGVDAAFSYKYNQQQGVCDKDGLAMCPGFNTTHVIPFVDGEPIYKGCCRTNIGGFHVTDYLKQLLSLKYPHHMTRFTWEKVEDLKMEHCYIAPDYASEARLFLKGAREAEEKTRCWQLPWVPPPTEEPPSEEEIARKAAIKERQGQRLREMAEAKRSSKINELENELHGLEFLLKQLEQVQDSNVPSFLAETGYVSRQEIESARTKVTQSLRKAKGEPKNEQAETDKASPNANEKYSLINIPDDMLTPDQLIEKKKQLSLKSMSEGRQRLKQKRYEEELERQRKQLLEEETRLENPELYLEQLRARYKDLSVKVDQRKRLKTNGGHSNGNNLAGAIGRGERLNAVQRERMRLLTTAAFDRGKGEDTFGAKDEDWQLYKLMSKDIDDGDEGPDEDDAELARISSRLQDLDPTFVPNKSEAGSSQPAAEAQRARPLTKEDFQIVFGVERFRCPEILFNPNWIAVDQAGLHEMAGVSIRRLSCKDEGLEERLTSSILVTGGSSLFPGITERLEAGIRMIRPCGAPIKVVRALDPVMDAWRGAAAFASAPQFHTQTFSRMDYFEKGEDWLRNYQIKYSS

SEQ ID NO: 96078 - protein, 259 aa, Glycine max
  Coding DNA Sequence Number=SeqID_4393
  Gene Ontology: Mol. function=protein serine/threonine kinase activity; Biological process=protein amino acid phosphorylation
  Homolog annotation: Hit_ID=A7P7C6; Match level="QueryCoverage=42%, HitCoverage=53%, E-value=9e-10, Identity=35%"; Hit description =Chromosome chr9 scaffold_7, whole genome shotgun sequence
  Pfam annotation: Domain name=B_lectin; Domain location=196-259; Score= -17.3; E_value=0.092; Accession=PF01453.15; Description=D-mannose binding lectin
MVLVQWKGLAPEDTSWEDWATLQSDYDLEDEADFPGEGVDRNNIRDNNRLGRLFKRPILGECFQEKVFFVANTEHKGPTFLGFIARSKIYFLVDHWTQKTNVFWVHYKKWALHVPPPFTNDFWRQYSTIPHHFHLSPSLNKAQPSNLNGDTLFQGHNHQLSTTNSLICSSGLFTLSFFQLDDSEDFYLGIRLSAVNSSYNWVANRDKPIHEDPSVAFTIDQYAKSYKNNGNFVLHEMNNQDGSVKRILWQSFDYPKNML

SEQ ID NO: 96079 - protein, 348 aa, Glycine max
  Coding DNA Sequence Number=SeqID_4394
MPRPIWFAYEQYWQREWTRVGLDEALNQVDMVVRDSCRQQSLWLLEEKCELGKQAMNLRGNGTWIKDEGVVLNAHRHMLTDTRTFQVLAIPHHDPKGCRGRPARQTQGGDHLRLDEVMRATSINKDGNTVVARKRVKTYLVLKWYWAIERVWVQMQVGWFYMRPRGLIFFRDKEKNPRGTTMPSVVLLVAGETQAALGVTEEVSGFAGAVKAADDNLTTSLPGDKRGRWPEPGPEMKQARRNGGGKPMMQFAKFSNSDKYSATEPFCVSLNNAPIHPNGSVPVKREDGVDGEMWVRISSIFKFMAWMVSPKRARTLVSWGGGLAVEAMRAPNDRDERVLVFEEPGTSN

SEQ ID NO: 96080 - protein, 141 aa, Glycine max
  Coding DNA Sequence Number=SeqID_4395
  Homolog annotation: Hit_ID=Q86AI8; Match level="QueryCoverage=95%, HitCoverage=22%, E-value=2e-08, Identity=26%"; Hit description =Similar to Homo sapiens (Human). Mucin 2
MDLWVLVPSPLEDYTSSPSEGCTPSPSEDYMSSPSEDYTSSLSEDYTSSPSEDYTSSPSEGCMPSPSEDYTSSPSEGHVPSPSEDYTSSPSEGCTPSPSEDYTSSPSEGHVSSPSEDYTSSPSKGFMPSPSKGYTPSPSED

SEQ ID NO: 96081 - protein, 123 aa, Glycine max
  Coding DNA Sequence Number=SeqID_4396
  Subcellular localization annotation: CTP_CleavageSite=53; ConfidenceScore=5.35e-01
MYPPLFSLNNLVDVPFSRTDPQEMYPLLFSLTTTQVNVPSTCTTKDVPSNVLRQSSQAGRIKRILRLCRFEFFDKGDRRHKRILAVSPLFFWKREKRDTKIILRRLVLGEFFLAKGEGNEKDE

SEQ ID NO: 96082 - protein, 140 aa, Glycine max
  Coding DNA Sequence Number=SeqID_4397
MGSTQAPSFKKRFYQVKIKSLGVASLKELGQLMGQLQQQAFRKVYGKIWDLTMVEVSTEAIDSLGQYYDQPLSQNLNTGIRPREASRKWGGWGTKEMFGSKGESLGKSRRMGPVHGHPGTFDLWGGPLSKCGWVGGPSSH

SEQ ID NO: 96083 - protein, 690 aa, Glycine max
  Coding DNA Sequence Number=SeqID_4398
  Homolog annotation: Hit_ID=A1JJV1; Match level="QueryCoverage=27%, HitCoverage=70%, E-value=9e-22, Identity=30%"; Hit description =Exported pilin protein precursor
MAQRKLALCLSDGHSRGLCLQWLNYSVDDGGDIYTPEKGICRGSALSPKPGIGGCRGQKLRRWCVSMKTGGVCGQAGGAVPWPVLMDPKIVSCDDQYKNPCSANVQYYSAGVMMIDVLAVGQPNAANTGTLVHPVGVHCNTGNALVGNLPFKNCKWLSDDTHRPPLVGKCELKSPNSWTLTSDSDCSVRSTLLWGHYGAGPGGECVVFTNTIYPQAQGVVNTPWGAITATQAANSGNRFCSKPLPPNVTCELDLPNIIDHGEVRAGDSSKRVDEGQIKCGLTPKIDVLVNGDRDTEGVRISTTPLIVNPTTVRITTEITVSNSAVAGEHSATYVFVASPYYRPRSVLGPGGDKGGITLSGHDYWSESQRIGCDNTTASGVYVGIANGDTLQMARDKFLRKYPGVGTWKLTPWFKGGPTCEGLLIWQSQQQAGNPSGVPVPGTYCGKIPPTNVSCDLEGDIRYEYGTVSGMAVNGMAKTEYITINCSQSADVIVTVGGGGRVSMGGGVTSRLYINGTDLGGGARLTAPAGTRRVPVEAVLYSQAEPKPGTYQGATGRCILPIAGAATGAPHKRATALHYRYGRGPAARVDLRVVVAQQVPQGCARLALPLSFNKQLPAVGKGRTEDTYFNPLWGAQRSMARMAQRNRTSGRGAVLLKNGDSGECCCSAIHLSGLGATTAAGFGFAARQQKR

SEQ ID NO: 96084 - protein, 139 aa, Glycine max
  Coding DNA Sequence Number=SeqID_4399
  Gene Ontology: Cellular component=cell projection; Biological process= cell adhesion
  Homolog annotation: Hit_ID=A8GL20; Match level="QueryCoverage=97%, HitCoverage=75%, E-value=2e-43, Identity=61%"; Hit description =Fimbrial protein precursor
  Pfam annotation: Domain name=Fimbrial; Domain location=5-139; Score =23.1; E_value=7.4e-08; Accession=PF00419.11; Description=Fimbrial protein
RIPPPGDEEIQLDFGTIVDKYLYQNTRTLGQPFEIRLAECDISLGKTVKVTITGMENAALPGLLAIDAGSGAKGIAIGLETLEGKPLPLNKSSDNYVLQAGNNLIALKAYVQGEPQAIANRTIGYGPFNAVATFSLEYE

SEQ ID NO: 96085 - protein, 179 aa, Glycine max
  Coding DNA Sequence Number=SeqID_4400
MASRKTKSTASRPQEPYNTMRFFSEVAWERYEQNVHSRRNLPKRNVTLYVTEYDEFRRELERRRWHKALTRQPDGHIDVALVKEFYANLYDPEDKSPRKVRVWGKLIKFDEETLNAFQETPMVLELGEYYSAFFRFYHTHPDPQELASKLYIPKHGFVLNAEGAPWKLLRKDLTTLAQT

SEQ ID NO: 96086 - protein, 50 aa, Glycine max
  Coding DNA Sequence Number=SeqID_4401
MVISPGVTRPAQDVKEALLGGNLSYWTHLVAHDPGNLNKTSASSEGRKIP

SEQ ID NO: 96087 - protein, 145 aa, Glycine max
  Coding DNA Sequence Number=SeqID_4402
MEGKKTIQIKRGISFNALKKKIGDKENILPCKFVMTKTLKRCWKVLNNKNKYDGDDDDDYLVSNSYVEESLDEDDSVDDIFDIDDEVTDMIQPELKIHFEMMLCIITISTGVILMRRTFAVWRCRQPLMLAKNYMLAWNFIVKMR

SEQ ID NO: 96088 - protein, 92 aa, Glycine max
  Coding DNA Sequence Number=SeqID_4403
  Gene Ontology: Mol. function=hydrolase activity; Biological process =metabolic process
  Homolog annotation: Hit_ID=Q7CTS4; Match level="QueryCoverage=100%, HitCoverage=40%, E-value=3e-48, Identity=98%"; Hit description =Hydrolase
MVADASGGTSVDAHKYAMDRMVQAGVIPVTWQQVLLEWQRDWARKETYDAVTSLVKEHSGAYGMGIDYAVTHVHGGAERVKHGKRIGPNPAK

SEQ ID NO: 96089 - protein, 343 aa, Glycine max
  Coding DNA Sequence Number=SeqID_4404
  Gene Ontology: Mol. function=motor activity; Cellular component=cell projection
  Homolog annotation: Hit_ID=UPI00006A16D8; Match level="QueryCoverage =85%, HitCoverage=86%, E-value=4e-18, Identity=24%"; Hit description =UPI00006A16D8 related cluster
HAIRGIHVLSCRGLHVLAIRGLHALTFRGLHVLAIRGLHALSFRGLHVLAIRRLHALTFRGLHVLFIRGLHVLACRGLHVLAIRELGLHALTFRGLHVLAIRGLHALTFKGQHVLAIRGLHALNFRGLHVLAIGGLHALAFRELHVLAIRGLHALAFRGLQVLTIGGLQAVTFRGLHVLTMRGLHVLATRELHVLAIKGLHALTFRGLHVLVIRGLHVLACRGLHVLAIRELGLHALTFRGLHVLAIRGLHALTFKGQHVLAIRGLHALNFRGLHVLAIGGLHALAFRGLHALAIRGLQVLAIRGQHALAFRGEHVLAIRGLHALIFKGLHVLVIRGLHFLAV

SEQ ID NO: 96090 - protein, 292 aa, Glycine max
  Coding DNA Sequence Number=SeqID_4405
  Homolog annotation: Hit_ID=Q5XM22; Match level="QueryCoverage=28%, HitCoverage=62%, E-value=1e-14, Identity=44%"; Hit description =Resistance-like protein HAAS-2
MFANKSATNVHVVYLEALRDLSMTERYAWGVAALVHMYDQLNDASMSHSRQLGGYITLLQCWIYEHFPSVPESTADQDYDEASPRSAWTDSGFQMSIGPRIGSIERSGTSTSDHATPISCAGGLLLFNTDRRGSCGSLVTRRPFLLLLSIHGSHMMIYTTGEVCVVPGACSSDYIDWFFRISHPFLTPGNAVDPLPHGHAPQPRVVPQAPQTDIPRVPEPGASSTSAEEPRHAVEVCDDIAERLESNLSLGVVTPGSSTHEVIEECLRLARSVTQDHLVYVRCRRIVHELIS

SEQ ID NO: 96091 - protein, 451 aa, Glycine max
  Coding DNA Sequence Number=SeqID_4406
  Homolog annotation: Hit_ID=Q6WAY4; Match level="QueryCoverage=50%, HitCoverage=51%, E-value=1e-25, Identity=30%"; Hit description =Putative uncharacterized protein
MGTNQTGKRFYQVKIKGLDITNIKELGRLMGPLQMQAFHKAYRKILDLAIAEISTKVVVSLTQYYDQPLRCFTFGDFQLVSIVEEFEEILGCPLAGRKPYLFSGFLPSLSKIAVMVRDSARELDHKWVPFMDLLALLIFGVVLFPNVDGLVDLAAMDAFLAYHHSKESPVVAVLANLFDAFDRRCDKSSARIICCLPALCVEQSAGFLDGREGVLFLCGEYPNIPLIGMRGCINYNPALAIRQLGAWESPLRKDKELRGIRNDIIGGYHEWLKVCTRGLDWLSKLKIIDEENFEAPEEDEEVRALKTKLGKARLAKEKFKLVATDVRKECAGLREENAATARALEQEIKRARKEEHGRDKFHGALWGSNSELKLRWEERDQSRAHSMVLKEELATCSRSKRNLSQCLCKIETNMLAIVSKYQEELNLATAHEHKVADEYAQVYAEKEARGR

SEQ ID NO: 96092 - protein, 115 aa, Glycine max
  Coding DNA Sequence Number=SeqID_4407
  Gene Ontology: Mol. function=phosphoprotein phosphatase activity
  Homolog annotation: Hit_ID=A5AWR0; Match level="QueryCoverage=86%, HitCoverage=10%, E-value=8e-18, Identity=43%"; Hit description =Putative uncharacterized protein
  Pfam annotation: Domain name=DUF1723; Domain location=81-115; Score =34.4; E_value=4.1e-07; Accession=PF08330.1; Description=Protein of unknown function (DUF1723)
MASSSSCSSSIQTRSGPIDSDVLWMQPKHVSEHVWNGEPDRKLHIRRAVPTYQGEEQIPEEIVPLLRQCGFYWIMRMGYLKINAALIERWRPETHTFHLRCGEATITLQDVSVLL

SEQ ID NO: 96093 - protein, 177 aa, Glycine max
  Coding DNA Sequence Number=SeqID_4408
KDATREGSSAALQANMDFDGHRDEEYAEFQEEIARRKWAQLASPIAKFDPEIVMEFYANAWPTEEGVTDMRSWVRGQWIPFDGMPSISFWGIHWFWRKASVVSSPRGGFRPPALMRSLSVSCYAFRGITPPRHPVDSEKSNRALGFPALIIGLFQFYRVSVTPTKLIQPSINRVFIE

SEQ ID NO: 96094 - protein, 67 aa, Glycine max
  Coding DNA Sequence Number=SeqID_4409
MKHSSSFRRLWVWINSSDFEEGYENLQISCQKEGLGLGVGGWGLGVWGMGYGVWGLGYGVWGLGFGV

SEQ ID NO: 96095 - protein, 122 aa, Glycine max
  Coding DNA Sequence Number=SeqID_4410
MAKFDPDIVLEFYANAWPTEESVRDMRSWVRGQWIPFDADAIGQLLGYPLVLEEGQECEYGQRRNRSDGFDEEAIAQLLCIPGQDFARTAAGRRVRIMRTKHDHPDSDMDDFAAQQHPAQRS

SEQ ID NO: 96096 - protein, 81 aa, Glycine max
  Coding DNA Sequence Number=SeqID_4411
  Subcellular localization annotation: CTP_CleavageSite=33; ConfidenceScore=5.10e-01
MSEPSSRVFLFDNILLLVVPTATIFSSKGMIPVATYPSAGGRRVTRGMRVPRKEYARSRHQRLFEENVGKTGKDAIYELLS

SEQ ID NO: 96097 - protein, 127 aa, Glycine max
  Coding DNA Sequence Number=SeqID_4412
MEFGDIVVHFNILDAMKHPSEDHSVFCAVILDQIVDDYMFDFDSLHGSTYTSYLLYEVQAEEPSSSLTLVSPTVQPPPTPELKPLPTNLKYAYLVDKEKFSVIISASLAAKQEEKLLLVLKKHKQAI

SEQ ID NO: 96098 - protein, 108 aa, Glycine max
  Coding DNA Sequence Number=SeqID_4413
  Subcellular localization annotation: CTP_CleavageSite=87; ConfidenceScore=5.28e-01
MRRALPSASRRQAHRRRADGSSRSLTYRRMRQRVRVSATTAHHTGEQPDGLTSSTASPAASARVSRRCTGYTPPHSLRIHSPCASCQAAAARYAPGRTYAAVRLRLAR

SEQ ID NO: 96099 - protein, 741 aa, Glycine max
  Coding DNA Sequence Number=SeqID_4414
  Gene Ontology: Mol. function=serine-type peptidase activity; Cellular component=intracellular; Biological process=metabolic process
  Homolog annotation: Hit_ID=Q8GF53; Match level="QueryCoverage=41%, HitCoverage=84%, E-value=1e-99, Identity=57%"; Hit description =Putative uncharacterized protein
  Pfam annotation: Domain name=Abhydrolase_3; Domain location=270-494; Score=26.1; E_value=3.7e-09; Accession=PF07859.4; Description =alphabeta hydrolase fold
  Pfam annotation: Domain name=DUF1738; Domain location=621-737; Score =59.0; E_value=1.6e-14; Accession=PF08401.2; Description=Domain of unknown function (DUF1738)
  Pfam annotation: Domain name=HTH_AraC; Domain location=117-157; Score= 9.1; E_value=0.27; Accession=PF00165.14; Description=Bacterial regulatory helix-turn-helix proteins, araC family
  Pfam annotation: Domain name=HTH_AraC; Domain location=65-111; Score =12.4; E_value=0.1; Accession=PF00165.14; Description=Bacterial regulatory helix-turn-helix proteins, araC family
  Pfam annotation: Domain name=LIP; Domain location=271-519; Score= -131.2; E_value=0.053; Accession=PF03583.5; Description=Secretory lipase
  Pfam annotation: Domain name=Peptidase_S15; Domain location=250-492; Score=-52.6; E_value=1.1e-05; Accession=PF02129.9; Description=X-Pro dipeptidyl-peptidase (S15 family)
  Pfam annotation: Domain name=Peptidase_S9; Domain location=285-515; Score=-16.7; E_value=6.7e-06; Accession=PF00326.12; Description =Prolyl oligopeptidase family
  Pfam module annotation: Pfam domain module=Abhydrolase_3::DUF1738::HTH _AraC::HTH_AraC::LIP::Peptidase_S15::Peptidase_S9; Domain location =270-494::621-737::117-157::65-111::271-519::250-492::285-515
MPVRCCTVAITPLVRELILYLAEQNPCYSPDDKTGRIAAVLLEQIPGAPVEILHLPVSDHPKIRQITEALFADPGDRATLQQWAVRLATSERSLARVVKSATGMSFGRWRQQLHLMIALNHLAEGQPVQNVAGTLGYDSVSAFITMFRKALGAETQRCAPLLAGRSLSRPACHYGLRSRLNVGYFPSSGRLSTESASEASGLPTAGITDSDKHNIPGYTKGADIMQINSTEKQIDYIGNIVYRQVKSMRSVRQLHMSVLVPRTSDLKPAIIYFPGGGFTTAEHDKFIEMRLALAKAGYVVAAAEYRTIPDTFPSPVVDAKAAVRYLRQHATDYGIDPGRIGVLGDSAGGWLVQMLGTTNGDKSFDTGNFLSQSSAVQAVATLYGISDLRSICEGFPENRLKVHQSPAVTEALLVNGVAFRDFAGASLISTPQKALSASPVGRLRGSNPPFLIMHGSRDTLVSPEQSATLYNALRKSGGRADYVLINGAEHGDHHWYQPAVINRVVDWFRQILGTPEKQDAICSASSALMGKRRHLNGFHLSGKAKPDRALSVMKLPQVLSVKWINWSVAATTPPAGADFAFCQPARALRNYQCRAQSVLLTGPVIERTLSGLLTQGVFSMKLPFYYLAALFLTAGTHSGTVIYTDSAHPVTDRAYSGFNVLLLWMAAEEYGYTSERWLTFLQSKTAGGHVRKNEISTLAIIYKSFEKQARDSIDNLLFRDGERVMEQLAMLKQLQLFNVEQ

SEQ ID NO: 96100 - protein, 185 aa, Glycine max
  Coding DNA Sequence Number=SeqID_4415
  Gene Ontology: Cellular component=cell projection; Biological process= cell adhesion
  Homolog annotation: Hit_ID=A8AMS0; Match level="QueryCoverage=77%, HitCoverage=79%, E-value=2e-25, Identity=43%"; Hit description =Putative uncharacterized protein
  Pfam annotation: Domain name=DUF1120; Domain location=1-185; Score= -108.3; E_value=0.062; Accession=PF06551.3; Description=Protein of unknown function (DUF1120)
  Pfam annotation: Domain name=Fimbrial; Domain location=33-185; Score =187.7; E_value=3e-53; Accession=PF00419.11; Description=Fimbrial protein
  Pfam module annotation: Pfam domain module=DUF1120::Fimbrial; Domain location=1-185::33-185
  Subcellular localization annotation: CTP_CleavageSite=52; ConfidenceScore=5.59e-01
MKHTLIAPLLLGPALAVFNASAVTSTPVVVNGGSIHFTGQVVNAACSVNASSADMTVQMGQVRTVTLSSAGATGSTVPFSIILDNCDTSVSGNVSVAFSGTTVSGSPTILSLGGSSNSSASNLGVQILDRTGTPVTFDGATWSAQNVLHNGRNYIPFQARYIGVGSGGAVAGDAAADANFSVQYQ

SEQ ID NO: 96101 - protein, 350 aa, Glycine max
  Coding DNA Sequence Number=SeqID_4416
  Gene Ontology: Mol. function=protein binding; Cellular component=cell projection; Biological process=cell adhesion
  Homolog annotation: Hit_ID=B0LF88; Match level="QueryCoverage=38%, HitCoverage=43%, E-value=4e-15, Identity=37%"; Hit description=FimH
  Pfam annotation: Domain name=Fimbrial; Domain location=221-350; Score= -34.6; E_value=0.0024; Accession=PF00419.11; Description=Fimbrial protein
  Subcellular localization annotation: CTP_CleavageSite=97; ConfidenceScore=5.39e-01
MTVSLGDIYTSTLVGAGAATPWVPFTLSLTACPDGTNGVTAVFSGATDSNGNFSNQGTAGDMAVQLETQSGTLLTSGSSLQTAVDQSQNAAFSLQARAITSGGKIIQNDKIYGDNMKHAGTNIKSIPKLLIGILLLLFPLLTWAGHARISCTPPPAHDAGRNWVDTSVSIPVALPDTMEPGVINPGDTLFTMAYGSKVRLASTSDSSVNVVIPFVAANRSVIVNRNCDFSSQSASVTLPEYSVAGTSAFSVPLSLSCTAGGNIYGTMSLTGTTASGDNTVFTSDGSAQGVGVRFYYNSQPVAANQGLQFGPISGNNIPTPLGLSVAYARTGGRLTAGTVQSRVNLNFTYY

SEQ ID NO: 96102 - protein, 113 aa, Glycine max
  Coding DNA Sequence Number=SeqID_4417
MRIDNPAQTVSRGIQCRLHADPLVMKLRMQQPSGLCQGFAQCRALYAQPPGIRRMTGIATDLSQRALRLRDLDAAAHTAISAGGFHDACAIRLSGRFATQTWPSSSLTGQQRS

SEQ ID NO: 96103 - protein, 535 aa, Glycine max
  Coding DNA Sequence Number=SeqID_4418
  Gene Ontology: Mol. function=DNA binding; Biological process=DNA recombination
  Homolog annotation: Hit_ID=Q5WS97; Match level="QueryCoverage=41%, HitCoverage=72%, E-value=7e-35, Identity=34%"; Hit description =Putative uncharacterized protein
  Pfam annotation: Domain name=Abi_2; Domain location=211-424; Score =148.3; E_value=2.2e-41; Accession=PF07751.2; Description=Abi-like protein
  Pfam annotation: Domain name=DUF1526; Domain location=281-445; Score=- 39.5; E_value=0.0023; Accession=PF07512.3; Description=Protein of unknown function (DUF1526)
  Pfam module annotation: Pfam domain module=Abi_2::DUF1526; Domain location=211-424::281-445
MSNKELHRLSVIQAVIEKRLRRRDAASQRTSGSAADEPLPQVWCSRFHAATSAVRTWPDPAPRYFDYESALALRNLATAYGIDMPRYLHAPDVAVQLSKVPDMKKRLFIDALWYTGGRLNEILPLTREDLCTGRSADRRPAFLTVRGAAHAQAAKARGGRAQPPARPANEGGTAGLVKKRGIGRRSGWAHFSATTSAMAKGISRSKVAYEKPTSLPGDLITRLRERELVIEDEHIAENALRFVGYYRLRGYFYPFYRMTEERVPRVHEPKRFLSGTTLGQVIDLYEFDRRLRLIILEQIQKVEVALRTCLSEHMSARYGAHWFMNLAIMRPDYDHQEFFRQIAGAKEVFIQHYRERYSTPVCPPSWMITEVMTFGTWSAMYASIPVSDQRAIARMFSLNSHDVLGSWFHTLSHLRNLCAHHNRIRFPGVMDLKSSLIRLWHSRQPASRGKKWAFPNSGGTILSGPGPLIRPVRVLSRIRPQAAVVRITDRRHGACPARPLSDFPAYGSGFDSRLYLERFFNRSGTLSYMSLLSAR

SEQ ID NO: 96104 - protein, 600 aa, Glycine max
  Coding DNA Sequence Number=SeqID_4419
  Gene Ontology: Mol. function=acid phosphatase activity; Cellular component=periplasmic space
  Homolog annotation: Hit_ID=Q84CN9; Match level="QueryCoverage=66%, HitCoverage=99%, E-value=1e-133, Identity=59%"; Hit description=3 -phytase
  Pfam annotation: Domain name=Acid_phosphat_A; Domain location=32-365; Score=137.6; E_value=3.5e-38; Accession=PF00328.13; Description =Histidine acid phosphatase
  Pfam annotation: Domain name=CcdA; Domain location=529-600; Score =112.0; E_value=1.8e-30; Accession=PF07362.3; Description=Post -segregation antitoxin CcdA
  Pfam module annotation: Pfam domain module=Acid_phosphat_A::CcdA; Domain location=32-365::529-600
MMPRRHQAAARMFIAGALWLCASQAHADTQYQLEKVVELSRHGIRPPTPGNRKDIEAATHRTWTTWTTHDGELTGHGYAAVANKGRWEGEHYRELGLLTSGCPQSRDIYVRASPLQRTRATAQALVDGAFPGCGVEVHRVEGEDDPLFQTEAFPATNTDPAKQLAAVKAVTGDLAARQRALQPAVLALKRAVCSSDADCSYFDKPWQIKQNKSGKTSIDGLSVLANMVETLRLGWSENLPLSQLAWGNITSSAQITAVLPLLTANYDLGNDVMYTAQKRGSILLNAMLQGVEQGVSRTTDKLPDTRWLLLVAHDTNIAMGADPHELYVDTFWLYAWKHSARKHLDDLRRLQAIDKEHPLLREEWRQSDCRVTGVGTLCPMKTALKALSRNLDPVAITPVRIVWATLCADHLPFGDIEQLAELSGLSVRTVSISDLSGHDAPGDDALDQRIAEAKSNLAEEGRFYRSVITAIVVCALLLVLNHFTNPASTDQPLATEAATADAAARRTLHSSGAALAPGKGRNEPAAAATRQNVNLSIDKELLNKARDAGMNLSRTLSMAIDEELRRYAASRWQEENAEGINTLNRIGEETGCFSDNYRNF

SEQ ID NO: 96105 - protein, 307 aa, Glycine max
  Coding DNA Sequence Number=SeqID_4420
MRQGGSGSEAAPDPPQRARHTSGKVLYWPESGSGAEREAVKAGGPLKDGEFFDELRDLYLRYCEITDHRLGNREVHSFSVNYETRHTDQNYGNGVKMMMKADGIVRGITGPVAHPLTVRVSSPRAGIRGRLAAGLIAGVIASAGVVPATPAATRDEVIHLNAAYPSGSVMVCSKNLPGDGKMIQPTVLQMRGTVVNRKQDSAVYEVSSTWTIPGKSSSSDLTLKLRMLERMDDKGSYSRIVPDSMSVSMPSVGPAGEKSVLEGFRRRLPAGEIFTPFSNIEITDFPSYTVHPRGEPTSYCHRESAGT

SEQ ID NO: 96106 - protein, 168 aa, Glycine max
  Coding DNA Sequence Number=SeqID_4421
  Gene Ontology: Mol. function=hydrolase activity
  Homolog annotation: Hit_ID=Q9UY15; Match level="QueryCoverage=100%, HitCoverage=89%, E-value=2e-22, Identity=35%"; Hit description =Xanthosine triphosphate pyrophosphatase
  Pfam annotation: Domain name=Ham1p_like; Domain location=3-147; Score= 24.2; E_value=6.6e-12; Accession=PF01725.7; Description=Ham1 family
MNIRFVTSNTVKFTDAARYFSASGIGLEQAELAVPEIQADSANEVCRAKADYVSGRLSGPFFVEDSSFHIPSLNNFPGIYARYALATLGTEGLLRLMKGLASRECYFRSCVVFRDKNNTFHEFSFVRDGLFITEHTHKNITGWSELWGIIGNANLNKPFSELSPEQRS

SEQ ID NO: 96107 - protein, 114 aa, Glycine max
  Coding DNA Sequence Number=SeqID_4422
  Gene Ontology: Cellular component=cell projection; Biological process= cell adhesion
  Homolog annotation: Hit_ID=UPI00005FA72B; Match level="QueryCoverage =92%, HitCoverage=59%, E-value=9e-17, Identity=45%"; Hit description =COG3539: P pilus assembly protein, pilin FimA
  Subcellular localization annotation: CTP_CleavageSite=95; ConfidenceScore=5.65e-01
MFKKTLVTMIVALTASSAFAAQQNSIRFKGSVSAQTCNISVNDSTSAAPVILLQAAKVSDLTAAGNTSTPTTFSMKLTGCANPGTAGEDIKINFVSNNVDASGNLKICHHIPCD

SEQ ID NO: 96108 - protein, 257 aa, Glycine max
  Coding DNA Sequence Number=SeqID_4423
  Homolog annotation: Hit_ID=A4V9L0; Match level="QueryCoverage=100%, HitCoverage=73%, E-value=1e-75, Identity=52%"; Hit description =Putative uncharacterized protein
MDESGFTGEDLLHRPQPFQCATTLSISPDDARHLIRQHFPKLKAPELKFSSLIKRDTNLKPLYELQRDLLANFPCVSCVADKKFILILLFVTHAVEPWHHARGRNLLSNGGHFLLASSTFFAGPALLGNDFELILRCFQHAMKLKTYESVQELITTVRGVNWFLMEDFLGPIATGDPDCINEILDEKTSTDAAFIILNALISKTEMMSADAYRIEHDRSKNLLQYHDYLMRFIGCDQPAEFRLSDDASVSYPLKLRE

SEQ ID NO: 96109 - protein, 497 aa, Glycine max
  Coding DNA Sequence Number=SeqID_4424
  Homolog annotation: Hit_ID=A7FCF9; Match level="QueryCoverage=39%, HitCoverage=72%, E-value=7e-33, Identity=35%"; Hit description =Putative uncharacterized protein
MAQQQHGELERVYTMIGAVVMAMAGDGLETTRLRIAGFIRGELARTQAWSPEMETAMLSAIETLEIYPDQEVVERHRDGGDWRRPEWFLTPPCRSCGIQGPAAHCLPASVKILVINGCATQPQSSAPLYLKTEMQSPVSGKAGYTDPVLSYIKEDNVRHIRLYSLSPLPGKQFHDALERKYNATILYIDLVENHGGYKAEISGVINYYDTQRYVNGKLVGDVIESVPVPTVAVQLNSEKSVNIELPRGRAAHCPSVLKWGRMLNKAKTAAEDSGYANCEMDEALLAMMRSNGRNKAWAETMVNLEARKLIETANRVAGFHIRDGLTRLQFVQEIRDVIEGQFAIARRAKTDEECMACIKNLREESENLAEQDRLLRIKTAQLYAKVEFVWQNNKIVGYTLSAVHIAISGIALFTGLAMITSMPAIGMLAGAVLVSDGINGLSQEIINHFSPPGSAHSEGIFGDAAMAGAEFLGFRPETGKPGHGACSDGCPETITAK

SEQ ID NO: 96110 - protein, 239 aa, Glycine max
  Coding DNA Sequence Number=SeqID_4425
ETADKAQQVPANHREGREHAACRQDQQDQQRGDYARRHHIALHHAGGKVIRIELAVGHEGSDDIRPELPQHDRAPGKKQGKPDNKGACRTAEREHGNILQRVKNRGESREGGGAAPVVVVMLPPVSAARGHRRRSAGAPLSGECSHFPLKARAAGSHRSLSNTSIAASMNRQNSPDPAAPGAVSKRRSPLTKCQGSQLSVTFTSSRVMMAAVSIRFMKPGSEDASRSIFLRMAPPAPVS

SEQ ID NO: 96111 - protein, 171 aa, Glycine max
  Coding DNA Sequence Number=SeqID_4426
  Homolog annotation: Hit_ID=A4WGU1; Match level="QueryCoverage=85%, HitCoverage=13%, E-value=2e-07, Identity=26%"; Hit description=TraG domain protein
RHPPVQSLDVPEAVSGGAVRTASHASQQLSAERRGSGVTEESLQRRERNLTAPAGAPSQAMSEDFRSGSQRVGEKASGAGIESNVANKVAAQRSGLMETIRENDGKIAENKTTVQTSSDILRNEHQGAVRSQQIGRTEEDIRQTKPKIDDAETEQFRHKLEKLRSSQQKAS

SEQ ID NO: 96112 - protein, 540 aa, Glycine max
  Coding DNA Sequence Number=SeqID_4427
  Gene Ontology: Cellular component=periplasmic space; Biological process=conjugation
  Homolog annotation: Hit_ID=A4WGU0; Match level="QueryCoverage=81%, HitCoverage=95%, E-value=0.0, Identity=77%"; Hit description=TraH family protein precursor
  Pfam annotation: Domain name=TraH; Domain location=84-518; Score =562.9; E_value=3.4e-166; Accession=PF06122.2; Description=TraH protein
MTEHTFTLSRTETALLLVCASMLAAAGIYAWLACDLARLPAGVAYGTDALLLSGLQLYPLLFLFALAGGFGCGALGGIMNLRQLVISALAALTISSPALADVQGDLNGYFGSLGFDGNVSKAQAWQGQAAGYFTGGSVYLRNPVKQVQLISMQVPSLNAGCGGIDAYLGAFSFINGAELQRFVKQIMSNAAGYAFDLALQTMVPELKQAKDFLQKLASDVNSMNMSSCQAAQGIIGGLWPVSQVSNQKICQDIAGESNIFSDWASSRQGCTVGGQGDSVTSRASDKDKDQVLKNKNLIWDALGRNHLFDGNRQLKELVMSVVGSIIFNKDGQVTILTPLVDNRDIINVLMRGGTAKIYGCDEQDLCLGPMPASVTVSSDVALVTQVRNLMISIDSKLSADTGLSDKEKGFINTTSVPVLKYLTNSRSMGMSPTYLIQVADFIAQDMMIQYLQELVKQASQSLAGKNFPEQAAGELRNNVQAATSLLAQMKLQSTADQNALDGIDRNMQYLQQQRSGRAMHSGVSVMTEVWTIYGGDMWRQ

SEQ ID NO: 96113 - protein, 524 aa, Glycine max
  Coding DNA Sequence Number=SeqID_4428
  Gene Ontology: Mol. function=scavenger receptor activity; Cellular component=cell outer membrane; Biological process=conjugation
  Homolog annotation: Hit_ID=A4WGT5; Match level="QueryCoverage=84%, HitCoverage=71%, E-value=1e-100, Identity=45%"; Hit description =Putative uncharacterized protein precursor
  Pfam annotation: Domain name=TraN; Domain location=370-403; Score =21.0; E_value=0.0045; Accession=PF06986.2; Description=Mating pair stabilisation protein Tra
MKRLLLILLLFSVAGARADAVSDAYNAGAGYAGANKGQGTSAAKGTDPASVIPGYTSSPSQSGYYGGVQGGDGGISDKGQTELSHNEAGLAISDSSTKNPAVTIDPNADFIQNGKNAEANSGSIVDGTNQQCTTKVVSKSVFENYSCDRDVAQVQTCARTGSIQITGSKEYYNTELVLDSHNSTAVILDDYWVRFDFTVPDDGVVSTGTWDFRYPRSPNYHGSDGNRLWYTMKAFDLTVDHIQLNNGGQAAITPQRVTKGQTVSLYIHYHTDGHYSEGRDGIIKNARDGTFVMKMTFPLTAERDTTSSQVVWSESCGFDKSKATGTAGTVCTDPGGSRTVNQNGKDYTQSASCWQYSDAYIVPVSSTGNCSTLMANKNCTVSARSCTQTEGGTCLHEQDTYQCQTTYSSEGLLCGGQYFCRTGDCSGTDGAGDSGFDTAVAKLAGLASAGDDVKADQVNVKAFTGQALYCRKAMAGFSSCCVDTGWGNSAGLANCNSDEMAIGKAKAKKVTVLVGEACNRAVLG

SEQ ID NO: 96114 - protein, 285 aa, Glycine max
  Coding DNA Sequence Number=SeqID_4429
HNARGQTAPQKVKRHNAQVRLDDDDKSGLRRMTAEFPLYSESMILRAALQTLLACSGEVRSAIVLASLTDKDVGEVMRHASRAAGLARARARVSRGNFAFASEYSRTRRADGSSARGRFTPYAAGAADRADAFSVRHGTSVPVPAPFGSPAMAARALAHEETAYWQQLLAAFAAAIEAEGYTFGTDARAKVALPHAVRARAGGAIVKARSRHITPLRSEAALEDLQLQAAEDGYAGSWADWCQRGAEAAGWYVIRREVNQLSDGAVTATDEPKPDNRIQTDGLLP

SEQ ID NO: 96115 - protein, 1057 aa, Glycine max
  Coding DNA Sequence Number=SeqID_4430
DGLADFIQRLCRTGQHGEQPLDALRGALDAGDVGKRVKAQRGTVQIDAARLPAEVFIASPHVDNPAEAAGVECLSQRLLNQEAFARPGGTGHRNVGVCGAVLFAEHIKKSQLPPVGGQRAAEGRHLPLCHHRHQVHRVKAFAAQGGPHVPHVVPQPLLHQERQRGEPVAQLLIAGRRHFQFVLTEHVDGRVLAFLLRTRAVGRKQGQIQRHVAHGNFVVRQLLAQPPPLLVSALRAREQLRVRGAGLLAQILLFAERGVLAFHLVLHAHRPAQDKRTGNAEIGEAHVLQVVGRLPERELERRFGHLQAHNARAGDVRLPFLTQRPVFALTRRGEPQVARMDLELRAGIHALAMQFLIAIPVTAAGDHLPLAIVQLFTHHRKKGFRSDAQGVHLCGQQRHAYGFTQLHRLVHCAYPAPPRLPVNQKHAAGRHAALPHVAAESLVQHLAHALAGHHQHALTTCVASGAPTSSSPGPVLPRARAGLRSAPARDGAGHAQGAAGFAPSARSRSSRRSDAMLASIDMVGGGVHSQSQSLPQPVRRKQCARDEYPWRPGRSGMSVRVNRMVRVALVKAQKFAIQSVCFFFIKVGTICRSLGASSLIARWLLAAGTFFTGAFMRAQTSARGVPGETWRMTSAMYAASRSIVMSASAGTCPEFITSGRIAASGTGRVLSLSSRNTILPAGCVTRMSSASGGVTVLSGTISTSDNHVAVLRMSASEKCQDYAPGRGNIMSELNAVSGKPVITFSCDDKQICEEIIALKTFVFSLLRMMPEDISLDVVKNLSGNGDNPPLNRLCTEMVDAMIATSTHDVRVLTHPDLGLSDVTDFSRFSCVTPDDSELVQDKRYTGGEAGQQAEQRQSLKTQLHTASACALIGKRGTFMMIVWSLGIAKMRKDTHRPPFKGKCANNDKSAEQRSHSSVPLRPPGGFQPYVEEEVGQPDKGCTENDGPPSIKCSQQTDHKYPRNSNKKDARKCGQSLRQITAAVKQSAELHAHQIDQLNILSSSRATSVIIRIGTVTLISAGNDSAELMHHQRYPGGEAGQQAEQRQSLKTQLHMASV

SEQ ID NO: 96116 - protein, 233 aa, Glycine max
  Coding DNA Sequence Number=SeqID_4431
MNLLRISLIFDLKPRCGHLYAEFFGSGAACDDAAVIVTQHHHRPAAQVRAEERLAAGVKGVNVGQTKHGHDHLRRARQREPGLQLQALDRELAVDLGNHDVAVSGFLGPVNHHYVAVAEAQVPHAVAAGAHEEGRGAPADAQFVQIEFFLDVILCRGGEAGGARIGIKRYPDPRRKNGWPEQRQAGGRAARVRAGRRGEAFPVYRYSPALCGRAGFVKCRISVTCVSSSCRHR

SEQ ID NO: 96117 - protein, 1252 aa, Glycine max
  Coding DNA Sequence Number=SeqID_4432
  Gene Ontology: Mol. function=catalytic activity; Cellular component =mitochondrial matrix; Biological process=metabolic process
  Homolog annotation: Hit_ID=Q48LA2; Match level="QueryCoverage=31%, HitCoverage=99%, E-value=1e-163, Identity=71%"; Hit description =CAIB/BAIF family protein
  Pfam annotation: Domain name=2-Hacid_dh; Domain location=773-1143; Score=71.3; E_value=3.1e-18; Accession=PF00389.21; Description=D -isomer specific 2-hydroxyacid dehyd
  Pfam annotation: Domain name=2-Hacid_dh_C; Domain location=868-1046; Score=207.1; E_value=4.1e-59; Accession=PF02826.10; Description=D -isomer specific 2-hydroxyacid dehydr
  Pfam annotation: Domain name=CoA_transf_3; Domain location=69-258; Score=243.9; E_value=3.6e-70; Accession=PF02515.8; Description=CoA -transferase family III
  Pfam annotation: Domain name=HMGL-like; Domain location=399-670; Score=164.9; E_value=2.1e-46; Accession=PF00682.10; Description=HMGL- like
  Pfam annotation: Domain name=SDF; Domain location=1056-1251; Score= -163.8; E_value=0.00082; Accession=PF00375.9; Description =Sodium:dicarboxylate symporter family
  Pfam module annotation: Pfam domain module=2-Hacid_dh::2-Hacid_dh _C::CoA_transf_3::HMGL-like::SDF; Domain location=773-1143::868 -1046::69-258::399-670::1056-1251
MALPLEGLRVIEMGQLIAGPMAGRMLAEFGADVIKIEPPGKGDPLRKWRMLHNGTSVWWAAQSRNKRSVTVDLRQPEGQQIAMSLLNSADVLIENFRPGTLEKWGLSWETLHANNPRLIVLSVSGYGQTGPYRDRPGFGVIGEAMGGLRHLSGEPNRTPVRVGVSIGDSLSALHGVIGVLLALQSREKTNQGQQIDVALYESVFNMMESLIPEYSVFDHIRQPAGSSLPGIAPTNAYRCKDGKYALVAGNGDFIFQRLMQIIDRPDLAADPALAHNDGRVKQVEMLDAAIGEWTSQRSLQEVLASLNEGGIPAGKIYDAADIANDPHYKARDMLLPAQLSDGTPVTLPGIVPKLLSTPGSVRHAAPELGQHTEEVLSELGIDAKQRMVLKEKGAEVCPRDGLQNEAVFVETQDKIALIDRLSQCGFVKVEVTSFTSPKAIPALKDAEAVMHGIRRMPGVEYSVLVPNQRGAERAMACRIDEANLVMSASESHNNTNLRMSREASFSQLSQVVHELSNTPVAINVSLSAAFGCPFEGDVPQNTVLNFVDRFASLGVRGVTLCDTTGMAFPTQVASLSRMVKQHFPHLEITLHFHDTRGLALANTVAALSEGIDRFDSSTGGLGGCPYAPGASGNVCTEDMVHMLELMGYQTNVDLPALLGLSRDLESLIGHKVHGAVVKSGMRLNQFGNNRIAFTFGQQKINVHEYGKEIDPKAHLPVPGSLDICLISSYPVEKIKAHLEQFDVALVEGPVTRTGACGPITNRGRYENCDTGCGDVARSVRKPQSCDNWVYRESTREEDVVSVLDNAKIVITNKVPLRKAALEKLPSLRFICVAATGYDCIDTDYCRERGIVVSNVPGYSTRSVSESVIASVFALRRNLVEYCCSSHTEWSLSSHFCLHKSPIGDIQEATLGIIGRGDIGCAVARLARALGMNVLFAERPGQNSVREGYTLFDDVISQSDILTLHCPLTPETYQIINQDVLVRMKPSALLINTARGALISEDDLADALTRGEIAGAALDVLAKEPPSPENKLLHVRHKNLLITPHIAWASQTGVNNLIKGINYNLAGIGHFYPNVGVDLKPLGDTFIKLIRLLIAPIIFCTIVSGIASMKSLKSVGQECISIPRRWMAGPSLPIQKRRMSSLLPAFLTHIIPETVFGAFAEGNILQVLFISILFAFGLQLLGDLGKPLLNTIDLVAKTFFRMLKIVMYVAPLGAMGAMAFTIGKYGVASLSSYGALLPMALPPLHSRRAGTGI

SEQ ID NO: 96118 - protein, 280 aa, Glycine max
  Coding DNA Sequence Number=SeqID_4433
  Gene Ontology: Mol. function=DNA-directed DNA polymerase activity; Biological process=response to DNA damage stimulus
  Homolog annotation: Hit_ID=P23832; Match level="QueryCoverage=84%, HitCoverage=63%, E-value=9e-84, Identity=60%"; Hit description =Protein samB
  Pfam annotation: Domain name=IMS; Domain location=3-280; Score=155.4; E_value=1.6e-43; Accession=PF00817.11; Description=impBmucBsamB family
MTPFRHEDVASLAADTDAQVTGQLAICKGSYGPDMKSRCFSGFEFAFHINHSLSNRVMMALEEMTPKVEQYSIDEMFLDLTGIDGCEDFEHFGRRLRAHFRGVLALTPDNPKRTATLLENQPVEEIWGVGRRIGRRLNLMGIENALQLARAHPALIRKNFSVVLERTVRELNGESCIPLEEFAPAKQQIVCSRSFGERITTKVAMQEALCHYATRAAEKLRNERQFCRRISVFIRTSPHAQGEVFYGNSAGENLTLPTQDTRDVIGVAMRSLDRIWLDGR

SEQ ID NO: 96119 - protein, 47 aa, Glycine max
  Coding DNA Sequence Number=SeqID_4434
MVCPGTRQQGRPVNPADAGAVLGTVAMGMYIAGCMIIAVKLEKFITY

SEQ ID NO: 96120 - protein, 302 aa, Glycine max
  Coding DNA Sequence Number=SeqID_4435
  Gene Ontology: Mol. function=DNA binding; Biological process=DNA recombination
  Homolog annotation: Hit_ID=Q5QBE8; Match level="QueryCoverage=60%, HitCoverage=52%, E-value=3e-39, Identity=48%"; Hit description =Tyrosine recombinase
  Pfam annotation: Domain name=Phage_integrase; Domain location=1-180; Score=-11.1; E_value=0.007; Accession=PF00589.13; Description=Phage integrase family
QRRDLTFLHVAYSTLLHISELGRLRVREVSRAADGRIILDLAWTKTIVMTGGLIKALGDLSSQRLTEWLTLSGLAGEPAAFIFGPVHRVNRAMAVTEKPLSARTLEDIFARAWQEAGDAGAVRPNKNRYRTWSGHSVRVGAAIDMAMKKYSTAQIMQEGTWKKPETVMRYIRHVDAHAGAMIDLMKQHQPVRSLSISARIMKHERGMTLTPDVNLVVSDADRSDSAMSEAKRQHIGPSICWPPDAISLSNKVSAPGSLHCRSDEARDHHRPLYAGCDRGGDAIARPHLAKRATLHGGRHDAQ

SEQ ID NO: 96121 - protein, 146 aa, Glycine max
  Coding DNA Sequence Number=SeqID_4436
MEKFPVKLQTKFREDPTVNKSWAAFLPRKLHVASSRSFIKRLPQKASLRGFLKKLPRCYTKFRAPFLPLPPFIFSHLQALIMAFYGGELLLNSSSPRSGVSSQLFFFSIPLPLKFKKQRTPLMKKIQGLQAPNGATSCGIRASSSR

SEQ ID NO: 96122 - protein, 21 aa, Glycine max
  Coding DNA Sequence Number=SeqID_4437
MEVGGWKLEVEVTRSWKLEME

SEQ ID NO: 96123 - protein, 52 aa, Glycine max
  Coding DNA Sequence Number=SeqID_4438
MVMIPDKIRSIDGSKETLKLAVRITDLWFIGTPNKSEQAEWFLLILSLHISG

SEQ ID NO: 96124 - protein, 153 aa, Glycine max
  Coding DNA Sequence Number=SeqID_4439
MGKVGEVQDQMKAATEPLKEQMAPIRGALISIREIRGVNGVVIAAPSPFVGGALPPPPPLYGLNQINHPTSDMVGLEGKELGGIGSPHLVRKTSMPSHHMACLPTMHLLMWHTLPMRMSISPLPYSLKADNLKLIMHMSLKPWGRHMKFPTTI

SEQ ID NO: 96125 - protein, 172 aa, Glycine max
  Coding DNA Sequence Number=SeqID_4440
MAPKKLSTKRSRRDATGEGSSAASEEDEYMDFQEEIARRRWTLLVTPMAKFDPEIVLEFYANAWPTEEGVWDMCSWVRGQWIPFDADALSQADSFDEEATAQLLCIPGQDFARTAAGRRVWIMRTSMTTLTQTWMTLLLSNVLPSDHKSDLPLPKCQLVYVILTWMRVHVAQ

SEQ ID NO: 96126 - protein, 143 aa, Glycine max
  Coding DNA Sequence Number=SeqID_4441
MAAQFIHDRVKMECLEGAWETLEGNARCRFRGTIRFTATSLVHPEEPARTLQRTVEWILPTPTPYRLVEPIQVIEVTSSEEDPEEDPEELPADPAVDALDFLEGDEDPLPVVDSPEDVMSASEADSTEDSGPGEMATSGGSSS

SEQ ID NO: 96127 - protein, 127 aa, Glycine max
  Coding DNA Sequence Number=SeqID_4442
GVWETLEGNERCRFHGTIRLTTTSLVHPEEPARMLQQPVEWILPTPTPYRLVEPVQVIEVSSSEEDPEEDPEELPPESAVDALDFPEDDEDPLPDVDSLEDIMSASEVDSTEESGPGGTANSEDSSS

SEQ ID NO: 96128 - protein, 35 aa, Glycine max
  Coding DNA Sequence Number=SeqID_4443
MVSPKQKQIGVYGMGCESSHSSRMDEMEKSIGGVM

SEQ ID NO: 96129 - protein, 205 aa, Glycine max
  Coding DNA Sequence Number=SeqID_4444
GYTPSPWVLVTLTVERTTRPRLERTTRPHHQRAARPHLQRTTVLALRGLHALTLGLHALTFRGLHVLALRGLHALTLGTTYPHRRGLHVLALRGLHVLTELQRAARPHLPEDYKGLHVLAVKGSCAFTFVGLHALTFRGLHVLTIRGLHALTSRGLHVLAFKGSCTFNFRGLHVLAVKGSCAFTFVGLHALTFRGLHVLTFRGLH

SEQ ID NO: 96130 - protein, 94 aa, Glycine max
  Coding DNA Sequence Number=SeqID_4445
MPVSAETQLRLSSHRKTTPTYITYQGNPCGVYPDLSSFTGSGVYPDLSSFTGSGVYPDLSSFTGSGVYPDLSSFTGSGVIQNFVACIKQSVPNQ

SEQ ID NO: 96131 - protein, 62 aa, Glycine max
  Coding DNA Sequence Number=SeqID_4446
MVWHHQGSGGVSSSSPSIVAAAGSGFWAVEDPPPPEGEGWAPGQATYASNSSMLIMDGKPKP

SEQ ID NO: 96132 - protein, 49 aa, Glycine max
  Coding DNA Sequence Number=SeqID_4447
MADQQATKSEAKGHPLYPRTAGQTLTYIMTSRSTSLEPKSQLIINFDPG

SEQ ID NO: 96133 - protein, 88 aa, Glycine max
  Coding DNA Sequence Number=SeqID_4448
  Gene Ontology: Mol. function=RNA-directed DNA polymerase activity; Biological process=regulation of transcription, DNA-dependent
  Homolog annotation: Hit_ID=A7QHN2; Match level="QueryCoverage=100%, HitCoverage=11%, E-value=3e-19, Identity=51%"; Hit description =Chromosome chr5 scaffold_98, whole genome shotgun sequence
MALFDTGADSNCILEGLIPTKFFEKTSEKLSTTNGSKLKINFKLSNAIIENQGLKINTNFLLVKNLKNEVILGTPFIRALFPIQISNE

SEQ ID NO: 96134 - protein, 310 aa, Glycine max
  Coding DNA Sequence Number=SeqID_4449
  Gene Ontology: Mol. function=motor activity; Cellular component=cell projection
  Homolog annotation: Hit_ID=P15305; Match level="QueryCoverage=84%, HitCoverage=91%, E-value=3e-19, Identity=22%"; Hit description =Dynein heavy chain
MLYLVFLNHCLDFRGLHVLALRGLHILTFRRLQVLSFKRLHTLAFRGLDVLTFRGVHVLDFRGLHVLALSRLHVLPLRGLHVLALKGLHVLAFRGLHILGFRGLHALAFRGLHVLAFRGLHVLAFKGLHILPYRGLHVLAFRGLHAHAFRGLHVHAFRGLHVLAIRGLHVLPFRGLHVLAFRGLRALALRGLHILAFRGLHALTFKGLHILAFRALHVLDFRGLHVFAFRGLHALSFRGLHILTFKGLHLLDFRGLHVLALRGLHILAFRGLQRATRPRLKRAARSPLKRAARPRLKRVARPRLQRTTHP

SEQ ID NO: 96135 - protein, 106 aa, Glycine max
  Coding DNA Sequence Number=SeqID_4450
RPIRKPPLPGGRPIHYSRWHDRFPEWKGGRERNAINRVRSILRHPEQNTLWFPPVWCAELLRDITITHQTGNPPFSPSSKPPSRKGTKAGTGPHFEVGGIVTRDPK

SEQ ID NO: 96136 - protein, 106 aa, Glycine max
  Coding DNA Sequence Number=SeqID_4451
  Gene Ontology: Mol. function=endopeptidase Clp activity; Biological process=proteolysis
  Homolog annotation: Hit_ID=A7ZJU9; Match level="QueryCoverage=100%, HitCoverage=100%, E-value=2e-51, Identity=91%"; Hit description=ATP -dependent Clp protease adapter protein clpS
  Pfam annotation: Domain name=ClpS; Domain location=22-103; Score =171.9; E_value=1.6e-48; Accession=PF02617.8; Description=ATP -dependent Clp protease adaptor protein C
MGKTNDWLDSNQLAEDKVRDALKPPSMYKVMLMNDDYTPMEFVIDVLQKFFSYDVERATQLMLTVHYRGKAICGIFTAEVAETKVAMVNDYARENEHPLLCTLEKA

SEQ ID NO: 96137 - protein, 52 aa, Glycine max
  Coding DNA Sequence Number=SeqID_4452
MEDVQLFKLQEQGGIQEDPDNCQFFQWVEEENQVSNPSSTTRESMIVADLNL

SEQ ID NO: 96138 - protein, 61 aa, Glycine max
  Coding DNA Sequence Number=SeqID_4453
MDIEEDVEIPLILGRPFMLTANCVVDMGKEKHSLDLNVCSKMDEVENKMVLMAKAKLAPDP

SEQ ID NO: 96139 - protein, 272 aa, Glycine max
  Coding DNA Sequence Number=SeqID_4454
  Gene Ontology: Mol. function=transporter activity; Cellular component= integral to membrane; Biological process=transport
  Homolog annotation: Hit_ID=Q57PE4; Match level="QueryCoverage=25%, HitCoverage=29%, E-value=3e-29, Identity=94%"; Hit description=ABC -type transport systems, permease components
MGWLQRHAGARVDALRCRDRIDYQYLSACSPCTPPTQQIKFSGRVTGTSRYVTLVTDFPPSLEPFPNACYRSITPAETWHNNRQPVVAITHAHRETHRNAPITQTFAAVCRRHSGGPRPPRLGYWAGDNQGAPGRPALSRPTAHDSGFLVDVFCPAGGYSGRDPAEPPGGAGDRRIRDANLQHRQYAAAAGRAGAGDGANGIGMTRWQRLRQVELPNAWPVMLSGIRIATAINVGTAPLAFLIGASSYCELIFPGIYLNDFPTLILDAAATA

SEQ ID NO: 96140 - protein, 113 aa, Glycine max
  Coding DNA Sequence Number=SeqID_4455
MDKVDIFVPHPLTNASLLIQLSPECGCKPLVYLLKRPVLLSLDFQDRSIRDYSSCTLVGGQPFPCVQESPTTRDPRSLNPFSEIRIREEEVSLKRDGLYNEDQSKFFIEYASG

SEQ ID NO: 96141 - protein, 139 aa, Glycine max
  Coding DNA Sequence Number=SeqID_4456
MEGLVDLAAIDAFLTFHHGKESPVVAILAMYDTFDRGCEKSGARIVCCAPTLGYPMRGAPLDESITPFIARGFSDHNVRVLQGVRKAWDAATGLAPKTKDLRDDEFKASKESDKVQALKAELERARVVEEKFKSIAIKV

SEQ ID NO: 96142 - protein, 190 aa, Glycine max
  Coding DNA Sequence Number=SeqID_4457
  Homolog annotation: Hit_ID=Q6WAY6; Match level="QueryCoverage=84%, HitCoverage=34%, E-value=6e-16, Identity=31%"; Hit description =Putative uncharacterized protein
VVLFPNVEGLVDLAAIDAFLAFHHGKESPVIAILADMYDTYDRRCEKSIIRIVCCTPALYVWLEGRTGILSLCKGFLNVPLMGTRGCINYNPILTKRQLGYPMRGVPSEESITPFIARGFSDSNARVLQGVRKAWDAMRTKDKELRGSSNGIIGDYRKWLRVWTQGLDWLPKLRAARNEEAEAPEESEEV

SEQ ID NO: 96143 - protein, 98 aa, Glycine max
  Coding DNA Sequence Number=SeqID_4458
MNFLTTHDKGWEHELSPYNQYEEERTLNLESVFEEFRAYHANSKANQNSMKNHEIYFEKYFVEVEAQEKSPVKEHESREKDEEQAQQQWEKYSIVENQ

SEQ ID NO: 96144 - protein, 52 aa, Glycine max
  Coding DNA Sequence Number=SeqID_4459
MLLLMKLTQLGQERKLLMIFQILKKVWIFMVKSRKAQEREMMKTFKLMKQKQ

SEQ ID NO: 96145 - protein, 138 aa, Glycine max
  Coding DNA Sequence Number=SeqID_4460
  Homolog annotation: Hit_ID=A7Q5D6; Match level="QueryCoverage=23%, HitCoverage=21%, E-value=6e-07, Identity=75%"; Hit description =Chromosome undetermined scaffold_53, whole genome shotgun sequence
MKGYKSFKAHVIDYQWFESHKVQQALGVAKPSIASYISQEILAEQEADRVHGLPRQPMVKFDNMVVISLSMKLKEEHCSIGFLRPLTNQNKKSFSYGLMELCQSLEGNVGALTNFEVLDFLRAKGASKDPTRVIAKVA

SEQ ID NO: 96146 - protein, 100 aa, Glycine max
  Coding DNA Sequence Number=SeqID_4461
  Homolog annotation: Hit_ID=O64438; Match level="QueryCoverage=45%, HitCoverage=17%, E-value=2e-07, Identity=60%"; Hit description=ARG10
MRIFTLMLSMFCFFFVPQNSVGGLRCYENPKNKIIVVHTEEKEIWGAFFKNRESVISPNSNITLMSVETASGTKGKCEVILELKKLELNIHYVTRIASCN

SEQ ID NO: 96147 - protein, 80 aa, Glycine max
  Coding DNA Sequence Number=SeqID_4462
EVQEHMKADMEAMKEQMATMMESIMSMKRVIEVNTATAIAASTATKVATHGKPPTTLTTRNVYINAAVGGSGIAATTTGC

SEQ ID NO: 96148 - protein, 144 aa, Glycine max
  Coding DNA Sequence Number=SeqID_4463
  Pfam annotation: Domain name=zf-CCHC; Domain location=113-130; Score =9.9; E_value=0.048; Accession=PF00098.14; Description=Zinc knuckle
MKIFIQSIDLGAWNVIIKGPFIPTKEMNGELIPKEWDEIRDDGKRKVQDEQKAKNILTSGLSSDDLFILQGAKVQRKSRIWLKSLMKAQRMKSKDKKFFKSSKKVDNSNNNSYTCFECGKQCHIKSECPIYLRTHDGENKREEG

SEQ ID NO: 96149 - protein, 65 aa, Glycine max
  Coding DNA Sequence Number=SeqID_4464
  Subcellular localization annotation: CTP_CleavageSite=31; ConfidenceScore=5.68e-01
MSPSPLGSHNHSNSSQALKPAPASSSGGFVRARALSAIMERLVHISEFRLRVCLSRLADELKRCA

SEQ ID NO: 96150 - protein, 154 aa, Glycine max
  Coding DNA Sequence Number=SeqID_4465
MSSFGSVNGRRIDDMSDVWWLRLKTKVLPREEPSSARVEGEVGYCSRRRGSSTGSCGRKVRRLFRGFRRKKAKKVLPLGPAEEGSANSSIGSSGRTCGTFFRRQHFLVAEEPAEPSSAGYLSFSRKNMRNFFRGPCFAIFLFFFLKILSEPPIY

SEQ ID NO: 96151 - protein, 168 aa, Glycine max
  Coding DNA Sequence Number=SeqID_4466
MPYGEHRGVKAFDLISSYTGQLRWGQIVVHVQPEPFGAFRGVLCSSWTGSARLHGVVFRISYPFITRTEETAASRHPPPPHHEEFVEPPILEVSVATDLPTHLVVHCEGCQGMAQDLGAIVEDLERVINLMMVTEGTDLHDIMTRCLRRARGDAADGSLRPCQRRHID

SEQ ID NO: 96152 - protein, 135 aa, Glycine max
  Coding DNA Sequence Number=SeqID_4467
MRKRGNGLLRILLDDMVGTECLCCAIFVGAGCACALLWCDICQLSLAEDVFREIQRKKVSSVVEITPAEECFFRGVSRKTSSVRLHGRSILLLLTLQLRKTASSVETHGRHFPRALMEDVFRSCDINSGRKLLSW

SEQ ID NO: 96153 - protein, 112 aa, Glycine max
  Coding DNA Sequence Number=SeqID_4468
MVTGRGVGRGDRDDSDDAPQRRWSTASARKLRVTVTATHDEPVVPAPDVEPDVFPDDPMAPTDSENIVTDIPADTGTEAVEDEHEGFPGGPSDPSVLTQYADHVACSIWTGE

SEQ ID NO: 96154 - protein, 247 aa, Glycine max
  Coding DNA Sequence Number=SeqID_4469
  Pfam annotation: Domain name=DUF1723; Domain location=161-209; Score =9.7; E_value=0.037; Accession=PF08330.1; Description=Protein of unknown function (DUF1723)
MKNRRAEPRGRMEEAHSKEGEAVARSGEAQPPRAEEAKGLAEERRRRGSRKRKKKEAEEAPGVIGKASVREISGDANEGPQRQRPTASARRQRETAFVAEDVEHLDHAADKATADDVVTDAEGFLGGPYDILVLMDYVHHMAMIVWNGELSSYGRKVEKFGRPAPAIEGLVRWHKETSSFHILVRDVTISLDDVTSLLHLPIIGTFHSFKALHMDEIVFRLVEFLEVSSEELRAETLQCHGAYVQQS

SEQ ID NO: 96155 - protein, 109 aa, Glycine max
  Coding DNA Sequence Number=SeqID_4470
  Gene Ontology: Mol. function=monophenol monooxygenase activity; Cellular component=chloroplast; Biological process=metabolic process
  Homolog annotation: Hit_ID=A7R149; Match level="QueryCoverage=64%, HitCoverage=12%, E-value=5e-14, Identity=52%"; Hit description =Chromosome undetermined scaffold_337, whole genome shotgun sequence
MSTTNSITDFIHSKHGSDKYVKYDVHIDDDEDNLSEPDQTEFVGTFVNLFHGQGHNIKVTSFKVGISKVIDCLEAEEDDVVLVTLVPKVGKGDVIIGGIKVEFIPKYKD

SEQ ID NO: 96156 - protein, 49 aa, Glycine max
  Coding DNA Sequence Number=SeqID_4471
MVRAEEETREKVGEKEREIEEMRQRIEDVEKVRVVEMKEKGESGWNICE

SEQ ID NO: 96157 - protein, 171 aa, Glycine max
  Coding DNA Sequence Number=SeqID_4472
MWTSLRSGASAHVGSVHAALVGDCERHRDPAVAPLHLRGAYAYSYKADRGDFGSGGGGGEFAVWMIPQLFAYAVNYPAAEQDHGDGVDRGGGTGAAHFVQLVAHSGVLVGSRQRRRGAERVVVVHRHWTAAHFFFNLIEDDTSSPSELEDERAKSVSSLSRAHYDGNEESG

SEQ ID NO: 96158 - protein, 447 aa, Glycine max
  Coding DNA Sequence Number=SeqID_4473
  Homolog annotation: Hit_ID=Q6WAY4; Match level="QueryCoverage=44%, HitCoverage=40%, E-value=2e-14, Identity=27%"; Hit description =Putative uncharacterized protein
MEEKKEGEKERGGSTKLKEEKGREVELCVVSHKTLIHQSSYLAHGLEIYPKTHENPRAFPWISSPINLESSTQCPYGVGLHHFVDFQLVLMLEEFEKIVGCPLGGTKSFFPLGHSTSMPRLSKVLGISVTELREKEMNGNGVKSFPKKFMEDKARECASKGEWGTVVAILADVYCTLDLSWEKKNTRVICCLPTLYVWMVSHFVMHNGRPTFPLEDFCVAPDKSKINWEELLASMSSSTICRFPRWEEMPNVLYRCGAFPNVPLMGTKGCVNYNPMQGIRRDKELRKRDEGVVGSYPQWLENRVREVKPPKKTNGERVEINVPIEMGEESLKEKLGMMEKNMLVIVDQYEGEREANEEVIELLHQESMKWMNRFVLTLNESQELLKLLARAKMMDDMYSTPDEVHSLFDYCQHMRASVKRNTPGLSARKNLEEDELYRFAKRTASSL

SEQ ID NO: 96159 - protein, 160 aa, Glycine max
  Coding DNA Sequence Number=SeqID_4474
  Subcellular localization annotation: CTP_CleavageSite=9; ConfidenceScore=5.20e-01
MAHGLNAVTAPNVAYGRNTNDVRLDAKNFLPKRHYNWGRKKLVSRSPRKTSSVRFHGRSCLPQLIFRETPRKKLSFAVDITSAEDNFFRGVEMDEDQWAYYSAMSEEVDMDFQNEEEDCGVNRAHVNCSHAFNTSQVFETREDVLKLDLARLPMEMVLLQ

SEQ ID NO: 96160 - protein, 62 aa, Glycine max
  Coding DNA Sequence Number=SeqID_4475
MKKQQWKRSRRQRRRGERRHHPLGNKPWKKELHHQDEPWIRSLERMLQWRKRKRERKGEGGA

SEQ ID NO: 96161 - protein, 335 aa, Glycine max
  Coding DNA Sequence Number=SeqID_4476
  Subcellular localization annotation: CTP_CleavageSite=25; ConfidenceScore=5.34e-01
MAPTTVATPTPLPPPAVVVQEATPVATEVVVPTTYVGFVVAPLLNVDVATTSAPTVLPPSLLTLMVSPSVVLAAVVSPSSSSHLHVFLDHFVDVATTSAPTVLPPSLSTLMVSPSAVLAVVASPSLSSRLHIFLDHLYTSMMLTHCGVQLTSRSRRPEMLLTQPKSFSKGVWQFLGEWIVTPRGCVEAGVLRGRKVKPPIDFQSREEELGRQGGELGGWKDELAKVVEELEALLEELESSFIAKDLDLGLFDPFKDMKDGVLLDEEDIVAEDEAIDEGALVRRLQVDWARDPREGPKVLMSLREVSLAIRELLKEVFSKKLIKEVFSRKLLKEAT

SEQ ID NO: 96162 - protein, 62 aa, Glycine max
  Coding DNA Sequence Number=SeqID_4477
MASYGALTMTISPIRVGNFIFKWGVETTAPSSLSVFYPIKAKYDVSTSTNRYLMVKLLERLP

SEQ ID NO: 96163 - protein, 37 aa, Glycine max
  Coding DNA Sequence Number=SeqID_4478
MTDVEDVSSSAKPLVNEVEASLFDMLGLLLVDSKLVV

SEQ ID NO: 96164 - protein, 90 aa, Glycine max
  Coding DNA Sequence Number=SeqID_4479
  Homolog annotation: Hit_ID=Q84SQ2; Match level="QueryCoverage=58%, HitCoverage=10%, E-value=2e-07, Identity=54%"; Hit description =Putative uncharacterized protein OSJNBb0047D08.10
MADEQHQRITLEDYSSSSVPQFFTSIAPPEGNLFQRLPNKDPYAHLATFIEICNTVKIVGVPDEAIRLSLFSFSLAGEARGGFTCLRVTV

SEQ ID NO: 96165 - protein, 105 aa, Glycine max
  Coding DNA Sequence Number=SeqID_4480
MRSFNGDFPPWRCSGRQRRRGERRRHPLGNKPWKKELHHQDEPWIRSLEGGFKGGKERGRERERGEHEIEGIKEGEKWNFEVASLRSFLEKTSLRSFFEKTSLRS

SEQ ID NO: 96166 - protein, 133 aa, Glycine max
  Coding DNA Sequence Number=SeqID_4481
MESGTTVVSSSDAIVSFGLGSLSPFSLQKAISFGVRWTNGGFGFWFKLVGWLDGDEKLLGRANTSRRISGAKLKMKQLNINGGGRTITRLANRSNSIRYSLTVPCCDNLKRAPFGSSQNDGANLDSRACRKSD

SEQ ID NO: 96167 - protein, 62 aa, Glycine max
  Coding DNA Sequence Number=SeqID_4482
MINSALKGFNNNHGSKSKATAKWIPVKYFTDPRPFEPERIKAIRIQWTRCLLRVKNDALSSV

SEQ ID NO: 96168 - protein, 180 aa, Glycine max
  Coding DNA Sequence Number=SeqID_4483
  Gene Ontology: Mol. function=nucleoside-triphosphatase activity; Cellular component=intrinsic to membrane; Biological process=innate immune response
  Homolog annotation: Hit_ID=A2Q3Z6; Match level="QueryCoverage=86%, HitCoverage=88%, E-value=5e-43, Identity=56%"; Hit description=TIR
  Pfam annotation: Domain name=TIR; Domain location=17-149; Score =169.4; E_value=9.7e-48; Accession=PF01582.11; Description=TIR domain
MASTCSSSFSVTKKYDVFISFRGEDTRADFTSHLHAALRRNNIDTYIDYRIHKGDEIWVEIMKAIKESTLFLVIFSENYASSSWCLNELIQLMEYKKHEDVDVIPVFYKIDPSEVRKQSGSYHMAFAKHEKDRKVTEDKMQKWKNALYEAANLSGFLSDAYRQSDVVKRKGKGNEDSTSR

SEQ ID NO: 96169 - protein, 143 aa, Glycine max
  Coding DNA Sequence Number=SeqID_4484
MHKALRLNAPLPYPHLVTRFLQHFNIPLDFEPYVPIKRSFLIGAAVIASFGYRKERDDSWVKKGAQINDDEGHLPVGEDSSLLQSILDRFDGLQTYVGERFDALEQQVDMRFDKMDSRITKVEGDVTYIRTCFDLPPPPPSSS

SEQ ID NO: 96170 - protein, 148 aa, Glycine max
  Coding DNA Sequence Number=SeqID_4485
MSWLSAPLLSRENRVRWHAEKTHEANKSDGIRDDDGRPFLIWRFFPPLLSSRDNQVRCRIKALFCYPKDNQVRWYAETNIVVCFPGRETQCVLTKATGVSLAIPRQASLIACRGRHGYPFLFIAFKAPRLLLMHLMSFMLFLLIGFVD

SEQ ID NO: 96171 - protein, 72 aa, Glycine max
  Coding DNA Sequence Number=SeqID_4486
PRGEGDILTTCVFAVFHLVLLFVVKEVPDYGKLNPLLDLPWSFNSGNWSDSKVLGSTGLICCAITRDRGTRT

SEQ ID NO: 96172 - protein, 85 aa, Glycine max
  Coding DNA Sequence Number=SeqID_4487
MTIEESIHVAFDETNITSLRKEFLDDIADSLEDMHNQERNLKRKRDEENKDVQDDIAQENDDLPKEWKTSRNHPLDNIIRDISKR

SEQ ID NO: 96173 - protein, 80 aa, Glycine max
  Coding DNA Sequence Number=SeqID_4488
MTIKFWISHGLYEWLGEEGITKSNILQWRGFMRLKNTDANNGDNGVLIGAKSKGVEVRRCRSKGQSNGVIVGAKNEGGKV

SEQ ID NO: 96174 - protein, 77 aa, Glycine max
  Coding DNA Sequence Number=SeqID_4489
  Homolog annotation: Hit_ID=A5C549; Match level="QueryCoverage=96%, HitCoverage=17%, E-value=3e-09, Identity=37%"; Hit description =Putative uncharacterized protein
MHQCFLKPYHPYQQLKKAFNGSQEHENVPIIEKACDSVIGMLFNIQGKMKDGLNTRQDLVEMGIQDQLHPSSGGKKI

SEQ ID NO: 96175 - protein, 53 aa, Glycine max
  Coding DNA Sequence Number=SeqID_4490
MVTIIISISTMLKAQVEEDEGPSGEGQSPQVEKDEGPEAETLSRLLIVAEGPN

SEQ ID NO: 96176 - protein, 134 aa, Glycine max
  Coding DNA Sequence Number=SeqID_4491
  Gene Ontology: Mol. function=transferase activity; Cellular component= membrane; Biological process=metabolic process
  Homolog annotation: Hit_ID=A7P576; Match level="QueryCoverage=100%, HitCoverage=19%, E-value=5e-44, Identity=65%"; Hit description =Chromosome chr4 scaffold_6, whole genome shotgun sequence
MNKLLLQSHASYCSMRPSWFSAVDQELLQARSEIEKAPIVKKDPNFYAHIYHNVSMFKRSYELKEKTLKVYVYSEGARPIMHSPFFTGLYASEGCFMKQMEANKRFVTRDPNKATLFYLPFSSQMLEETLYVQN

SEQ ID NO: 96177 - protein, 244 aa, Glycine max
  Coding DNA Sequence Number=SeqID_4492
  Gene Ontology: Mol. function=transcription factor activity; Cellular component=nucleus; Biological process=regulation of transcription, DNA-dependent
  Homolog annotation: Hit_ID=A9PL75; Match level="QueryCoverage=85%, HitCoverage=81%, E-value=1e-55, Identity=56%"; Hit description=TINY -like protein
  Pfam annotation: Domain name=AP2; Domain location=48-99; Score=79.8; E_value=9e-21; Accession=PF00847.11; Description=AP2 domain
  Subcellular localization annotation: CTP_CleavageSite=2; ConfidenceScore=5.61e-01
MRVSTQNNSETESSSTSFLPPSPSPSPSSPPSSEFKTEKRNRESNKHPVYRGVRMRNWGKWVSEIREPRKKSRIWLGTFPTPEMAARAHDVAALSIKGNSAILNFPELAASLPRPVSLAPRDVQAAAAKAAHMDLPSTSSSISSSLVPTTQSASSSSSSLSSLTSADLLPTASEELSEIIKLPRLETTSYELGNEFVFMDSQDAWMYQPPIPWLHTTYDGSDADEFVVPESGVVTSFESFLWDY

SEQ ID NO: 96178 - protein, 577 aa, Glycine max
  Coding DNA Sequence Number=SeqID_4493
  Homolog annotation: Hit_ID=A5B5G7; Match level="QueryCoverage=13%, HitCoverage=5%, E-value=1e-07, Identity=39%"; Hit description =Putative uncharacterized protein
MRKIVKKEGVKKTKSELAREKKKEAVPYTGKEVPYPLMPLYSKFLKDLLTKKSKYIHSDNIVVEGNCSAVIQRILPSMHKDPRSVTIPCSIGSGNFMLTSNCMVDMGKKKLEMGIANQKISFDLFDEDKHLLSQNVCSEPSTKQIFVHALSESLLALSASIPTHWLKGPLRASPWVSPLSPNPSQVWSCAKHESLANLRGFLSSVGAKRVSLAKPPSLCRLNKPGLSKLSKPARLAIVLCQLSEWPPGRGSPVYPGPRSLMTPPDSSLRLPSRGIPKMFTPDTSFWRGTHMDGHIDVALGELIKFDAASLNAFLETPLVIQPGEQYTSYSLFCRTGTDPQEHTSKLCIPRREFVLNAEGVPWKLLRKDLTTLAQTWSVLSYSNLAPTSHTSDLNMYRSNSSRLDFPALITALRVARGVISDSLTFESLSPAINLAYIKKNCWNLEDPTIVFPGTRKARAQGSEGPSSSAPPAPTSTPPAPSLAPSPSALPSSVPTPTDTSAPSSDVTVPMLRSLHHGLCLPGVQPSPLGGGEASTAQEPQPEPQSEVSEDEEGTEDTDYTANLQEAQSTWDPWPTAA

SEQ ID NO: 96179 - protein, 68 aa, Glycine max
  Coding DNA Sequence Number=SeqID_4494
MAEDQPRRVTLEDYSSSAMPQFFTSIVRPEVQAHNITYPHSMIQLIQDKTRVHTCQLTLKFAIKSSLQ

SEQ ID NO: 96180 - protein, 22 aa, Glycine max
  Coding DNA Sequence Number=SeqID_4495
MNLSHARGVRDYLYALTGNDML

SEQ ID NO: 96181 - protein, 146 aa, Glycine max
  Coding DNA Sequence Number=SeqID_4496
  Pfam annotation: Domain name=zf-CCHC; Domain location=74-91; Score =33.4; E_value=8.2e-07; Accession=PF00098.14; Description=Zinc knuckle
MELQRLNQNKETDKRKRSIALKVSSSMQEEEESDDEEDFSLFVNKFHKFVKNRRMERSHNFNNGKRSQEVSPTLKCYKCNQPGHIKANCPTNESWPKKNEKKSYKERRSKKAHIAWDDNDSSDGLEKEINLLSKDYESDENITQED

SEQ ID NO: 96182 - protein, 57 aa, Glycine max
  Coding DNA Sequence Number=SeqID_4497
DCHHQKGGDCGSNEFQDYFDDAKESRVNQVSKNQDSRIIKVKIQDSRFKNQEKTQSR

SEQ ID NO: 96183 - protein, 27 aa, Glycine max
  Coding DNA Sequence Number=SeqID_4498
PYEFGKQTLELYLMLLYATRKGIITLQ

SEQ ID NO: 96184 - protein, 202 aa, Glycine max
  Coding DNA Sequence Number=SeqID_4499
  Homolog annotation: Hit_ID=Q2HTA0; Match level="QueryCoverage=71%, HitCoverage=23%, E-value=1e-16, Identity=37%"; Hit description=IMP dehydrogenase/GMP reductase, related
  Pfam annotation: Domain name=DUF1723; Domain location=114-163; Score =52.8; E_value=1.2e-12; Accession=PF08330.1; Description=Protein of unknown function (DUF1723)
MVHDEPVVPAPDVEPDVFSDDPMAPADYEDIVADNPADTGAKATEDEHEGFPGGPSDPSMLTQYADHVACSERPELKLSSHGRKAHSLGRPVPAIEGLVAGIGLSPLIACSVDTGDRGLLSSFVERWHWETSSFHLPVGELTITLDDVSSLLHLPMVGDLHAFEPLHVDDAVEMLMDLLMVFTESARAETAQCRGPYVHLQW

SEQ ID NO: 96185 - protein, 236 aa, Glycine max
  Coding DNA Sequence Number=SeqID_4500
MIFQSHLLQNAAQTLTPPSPSPTTTGGHHEPPLLAAKPPHQEEHLNQSRILIILLKDSVEKIPPILPFKAFLSISRGGWLRAFNYPRSMHLMEYLYLGACYLVWNSLETQADHHGRGVAYARQGDLDTYFLVFLSESVVWTRLGYFLGDGTTLHLRVEMQSQGLILPPKQKVAPIATHVSTKGSCIDPSRKDPDKGESNKCGLYVDDNHPYLVALGSVYEELTIVNKVSLSNDQVK

SEQ ID NO: 96186 - protein, 77 aa, Glycine max
  Coding DNA Sequence Number=SeqID_4501
MSNHKSTESAIKNLEVQSAVEPTLEPVSNLVELEEVVEDEDDQQERETPIKDSQEGIKMTEEQEKEKQKEAIAKQGR

SEQ ID NO: 96187 - protein, 184 aa, Glycine max
  Coding DNA Sequence Number=SeqID_4502
  Homolog annotation: Hit_ID=A2Q169; Match level="QueryCoverage=44%, HitCoverage=19%, E-value=2e-08, Identity=33%"; Hit description=Zinc finger, CCHC-type
MMINNTFLANRFPFINIHKKLYDLGHGLKSNIYAKETTSKSRTIFQKGGHRPLSCALLGFSIGNISAYHPNKCFLFLGVSKVSVLPRPGEGSEPASWLIGRVMMNRGVNLIVFKSTILQAWNVKNRVEVRDVARNLFFFRFFDRRDMERVMEAGSWNFDRRLIVLKEMKGDENPKTVSTTNCNF

SEQ ID NO: 96188 - protein, 17 aa, Glycine max
  Coding DNA Sequence Number=SeqID_4503
MAESTEWGLKSVEAKEQ

SEQ ID NO: 96189 - protein, 209 aa, Glycine max
  Coding DNA Sequence Number=SeqID_4504
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=A7PMM1; Match level="QueryCoverage=33%, HitCoverage=7%, E-value=4e-17, Identity=61%"; Hit description =Chromosome chr14 scaffold_21, whole genome shotgun sequence
  Pfam annotation: Domain name=Cation_ATPase_N; Domain location=18-93; Score=79.0; E_value=1.6e-20; Accession=PF00690.17; Description =Cation transporterATPase, N-terminus
MGLMSISRFCFYDPGVGSFKSCSENVPLEEVFQRCDSNGLTTESVEERLVIFGHNKLEEKKESKVLKFLGFMWNPLSWVMEAATIMVIALADGELLLLFREPASSSLLREPASSPRGTPKVVLFFSANRVEDERGEDESTPEKMGKMADDGVFRKTLTKRLPEEYFFRKTPGTPLPKTFWKKWFFRKNSGRRAFPDDLSNFRKNHFFRK

SEQ ID NO: 96190 - protein, 182 aa, Glycine max
  Coding DNA Sequence Number=SeqID_4505
  Gene Ontology: Mol. function=nucleic acid binding
  Homolog annotation: Hit_ID=Q1SKZ9; Match level="QueryCoverage=68%, HitCoverage=24%, E-value=3e-25, Identity=42%"; Hit description=Zinc finger, CCHC-type
MQHASGTSHRDEERGKMHASTNEARAKCTCQQMKQGKNDQKTNKCATCGNVSGGGYANEPPDGDEEYTPQPRLNFKQLFVKEVVTDRPKVDLIKENLERIEYEEGNKLKPKVILADSILEGLCAPWKEFFVVKLLGKNIGFTTMHDRLARAWKMPGGFEVLGLGNGYFMVKFDKDEDRKKSH

SEQ ID NO: 96191 - protein, 74 aa, Glycine max
  Coding DNA Sequence Number=SeqID_4506
  Subcellular localization annotation: CTP_CleavageSite=11; ConfidenceScore=5.04e-01
MRFLRTLGPCLAALTQSSWSLLPNTLGGSPFRSILMQSYPSRALDRKLQEDWARDAREDPRVLMSHKVDFGPMG

SEQ ID NO: 96192 - protein, 67 aa, Glycine max
  Coding DNA Sequence Number=SeqID_4507
MEGAKPMETPMHASNPLSKDKSGITNQSLFYKKNQEFRCIDRRGSMFKKDKNLLPSLKRLCRPFNHD

SEQ ID NO: 96193 - protein, 70 aa, Glycine max
  Coding DNA Sequence Number=SeqID_4508
MVLRQAMIAHGGHRWSVVVKEEVGSVGLVQEKFYSPGQADPAQISLGDFCSNKFYYFTENIISHTPNVIL

SEQ ID NO: 96194 - protein, 146 aa, Glycine max
  Coding DNA Sequence Number=SeqID_4509
  Homolog annotation: Hit_ID=A5AKY6; Match level="QueryCoverage=54%, HitCoverage=7%, E-value=2e-25, Identity=69%"; Hit description =Putative uncharacterized protein
MTVRVCGLSSFVPHRLVCKNLCLISVIYRDTLAFGYSTGFPYFKGISGSLLSLEEAVGAMALEDGKVKIEKFDGRDFSFWKMQIGDYLYQKKLYQPLSGVKPDDIKQEEWNLLDRQALGVIRLTLAKNVAFNIVNRKTTAGLMKAL

SEQ ID NO: 96195 - protein, 43 aa, Glycine max
  Coding DNA Sequence Number=SeqID_4510
MGQSAPPFVCEFLEKGCISESIIDTAIALKNKEFLPPLPEPIL

SEQ ID NO: 96196 - protein, 76 aa, Glycine max
  Coding DNA Sequence Number=SeqID_4511
MEELINKIQLSPKIMPTSSRRLGGFSPESYSLHPATVILLPRTMVVIITGNSLSMSTRHSHLGNHAEFVETTRLCT

SEQ ID NO: 96197 - protein, 111 aa, Glycine max
  Coding DNA Sequence Number=SeqID_4512
MVGYMPSSFVDLVFAGERIEVGLRRGKFDHPALMNRKPGANVENKKEGENCCDCRSYMTKFSTSSTISILSQYQSFSLPTTLSAKNTQSSTKATPKSTTKPACCTSEARHH

SEQ ID NO: 96198 - protein, 26 aa, Glycine max
  Coding DNA Sequence Number=SeqID_4513
MVVHYSLEIQCLDEFLSASQKARVTG

SEQ ID NO: 96199 - protein, 87 aa, Glycine max
  Coding DNA Sequence Number=SeqID_4514
MESIAAHLLWKQHFHRSRKIPELILSLVQAGFLDVAKLGQVKIHDALVTALVERIDWWGVNAKRSGNRVHLMYLPLLADPAQVRWYN

SEQ ID NO: 96200 - protein, 289 aa, Glycine max
  Coding DNA Sequence Number=SeqID_4515
MGAKYLEAVKQRLHAINGWSPDEIRGNLGVAGSGVKGVVEPEGLMVVLLHENCNGGPSIYLPRIWPTPLLGEEIKATKPAPRSPFEFRKVFVHSATLLELEQGTLWVIVEGGWSLHVEGGHCEPLVVKNSLVIENWGGGVDMVDDLGEKGIVVTIVRCSSMESILEEREDYVWVKLACVWASEIEKLKISEFSESSVLLGVNLDFVFGLFASDDKVFHGMGEREEEEEGLLVVEAMLFHLVIFLCLLLRQIGIRIGIGESSNDERRGLESGFGMTTTVTIVMTMAGMRG

SEQ ID NO: 96201 - protein, 160 aa, Glycine max
  Coding DNA Sequence Number=SeqID_4516
MPPTRHPLDPDKSNRALGFPALITGLYQSFGVPVTPSKVIRPPITQAFIEKYCTPRQAQGDAPQAADAQPPPHQADPAGSLGMERYLQHLDRHLSQQGQGFAPFACPTPEQFGAEVTWPGDWPEAQAEEAPAGAPDDAEEARMDEEMTDLLGFLGGSGAT

SEQ ID NO: 96202 - protein, 252 aa, Glycine max
  Coding DNA Sequence Number=SeqID_4517
MGAAETSGNRDEFVIHEARVPILGDVIDADDGGIGVAVKLKHVLDEINDDDTSAVAHVTKIEAFDVVTELVLVDHHGREGRGRVEEARVDDEDSDVFKLVVGVGEEVVKGAKHDLLGLFPSGGLEGASRDGVHGLGDVGVFTKAEAEENLALEVKGGGEEVADEGGVVHELAKEDAKVLRGKGGVEDRDGGKSNGIVLEVGPEVLDVVAFHLGGLEENYGHEREKAICVTSSIVTLASCSFINGNGQKLTDG

SEQ ID NO: 96203 - protein, 174 aa, Glycine max
  Coding DNA Sequence Number=SeqID_4518
  Pfam annotation: Domain name=Transposase_23; Domain location=77-139; Score=-16.6; E_value=0.078; Accession=PF03017.5; Description =TNP1ENSPM transposase
MTLSVKSTILAKKSGNNFVKFVEIFHDRIPLKSSQHRKALSPMDGLLLPPKPEVSPSSAHFSIKGSSVKLSGQNPDTGESDKCGLYVDNNSPRLVALGRVYVGSTTIHNIPLGNDQVKVDVDVVPYANARVPIPTQVDKHKAEGPMKPVERLEPNDDPLYQMALTIPELFLKPM

SEQ ID NO: 96204 - protein, 133 aa, Glycine max
  Coding DNA Sequence Number=SeqID_4519
MVDSSYKVNMTSQPSDQQVQQLKKIQAELWEKANLHESIMRQKSRTKWIKEGDRNSLVFFERGQCGFCGVRATTMWVFRQCRGFCGFQQGQCGFFGSVGGSVGSSEDNVDVEGAVSERFQAGGETEERFQAGG

SEQ ID NO: 96205 - protein, 30 aa, Glycine max
  Coding DNA Sequence Number=SeqID_4520
MAARVNAVTNFLVAGNVDAQYWRSCSPAGD

SEQ ID NO: 96206 - protein, 311 aa, Glycine max
  Coding DNA Sequence Number=SeqID_4521
  Pfam annotation: Domain name=Transposase_23; Domain location=65-135; Score=14.0; E_value=3.5e-05; Accession=PF03017.5; Description =TNP1ENSPM transposase
  Subcellular localization annotation: CTP_CleavageSite=27; ConfidenceScore=5.15e-01
VDSRGSPCPEHPGAGVTIKQYFGSTPRTSRSSSSLPPKELQQLTQQIRDQLEESITERGTRDPETGDSDKCGLYIEADPARLVAMGRVYEGSTVVHNTPLLPGQVKVSVEEVTDADAPVPLPTDEVSLVGQALHTFLDWPTHLVKFLSQQLAVSPAKPPPKPDPEVDDPLYLMTLTIPEHFLRPYQVRWDATVFRVLNPDFPLYIKHEDLSKIAHSGQCLSISVLQLWILHLTETCMRARNSDIYGFLEPQFIQSALKGLDDAPQPKSKAPTRWIVVKMSTIILGTFRNNWEAYFNDPRSLEPERLKALQI

SEQ ID NO: 96207 - protein, 177 aa, Glycine max
  Coding DNA Sequence Number=SeqID_4522
MTLLLSNVLPSDHNSDLPCPKCQLVYAILTRMSVHVAQVIVDAIYLFAGMAPTRHSLDLDKSNRALGFPALITGLCQSFGVPVTPSKVIRPPITRAFIEKYCTPRQTHGDAHQAADAPPPPRQADPARSLGMERYLHHLPEAQAGEEPAGSLDEAEEARMDEDMTDLLGFLGGSGAT

SEQ ID NO: 96208 - protein, 223 aa, Glycine max
  Coding DNA Sequence Number=SeqID_4523
  Gene Ontology: Mol. function=catalytic activity; Cellular component =endoplasmic reticulum membrane; Biological process=metabolic process
  Homolog annotation: Hit_ID=Q2PEY2; Match level="QueryCoverage=97%, HitCoverage=32%, E-value=4e-94, Identity=74%"; Hit description =Putative long chain acyl-CoA synthetase 9
MAAVPAILDRVRDGVFKKRSLFKQSLMRQDLGLKKLVNAVNGSWFGAWGFEKALWDFLVFRKVRAILGGRIRFILSGSAPLSGDTPKFINICLGAPIGQGYGLTETCAGGTFSDVDDTSVGRVGPPLPCSFIKLIDWPEGGYLTNDSPMSRGEIVIGGPNVTRGGEKVDERGMRWFYTGDIGRVHPDGCLEIIDSKKDIVKLQHGEYVSLGKLWILLLFFFRI

SEQ ID NO: 96209 - protein, 195 aa, Glycine max
  Coding DNA Sequence Number=SeqID_4524
  Gene Ontology: Mol. function=RNA-directed DNA polymerase activity; Biological process=RNA-dependent DNA replication
  Homolog annotation: Hit_ID=O64612; Match level="QueryCoverage=76%, HitCoverage=9%, E-value=1e-10, Identity=31%"; Hit description =Putative reverse transcriptase
MSFIMWLAKRNWLLTLDKVAFLNKGSLCPLCSNESESNAHLIFSCRKSLQVWAHIRDLGLFCRRFTSLQRITDSLIRGRSASGVQGKLRCLAIAITVYCIWLSRNKLIFEDYQFSIIEISLPLFMEELTKDHRHEKQGKTSPLTTINDHKRQQDTSNPARKTTIGVGICHTRNDYHEDPRKRESHNHGGPLAPSA

SEQ ID NO: 96210 - protein, 116 aa, Glycine max
  Coding DNA Sequence Number=SeqID_4525
MFGKLDSIWVQQVLYHYWEMVGADARKLSTWQPVIEKVRKKLTPWRRRHLSFGGRICLWRWDLLWRRPWFTWEQSLVQKLMGVIGEFGPYKNGRDGWMSSNNAEKKCGQTCLWRVD

SEQ ID NO: 96211 - protein, 346 aa, Glycine max
  Coding DNA Sequence Number=SeqID_4526
MSFSEEGSACSDDGRMLSPEVRPIGESSNDDHTHPHGGSDVASNQVSDICIGDVVSGIVIPLDVGPAIPIGGVATRKGPHPYFGVRLTLMEDEAESPRPNPPQNVIDLDLETTIIQVLLRQPFVPPFPLLRKNISAKGFPPIVFLGYSWVHEEVGFFASSFLTYKSIVEFLELVVLMFPFYWILSPTKFIKKAVVYMSDTNQEDMVILHKLPRGLHCKTLAHAEKAEKVPTEKDKWKQKENPQDDWVPPPLPVTIGIIIWEGHGPSGGGPLKKKRLESILMVVPFAIESHLAFLLMKEGVSYPWGKNYNPKARIQASMLSQSNQDMLREVGHRVPMDSIARFTARS

SEQ ID NO: 96212 - protein, 130 aa, Glycine max
  Coding DNA Sequence Number=SeqID_4527
MEESLIQVSKTDESFIVEKVREEVACLTKDFGWFFESSNTLTMLLKFHLHSHDKSGLGLEKGASSSKSQSDLDKCDFCAKSGHPKFKCIHKKKKMSKVLMLLDPKGFGVKWWMDRNIEMTITEATGLQMR

SEQ ID NO: 96213 - protein, 148 aa, Glycine max
  Coding DNA Sequence Number=SeqID_4528
METLNTLKDSSVHLEANSGQITNKDKPSKETNSSRGYVIKTLPLWWESMSWVNLTTTMPQNPRDHFLQHGNELAKGVKSKRWKCWWIALTWTIWQHRNKVVLQNATFHGIKLLDDALLLLWSWIKAMDKDFTLHFNQWSSNLKEGFCN

SEQ ID NO: 96214 - protein, 164 aa, Glycine max
  Coding DNA Sequence Number=SeqID_4529
MTILFAFLLHMKDQWALEEDLLVNRYDEFPMVNKDSNSSGLADRDCTSFSQGEKESVATWKMGQENKSPVRKEGISNSVFKVYSRRTCQIAKSMARLNLGPVLNEIGSEKEARVMEDQHWEIARQLGLASDEFFKNRGKESLDEDNISHLNAVTAEMGNKTIDP

SEQ ID NO: 96215 - protein, 313 aa, Glycine max
  Coding DNA Sequence Number=SeqID_4530
  Homolog annotation: Hit_ID=A5BAF4; Match level="QueryCoverage=84%, HitCoverage=58%, E-value=1e-09, Identity=22%"; Hit description =Putative uncharacterized protein
MIVLLIVSTLIMKPRKSKIKHSWYGCSQLFLNQCCFWDKIHEHFSLHTKTRARQLHTAMRAVTLDDKIIKEYLQKIKGFVDELAGVGVPVHHEEYVDALLERLSSDYASVVSVIESKKQPIPHSTGSVRTSNTWVNPNSTISGPSHSQLSAMITSSTSQGNGQAGTTWIPNSRASFHVTGDSQNIKQFTHFDAPDQIFIGNSEGPQIIYIYIIIKMNTAAPEETNKILLKGVVGADGFYSFHNLKLQESPSLLMSTASSVASPSSALTINNNGSTVMSDFVSSSLSIANLWHARLGHPNDHVMKLVLSHCNIS

SEQ ID NO: 96216 - protein, 92 aa, Glycine max
  Coding DNA Sequence Number=SeqID_4531
MKRGCVIKMSNSKILVVQETEYPHKVFQRGAERKRAYDVVGRRAQFSTCEGNARGRKHRTRRKHDHRDTSQGGNIAATGAGSCSAARATASL

SEQ ID NO: 96217 - protein, 224 aa, Glycine max
  Coding DNA Sequence Number=SeqID_4532
MDDAKTLAQKRERLAQKVRGRVRIGRALQKGVSQYWDGIDEKSLISGVSHGTSIMFLKDACVPNYTALEDKATIDGDACQGNWGGYYGHGSPCVIHYSSRESRNGVDTREYGAMRGSGDVQFWMSKNCRYSVMHGGMRHDYNNKQIAWVPPMTGKFKLGWAVMVSGIAACKGTVWDHYGEVIRSYSFKLGRCSIIPSDFCFWCHVYKKANQMVNALVKFGLSMM

SEQ ID NO: 96218 - protein, 371 aa, Glycine max
  Coding DNA Sequence Number=SeqID_4533
  Gene Ontology: Mol. function=protein binding; Cellular component=Cul3- RING ubiquitin ligase complex; Biological process=embryonic development ending in birth or egg hatching
  Homolog annotation: Hit_ID=A7NVE2; Match level="QueryCoverage=84%, HitCoverage=96%, E-value=1e-141, Identity=76%"; Hit description =Chromosome chr18 scaffold_1, whole genome shotgun sequence
  Pfam annotation: Domain name=BTB; Domain location=151-259; Score =70.8; E_value=4.6e-18; Accession=PF00651.22; Description=BTBPOZ domain
MSDSKVETIARLAQWKIDNFGPCSYKKSDPFKLGIWNWFMSIERNRYLYIHIFPEPSRLTKEQPPVARFILRVSNNSGPTRKFYISPVHERVLRTCEDFVWPVDTAFLGRFVIDIEFLDLRTCPVNGETRSVWPSDGKLQTVAAQSTLRCLSRMLDEAIHADLTIITADGTLRAHKAVLSASSTVFHSLYLHNGDEKETSTIHIEDMSQESCMALLSYLYGTIKQQDFWKHRLALLGAANKYEIGDLKDASEESLLEDLNSGNVLDRLNDARLYQLHKLKKGCFSYLFDFGKIYDVRDEIDTFFRHADRELMLEMEKKESHQDSTNGGFNPFSFSLKFGNPIRATREKIEKSQELARDGAIVVGRHVNPLR

SEQ ID NO: 96219 - protein, 193 aa, Glycine max
  Coding DNA Sequence Number=SeqID_4534
  Gene Ontology: Mol. function=binding; Cellular component =mitochondrion; Biological process=attachment of spindle microtubules to kinetochore during meiosis I
  Homolog annotation: Hit_ID=A5AU97; Match level="QueryCoverage=88%, HitCoverage=100%, E-value=9e-36, Identity=45%"; Hit description =Putative uncharacterized protein
MDESSLQLVSEIGRRLAHRTRPNKDFIVKSLAKAANALSLIKQSSQPRTAKEVQAAKKQEDTLKPLANAVVCGGLLQHADKEVRLLVAVCVTDLFRIMAPVPPFEDKHLRDVFKLIISLFEDLADTASPFFSKRVKVLETMAQLKCCVIMLEIDSIDLVLEMFNIFFSVVRSHSLEICSPFMIVDFSGIVDDT

SEQ ID NO: 96220 - protein, 95 aa, Glycine max
  Coding DNA Sequence Number=SeqID_4535
MTHPVPIELHLASRYRWPSIYVCVLLFLLVVEQSSSYIVEYMEDNKGTHETCDVEEGSDEESQEHGEEECEKEMEEHINERDEETWDVEEGSDEI

SEQ ID NO: 96221 - protein, 368 aa, Glycine max
  Coding DNA Sequence Number=SeqID_4536
  Homolog annotation: Hit_ID=A4PP05; Match level="QueryCoverage=43%, HitCoverage=46%, E-value=2e-11, Identity=32%"; Hit description=IMP dehydrogenase/GMP reductase, putative
  Subcellular localization annotation: CTP_CleavageSite=59; ConfidenceScore=5.15e-01
MVWLPLQDVPGSNSFVSMMGFSLCTQQNCWCTQQLKSSSHGRKVEKFAKPTPEIEGLVVATGLSHLIACSLEIGDQGLISAFAESFEALHMDEVVFLLIELLEVSSEGAKAEIYENLNDASKSSVRQLAGYITLLQCWIYEHFPSIASSIAAEDCHERKPRACRWKFGKALPVSTYRKWIDRLTFDVVCWIPYEGCATVWYVQTIPPHPAAPTLCIEDIDDRWIQFSKYLASVGQICVAPGQCAADYMQWFYMISNPFMSSAQARDPPRHPRVLRDDIFIELDIPQHQVAATAMDKAPADSPAHVEQPRHAVFGTVAQPKDSEKRYKGIHYHERLPKDHQRCDCETQCICAVTTKAAYGRCMKTFRIY

SEQ ID NO: 96222 - protein, 135 aa, Glycine max
  Coding DNA Sequence Number=SeqID_4537
MEKLEHHITGVHWAWPNRGYAWPSEALIGHSPSEDLLPPSTPRYHQPIKHYHHPTSSKTRKQEIEKQVEAYSKETSFDPTAVLFFARWTLHKVSIKFGWWNPTSPKWCSAPIKGITSSLSCRLDSAMHCSLSKPR

SEQ ID NO: 96223 - protein, 797 aa, Glycine max
  Coding DNA Sequence Number=SeqID_4538
  Gene Ontology: Mol. function=nucleoside-triphosphatase activity; Cellular component=nucleus; Biological process=cell cycle
  Homolog annotation: Hit_ID=A5B201; Match level="QueryCoverage=69%, HitCoverage=50%, E-value=5e-86, Identity=38%"; Hit description =Putative uncharacterized protein
MGNSIASDGGGQMFGVGDDDGGSVSGAAGSACIRRWYVSSGGGVGAGATSGAETTDTVEVEERSIGNPSGDSSAQGVDVRELEMQMRHSHRQSEAHWNQESKVQERRTKKQRLQDYQTEPEVTCDASFVGCSKLEKLIILSNRDIFFNMNPVLAVVAVNTSTITTSSMMRGVRDKGRGIPSRSGKGSEGSEYTVETMDIVGVNFLGLGPHIIAGCKSLVLCLKVGEFDGGVAGELVRQIVDHGGNSRGVVMSGLLDHTESPHKKTVKLLPSPALPNGIEAEEMGDGVIELITISDDEACSLGGTSPRLRGKSNVFTCGSVQTLILVEDVDILFPEDRGCIAAIQHISETAKGPIILTSNSNNGGLPDSFARLHVSFSLPLPDELLCHMYMVCVTEEVNINPLLLKNFIQSCDGDIRKTIMQLQFWFQSKKYKKDRKVQKVYGSLPFDLEACHQIIPKMLPCDYPSELSKLIEKEIANSITIMEDNSCSQGLVNKELDINERKNDLDVQFMKTDYLEAKVERIKRSLTDCSRFESQHSAISELSHCSGSLVTSSWQKDQSKHIVMSSDSEEKDPNNGHSLDVHEEVYKRHSLESNNSEEERYKYVETAHDACLNETCKSFDMSCFPGTISIPETAIQNGIKPMSGPVSSGCHADPVEVSLNNELTPFTFSVCQSLDKLPQNSDSLVNTEIPESFSKAAVQNLRDGNTETSTVCNVIDECGHADFKWKSKFAESSPSMAMDMVHLWRKHRICQKDLGQHDNPELGVIQVVKLTSGLTNLISEADLLFHGYYGASDVPFR

SEQ ID NO: 96224 - protein, 222 aa, Glycine max
  Coding DNA Sequence Number=SeqID_4539
  Gene Ontology: Mol. function=oxidoreductase activity, acting on the CH-OH group of donors, NAD or NADP as acceptor; Cellular component =glycerol-3-phosphate dehydrogenase complex; Biological process =glycerol-3-phosphate catabolic process
  Homolog annotation: Hit_ID=A7Q3X8; Match level="QueryCoverage=19%, HitCoverage=9%, E-value=1e-14, Identity=93%"; Hit description =Chromosome chr13 scaffold_48, whole genome shotgun sequence
MAPLYLNYYGLCMLNDNYKVKLHFAEIAFSNDQSYSSLGKHVFDVSIQEFVQIATRAGGLSAIIVVGMAVIGIVVLYATFYVWLEVEPPNLMKAAYKGYWCIAGEEDKGAKTSRQLRKQAARRLETVHSMRMLKIIMTLTLIILMELNFKKKEVMTSNTSSTNQSNLVQSCSGVEIAGALKNVLAIAAGIVEGMNLGNNSMAALVSQGCSEIWWLPCNARHC

SEQ ID NO: 96225 - protein, 227 aa, Glycine max
  Coding DNA Sequence Number=SeqID_4540
  Homolog annotation: Hit_ID=A7NVB8; Match level="QueryCoverage=92%, HitCoverage=78%, E-value=4e-49, Identity=50%"; Hit description =Chromosome chr18 scaffold_1, whole genome shotgun sequence
MKSVEVAKTVLEVADVAWTAVEHTHHLRHRSHPVPAAPAADVCPSDQDLESLRSENRRLRNLLDQNLKLLQNLSEATCFDNCPPDLNDRLVATMRSDEYLTRLKYLQQETASGGNQFPFKEATELDYRSADILVNINSQEPSWWVWVTDEKEPINVEELSGIDDENYLVISEEHVVDGVANFMARCILSNPKALKFSPEELQKVRISPIHLYFMLGEETARHEAQPQ

SEQ ID NO: 96226 - protein, 115 aa, Glycine max
  Coding DNA Sequence Number=SeqID_4541
MWVSTEWFPTDFGREEKENNNFRQEDDKEKRLGYKNITVLEKHHTVGGMCELVEIEGSGSGWIQESHTRTRTRLLVIWENPNPNPYPVNSGITRQSRDGLGRVPTGTDFLAMSKP

SEQ ID NO: 96227 - protein, 202 aa, Glycine max
  Coding DNA Sequence Number=SeqID_4542
  Homolog annotation: Hit_ID=A5BEV8; Match level="QueryCoverage=38%, HitCoverage=9%, E-value=3e-10, Identity=42%"; Hit description =Putative uncharacterized protein
MNNMITLQHTKIKVSFETSTHVVGHVFKVTVYKKLLGMISRYALNQIVAECERVSYVGIDSSRCGCGMRTIHGLPCALILSVKRSASSSDQAIPRRTLPILDRFHPCIHHSIENIVEDSWSLVCNHLLKELVKWSDEYINLLGGIDKFEELKQSLLVDELSMVAMDKWMNITDMGYVIASRDSCPLLPLALLWSRHCHPQAK

SEQ ID NO: 96228 - protein, 67 aa, Glycine max
  Coding DNA Sequence Number=SeqID_4543
MDVAIVKEFYANLYDPEEKSPKQVRVRGHLIKFDEDALNTFLKTPVIIEEREDLPAYSRFCRLRPDP

SEQ ID NO: 96229 - protein, 168 aa, Glycine max
  Coding DNA Sequence Number=SeqID_4544
QTVIIVIKRKECTLRRPYQMLARARVMSEIEEVQEQMKVDMKAMKEKMTTMMEAMISMRKMMEVNTTTVVATSTATEVDLTHPPGFNQVQNKHSFPPYGLPPNYTPPNVAHTPDENTHEAPQDHTLADFEPHLGCATEGQAFGRGYAFAHMAELCLVPDVVIPPKFRV

SEQ ID NO: 96230 - protein, 17 aa, Glycine max
  Coding DNA Sequence Number=SeqID_4545
MDKKLEEDALMEEKKET

SEQ ID NO: 96231 - protein, 171 aa, Glycine max
  Coding DNA Sequence Number=SeqID_4546
MVENGNYIPYNDQLNKIPKSQWTKEQSDFLNSKTRNVMLYALSEEEYTKDEGSKGEKFLALSSQKNIKTSLSKEQVLRSLSKALKVDNSSNEESEEDFDEDKLDFISRKIYKMWKNKGGSRWSSSKRVLKEKKDKDKSSIMLKQRHFDVLMMPKDHVLLKFNSRGSCASQV

SEQ ID NO: 96232 - protein, 72 aa, Glycine max
  Coding DNA Sequence Number=SeqID_4547
MKMLLIPHDASSIGAYEWQRNEERKRERRRHFKEKMSLEEVHHHRRPWIRAWRKKEMNEGRGREEHEILCSK

SEQ ID NO: 96233 - protein, 97 aa, Glycine max
  Coding DNA Sequence Number=SeqID_4548
  Subcellular localization annotation: CTP_CleavageSite=80; ConfidenceScore=5.42e-01
MAMAVMVILLVVTVVVVVAIAMAMVVIQMSMAMVVMVTVVVVVLVSASNGGVVVVVTKVVLVVVAVIVALVIVMVVVVVVAVTTKSVIIKYGKYVFF

SEQ ID NO: 96234 - protein, 207 aa, Glycine max
  Coding DNA Sequence Number=SeqID_4549
MESAKHMATPMSTACYLDKDETGQSIDIKQYRGSALVSKVHGIPMVIDQYVFFSLTHLPSQGAPFEGTIIDDWKFDFSSHDAHRMDDLIIMWAFLTGRQIDWAHLVRYHMHKALQSSAPLPYPQLVTLFLRHFQIPLDNEPFVKVKRSFAIGASAVTSFRYHKDMDGQWVKKDVQQQAQDERTPSPPPQHVDTASLLQEVLTDLRDF

SEQ ID NO: 96235 - protein, 53 aa, Glycine max
  Coding DNA Sequence Number=SeqID_4550
MCVFQKGEYAGVTTNAYSRKTLEKPKRGKWELGAMGALPGELKLSTEAMSLPR

SEQ ID NO: 96236 - protein, 209 aa, Glycine max
  Coding DNA Sequence Number=SeqID_4551
MSEIEEVQDQMKADMEAMMSMRKMMEVNTATVVAASTTTEVDPTHPSGINQASHPVPDMHSFPPYGLPPNYTPPNVAHTPDENVDNSAPMPIESQQPQSGHAQVPQPMGETYEAPRDHTLADSEPHLGYATEGQAFGGIPLPNTLGGPSVSATTTTLTFCGGKTTSYHGRNYAFADMVELCLVPDVVIPLKFKVPDFDKYTGLLAPRIT

SEQ ID NO: 96237 - protein, 72 aa, Glycine max
  Coding DNA Sequence Number=SeqID_4552
MGTWAKAVCPGELKLCAEAMSLPRRVGACPAHERKIYPKAHENPWAFSCISGPIFLEFSIQCPLRVGLHQKG

SEQ ID NO: 96238 - protein, 112 aa, Glycine max
  Coding DNA Sequence Number=SeqID_4553
MNKSDIPLESHHREGEIEPSFWMQSYTSSECNHILCNSKDTFEIVFLFGSKLKETRSYLSEFGYCLIIRNLEISLLNFGIGIGINDSINDERRGLESCFGMITMMMTATMRN

SEQ ID NO: 96239 - protein, 104 aa, Glycine max
  Coding DNA Sequence Number=SeqID_4554
MDTKIKSKLSRSGLLRVQPPQIEFPLAPAPCTELRKTKASATEEGRTPVANSETQTAQAKTATKTMIVLTMEPSLAATIVLVEAEPEAVEARKKGLKSSWRFNR

SEQ ID NO: 96240 - protein, 189 aa, Glycine max
  Coding DNA Sequence Number=SeqID_4555
MTRGNPSDLQPFDPKIDRTFHRLVRHHLVPFEHPEHFVIGDFEHYSFEHSDFEHSKNMAQPPPRERTLWEMAAPNFTYGSLCIQYPDEDVPYVLKTGLIHLLPKFHGLAGPSRAGMTSREYSKKKISLLLGPRPSEKIFQSIRQLSGESIYEYCERSKKLCASFPHHQISEQLLLQYLSLKDSITWREV

SEQ ID NO: 96241 - protein, 112 aa, Glycine max
  Coding DNA Sequence Number=SeqID_4556
MRMTSSSSCNLLQKEARDKVDVTYKNWKEVPTAQKDLIWEDIQAEFEIPKTGERWRQFKLDFTRKWALAADQDGVDGTICEKYGISKEKWVQFCQTRRDPSWEDVSKKAQAI

SEQ ID NO: 96242 - protein, 61 aa, Glycine max
  Coding DNA Sequence Number=SeqID_4557
MSAYSPFAKCEPRAKRIFDHALSCESQALSAQPLHLRLIWYAKLAKDELSQLQFDLNSTKL

SEQ ID NO: 96243 - protein, 157 aa, Glycine max
  Coding DNA Sequence Number=SeqID_4558
MDNFFQHSPTAGTFATDRRWKIWWLATTNSIWVLRNDMIFHSQSFDISKLADRVGKGFQCPFSLMVLSNVISFYLMLLGRAGFVFKKKNTSPGNANALAAAALENKDLAFLVAQLGSDSHQSSNNNNSDGHGRQKLDNKENEYRNGCSCVSNAYLRQ

SEQ ID NO: 96244 - protein, 203 aa, Glycine max
  Coding DNA Sequence Number=SeqID_4559
DSTSDSPQISASPHQLDFAPYASGSYNVQWNAPGLLHDMHMLRSSCILRKMEGLWLPLNYQVDMRASLSYDTGIWGFVVDLGMAFMDNWVVGNFMCLPHGLRDMCMISLRLLALNEHRSGVIDILIGSVRHIGWCKLGGKPYGGKAPDGGIGFTLVTALVAATATILSSSSSSWPPSLWPFALSWPPCRPSSALAPLLLHPLL

SEQ ID NO: 96245 - protein, 153 aa, Glycine max
  Coding DNA Sequence Number=SeqID_4560
  Gene Ontology: Mol. function=hydrolase activity; Cellular component =spliceosome; Biological process=mRNA processing
  Homolog annotation: Hit_ID=A7QRU2; Match level="QueryCoverage=70%, HitCoverage=7%, E-value=3e-46, Identity=79%"; Hit description =Chromosome chr13 scaffold_152, whole genome shotgun sequence
MGDIELCQLFLFNEEFKYVRVRQDEKMGLAKLLDYVPIPIKESLEEPINDACVLYCERFMEFLIDLFSQLPMRRYLRPLVANVAIVAKCHLSAVYRHEKGKLFAQFVDLLQFYEWFEINDHTGTQLTDDKVLESHYSRMQSFQLLAFKKMEKI

SEQ ID NO: 96246 - protein, 67 aa, Glycine max
  Coding DNA Sequence Number=SeqID_4561
MTRNGRIPDLPTQPANAKGKAKIAEEQNNKVIPAPDEDIPMKGLSEKKDGCGKKEVLLEEAGRSGSS

SEQ ID NO: 96247 - protein, 115 aa, Glycine max
  Coding DNA Sequence Number=SeqID_4562
MVCTNQADMTRRLLAGSLAFECRIMHYMIVRILPPRSSNLAQSEPFVKVKRSFSIGANVVSSFGYHKERDGSWVKKDTPAQAVEDRSPSPPPQRDHSSSLMHNILDRLDGLHTFV

SEQ ID NO: 96248 - protein, 117 aa, Glycine max
  Coding DNA Sequence Number=SeqID_4563
  Subcellular localization annotation: CTP_CleavageSite=45; ConfidenceScore=5.51e-01
MATPPSSPPPPPPLPTSATSQLPSTLKQTRKATWLRSLAEFDIPEASDLRTKNKMLQTLGERWRQFKSDLTSKWALAADKESVDDTIYEKDPSWEDMRKKAQAIQKQNTAPHMLSRG

SEQ ID NO: 96249 - protein, 137 aa, Glycine max
  Coding DNA Sequence Number=SeqID_4564
  Subcellular localization annotation: CTP_CleavageSite=74; ConfidenceScore=5.16e-01
MWEVLIPSSKVNTTPESGIIQTSVACIKQFAPTQLNQNQSQNSDRLPSQSVQNPQNVSAITLRLGKQYQGPQLVASSSSANEPAQPHSTPEKDDDKNLKSKLPNNFYAVVAYPSSIPTKSNFQQENGRGGEGDLGNI

SEQ ID NO: 96250 - protein, 166 aa, Glycine max
  Coding DNA Sequence Number=SeqID_4565
  Homolog annotation: Hit_ID=A5BSR3; Match level="QueryCoverage=57%, HitCoverage=30%, E-value=3e-11, Identity=40%"; Hit description =Putative uncharacterized protein
AEFDIPEASYSRTKRKLLQTVGERWRQFKSDLTRKWALAADQDGCAHEGTAIQKQNTAPQVLSRGGYDYLEQKLLAEKTKKKMQEAAQSGSVDDVIDPPSSVRRHVKWKMARTKKTGEMTTEAAKEIAEKIDSFEEQATQGSFVPHGRQDVLAAAIGRPEHPGRVR

SEQ ID NO: 96251 - protein, 147 aa, Glycine max
  Coding DNA Sequence Number=SeqID_4566
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=2e-13, Identity=28%"; Hit description= UPI00006A17C9 related cluster
  Subcellular localization annotation: CTP_CleavageSite=19; ConfidenceScore=5.08e-01
MARTCRPLKARTCSPLKVRACSLTKAKVHGPLTARTCSPLKVKVHDPLKARTCSPLKVKARTFSPLKARACSPLKARACGPLKARTCNPLKARTCSPLKVRACSPTKARACSPPKARTCSPLKGRTYSPLKMRVSSPLKVRACSPMK

SEQ ID NO: 96252 - protein, 67 aa, Glycine max
  Coding DNA Sequence Number=SeqID_4567
MEAFKKFKWSELFTRRGITYRDARKRTTEALENSNGHNFSHGGRFQAQNVSRRSKLNNGSSRELKWS

SEQ ID NO: 96253 - protein, 92 aa, Glycine max
  Coding DNA Sequence Number=SeqID_4568
MSIKFQGTLQTSPALAKEREAFSREAKCEVCNSAQDGAANWVPTNHTSTVATENLLSSLHYKLIKGHMSQTLSRHLRRSQDIQGKSCLGKCP

SEQ ID NO: 96254 - protein, 81 aa, Glycine max
  Coding DNA Sequence Number=SeqID_4569
MHENEWHGACLLFAPIWEPIGQYLGVSNNYSPTIHNSHDCFLEASKGEAHGCAFQRRKDARSRHQRLFVENVGKTEGNRSK

SEQ ID NO: 96255 - protein, 166 aa, Glycine max
  Coding DNA Sequence Number=SeqID_4570
MGETHEIPHHNLANFESCLRYATEGQVVGASISPPTTTLLWKNGGLHTFKLSENLVFADERIKVGPEKGKSDHPALMIAKTGANEEDENNGETLAMIAIPTRSNFPSAQQCHYSANNSPSHPIIHKGHPQSSTKPARHTSGAKTPTKKEFCSKKPVGFTPNFGVIC

SEQ ID NO: 96256 - protein, 358 aa, Glycine max
  Coding DNA Sequence Number=SeqID_4571
  Homolog annotation: Hit_ID=Q3JX81; Match level="QueryCoverage=85%, HitCoverage=63%, E-value=2e-16, Identity=26%"; Hit description =Putative uncharacterized protein
LAAIHGCVIDSQRGALSAPQHHLEYRARQPAERRAQQIGEAPAALDKDALGMAQRPESFDAVTGPHAAGADAAERQIVLGKVQQGGVDADVAGGGACQQPVLQRAAWAKVVQRQRGAGPAVDNVDRFIKGGVGAHRAAAARKISSCMIRLSSGAPTISVGARILQTVVVPVVDDGAVVMARRPVGVKRFDRRVVERNEVFHIVLMDQQEIGRDAGLARVRQLAERQAVNGSGVNRAGRHHGGAFAAQLERQGHQIFTGRLHDLTADRRAAGEHQVIERQLAEPGPDVRPAGHHRDLIGGKQRRQHRFDKLAGARRELRRFQHHAVAGGQGGGQRDEGQRKRGDVAAFRLHEAFQVAQQ

SEQ ID NO: 96257 - protein, 38 aa, Glycine max
  Coding DNA Sequence Number=SeqID_4572
MAPTRHLVDPEKSNRALGFPTLITSLCQFYEVPVTPSK

SEQ ID NO: 96258 - protein, 184 aa, Glycine max
  Coding DNA Sequence Number=SeqID_4573
  Gene Ontology: Mol. function=ATP-dependent helicase activity; Cellular component=cytoplasm; Biological process=regulation of transcription, DNA-dependent
  Homolog annotation: Hit_ID=A7MJ24; Match level="QueryCoverage=91%, HitCoverage=35%, E-value=5e-81, Identity=91%"; Hit description =Putative uncharacterized protein
  Pfam annotation: Domain name=Helicase_C; Domain location=100-176; Score=115.5; E_value=1.5e-31; Accession=PF00271.22; Description =Helicase conserved C-terminal domain
GLYPDIRRVLAKLPAKRQNLLFSATFSDEIKALAEKLLTNPEQVEVARRNTASEQVSQQVHFVDKKRKRELLSLMIGRDNWQQVLVFTRTKHGANHLAEQLNKDGITAAAIHGNKSQGARTRALADFKTGGIRVLVATDIAARGLDIEELPHVVNYELPNVAEDYVHRIGRTGRAAATGAALSL

SEQ ID NO: 96259 - protein, 224 aa, Glycine max
  Coding DNA Sequence Number=SeqID_4574
MRSWVRGQWIPFDADAIGQLLGHPLVLEEGQECEYGQRRNRSNGFDEEAITQLLCIPEQDFARTTAGRRVRIMRTNMTTLTQIWMTLLLSNIQPSDHNSDLPLPKCQLVYAILTRMSIHVAQLITDAIYIFAGMAPTRHPLDPDKSNRALGFPALITGLCQSFGVPVALSRFKEEVAWPGDWPEARAGEAPTEAPAEAPDEANEARKDEEMADLFDFLGGSGAT

SEQ ID NO: 96260 - protein, 121 aa, Glycine max
  Coding DNA Sequence Number=SeqID_4575
SPGRSSKKYYTPRQAQGDAHQAADAPPPPHQADPAGSLGMECYLQHLVCQQAANHRGQGQGFAPFASPTPEQFGAEVTWARDWPEAQAGEEPAGSPGEAEEARMDEEMTDLLGFLGGSEAT

SEQ ID NO: 96261 - protein, 168 aa, Glycine max
  Coding DNA Sequence Number=SeqID_4576
  Homolog annotation: Hit_ID=Q6WAY4; Match level="QueryCoverage=88%, HitCoverage=27%, E-value=2e-14, Identity=32%"; Hit description =Putative uncharacterized protein
MGTNQTGKRFYQVKIKGLDITSIKELGRLMGPLQMQAFRKAYGKILDLTIAEIFTEAIASLAQYYDQPLRCFTFGDFQLVPTVEEFEEILGCPLGGRKLYLFFGFLPSLSKIAIVIRDSARGLYRVKQTRNGIVGLARKYLEGKARDMANQDEWVPFMDVLALLVFGV

SEQ ID NO: 96262 - protein, 54 aa, Glycine max
  Coding DNA Sequence Number=SeqID_4577
MTEWILIIKNGEIVEAMPSKIILMMPKNQELSKFQRIRSKKASRIKFQRIKIQE

SEQ ID NO: 96263 - protein, 180 aa, Glycine max
  Coding DNA Sequence Number=SeqID_4578
  Homolog annotation: Hit_ID=A2Q3G4; Match level="QueryCoverage=92%, HitCoverage=37%, E-value=2e-10, Identity=30%"; Hit description =Ovarian tumour, otubain
MNNMIMLQHTEIKASFETSIHVIGHVFKVTLYKRLLDMVSRYALNQITAEFENVHYAGKNPSRCECVMRTTHGPIFHVHVSYPNMFLVPYHLTQSICFGRGFLDQGLSKPQVTITEEMETISKRFEKLDVCGKVTLKSKLWEIAYPDLNSMCHPPEEVNAKGAQKKSMTKHQRSTKHDPS

SEQ ID NO: 96264 - protein, 155 aa, Glycine max
  Coding DNA Sequence Number=SeqID_4579
MTQLKRSSNSLRKQVLMPRVFQAGRMTRVLTAYADHITVIVWNGKVTITLDDVASLLHLPIIGTFHSFDTFHVDKAVLMLVELLECNTRACAVLGRLLRPQLEWKLRMGATALVHMYDNLNDTYKSGNRQLVGYITLLWYFSSIAKAFTDEDYDE

SEQ ID NO: 96265 - protein, 119 aa, Glycine max
  Coding DNA Sequence Number=SeqID_4580
MDEVAKIRKRFGDEQSTLLDQFERLSFETHLNKAMLQRSLSEPGFPRQVSQPRHVSVTPTIPLLNHGKQRRCRVSGLSKVLKKLLRPILGRKSSGGERKHVPDPRNPLSWKNFSRSLRF

SEQ ID NO: 96266 - protein, 173 aa, Glycine max
  Coding DNA Sequence Number=SeqID_4581
  Subcellular localization annotation: CTP_CleavageSite=40; ConfidenceScore=5.43e-01
MPPVSWDTVTKSGVVDKSRAFAPTYPQFVMRNSDLRSSSYCETKNSLGAFFTKMRTCFSKETKLLTDQSNICFLDEKQCVYRGRRHFVSKRPFRENTGSNKNRRRSLKVYQSHTVRGEKVASAQDFVGNQRDWTTLGRGSFFLGKDYDKLGFGSRLVERLLTIYVRVWPAVRG

SEQ ID NO: 96267 - protein, 289 aa, Glycine max
  Coding DNA Sequence Number=SeqID_4582
  Homolog annotation: Hit_ID=Q6WAY4; Match level="QueryCoverage=93%, HitCoverage=48%, E-value=5e-12, Identity=23%"; Hit description =Putative uncharacterized protein
VWDQYLAGIGGSTINWFPRWKEGNEGVLFSCGDYPNVPLIGTRGCIYYNPALSIRQLGYPMRGAPTKESLSPFLVRDFGAQSLKIVQRVHKAWENPLRKDKELRGIRNGIIGGYHEWLSKLKIINEENFEAPKEDEEVQALKTVLGKARLAKEKFKLVATDIRKECADNNELKLRREERDQSRVHDMVLKEELATCSRSKRSLAQHLEATEQSMLAIIGQYKEELNQSLTHEQKLVEDFAQAYAEKEPRGRVIDALHQEATMWMDRFALTLNGSQDLPRLLAKAKAIAE

SEQ ID NO: 96268 - protein, 121 aa, Glycine max
  Coding DNA Sequence Number=SeqID_4583
NKDKGYVGVRELSWRWATGDGGLYVICGCGKSFRTIARPPPSTTCDGVVPGDMSRGSGDLGDVRWGTCDVPVATYPSAEGRRVTRGMRVPRKEYARSRHQRLFEENIGKTGKDAIYELLSE

SEQ ID NO: 96269 - protein, 337 aa, Glycine max
  Coding DNA Sequence Number=SeqID_4584
  Gene Ontology: Mol. function=motor activity; Cellular component=cell projection
  Homolog annotation: Hit_ID=UPI00016621D1; Match level="QueryCoverage =70%, HitCoverage=40%, E-value=3e-19, Identity=33%"; Hit description =UPI00016621D1 related cluster
GLHVLAIRGLHALNFRGIHVLAIKGLHTLTFRGLHVLAFRGLHVLLIRGPHALTLRGLHFLTIRGRHTLTSRGLHVLAIRGLHVLVFRGLHTLTFRGLHALTFRGLHALAFRGLHVLTFRGLNVLTFRGLNALAFRGQHILVFKGLLILTSRGLHVLTFRGLHVLAFRGLHALTFRGLRAPTFRGLHALSFRGLDVLAFRGLHVLTFRGLHIITFRGLDVLAFRGLHALAFRGLHVLAFGGLRAPLFEGCTCPSLEDCMSSPSEDCTCSHLEDCTSSPLEGYTASPSEDYSSSPSEDYTSSPLEDCTSSPSEDYTSSPLEDCTSSSSEGCTPSPLED

SEQ ID NO: 96270 - protein, 85 aa, Glycine max
  Coding DNA Sequence Number=SeqID_4585
  Homolog annotation: Hit_ID=A5AWG3; Match level="QueryCoverage=98%, HitCoverage=16%, E-value=2e-07, Identity=37%"; Hit description =Putative uncharacterized protein
MNIEESIHVTFDESNAILSRKNMLDDIAESLEQIHIHGQDSKEKGKGSNEDPLEEAKSNNELPKEWKVSKDHPLDSIIGDISKGG

SEQ ID NO: 96271 - protein, 453 aa, Glycine max
  Coding DNA Sequence Number=SeqID_4586
  Gene Ontology: Mol. function=L-seryl-tRNASec selenium transferase activity; Cellular component=cytoplasm; Biological process =selenocysteine incorporation
  Homolog annotation: Hit_ID=A7MND6; Match level="QueryCoverage=75%, HitCoverage=92%, E-value=1e-148, Identity=77%"; Hit description =Putative uncharacterized protein
  Pfam annotation: Domain name=Beta_elim_lyase; Domain location=25-305; Score=-91.9; E_value=0.00019; Accession=PF01212.12; Description=Beta -eliminating lyase
  Pfam annotation: Domain name=DUF1341; Domain location=367-453; Score =13.2; E_value=2e-11; Accession=PF07071.2; Description=Protein of unknown function (DUF1341)
  Pfam annotation: Domain name=SelA; Domain location=13-338; Score= -196.2; E_value=2.6e-05; Accession=PF03841.4; Description=L-seryl -tRNA selenium transferase
  Pfam module annotation: Pfam domain module=Beta_elim_lyase::DUF1341::S elA; Domain location=25-305::367-453::13-338
MSSIYEKYDLKQVINASGRMTILGVSTPSADVVDTVSYGLNHYFEIKDLVNKTGAYIARLLEVENAVVVSCASAGIAQCVAAVIVKDNDWLLDNLHAAPLSVPHDIVVPKGHNVNYGAPVGSMVALGGGRLIEAGYSNECSPEQLAAAITPTTAALLYVKSHHCVQKSHLSVEQAAVVARKHGIPLIVDAAAEEDLQCYYQMGADLVIYSGAKAIEGPTSGLVIGRSQYVEWVKRQSNGIGRAMKVGKEGILGLTQAIENYLLQSKTSGADMVAKMTPFIDNLNTLNGVSARVVWDAAGRDIARAEIKFDEAVTGWPTGELVQALKNGDIAIYFRGYKANEGIIEADPHPGAAQRRKTRMNLNPNFYQGRLCLNVLAGSKQNAQAIWQAAEGHVLVGVLSKNYASNEAAIADMREYAALIDNALSVGLGAGDPNQSAMVSEISAELQPQHVNQ

SEQ ID NO: 96272 - protein, 307 aa, Glycine max
  Coding DNA Sequence Number=SeqID_4587
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDPDTQATDSMMNRIVSHVSLLTLNVSILNAPLERYRMGQARWLMPDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 96273 - protein, 113 aa, Glycine max
  Coding DNA Sequence Number=SeqID_4588
  Homolog annotation: Hit_ID=A0PAV3; Match level="QueryCoverage=30%, HitCoverage=15%, E-value=6e-07, Identity=80%"; Hit description =Restriction endonuclease
MVKVGTYYVPINVSFSPKVGPGLPGINRDTRIYLFCEAILRHSVTTTPAAVNAPLQGASHSPFRLRNCWEGRSVRASSLLRQLAKGGCAARRLSWVTPGFSQSRRCQTAASEL

SEQ ID NO: 96274 - protein, 184 aa, Glycine max
  Coding DNA Sequence Number=SeqID_4589
METLQKVRKEWEVVRKKNKELTGSNNGPIGGYHKWFRAHMQGLDWLLSLRTAKREEVEAPEEDEEVQALRAELEQAQTVKERFKSAALKIRKENAELRDTSIATTKGLEREIKRARREEYGWNKFRGALWGGNNELKLRREERDQSRVDSLILKDELKACSRPKKSLSQRLCETETNMLAIISK

SEQ ID NO: 96275 - protein, 79 aa, Glycine max
  Coding DNA Sequence Number=SeqID_4590
MSIHHHHEVSFLSLSLAETSRVLIDLGSSTDILLSQCALLRASEGEAHGCAFQRRKGARSHHQRLFVENVGKTEGNRSK

SEQ ID NO: 96276 - protein, 30 aa, Glycine max
  Coding DNA Sequence Number=SeqID_4591
MEKNEETTIEEKMPRKAKEKRRGEAPSTTE

SEQ ID NO: 96277 - protein, 138 aa, Glycine max
  Coding DNA Sequence Number=SeqID_4592
DRECAELIGQTADDVNRVKIEDGDLDLNASPQALDKLLGHVLAFKVRIQSRFKNAVVLKYSKDLDLINVVLEMLPDSEILCFMQQSLSVTTDHDPVAGLPLTPKKRMSSDEADDELGSSQISPAQLSSNKLTRHSHRS

SEQ ID NO: 96278 - protein, 79 aa, Glycine max
  Coding DNA Sequence Number=SeqID_4593
MSSIVCWDRARKTPSGPEEGQQGLAVFIRHPINRAFIKKYCTPRQAQGETPQQPGECWQRATDAPPPPLEFTSAQQQKG

SEQ ID NO: 96279 - protein, 95 aa, Glycine max
  Coding DNA Sequence Number=SeqID_4594
MTTHADLMQASTSVPIPVPNGCDFQALKTRIHNTLKLIDKHFLDEIYYRQPFTYAGKNPKKFDIPSECTMDELKDLIKQVAPHGIPPYGIHKTQT

SEQ ID NO: 96280 - protein, 72 aa, Glycine max
  Coding DNA Sequence Number=SeqID_4595
  Homolog annotation: Hit_ID=Q1J7G7; Match level="QueryCoverage=41%, HitCoverage=42%, E-value=2e-09, Identity=93%"; Hit description =Transposase
MVKVGTSYVPINVSFSPKVGPGLPGVQWLLFLSAVPPVQLLTGWCETAKAPPDISGGKCSGHAARNHHSRRA

SEQ ID NO: 96281 - protein, 77 aa, Glycine max
  Coding DNA Sequence Number=SeqID_4596
  Gene Ontology: Mol. function=structural constituent of ribosome; Cellular component=large ribosomal subunit; Biological process =translation
  Homolog annotation: Hit_ID=Q5ZDK4; Match level="QueryCoverage=64%, HitCoverage=17%, E-value=7e-09, Identity=66%"; Hit description=50S ribosomal protein L22-like
MWEDEFVRCSQFPSLILKDKAVAPRKGHSPKKVNLVAALVRGMLVKDASMQLESTIKRAAKTVYQVKRVPIEEMVLR

SEQ ID NO: 96282 - protein, 52 aa, Glycine max
  Coding DNA Sequence Number=SeqID_4597
MEAYTKDEELLIHFFQESLTGVAVTWAYARGGMDLSKHTPKGRGIWQPEWFP

SEQ ID NO: 96283 - protein, 157 aa, Glycine max
  Coding DNA Sequence Number=SeqID_4598
ADILIARFPYPNYGVKTGSSRCGVSMENNDSLWWLMVVVGDGESAWDVRNGFGRKKGEEMAFFLSYTKAKLKCLNKRCSRKRKLLAPSRHLLKDPNGQIMDQCLVKLQTNFREDPTVNEGWAAFLPRQLHVAFSRSFIKRLPCGFFEKLSQEASLIR

SEQ ID NO: 96284 - protein, 31 aa, Glycine max
  Coding DNA Sequence Number=SeqID_4599
MMLEYARSRHQRLFEENVGKTRKDAIYELFK

SEQ ID NO: 96285 - protein, 98 aa, Glycine max
  Coding DNA Sequence Number=SeqID_4600
MGHVSDFVEETIAQLLCIPGQDFTQPLQGDECGSDRARKTPSGPEEVQQGLGVLALITGLYRFYGVPVAPNKVIRPPINQAFIKKYCAPRQAQGEAPQ

SEQ ID NO: 96286 - protein, 186 aa, Glycine max
  Coding DNA Sequence Number=SeqID_4601
MHYIIVRILLPRTSNLAQASEEDLILMWAFLTGRQIDRAHLVRYQMHKALRANAPLPYPQLVTLFLRHFQIPLDDEPFVQVKRSFAIGAGAVTSFGYHKDRNGQWLKKDALPPQDEHTPSPPPQQDDSALMTEVLSELRGLRTYVGERFDSLDNRFARMDIRLTQLEEDVGYIRQSFNLPPPPPPS

SEQ ID NO: 96287 - protein, 75 aa, Glycine max
  Coding DNA Sequence Number=SeqID_4602
MHALLGSFNSGNRSDSKVLDSTRLSCCTIPRNRVLIEFNLTRGICGRGLIRIRLGYHEESGSSSPGDNIGIHEHC

SEQ ID NO: 96288 - protein, 28 aa, Glycine max
  Coding DNA Sequence Number=SeqID_4603
MQARKIVISGEVAGLQIQLGTPAFPGRE

SEQ ID NO: 96289 - protein, 72 aa, Glycine max
  Coding DNA Sequence Number=SeqID_4604
MVAVTPARVPQPPFFRGYDLNATCAYHGGVLGHSFEHYMTLKPIGLFAQATCAPEFGLPRPFNQKLLVLHIW

SEQ ID NO: 96290 - protein, 62 aa, Glycine max
  Coding DNA Sequence Number=SeqID_4605
GVSSISSFSIMLPFIFQEAKESIDEEDPRPTSSNGAYITKQSFYCFLDGYSGYNQIAVDPQD

SEQ ID NO: 96291 - protein, 381 aa, Glycine max
  Coding DNA Sequence Number=SeqID_4606
  Gene Ontology: Cellular component=membrane
  Homolog annotation: Hit_ID=A8GE97; Match level="QueryCoverage=77%, HitCoverage=99%, E-value=1e-124, Identity=77%"; Hit description =Putative uncharacterized protein
  Pfam annotation: Domain name=DUF6; Domain location=11-136; Score =38.8; E_value=1.9e-08; Accession=PF00892.11; Description=Integral membrane protein DUF6
  Pfam annotation: Domain name=DUF6; Domain location=161-287; Score =54.1; E_value=4.9e-13; Accession=PF00892.11; Description=Integral membrane protein DUF6
  Pfam module annotation: Pfam domain module=DUF6::DUF6; Domain location=11-136::161-287
MNTLLYLAVVLIWGTTWIAITLQQEGPVAIPVSIAYRFAISAAVMFAVLLLTRRLRRLAPRDHLFCVLQGCCVFGFNFFCFYHAAAYISSGLESVIFSMAVLFNALNSLLFFRQRPSPNLLPAALLGLTGIVALFWQDLAATRMAPELLKGIGLSALGTYGFSLGNMISTRHQRRGLDIFSTNTYAMTYGALLMALIALAQGASFQIEFSSRYIGSLLYLAIFGSVIAFAAYFSLLGRIGAGAAAYSTLLFPLVALTISTIYEGYQWHFNAVLGLCLILLGNLVMFAKPGLKWRRPGGRVYPYAAAGQPRGGGAGGRGAEQRANAGIGPLDQPFRKPPLCLNRRTRRRIIRCAFSPPKRAALRRPPNAGHRPRPAGSRFDA

SEQ ID NO: 96292 - protein, 127 aa, Glycine max
  Coding DNA Sequence Number=SeqID_4607
  Subcellular localization annotation: CTP_CleavageSite=61; ConfidenceScore=5.02e-01
MVKVGTSYVPINVSFSPKVGLHEFLAIQQNHASYGYLQKDSSSLSIPSTSRGGPSSRETCRASCINESANARGMCGLRYWALAECILAYYVGTDEGVSEVLHVAGEKRCTGASAEYVIQDIFRFLAH

SEQ ID NO: 96293 - protein, 298 aa, Glycine max
  Coding DNA Sequence Number=SeqID_4608
MASSHPRLLPPRRALHVLDEALGKTRQVAATLAAQQAVAQGPRVVQLQHMQTHRAGCSAPRRRAAPRRCRRRPRPCGTRPRKLPTCTRWQMRLPKAAGDVFQEGLDGAVGMDADELVGIDQVGEMGRLRRRQRMVQRRDHGELIAEQRRHIQALDVDVAGHQPQVAGARADRDDDVARDLLFQLDVHVGILGQEGRQRVRQEGIGGGGVGQQAQPPLQAAGVGLQVGVQAFELAEHRVGVLEQHLAGRGQRHARGHAHQQPRLEGLFHVLDARAGGGQRQEGAFGRAGQIERFPHVHE

SEQ ID NO: 96294 - protein, 109 aa, Glycine max
  Coding DNA Sequence Number=SeqID_4609
  Homolog annotation: Hit_ID=Q6WAY4; Match level="QueryCoverage=75%, HitCoverage=15%, E-value=2e-09, Identity=40%"; Hit description =Putative uncharacterized protein
MGTNQNGKRFYQVKVKGLDVTSLKELGRLMGPLQRQAFCKVYQKILDLTAAEVFTEAVVSLVQYYDQPLRCFTFGDFQMVPTVEEFEEILGCPLGGRKPYLFSGFLPSL

SEQ ID NO: 96295 - protein, 78 aa, Glycine max
  Coding DNA Sequence Number=SeqID_4610
  Subcellular localization annotation: CTP_CleavageSite=19; ConfidenceScore=5.30e-01
MKGNQQRGKSRSPVDSPTVATYPSAGGRRETRGMRVPRKEYARSRHQRLFEENVEKTGKDAIYELLVEGSGVVFMHGE

SEQ ID NO: 96296 - protein, 127 aa, Glycine max
  Coding DNA Sequence Number=SeqID_4611
  Homolog annotation: Hit_ID=A4DID9; Match level="QueryCoverage=40%, HitCoverage=46%, E-value=1e-19, Identity=82%"; Hit description =Putative uncharacterized protein
GDWPRVQGRRELDCRPPVEQGRKAHIDGKVWHLDVGSSPPGAVVCSKGWAVRPLKRYVSWVQNVVRQFGPYPDREGRTSGVPVIVPTVNAGASGSTAETAMGSLPQRGWSERSFENSREGHGETSRF

SEQ ID NO: 96297 - protein, 141 aa, Glycine max
  Coding DNA Sequence Number=SeqID_4612
MVDYMCKSFLHAMDVFIRVHPKQFILMCKGIDSRSLYISGSFMCFCVVVLVLTSTTVGMYGDVSSIGACRPRIFFINGFLCFLEDEWQRNGERKRERRRHFKEKMSLEKAHHHRRPWIRAWRKKEMNEGRGREEHEILCSK

SEQ ID NO: 96298 - protein, 204 aa, Glycine max
  Coding DNA Sequence Number=SeqID_4613
MASNSQQFSARNDAIVIGGVHEVATNPSASSETKKLEGKLDALVNLVTQLALNQKSVPVARTFALPCSNLEQLSSLKLMQTSNIHRPPQPQQQNQPQQSNYDLSSNRYNPGWRNHPNLRWSSPQQQQQQPAPSFQNVAGPSRPYIPPPIQQQQQTQKQPTVEAPPQPSLEELVRQMTMQNMQFQQETRASIQSLTNQMDNWLPN

SEQ ID NO: 96299 - protein, 66 aa, Glycine max
  Coding DNA Sequence Number=SeqID_4614
MSQHISVTVMDSCNRQKGSTECGYYVMHWMSTIIFGTFRNNWEAPERLKALRIHWAQFYLRVRDQA

SEQ ID NO: 96300 - protein, 42 aa, Glycine max
  Coding DNA Sequence Number=SeqID_4615
MINRPSEFNIHRKVESKPKGIGKKDWCHQLKNLSQEARGQPP

SEQ ID NO: 96301 - protein, 62 aa, Glycine max
  Coding DNA Sequence Number=SeqID_4616
GTSFVVQVEGTSTWVVVTETKKGYISCRSVLVEGTSTRLFKENRAAKTGQPGPRGLAHNGLS

SEQ ID NO: 96302 - protein, 144 aa, Glycine max
  Coding DNA Sequence Number=SeqID_4617
MAYTYSAPEEIHGLLGYCHVRNEATHGEKRGHRCRCSAAEADPTLLATAHHPPPNTIGRGMSTLGHNSNPNLGYNRVAYPYGLPPNYTPPIMQDDAGHVSSPILEGEPPRQLDEVHEDHQEYAKGDVEFYPPIPVEEPAPNTLP

SEQ ID NO: 96303 - protein, 110 aa, Glycine max
  Coding DNA Sequence Number=SeqID_4618
MQSQLQSQMQSQGLALPLELKVGPSTTHVSTKGSCVDPSPTDPETGDSNKCGLYIEENPSRQVALGRFYEGSTVVHNIPLLHGQVKIGVEEVKDAKALVPVPTNEVQLVG

SEQ ID NO: 96304 - protein, 131 aa, Glycine max
  Coding DNA Sequence Number=SeqID_4619
MKIKRVGKKKTNTRDLYWFNNNPCLHPVPKRPAVLEISFQPCKNHFTNKDPQGMCPPLFSLNNLVDVPSTRTDPQEMYPLLFSVTTTQVDVPSTCTTKDVPSNVLRQSSQAVSPLKLCEGGNKRILKRLVL

SEQ ID NO: 96305 - protein, 67 aa, Glycine max
  Coding DNA Sequence Number=SeqID_4620
  Subcellular localization annotation: CTP_CleavageSite=32; ConfidenceScore=5.06e-01
MCGSNVFQGYFDDAKESRVKQSFKQRFKNQVSSFKFQDSRFKNQDLRINIQEKSRSRFKTQEKTQSR

SEQ ID NO: 96306 - protein, 85 aa, Glycine max
  Coding DNA Sequence Number=SeqID_4621
MPSFRDLEQKWLPKVGALLELQWWRKKKRMATYATCLHLSGAKVPTFSLDVTHAQPHDEKCQNPASVCMSFLWFQSLVFLYARRG

SEQ ID NO: 96307 - protein, 72 aa, Glycine max
  Coding DNA Sequence Number=SeqID_4622
MGLCGGDNEAKEGGWLTGSMKVKRLERGGWLTGDNDVVVGRCCRGMILTRTRRQQHGGGGSGSMDLSIRERI

SEQ ID NO: 96308 - protein, 96 aa, Glycine max
  Coding DNA Sequence Number=SeqID_4623
  Gene Ontology: Mol. function=nucleic acid binding
  Homolog annotation: Hit_ID=Q1SKZ9; Match level="QueryCoverage=67%, HitCoverage=13%, E-value=9e-12, Identity=50%"; Hit description=Zinc finger, CCHC-type
MVWIRFLGINLVFYDESSLLALAAMVGSPFKVDANTLDVKRGRFSHANKHVIGKHVIGKMWLLDHCSNDFSMDVVQDSQSPMQVSDEQIPPGKMSS

SEQ ID NO: 96309 - protein, 77 aa, Glycine max
  Coding DNA Sequence Number=SeqID_4624
MELHHGVLCIISLFSFKKRVVMFEEFGFCPTGMTYLMVWLMRKNVQNRAHARKKLDKCMANPKWRLGFPHALVEVLP

SEQ ID NO: 96310 - protein, 342 aa, Glycine max
  Coding DNA Sequence Number=SeqID_4625
MAKSVEKPFSIIGLLAISGGDKKKTLPTSKPKPFNKGRSSTVETHYKSTHDLLPPHKRKMVVNIEDNVEPVGSSLVNFSNFGGSLIWMSLSQEIDHVILSKDWESIQKKGLADLESTMSILAGHYLGDVNPLKLVEEENVTLKKAQDQADALSEEFNQLKEITRLKEESSQGEVTQLKEESSLGEEENFKKATRGSFNNVLKQVEYLHPKETNDLGTLDDVMVDGFIKTQRFIEASDVDAGLEGPQMVDVLIVDEAFEFIRDYIFLAFSSAFVVKIFCVAKRYKLCHELMQSYPPRVLDRRLQEAWARATKEGPRVLMNLRLSSSFFRNLLKEASQGGELSY

SEQ ID NO: 96311 - protein, 104 aa, Glycine max
  Coding DNA Sequence Number=SeqID_4626
  Gene Ontology: Mol. function=binding
  Homolog annotation: Hit_ID=A6WY70; Match level="QueryCoverage=100%, HitCoverage=29%, E-value=1e-55, Identity=100%"; Hit description=Sel1 domain protein repeat-containing protein precursor
  Pfam annotation: Domain name=Sel1; Domain location=3-38; Score=27.1; E_value=6.4e-05; Accession=PF08238.3; Description=Sel1 repeat
  Pfam annotation: Domain name=Sel1; Domain location=39-74; Score=25.9; E_value=0.00015; Accession=PF08238.3; Description=Sel1 repeat
  Pfam module annotation: Pfam domain module=Sel1::Sel1; Domain location=3-38::39-74
GYDTAQFDLGRWLIEGRGGDRDYEQGFGWMRLGAQRGMVMAQAWLARLYRDGIGTEGDLVKAAAWYIVAQRAGFRSPDLNDMMDGLADDQIKQAIETANNLRVR

SEQ ID NO: 96312 - protein, 225 aa, Glycine max
  Coding DNA Sequence Number=SeqID_4627
MAASDIAILRDRAHIPTKKSLLELTSQDALLAQNKLQGVPSDVELTIMAAVSPMKNQLMKLIIWGISQDKISMQVDIPDFSMQGPSLYDRTMKLEETLAQFIKVSMSNHKSIEFAIKNLEVQVGQRAKQLADRPLSYPNFVRGLLFDDMQPCFDCFEKAVAFGGSNLARLGELGGKLLPYFAINRGRSEEGRGSAFLALRIHLKLIFNRSSSFVVRSSSFFGLQP

SEQ ID NO: 96313 - protein, 231 aa, Glycine max
  Coding DNA Sequence Number=SeqID_4628
  Gene Ontology: Mol. function=motor activity; Cellular component=cell projection
  Homolog annotation: Hit_ID=UPI00016621D1; Match level="QueryCoverage =96%, HitCoverage=40%, E-value=3e-21, Identity=35%"; Hit description =UPI00016621D1 related cluster
GQRTLAIRGLHALAIRGLHVLAFRGLHALALRWLHALTFRGLHVLAFRGLHALAFRGLRVLTFRGQHAFTFRGLHVLTFRGLHILTFRGQHALAFRGLHVLAFTGLHILTFRGLHALAFTRLHALAFTGLHVLTIRGLHALAFRGLHVLTFRGLHVLAFRGLHVLSFKGLHVLALRGLHALAFRGLHALAFKGRHVLDFRGLHALAFRGVRVLTFSGLHIRTLREFKVLYP

SEQ ID NO: 96314 - protein, 137 aa, Glycine max
  Coding DNA Sequence Number=SeqID_4629
  Homolog annotation: Hit_ID=A7R6F1; Match level="QueryCoverage=65%, HitCoverage=25%, E-value=2e-07, Identity=38%"; Hit description =Chromosome undetermined scaffold_1262, whole genome shotgun sequence
  Pfam annotation: Domain name=zf-CCHC; Domain location=65-82; Score =31.8; E_value=2.4e-06; Accession=PF00098.14; Description=Zinc knuckle
MPRRCGILSNLHMKAPLMNMKWNSNGLIKMKKPTKRREKFVKKRRIERSQNFNNGRKSQEDSQVLKCYKCNQLGHIKANCPSNEEWPKKSDKKRYDERRTKKAYIAWDDNDSSDGSEKEINLLTKDYESDENISQEG

SEQ ID NO: 96315 - protein, 122 aa, Glycine max
  Coding DNA Sequence Number=SeqID_4630
MAKFDPEVVLEFYANAWPTEEGVRDMRSWVRGQWIPFDADAIGQLLGYPLVLEESQECEYGQRRNRSDGFDEEAIAQLRILTGARFCPDCCRKTGADHAHQYDHPDSDMDDFAAQQHPAHRS

SEQ ID NO: 96316 - protein, 115 aa, Glycine max
  Coding DNA Sequence Number=SeqID_4631
  Subcellular localization annotation: CTP_CleavageSite=46; ConfidenceScore=5.09e-01
MFGNFTDYTTTLFLTSRMLQNFTDCATMLVLTFGMLRNFMDYATMLVSRVPKGANKVQGPTTKWHDHWLAYSQLAQLLLPRSSALFFPLQKHLVVAWRILSNWAWIQNLAEPAWT

SEQ ID NO: 96317 - protein, 53 aa, Glycine max
  Coding DNA Sequence Number=SeqID_4632
MLPFQFRHVMEHHELPNDGCQHSLFALPRGDSAVFLFGGKDEDSLHRPRFKVA

SEQ ID NO: 96318 - protein, 163 aa, Glycine max
  Coding DNA Sequence Number=SeqID_4633
MVMGDFISRLSFPVEKTPRLFQVSQVIPELRRSEFLIGGYVGARASLLSDHTAFCCHNSRAGDTRRYLTVIRTPLLGQTQLCPMASRDQVWSFCTHDTRRYLTVIRTPLLGRHSCVRWQAETKSGHSAHMIRGDTLRLSAPLCHSGTVVSDGKQRPSLVILHP

SEQ ID NO: 96319 - protein, 247 aa, Glycine max
  Coding DNA Sequence Number=SeqID_4634
MGDVEEVQEQMKADMSALKDQMASMMEAMLDMKRLIESNAATAAATSTVVEADPILPSTANLAHQLAPNMVGQGRDTLGNTNSSCLGYNRSAYPYGLPPKEETHWDPCLMHPGASHDMETCSAVEQLLQRMIDQGRLEIGDEDEKEQHKPNERKEKATDTDSTSAKVTNITGLGGMTRSGRIFVVLDLSVRPVNANRKEKVVAEEANEANPTPDEDVPAGRFTEKGEGLGRKEVSLEEANEFLRIIQ

SEQ ID NO: 96320 - protein, 188 aa, Glycine max
  Coding DNA Sequence Number=SeqID_4635
MRNALRLDSMKKCFDNMKWLRGSFLQKDLGGTSRLKGPVPFDSHRFRSAEHQQHFEAIKGWLFHRERRVQLRDDEYVDFQEEIARRCWMSLVTPMAKFDPDIVLEFYANAWPTEEGVRDMRSWVRGQWIPFDANALSQFLGDLLVLEEGQECEFSQRRNRTDGFDEEVIAQPICIRGQDFSRTAAGRQ

SEQ ID NO: 96321 - protein, 198 aa, Glycine max
  Coding DNA Sequence Number=SeqID_4636
  Homolog annotation: Hit_ID=A5BY96; Match level="QueryCoverage=89%, HitCoverage=38%, E-value=2e-18, Identity=32%"; Hit description =Putative uncharacterized protein
  Pfam annotation: Domain name=zf-CCHC; Domain location=103-120; Score =13.8; E_value=0.012; Accession=PF00098.14; Description=Zinc knuckle
MGKARAAVEELRRFLVARKLDKFYMVLILRSLHSDFDHVRDQVLAGDQVPLMDSLITRLLRVPHALKDENLTDAVETLAMVAPRGRGGGRNSRGGRNGRSGRPQCTYCKRMGHTQENCYSLHGFPDKVAQVSKSEKSESKFSDEEYQEYLKLKSEKSSNQASSSSVLCFSTACVSQSIGSPSPWILDSGASDHISVSI

SEQ ID NO: 96322 - protein, 73 aa, Glycine max
  Coding DNA Sequence Number=SeqID_4637
MGDQEETQEQMKADMLALKEQMASMMEAMLGMRQLTRFTLTRGDLWPNKPVDTQRFTSSSALTRSIILTFESR

SEQ ID NO: 96323 - protein, 121 aa, Glycine max
  Coding DNA Sequence Number=SeqID_4638
  Subcellular localization annotation: CTP_CleavageSite=52; ConfidenceScore=5.04e-01
MQKIPKRRGKRVFLPSFLDPGSPGPSGDFSLKELARLGKPVTSGVSLGSLGRAAMVPNAFFDINRHEWELGKGCQHSIVKEIGRIRKEEERKRNEVEALPNRDCDQPLHRSLFGVLRATIG

SEQ ID NO: 96324 - protein, 90 aa, Glycine max
  Coding DNA Sequence Number=SeqID_4639
MKLASTKTTIDTSKPYTGAMRGTMHEPQANVGAVPIAFRGLHVLAFKGLHVLAFRGLYILAFRGLHVLTFGGLHVLIFRGLHALTFKGMQ

SEQ ID NO: 96325 - protein, 133 aa, Glycine max
  Coding DNA Sequence Number=SeqID_4640
  Gene Ontology: Mol. function=metalloendopeptidase activity; Cellular component=membrane; Biological process=proteolysis
  Homolog annotation: Hit_ID=O65444; Match level="QueryCoverage=95%, HitCoverage=38%, E-value=3e-16, Identity=34%"; Hit description =Putative uncharacterized protein F1C12.220
MEVEARRIRRFVPQRPSHRTILPLHASSSSHNVSNTISCWYCDYKICSFNRPLFHFGRRYARFLKVWFSIGVGFALSAVLGVTLVPGLSLSLADTGYACVSTIISVFMHELGHAVAATRQPLGCSHLLLPPKA

SEQ ID NO: 96326 - protein, 49 aa, Glycine max
  Coding DNA Sequence Number=SeqID_4641
MASYGVASPLSLPFSIPLPFIFQEAKESIDEEDPRPTSSNGACIKIDES

SEQ ID NO: 96327 - protein, 103 aa, Glycine max
  Coding DNA Sequence Number=SeqID_4642
MPASCKASKINLLEVTMSFICLGLYSPHAPIAFTAGPRTARMNAPECLRDTRRLAIKDGNKSLYDIGIKENSGSFFTEGFLPRLELVPELKSPVGQGLAGAGA

SEQ ID NO: 96328 - protein, 255 aa, Glycine max
  Coding DNA Sequence Number=SeqID_4643
MLPFDSRHVAELHGSPNDGCQTPRSGQAKVASHQTDDPSVLSSEGKGRNSYPGSRFMAEGLRFWLKRLAEGRTWRMSGRKSNISAMSSSSWASSTPPEAPARPPWPQTTQEWAKGKDWGPDFVGAVLSYASDRRWTSKTIPPLEAAVAHLQLVVGPPLATRAPSPAPAHAWGAVFLDEGPINRRLGDLAGGDGHSVELTEARNQSRKPQGPVGLLQVHRVSRQSLVASGRLQGLKSRLQGFFRNFNVRHIRRTAY

SEQ ID NO: 96329 - protein, 117 aa, Glycine max
  Coding DNA Sequence Number=SeqID_4644
MSRNFTDRLTMGVKHLEAIKRRTSFGRSISPPAEPFPLHPIVSAQQRRIPRVAGLKCFRMTRGQKTMSVSSRQRARLPLVDERVQKTTLVSVCYQTWSLTDSKRVWMTIICLRVPTD

SEQ ID NO: 96330 - protein, 389 aa, Glycine max
  Coding DNA Sequence Number=SeqID_4645
  Homolog annotation: Hit_ID=Q6WAY6; Match level="QueryCoverage=82%, HitCoverage=63%, E-value=4e-19, Identity=24%"; Hit description =Putative uncharacterized protein
GKARDMANQEEWVPFMDVLALLIFGVVLFPKVDGLVDLAAIDAFLAYHHSKESPVVAVLADLFDTFYRRTVNWFPRWKEGKEGVLFSCGGYPNIPLIGTRGCINYNPTLSISQLGYPMRGAPTEESLSPFLVRDFGVQNFKVIQRVHKAWESPLRKDKELRGIRNGIIGGYHEWLKGEVEAPEEDEEVQALRTELEQAQTVKERFKSVALRIRKENAELRDVNVATTKALEQETKRARREEHGRNKFRGALWGSNNELKLRREERDQSRVDSLILKDELKACSRSKRSLSQRLCETETNMLAIISKYQEELSLAMTHEHRVVDKYAQVYAEKEARGRVIDSLHQEATMWMDRFALTLNGSQDLPRLLAKAKANGGHLLRPRGDPQTSRL

SEQ ID NO: 96331 - protein, 468 aa, Glycine max
  Coding DNA Sequence Number=SeqID_4646
  Gene Ontology: Mol. function=glycerol kinase activity; Cellular component=mitochondrial outer membrane; Biological process=glycerol -3-phosphate metabolic process
  Homolog annotation: Hit_ID=Q0K1Y4; Match level="QueryCoverage=93%, HitCoverage=85%, E-value=1e-154, Identity=63%"; Hit description =Glycerol kinase
  Pfam annotation: Domain name=FGGY_C; Domain location=209-438; Score =89.8; E_value=8.5e-24; Accession=PF02782.7; Description=FGGY family of carbohydrate kinases, C-terminal domain
  Pfam annotation: Domain name=FGGY_N; Domain location=1-206; Score= -47.9; E_value=5.9e-07; Accession=PF00370.12; Description=FGGY family of carbohydrate kinases,
  Pfam module annotation: Pfam domain module=FGGY_C::FGGY_N; Domain location=209-438::1-206
MVKDGTSYVEINVSFSPKVVAQLRRINRAIRIYSLAKQIATAVLWDTATGRALVPAMVWQDTRYVDELDRLAPAWNPLLLEQVGRPAGVRSQYLWAARHLRDSPAVAQAWRERRLAFGTVDTWLLWHMSDRRECVTTPTNATSAGAYVLSGHRYYLDWIDALEFPRELLPALRQEADDFGQTREDILGLAVPIRASAGDQHAGAVGLGCKDRGQAKCVHGTGSFVDLIIGPEAPVNSGRYEGSLTMTARRQDQVSQFAVETFVATTGSALNWVCDKLKWFRNAQEISELAATAQSAGGVTFIPALTGLRVPRMAAGARASLTGISMATTQAEVAYAILEGIAHSVASCIEADEEVSGVQVSELVVGGGLSSSDPLLRIQADLLGIPIRRMQEADRASLRGAAFLAGASGLLWPSLQAARQTAATDAVFQPTLAAEARARRRALWHSRVESELAHAGLYSQDKQEALRT

SEQ ID NO: 96332 - protein, 193 aa, Glycine max
  Coding DNA Sequence Number=SeqID_4647
  Homolog annotation: Hit_ID=A5BEY3; Match level="QueryCoverage=95%, HitCoverage=17%, E-value=5e-21, Identity=33%"; Hit description =Putative uncharacterized protein
ELRKFLVADSLEEVNKKLDKFYMVLILRSLHSDFDHVHDQVLAGDQVPSMDSLITRLLRVPHSLKDENPADGVETLDMVASRGRGGSRNNRGGHSGKGGRPHCTYCKRMGHTQENFYSLHGFPDKVAQVSKLEKAESRFSDEEYQEYLKLKSEKPSNQAQSSSVPCFSTACISQSIEGSSPWILESGASDNIS

SEQ ID NO: 96333 - protein, 130 aa, Glycine max
  Coding DNA Sequence Number=SeqID_4648
MGQACVFPLKKHLMKLITWETSLDKILMQVDFLDFNMGNLTNSIINGEITMVSLTNHKSTESAIKNLEVQNLKEECKAAMTRGRKVTMEEEKKMKKMVEDDKQQLVIEPTPKPLQPFCELIKEEEEEEDE

SEQ ID NO: 96334 - protein, 314 aa, Glycine max
  Coding DNA Sequence Number=SeqID_4649
  Gene Ontology: Mol. function=gamma-glutamyltransferase activity; Cellular component=periplasmic space; Biological process=glutathione biosynthetic process
  Homolog annotation: Hit_ID=A6TF60; Match level="QueryCoverage=92%, HitCoverage=50%, E-value=1e-154, Identity=92%"; Hit description =Gamma-glutamyltranspeptidase
  Pfam annotation: Domain name=G_glu_transpept; Domain location=1-314; Score=269.8; E_value=5.5e-78; Accession=PF01019.12; Description =Gamma-glutamyltranspeptidase
LADDLKTYGSEVIPNHENSKAIFWKDGEPLKKGDRLVQKNLAKSLELIAENGPDAFYKGAIADQIAEEMKKNGGLITKADLAEYKAVEREPISGTYRGYEVFSMPPPSSGGIHIVQILNILENFDMHKFGFGSADAMQVMAEAEKRAYADRSEYLGDPDFVKVPWQALTNKAYAKSIADEIDINKAKPSSEIRPGKLAPYESNQTTHFSVVDKDGNAVAVTYTLNTTFGTGIVAGNSGILLNNEMDDFSAKPGVPNVYGLVGGDANAVGPKKRPLSSMSPTIVVKDGKTWLYRFWDERRRSDQRAAFSSPVAAG

SEQ ID NO: 96335 - protein, 243 aa, Glycine max
  Coding DNA Sequence Number=SeqID_4650
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
FGTSYVPINVSFSPKVGPGLPRYQQGHQDLFILRSDLPSQWLLFLSAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 96336 - protein, 75 aa, Glycine max
  Coding DNA Sequence Number=SeqID_4651
MTTKVMNKKLKRSKNNSSESKNISSESRTSQEFKNQEELKTQEESLQTKIKIQESRIKTQDLKNQDQDSRFKIQE

SEQ ID NO: 96337 - protein, 63 aa, Glycine max
  Coding DNA Sequence Number=SeqID_4652
MTKARQNGVRKGKEGEACQPAHPGELGCFLQKAPPSGGVEAKLHDESKMIQRCFDDKNDDNKR

SEQ ID NO: 96338 - protein, 109 aa, Glycine max
  Coding DNA Sequence Number=SeqID_4653
MSSGPPPLDDRNDQIFLCLSSGPPPLDDKRVRITVRYLRVSSGPPPLDDYKGADNRNGSPSSGPPPLDDKRVRITDKGQYDKDYGATDKSKALAPTYPPMRNSDLRSSG

SEQ ID NO: 96339 - protein, 42 aa, Glycine max
  Coding DNA Sequence Number=SeqID_4654
MADEFATLASMFQLTPHGDLPYIEFRCRGRPAHCCLVEEEWD

SEQ ID NO: 96340 - protein, 122 aa, Glycine max
  Coding DNA Sequence Number=SeqID_4655
  Gene Ontology: Mol. function=peptidase activity
  Homolog annotation: Hit_ID=Q8H6W2; Match level="QueryCoverage=71%, HitCoverage=93%, E-value=1e-11, Identity=37%"; Hit description=Gag -protease polyprotein-like protein
MASSNSLFPEGNSIHRPPIFNGEGYHYWKTRIQIFIEAIDLNIWEAIEIGPYIPTVVDVSTSTTTQKSRDKWTEEDRRRIQFDALEQQVDMRFNEMNSRITKVEEDVTFIHTCFDLPPPPPP

SEQ ID NO: 96341 - protein, 339 aa, Glycine max
  Coding DNA Sequence Number=SeqID_4656
  Gene Ontology: Mol. function=protein binding; Cellular component =integral to membrane; Biological process=defense response to fungus
  Homolog annotation: Hit_ID=Q949G9; Match level="QueryCoverage=94%, HitCoverage=85%, E-value=9e-58, Identity=32%"; Hit description =HcrVf1 protein
  Pfam annotation: Domain name=LRRNT_2; Domain location=27-67; Score =51.4; E_value=3.1e-12; Accession=PF08263.3; Description=Leucine rich repeat N-terminal domain
  Pfam annotation: Domain name=LRR_1; Domain location=112-137; Score =10.3; E_value=3.8; Accession=PF00560.24; Description=Leucine Rich Repeat
  Pfam annotation: Domain name=LRR_1; Domain location=139-161; Score =13.8; E_value=0.66; Accession=PF00560.24; Description=Leucine Rich Repeat
  Pfam annotation: Domain name=LRR_1; Domain location=163-186; Score =0.9; E_value=2e+02; Accession=PF00560.24; Description=Leucine Rich Repeat
  Pfam annotation: Domain name=LRR_1; Domain location=213-234; Score =13.0; E_value=1.2; Accession=PF00560.24; Description=Leucine Rich Repeat
  Pfam annotation: Domain name=LRR_1; Domain location=239-261; Score =9.1; E_value=6.2; Accession=PF00560.24; Description=Leucine Rich Repeat
  Pfam annotation: Domain name=LRR_1; Domain location=263-288; Score =5.0; E_value=36; Accession=PF00560.24; Description=Leucine Rich Repeat
  Pfam annotation: Domain name=LRR_1; Domain location=290-312; Score =6.3; E_value=21; Accession=PF00560.24; Description=Leucine Rich Repeat
  Pfam annotation: Domain name=LRR_1; Domain location=314-336; Score =11.7; E_value=2.1; Accession=PF00560.24; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1; Domain location=27-67::112 -137::139-161::163-186::213-234::239-261::263-288::290-312::314-336
MNSSSIYILVFVQLWLLSLPCRESVCIPSERETLLKIKNNLNDPSNRLWSWNPNNTNCCHWYGVLCHNVTSHLLQLHLNTTFSAAFYHFDEEAYEKSQFGGEISPCLADLKHLNYLDLSGNEFLGEGMSIPSFLGTMTSLTHLDLSGTGFMGKIPSQIWNLSNLVYLDLTYADGTIPSQIGNLSNLVYLGLGGHSVVEPLFAENVEWLSSMWKLEYLDLSNANLSKAFHWLHTLQSLPSLTHLYLSGCKLPDYNEPSLLNFSSLQILDLSRTSYSPAISFVPKWIFKLKILVSLQLWGNEIQGPIPGGIRNLTLLQNLDLSGNSFSSSIPDCLYGLHRL

SEQ ID NO: 96342 - protein, 140 aa, Glycine max
  Coding DNA Sequence Number=SeqID_4657
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=61%, HitCoverage=72%, E-value=2e-24, Identity=68%"; Hit description=LacZ protein
MKHFTDTLISANINILSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 96343 - protein, 163 aa, Glycine max
  Coding DNA Sequence Number=SeqID_4658
INLALVKEFYANLYSSEGPSPKQVKVRGHVVKIDADSLNTFLETPVVLAEGETLPVYSKYCRLPTDIREIEAALCILGQGFDLHAEGHPGKILKKDLTTLAQMDMNVGAFISSQITSMAQSNSSRLGFLALITALWSFISGNWSDSKVLDSVWLSCRTFTRNR

SEQ ID NO: 96344 - protein, 179 aa, Glycine max
  Coding DNA Sequence Number=SeqID_4659
MSPTRHPLDPDKSNRALGSPALITGLCQSFGVPVTPIKVIRPPITRAFIEKYCTPRQAEGDAPQGAGAPSPPHQVGPAGSLGMECCLPHLVCQQAANHRGQVQIHECLYRFSRSQQGQSSTPFVCPTPEQFAAEVAWPGDWPDAKAGEEPAGSPGRIDEPRMDEDMTDLFDFLGGSGAT

SEQ ID NO: 96345 - protein, 72 aa, Glycine max
  Coding DNA Sequence Number=SeqID_4660
MSYRMSRHHASEHADYMCPYEQIKQVHALLGSFNSENWSDSYNLIGQRNEEGREREETSLQGEDESRRSSLP

SEQ ID NO: 96346 - protein, 262 aa, Glycine max
  Coding DNA Sequence Number=SeqID_4661
MASRKRKSISTRPTSQYDTKRFSSLDAWTKYTDNVIGRNILPERKLELYHTELNDFKAELERRNFHKCLTNLVDGSIDLALVKEFYANLYSSEDHPPKQSRVRGHLVKIDADSHNTFLETPVVLAEGETLPAYSRYCRLPTDFREIEVALCILGRGFILNSEGQPGKILRKDLTTLAQVWSVLSYSNLAPTSHTYDLTVDRARLIFGLVSHLDMNIGVLISGQMTSIAQSNTFRLGFPALITALCRARGVVSDSLTFKRLSP

SEQ ID NO: 96347 - protein, 172 aa, Glycine max
  Coding DNA Sequence Number=SeqID_4662
  Gene Ontology: Mol. function=asparaginase activity; Cellular component=cytoplasm; Biological process=glycoprotein catabolic process
  Homolog annotation: Hit_ID=A6X3I8; Match level="QueryCoverage=98%, HitCoverage=54%, E-value=1e-91, Identity=95%"; Hit description =Peptidase T2 asparaginase 2
  Pfam annotation: Domain name=Asparaginase_2; Domain location=1-171; Score=-26.2; E_value=3.8e-10; Accession=PF01112.9; Description =Asparaginase
MAPEWFSTEQRRKALHDEMERRRSGAADDGDPARKHGTVGAVALDSFGHLAAATSTGGMTAKTPGRVGDSPVIGAGTWADDQTVALSATGHGEYFIRWAVGHEIDARMRWAGQSLDEAAGTVVRELGEIGGSGGLVAVDRKGNVSLPFNSPGMYRAWCGTDGEIHTGIYGLD

SEQ ID NO: 96348 - protein, 110 aa, Glycine max
  Coding DNA Sequence Number=SeqID_4663
MVPRKLASKRSRKDKAAEGTSSAPEYDIHRFRSAEHQQRFMDIKGWSFLRERRVQLRDDEYTDFQEEIVRRRWASLVTPMAKFDQDIVLEFYANAWPTEEGVRDMRSWVR

SEQ ID NO: 96349 - protein, 80 aa, Glycine max
  Coding DNA Sequence Number=SeqID_4664
MAERREGNRPPRRTLVIPPFSNKVMELKPALLSLISSHPFAGLDYEDPYTHLSTFMELCITMGAFDEDAEAVYLRAFHFH

SEQ ID NO: 96350 - protein, 103 aa, Glycine max
  Coding DNA Sequence Number=SeqID_4665
  Gene Ontology: Mol. function=aspartic-type endopeptidase activity; Biological process=RNA-dependent DNA replication
  Homolog annotation: Hit_ID=Q2QY59; Match level="QueryCoverage=95%, HitCoverage=13%, E-value=4e-09, Identity=36%"; Hit description =Retrotransposon protein, putative, unclassified
MAPLPKGFKIPYFTTFSDEDGKSTMVHIVRFTTQCGEVEVSLTWYSTIADLMNMKQLVDKLVMDFIERFRNDGNRCLVKLPEIECATMVVGNMRPQLKEKLVA

SEQ ID NO: 96351 - protein, 458 aa, Glycine max
  Coding DNA Sequence Number=SeqID_4666
MVVCDGGSRLSVWVWLGVGRVGGALIGGGGCIGGSGIGVVVTLNKCIWACCKLRMRDSPRNKVDSIASLDDASCEVDSVGASSILAFGCITTMNRVDSTILNASVVASIASTSASGSRPQGSSQSKHLRHQSGAGSFGVIPHRLIPLGLSIICVKLSDEFLALEQSFSNSGEVLGRLYQAMPIHLLMRSPKGYAVVGAEPKCAPPWKIVLEEWNGPLRAQEIDKGHPEPLWHLGAEQHIQQKEYGHTRTTSIEGLQLLLHVDPSTGNLDVLIGERGFLVVTGGGLDGCGLGVGVASLLDELEPSEHGILMGSFGVEDLHPTLVQTTEVLLSGNKSSLADDGELGVFVQFFKDMEYLVFLEKFVDEGGIVDVIHSSQGLHVHEYVNVDWVWKLWVIEITVDSAKKQNVLYVETKTFQHINVKVVFNVNSRFSINLDGSGVCDDNGGGKGSVFTGVRHGE

SEQ ID NO: 96352 - protein, 88 aa, Glycine max
  Coding DNA Sequence Number=SeqID_4667
  Subcellular localization annotation: CTP_CleavageSite=20; ConfidenceScore=5.16e-01
MQMLSASSWDIRWCWKRARSASMARGGTGLMGSMRRPSPSCYVCRMYAGAGFCPDCCREASANYAHQHDHPNSYMDDFAAQQHPAHRP

SEQ ID NO: 96353 - protein, 68 aa, Glycine max
  Coding DNA Sequence Number=SeqID_4668
MPDGDIRFTLATTLVAEIATALASIIFFTLIMASIIVAIFSFMASMPAFTFSCTSSALPITLALAQVR

SEQ ID NO: 96354 - protein, 149 aa, Glycine max
  Coding DNA Sequence Number=SeqID_4669
  Homolog annotation: Hit_ID=Q6UUU1; Match level="QueryCoverage=40%, HitCoverage=40%, E-value=9e-19, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNWTVCTNPPFSPTAAPYPELVLKSAPVKAKLKGQVLVTALLRASYL

SEQ ID NO: 96355 - protein, 78 aa, Glycine max
  Coding DNA Sequence Number=SeqID_4670
  Gene Ontology: Cellular component=chloroplast
  Homolog annotation: Hit_ID=Q49KT9; Match level="QueryCoverage=43%, HitCoverage=30%, E-value=4e-12, Identity=97%"; Hit description =Putative uncharacterized protein ORF113
MGAGHARSRYLNRKEGDAEGRASDWSEVVTRSAPPDNCVVVPGTVRALSHMDSLMCSSAPDPEMWIIQGTLAWRTSPV

SEQ ID NO: 96356 - protein, 179 aa, Glycine max
  Coding DNA Sequence Number=SeqID_4671
MREKKEKENSEAPQRNRKKKSDTPERKSDTHERKSDNSNELIVYVFPSVQPLLQEFKNVFPKEITHGLPPSRSSEHQVQIAKKNESYAKQTNKNRKEVVLEPSDDPRHLRANVFQEGGNDENPKTTQIEGPMTRSRTKKSVDTLQQMVAGILSKAQVEKDEGPEAEALPRISIFAEGPD

SEQ ID NO: 96357 - protein, 282 aa, Glycine max
  Coding DNA Sequence Number=SeqID_4672
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMLEEGRDKRALWKMWSEIHNRVRPQVGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 96358 - protein, 155 aa, Glycine max
  Coding DNA Sequence Number=SeqID_4673
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
  Subcellular localization annotation: CTP_CleavageSite=30; ConfidenceScore=5.06e-01
MDFKHPLVVGLYYGFLTTFSIGPSYLFLLRASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 96359 - protein, 42 aa, Glycine max
  Coding DNA Sequence Number=SeqID_4674
AHSTSVKSIILHRLWIDVVDDDVKRGWCFTTVIGNDVEWREF

SEQ ID NO: 96360 - protein, 55 aa, Glycine max
  Coding DNA Sequence Number=SeqID_4675
MSEIKEVQERMKADIEALKEQMTTMMEAVMSMKKIMEINAAVLRKKTQSFKNLMI

SEQ ID NO: 96361 - protein, 107 aa, Glycine max
  Coding DNA Sequence Number=SeqID_4676
EDEGPTTQVPQQVKDESSEATIPEPFFIREEAEKTQVRQVAAATPERSIKATSEPSAQREDIPSPQPAIDPSTPLLERPEDLNTSVLAMDTSPPTTPVLHLTDEEDL

SEQ ID NO: 96362 - protein, 77 aa, Glycine max
  Coding DNA Sequence Number=SeqID_4677
MRGTMHEPQANLGQIKSSHSVKKRLCYEALKVTVELSSSVGLSVHPSISTTSACLARQRNLAEHQYQGRALSARSVR

SEQ ID NO: 96363 - protein, 159 aa, Glycine max
  Coding DNA Sequence Number=SeqID_4678
MQLLCIPGQDFTSAAVERRVRIVRTNMTTLTRIWVVPTRHPVDPGKSNKALGFPARVTGLCQSYRVFVPPARSYHRDIGIVPARHPMDPEKSNRVLGFLALITDLCQFYKVPVAPNKVIRPPLTELSSRSTAPSGRCRARHHISLGMADSGQQAHRHHL

SEQ ID NO: 96364 - protein, 99 aa, Glycine max
  Coding DNA Sequence Number=SeqID_4679
MLLKYYYVAKTLIANFACFEMYYIPWESNTRTNLLSKMASTKKIGHLKTIIQDTLQTPTIDSEEVMAEEEDEPNLMTPYKNFLIQGVLPSNKNVARSLK

SEQ ID NO: 96365 - protein, 158 aa, Glycine max
  Coding DNA Sequence Number=SeqID_4680
LLLVEQQPPCQWFPDFNGNYSVCAICESALRLIESRAQGPEDDSVGFLCMVVGLRMFDRGDKAILAYEVFLGELLHLIGYNFSQWSCLDPLGEVIDVTSRYLTAPRAFGSGPNMSIPYMAKCQWELKLWRLSRGHASPLLQGIIPLYGNHKFLHGILS

SEQ ID NO: 96366 - protein, 216 aa, Glycine max
  Coding DNA Sequence Number=SeqID_4681
SSLSAENKKLEGKLDALVNLVTQLAINQKSTSAPVTVARVCGLCSSADHHTDLCPSLQQSGVNEQPEAYVANIYNRPPQQQNQQQNHPNLRWANPPQQQQQQQLVPPFQNVVGPSRPYVPPPIQQMTIQNMQFQQETRASIQSLTNQMRQMATQLNQAQSQNSDKLPSQTVQNPKNVSAITLRSGKQIEVPPPVAAPALEPVKLHSTPGKEDELAA

SEQ ID NO: 96367 - protein, 117 aa, Glycine max
  Coding DNA Sequence Number=SeqID_4682
RHHFIPFAHPEHSITSEFVYSIIGDFEHPDFEHYNFEHSDFEHSENMAQPPPRERNLREMAAPDFTYESLCIQYPDEDVPYVLKTGLIHLLPKFHGLAGSGKGLAVLPCSKVHHELG

SEQ ID NO: 96368 - protein, 71 aa, Glycine max
  Coding DNA Sequence Number=SeqID_4683
MTVKKRLSHEVQKVTVELSSSIRLSAHPSLSAASACLARQKNLVDHQYQGRTLSVRSVRYAQRLSSARLSA

SEQ ID NO: 96369 - protein, 45 aa, Glycine max
  Coding DNA Sequence Number=SeqID_4684
MVHHQAEFENDAETKLSNEGKEKVHWPVMPYAFGTEPNGPVESDD

SEQ ID NO: 96370 - protein, 243 aa, Glycine max
  Coding DNA Sequence Number=SeqID_4685
MERVPICHISKSFVSAGWMHEDQVVVLGKETYQGQSNWVQSCSPGFKLKNWRIMERPEIFVSNPISNNESCESSDTEDPDVDFERLGLPPRFEENGGARRKRGEAALRGDKGCEFRHWCKEKGIQGWHLYLLEHPRWVSDSVARLPRHLRLVLLGYVWFELRYYATHAIFESQVLPGKAKIEDNETRDVPKDKGGDEEAVQRWFLGRCSVPRMGRQYRASPGKEWEGANVRGLLGSKLSQSKG

SEQ ID NO: 96371 - protein, 76 aa, Glycine max
  Coding DNA Sequence Number=SeqID_4686
  Gene Ontology: Mol. function=hydrolase activity, acting on glycosyl bonds; Biological process=metabolic process
  Homolog annotation: Hit_ID=A6X6W9; Match level="QueryCoverage=65%, HitCoverage=12%, E-value=5e-21, Identity=96%"; Hit description=Lytic murein transglycosylase precursor
  Subcellular localization annotation: CTP_CleavageSite=63; ConfidenceScore=5.37e-01
MKLKAATVAIAALASTLTTGSALADAQFRQWVASFRPVAIKAGVSPSTFDRAFRGVDAPDPVVLQKARYQPEFTEP

SEQ ID NO: 96372 - protein, 213 aa, Glycine max
  Coding DNA Sequence Number=SeqID_4687
  Gene Ontology: Cellular component=integral to membrane; Biological process=transport
  Homolog annotation: Hit_ID=A8GAX3; Match level="QueryCoverage=21%, HitCoverage=5%, E-value=5e-16, Identity=91%"; Hit description =Putative uncharacterized protein precursor
  Subcellular localization annotation: CTP_CleavageSite=84; ConfidenceScore=5.12e-01
MDEGIAGRLKIKLGDTLTISGDTQAFSAKVTSLRQVDWESLKPNFTLSSRRARWTASRRPGLPASATTATPDGHRRDPETGRRRAAAGQPRAGGDGGAGGAVRRPAAAGTGAGRHASAPPGAGGVPHAGRRQTAAAPHAVVRVRPAGAGGGHRGGGGRRGGAVAAAEPGVRLPVDADAGAVVGIAAGQRAAAVAVRRLAGRAPAARPGAVPQL

SEQ ID NO: 96373 - protein, 215 aa, Glycine max
  Coding DNA Sequence Number=SeqID_4688
MKLCFHIPSLRTTKRKEDEAPEEDEEVQALRAKLGQAQTVKERFKSAALKIRKENTKLRDVNVATTKALERETKRACREEHDRNKFRGAQWGSNSELKLRREEMDQSRTNMLAIITKYQEELNLAAAHEHRVADEYAQVYAEKEARGRVIDSLHQEATMWMDRFALTLNGSQELPRLLAKAKAMADTYSAAEEIHGLLGYCQHMIDLMAHIIRNR

SEQ ID NO: 96374 - protein, 122 aa, Glycine max
  Coding DNA Sequence Number=SeqID_4689
MVTTKRLLESLLLFLTCMSSVSTLEGVVVSLFFFFFPFILSLPSPTRHTDTPNIIYINKQHCRNVIILILCSFDSTDGRCTLPQTITAAPPTTLLTSPLTPHRPPLDSRHPRLRPPMARRRH

SEQ ID NO: 96375 - protein, 56 aa, Glycine max
  Coding DNA Sequence Number=SeqID_4690
MEEFKKMIIKDSIYRSKSKFTEKMTTSNEVDEAQIKKEMDGEILYRKVLKEKEKSE

SEQ ID NO: 96376 - protein, 272 aa, Glycine max
  Coding DNA Sequence Number=SeqID_4691
  Homolog annotation: Hit_ID=Q6WAY6; Match level="QueryCoverage=86%, HitCoverage=43%, E-value=1e-16, Identity=26%"; Hit description =Putative uncharacterized protein
TGVLVSCGGFPNVPLMGTRGCISYNPVLTIRQLGYPMKGAPLEEELAPVISRGFSETNVETLRKVRKAWEVVQKKDKELKGHNNGPIGGYREWLKALVQGLDWLPNLRTAKREEVEAPEEDEEVQALRIELEQAQTVKERFKSVALRIRKENAELRDVNVATTKALEQETKRARREEHGQNKFRGALWGSNNELKLRREERDQSQTNMLAIITKYQEELDLATAHEHRVADEYAQVYAEKEARGRVIDSLHQEATMWMDRFAFTLNGSQELP

SEQ ID NO: 96377 - protein, 79 aa, Glycine max
  Coding DNA Sequence Number=SeqID_4692
  Pfam annotation: Domain name=zf-CCHC; Domain location=30-47; Score =12.6; E_value=0.019; Accession=PF00098.14; Description=Zinc knuckle
RFNKFIRNKGNQRRTNFNPKKKGEDSPSVPKCYECNQPRHLRVEYPSFKKRMEKSDKKNFKDKKAKKAYITWEDNDIDS

SEQ ID NO: 96378 - protein, 74 aa, Glycine max
  Coding DNA Sequence Number=SeqID_4693
FYGVPVAPNKVIRPPINRAFIKKYCAPQAGARQDTTAAWGWPAVGNRLTAATSRAPQLIYKAWRVAYDPWPTSR

SEQ ID NO: 96379 - protein, 69 aa, Glycine max
  Coding DNA Sequence Number=SeqID_4694
IAPVRHPVDPKKPSRVLGFLALITGLCQFYGVPVAPNKVIRPPINRAFIKKYCTPRQAQGETPQQPGDG

SEQ ID NO: 96380 - protein, 501 aa, Glycine max
  Coding DNA Sequence Number=SeqID_4695
  Gene Ontology: Mol. function=diaminohydroxyphosphoribosylaminopyrimidi ne deaminase activity; Cellular component=riboflavin synthase complex; Biological process=riboflavin biosynthetic process
  Homolog annotation: Hit_ID=A6T5E7; Match level="QueryCoverage=63%, HitCoverage=86%, E-value=1e-133, Identity=74%"; Hit description =Bifunctional diaminohydroxyphosphoribosylaminopyrimidine deaminase/ 5- ...
  Homolog annotation: Hit description=amino-6-(5-phosphoribosylamino) uracil reductase
  Pfam annotation: Domain name=DMRL_synthase; Domain location=355-499; Score=306.6; E_value=4.6e-89; Accession=PF00885.10; Description=6,7 -dimethyl-8-ribityllumazine synthase
  Pfam annotation: Domain name=RibD_C; Domain location=111-325; Score =224.3; E_value=2.8e-64; Accession=PF01872.8; Description=RibD C -terminal domain
  Pfam annotation: Domain name=dCMP_cyt_deam_1; Domain location=1-64; Score=45.3; E_value=2.1e-10; Accession=PF00383.13; Description =Cytidine and deoxycytidylate deaminas
  Pfam module annotation: Pfam domain module=DMRL_synthase::RibD _C::dCMP_cyt_deam_1; Domain location=355-499::111-325::1-64
IVGEGWHQRAGEPHAEVHALRMAGDHARGATAYVTLEPCSHHGRTPPCCDALIAAGVSRVVAAMQDPNPQVAGRGLYRLQQAGIDVSHGLMMNEAEALNRGFLKRMRTGFPWIQLKLGASLDGRTAMASGESQWITSAAARRDVQRLRARSSAILTTSATVLADNPSLTVRWDELSETVRQQLDESQLRQPVRVVIDSQQRVTPQHRLIAQPGETWLMRTEADAQSWPPGVSQIEVPPRGEQLDLVAMMMLLGQRQINSVWVEAGAGLAGALLQAGLVDELIVYLAPKLLGNAARGLCALPGLETLADAPALNFSDVRQPERVAEEYDRIRPLLRGHKTNTQRICMKVIEAAVATPDANIAIVIARFNNFINDSLLDGAVDALKRIGQVKAENITVVWVPGAYELPLAARALAKTGKHDAIVALGTVIRGGTAHFEYVAGEASSGIAHVAMNSEIPVTFGVLTTENIEQAIERAGTKAGNKGAEAALTALEMINVLKAIKA

SEQ ID NO: 96381 - protein, 315 aa, Glycine max
  Coding DNA Sequence Number=SeqID_4696
  Gene Ontology: Mol. function=transporter activity; Cellular component= outer membrane; Biological process=transport
  Homolog annotation: Hit_ID=Q0BAX0; Match level="QueryCoverage=84%, HitCoverage=54%, E-value=2e-34, Identity=32%"; Hit description=Outer membrane efflux protein precursor
  Pfam annotation: Domain name=OEP; Domain location=2-169; Score=23.4; E_value=0.00049; Accession=PF02321.9; Description=Outer membrane efflux protein
MVARALAYSRELRAASAEVRLGVTSPLSTVGGDRQSSSNNSHISDSSGTVSVNTPIIDWGRISNQVDNSLETAKAARYSKEYSREQLAYNTVSELMNMGRYQRSKVVAKQYVGRMKELVTMLSQITQADRGRESELVQAKAKLMSAQASLDNIEHQLSASKIKLVRLLGIEPELPEGISWHDTVIPASVALSALDKNPMMLNLQSKVRAAEYEAESIKSSALPQVNWVISKSTAKDSNGNEAGWYTGLNVEWEAFSGGSQRAAEMSARAKANMAQQQYEVSYKDLEYQINYQIQVRDSSFLRADDYDRLSGETDR

SEQ ID NO: 96382 - protein, 158 aa, Glycine max
  Coding DNA Sequence Number=SeqID_4697
MPISLCRCISWDRAHKTPSGPEEVQQGPGVSSSGYGPLSVLQGSRSPSKESLPQRHPVDPEKSNRALGDPQDTQWTRRSPTGSWSCQALITGLCQFYGVPVTPSTVIRPPTNRAFIKKYCVPRQAQGKTPQQPGDGRQRATDAPSSPLEFTSAHPQKG

SEQ ID NO: 96383 - protein, 43 aa, Glycine max
  Coding DNA Sequence Number=SeqID_4698
MEVGSWKWKLLEVGSGSYWKLEVGNESYWKLKVENEGWKLEGE

SEQ ID NO: 96384 - protein, 81 aa, Glycine max
  Coding DNA Sequence Number=SeqID_4699
MTVDVGQESPCGEGRRPMWRGAKAHVEKDKAPEWRRMKAQVEKDERPEAETLLRLLIVAEGPSGEGRRPMWRRTKPPSGEG

SEQ ID NO: 96385 - protein, 197 aa, Glycine max
  Coding DNA Sequence Number=SeqID_4700
MPKCPAGVRHPDTDEHPCMAPTRHPLDPDKSNRALGFPALITGLCQSFGVPVAPTKVIRPPITRVFIEKYCTQRQGQGDAPQAAGAPPPPHQAGQAGAFDMEQYLRHLVRQQAANHRAHVRTHDCLYQMSLSMQSQGFASFSCPTPDQFRAEVAWPGDWPEAQAGEAPPEAPGDGEEAHEDEEMADLLDFLGGSGDT

SEQ ID NO: 96386 - protein, 108 aa, Glycine max
  Coding DNA Sequence Number=SeqID_4701
MIESFQQQQQMSVLELYVEKDIAGGSMFHAANSVTSCGHNNVSHHESELPRNINNLHDDEDDDMMIILRLTHMLKSLSKKMILLMEYLIQTMKSPTSLNQFQLFIQLK

SEQ ID NO: 96387 - protein, 115 aa, Glycine max
  Coding DNA Sequence Number=SeqID_4702
  Homolog annotation: Hit_ID=A5BP71; Match level="QueryCoverage=65%, HitCoverage=19%, E-value=1e-11, Identity=46%"; Hit description =Putative uncharacterized protein
  Pfam annotation: Domain name=zf-CCHC; Domain location=88-105; Score =17.9; E_value=0.003; Accession=PF00098.14; Description=Zinc knuckle
MVVIVNAEACGYVSMNYYQYIDVVYTNEHILKAYSAQWWPLGNEAAIPPSDDAWTLIPDPTTIRAKGRPKSTRIRNEMDWVEPSEHRTKCSRCGAEGHNRRRCPMQSERGSCSNP

SEQ ID NO: 96388 - protein, 111 aa, Glycine max
  Coding DNA Sequence Number=SeqID_4703
MEEVQEGLEFPLAQRWSHPRTETNIPTNSFLWTPYDTLEIRPLINDVEGEQIFFGLTIIITGLPNGIIGMIILFMVKWAKVFCMKIQNTCNGIYVELDDIYPVKEHYLLRL

SEQ ID NO: 96389 - protein, 71 aa, Glycine max
  Coding DNA Sequence Number=SeqID_4704
MSCTSSLSAPLHLSKCTASVHPLSEKGSLDWDSELCLSRVSRERKVQVPESFERFCCVKIYRDQSLKQEPV

SEQ ID NO: 96390 - protein, 82 aa, Glycine max
  Coding DNA Sequence Number=SeqID_4705
MYPNLQPFLPRKVDTLHMVTTTKRLFAMRRYGGGMLYAALSLHVQDDIVQEKDDLPKEWKTSRNHPLDNIIEDISIRSDLAA

SEQ ID NO: 96391 - protein, 101 aa, Glycine max
  Coding DNA Sequence Number=SeqID_4706
MTQSTSSAKLLSLEFAQSFCFNFERLDILRDSCMPAGRLRAKKLLSFEFWRASVIQFERLELLRDSSDIRVKSYCLLNLLRASVFNFERLKLYTGLNQTSE

SEQ ID NO: 96392 - protein, 35 aa, Glycine max
  Coding DNA Sequence Number=SeqID_4707
  Subcellular localization annotation: CTP_CleavageSite=5; ConfidenceScore=5.05e-01
MGSPPASAPPPPPSTSDASASPSAVKRTHKASRLR

SEQ ID NO: 96393 - protein, 89 aa, Glycine max
  Coding DNA Sequence Number=SeqID_4708
MKKLCSIIGPGIGHAVIHEEGLCCRQYIPCKTTARPSRHASRSTLEDPPIEVIGDFTAAEGREFLQNYALPGYGHTTELTNDQWSAIFQ

SEQ ID NO: 96394 - protein, 88 aa, Glycine max
  Coding DNA Sequence Number=SeqID_4709
MAKDFERTLLCEEEGLVEAKLHGESKNNSRVQDKNQEEFKTQEESLESRIKIQGSRSQESRSRFKTQDSRIKRRLNQDKYEKFFSKIE

SEQ ID NO: 96395 - protein, 71 aa, Glycine max
  Coding DNA Sequence Number=SeqID_4710
MSFMGDEDDAKEQAKEVAVEVVKAEDVIAMMLEGEGDIRVNEASGTVDEDEKARGGSLGDKGRGQRVIRRQ

SEQ ID NO: 96396 - protein, 162 aa, Glycine max
  Coding DNA Sequence Number=SeqID_4711
MDDFSEHKDQELFHHNNDQSDDEGVAVTTSPLLQYHQPRCPVELNLDHLPQYIDYHHFVQQQDYVQPSTDALEVGMTIDEKAQYIQTVKEYNIRNHVDYKTIYFDQRKLNFVCKSHENGCTWSLAHAIQRSIRNELSIVLEALDLLHQWSPLLLEDEWQWNG

SEQ ID NO: 96397 - protein, 171 aa, Glycine max
  Coding DNA Sequence Number=SeqID_4712
  Gene Ontology: Mol. function=calcium ion binding; Cellular component =cellular_component; Biological process=defense response
  Homolog annotation: Hit_ID=Q5ZEX1; Match level="QueryCoverage=73%, HitCoverage=44%, E-value=2e-45, Identity=70%"; Hit description =Lectin precursor
  Pfam annotation: Domain name=Lectin_legB; Domain location=2-148; Score=12.1; E_value=3.3e-11; Accession=PF00139.10; Description =Legume lectin domain
MIHNFLGTFDMLTEIACLHHLSIFYEFAIFKFLPRLYNFSGSATDYNQKWDPASRHIGIDVNSIKSVKTAPWGFANGQVAQILITYNADTSLLVASLVHPSRKTSYILSETVSLKSNLPEWVNVGFSATTGANKGFAETHDVFSWSFASKLSDGSTSDTLDLASFLLNEAI

SEQ ID NO: 96398 - protein, 136 aa, Glycine max
  Coding DNA Sequence Number=SeqID_4713
SQDEATTSPSSNENEEAIGEESREEIYPQEEGQPLMVKEECKEVSVSSKSGQGVPADPKRIKVILDWPTPPTPLIELVRNDAPSWEDVHEKGQILSKVEGMMQSYPVRVLDRRFQEDWARAAKEGLGVLMNRRVDF

SEQ ID NO: 96399 - protein, 89 aa, Glycine max
  Coding DNA Sequence Number=SeqID_4714
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P38417; Match level="QueryCoverage=93%, HitCoverage=9%, E-value=2e-31, Identity=79%"; Hit description =Lipoxygenase-4
STLEDPHASDEFYPGQRDGGEYWTSDAGPLEAFKRFGKNLEEIEKKLIEKNNDETLRNRYGPAKMPYTLLYPSSEEGLTFRGIPNSISI

SEQ ID NO: 96400 - protein, 201 aa, Glycine max
  Coding DNA Sequence Number=SeqID_4715
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLNHPTVEEKILAKLMVVLTSIRGGMQAWHWPSFYNVVTGKTLALPNLIALQHIPLSPAGVIAKRPAPIALPNSCAA

SEQ ID NO: 96401 - protein, 42 aa, Glycine max
  Coding DNA Sequence Number=SeqID_4716
MYEHEMPLKKLSTKRSRRDAAAEGSSATPEFDSHRFRSVKHQ

SEQ ID NO: 96402 - protein, 58 aa, Glycine max
  Coding DNA Sequence Number=SeqID_4717
MGDQSTSIKEFYIKAQQKFPTRALAFHGKLSPFSYNMGFWKQNSDYTVVGMSPPPLGT

SEQ ID NO: 96403 - protein, 194 aa, Glycine max
  Coding DNA Sequence Number=SeqID_4718
  Homolog annotation: Hit_ID=A6BLN7; Match level="QueryCoverage=96%, HitCoverage=35%, E-value=2e-08, Identity=24%"; Hit description =Putative transposase
  Pfam annotation: Domain name=Rep_fac-A_C; Domain location=86-194; Score=-57.6; E_value=0.012; Accession=PF08646.1; Description =Replication factor-A C terminal domain
SYPASVSNSFKASKLMINDLVLEIQEFRESLLDLGIEVRSILAPIGQGSSQVSGSSQLSSKDAFLSKTEVKNISQINASSEEFVCVTVVKDNYSWCYPACGQCYKKDDMQTVPFTCPCGKENDQPVLRYQVEVMVNHKGEQTKFLIWYRECAQLIGQSADEVNRLKIEDGDVDLNASPQALDRLLGCFLAFKVK

SEQ ID NO: 96404 - protein, 124 aa, Glycine max
  Coding DNA Sequence Number=SeqID_4719
  Subcellular localization annotation: CTP_CleavageSite=28; ConfidenceScore=5.67e-01
MGHQGHFQAPFSPISWLLMSRTSFGHVSSNRIRDRGNFSLLGQRCNFAPSGVVSGGTQLVQGANPMLACILHCFPVESFPFFLANEELDLLGGGNVGNFDAQGNSFNDSTADFLSFSWSCPEGS

SEQ ID NO: 96405 - protein, 163 aa, Glycine max
  Coding DNA Sequence Number=SeqID_4720
  Subcellular localization annotation: CTP_CleavageSite=51; ConfidenceScore=5.25e-01
MGKPWATPPNSVWPLNTRDAAPQTPRYPSVVRPILFPYQNSHAVSWRYAPPSERKEEAADFSSLSAKVTNITGLSSMIRSDHVFASPDLLTQPANAKGKAKIAEEQNGKVIPALDEDIPVKGLSEKKDGCGQKEVSLEEASEFLCIIQQSEFKVIEQLNKTLA

SEQ ID NO: 96406 - protein, 292 aa, Glycine max
  Coding DNA Sequence Number=SeqID_4721
  Gene Ontology: Mol. function=binding; Cellular component=integral to membrane; Biological process=proteolysis
  Homolog annotation: Hit_ID=Q5P7K0; Match level="QueryCoverage=71%, HitCoverage=70%, E-value=2e-44, Identity=47%"; Hit description =Putative uncharacterized protein
  Pfam annotation: Domain name=TPR_1; Domain location=237-270; Score =19.9; E_value=0.0095; Accession=PF00515.19; Description =Tetratricopeptide repeat
  Pfam annotation: Domain name=TPR_2; Domain location=203-236; Score =4.0; E_value=9.5; Accession=PF07719.8; Description=Tetratricopeptide repeat
  Pfam annotation: Domain name=TPR_2; Domain location=237-270; Score =19.4; E_value=0.014; Accession=PF07719.8; Description=Tetratricopepti de repeat
  Pfam module annotation: Pfam domain module=TPR_1::TPR_2::TPR_2; Domain location=237-270::203-236::237-270
AGWGYYPSGGLGLILLILLILALTGSAFLSLFTGSIQAVQAEYQCGPPHWQKDGLTAVDISVTPDQLTPEVYVPSRQGSLQVEMLAAARRHGAIAIQIPPQLEAVLQEIAAGNVVVVMQNLGFAWVPSWHYAVVVGYDLDKELVWLRSGTFERFEMTLSAFQRTWMRSEQWALSHCLHGKLHAASACDDACRALVYENAEYHAVLLMGLGNTAYALNDLTVAEMTFRHMTKAHPHSAVAYNNLANVLLAQKKVVQAEAVAQHGLALASEDEKLTVQLKQTLGEIRQAKKQML

SEQ ID NO: 96407 - protein, 161 aa, Glycine max
  Coding DNA Sequence Number=SeqID_4722
  Gene Ontology: Mol. function=transferase activity, transferring phosphorus-containing groups; Cellular component=membrane; Biological process=regulation of transcription, DNA-dependent
  Homolog annotation: Hit_ID=A1AUE1; Match level="QueryCoverage=94%, HitCoverage=33%, E-value=1e-37, Identity=44%"; Hit description =Diguanylate cyclase
MLAFLFWHFLLDYQRQKDESKAYLEAATYGSLLRAQLDRELNSLLFISNGLSSFLKVYRNELQQEKMQAILGDLWSNAHHVRNLAVAVNYKLTYVYPEKGNERIIGVDYRDVPSQWPKVQLAIDSHRGVLDGPIELIQGGNGMVYRFPIFVDDEYWGIMST

SEQ ID NO: 96408 - protein, 200 aa, Glycine max
  Coding DNA Sequence Number=SeqID_4723
MASKKRKPPATPFQVRYDRSRFTSLEAWERYTDIMVPRKIIPERNVVIYHTKFDEFKDELMRRKWDEELTSFAEGNIDVAIVKEFYANLYDPEDKSPKQVWVRGHLIKFDEDMLNTFLKTLVIIEEGETLLVYSRFALLRPDPQELAVKLCILGRGFELNVDGQPLKILRKNMTTVAQTWSVLSCSNLVPTSHTSDITLD

SEQ ID NO: 96409 - protein, 404 aa, Glycine max
  Coding DNA Sequence Number=SeqID_4724
  Gene Ontology: Mol. function=transporter activity; Cellular component= periplasmic space; Biological process=transport
  Homolog annotation: Hit_ID=A0NM45; Match level="QueryCoverage=94%, HitCoverage=92%, E-value=1e-127, Identity=56%"; Hit description =Extracellular solute-binding protein, family 1
  Pfam annotation: Domain name=SBP_bac_1; Domain location=10-329; Score= 139.3; E_value=1.1e-38; Accession=PF01547.16; Description=Bacterial extracellular solute-binding protein
MTTRFALKALVLAVGLGSAFCSLAAKLTVVEVITSPPRTALLQKMLDEYKTQHPGTEIELISLPWGQAFEKLGTMLQSGQVPDVVEMPDTWQGLYASNNMLEDLEPRLKSWPESAQLTDKTLAMARAANGKATMVPYGFYLRALFWNKKLFKQAGLSEPPKTMDEFASDAKRISQSGNGISGYCMRGGVGGTNAWMMFMAAMNGSPAFFDKDGNSTLTQPGAIKGAQLLVDLYQQGGAPKDSVNWGFNEIVSGFYSGKCAMLDQDPDALIAIKNSMAAEDFAVAPMPVGPSGKAFPTIGYTGWAMFKQGKQNDIAWPLITFLSNKTNNLAWAKFVGTLPIYKGAEQDPFYQTPQFAGWFKELNDPNYVPLTMPTHLKGWGYFNSVIVKESSQETLLSENDTKDM

SEQ ID NO: 96410 - protein, 60 aa, Glycine max
  Coding DNA Sequence Number=SeqID_4725
  Gene Ontology: Mol. function=protein dimerization activity
  Homolog annotation: Hit_ID=A5ATT4; Match level="QueryCoverage=91%, HitCoverage=14%, E-value=1e-11, Identity=56%"; Hit description =Putative uncharacterized protein
MDRAKERIKSNFNNVKKNYEPIWEIIDKRWENQLYRPLHAGAYYLNPQFHFEDDFKKDNG

SEQ ID NO: 96411 - protein, 298 aa, Glycine max
  Coding DNA Sequence Number=SeqID_4726
  Gene Ontology: Mol. function=motor activity; Cellular component=cell projection
  Homolog annotation: Hit_ID=UPI00006A2D9E; Match level="QueryCoverage =57%, HitCoverage=98%, E-value=1e-14, Identity=15%"; Hit description =UPI00006A2D9E related cluster
LHALTFRGLRVLAFRGLHALAFRGLHVLAIRGLHVLAFRGLHVLAFRGLHVVPFGGLHVLAIRGLHVLAFRGLHVLAFRGLRVLAFRGLHALAFRGLHVLPFGGVHVLAIRGLHVLAFRGLHALTFRGLHALTFRGLHVLAFRGLHILTFRGLHRTTRPHVQRATRPRLQRTTRPHLHRAARPRLHRTPHLRLQRTQGPGPPPNIGGRPTVRAQPEREAIVQLLCIPGQDFTQPLQGDECGSCTPPQLRSPFAKGSRPQDTQWTQRSPTGPWGFQLWLWASVSPTGCPSPQQGHAIVT

SEQ ID NO: 96412 - protein, 100 aa, Glycine max
  Coding DNA Sequence Number=SeqID_4727
SIVECNDKLSDEEQVLLLLASLPRSFKNLVQTLLMGRSTSNLDEEDLKKLRDMNKDSANSQANVVKSVGDEDDVFLAINDDVAKTKWVMNSVVSKHICKD

SEQ ID NO: 96413 - protein, 124 aa, Glycine max
  Coding DNA Sequence Number=SeqID_4728
DSQAILLKFQPARIILDFTPYASGSYNAQWNAPGLLHDKHTLRSSKLACDTGIWGESYRLFAAKFISWFVLKVVFSIGCVIRFDPFPERRPNPQSFEGAYPTIFHSKTLVPLELLDPSTSGHIP

SEQ ID NO: 96414 - protein, 83 aa, Glycine max
  Coding DNA Sequence Number=SeqID_4729
MEGRWPSVVVKGRDSSKCAAVTWRFSSDDEFLTCFNSIAIFFCFLFSVKMRSNLSVLSLITNPTVKTPLQLWGTLEVVCLLVH

SEQ ID NO: 96415 - protein, 77 aa, Glycine max
  Coding DNA Sequence Number=SeqID_4730
  Homolog annotation: Hit_ID=A5C4D7; Match level="QueryCoverage=74%, HitCoverage=10%, E-value=6e-10, Identity=42%"; Hit description =Putative uncharacterized protein
MGYHYWKTRMQIFIEAIDLNIWEAIEIGPYIPTMVVGNATIEKPREQWDEEERRKDWMNTLESQIVRIQKKCEIHCK

SEQ ID NO: 96416 - protein, 17 aa, Glycine max
  Coding DNA Sequence Number=SeqID_4731
GILEHKGRVVPVCVVNP

SEQ ID NO: 96417 - protein, 66 aa, Glycine max
  Coding DNA Sequence Number=SeqID_4732
MDFQMAKTSAWCKEMSEELSETIVGLGKFGSFLAHHQFHQMIGVFWTLKEILQLDHGLLSQTEIAA

SEQ ID NO: 96418 - protein, 530 aa, Glycine max
  Coding DNA Sequence Number=SeqID_4733
  Homolog annotation: Hit_ID=A5AZG1; Match level="QueryCoverage=17%, HitCoverage=30%, E-value=1e-06, Identity=33%"; Hit description =Putative uncharacterized protein
  Pfam annotation: Domain name=zf-CCHC; Domain location=382-399; Score =21.5; E_value=0.00084; Accession=PF00098.14; Description=Zinc knuckle
MEFKKRKAPSTPSQVRYDWSRFTSQEAWEGYTDIIVPRKLLPKRNVVMYHIEFDEFKEELMRRHWDEELTSFDEGSIDVAIVKEFYANLYDLEDKLPKQLQVRGHLIKFDEDTLNTFRKTAMIVEEGENLCAYSRFALLRPNPQELAAKLCIPGRGFELNSLEENEHVIGSMTENISQFVRLIVKECIDRIPESIIHRKPGSKQICPKFGGVIIKKNKREKKKEKKRVEEISQDEKEKIREEERRKILKELRKEKHASSSSHNSCNSLSEELRDYYEGRHRSYLRPHSHGREKEIKPQEANINLPYFHGKDNVEANLDWEIRVEQQLKSKSTSKFYGSHSYPKKDQGQGILEATPSKLKDHKGKTIEKQPLKASMQEKTSSMKCFKCLGRGHITSQCPTMKTMIMRGQDIYSSQDEVTTSPSSSESEEAKGEESSEEIYPQEEGQPLMVKEECKETLVSIATPLRLEFIPQVKELLDEGLVRKSLNPCALLVPKIGVEEKINEFQEPLDLRSNPFQGGGNDAILPSKGIG

SEQ ID NO: 96419 - protein, 123 aa, Glycine max
  Coding DNA Sequence Number=SeqID_4734
MTIICLRMSSGSPPLDEKRAQNDHNLSLRAIGHDCLRMAKRVSMIEGRRMTIICLCVPSDTIKSGWQKVHNDHNLLRMSSGSPPLDDKRRRMTIICLCVPSDTIVSEWQKGVRNNHNLSPHVT

SEQ ID NO: 96420 - protein, 107 aa, Glycine max
  Coding DNA Sequence Number=SeqID_4735
  Subcellular localization annotation: CTP_CleavageSite=27; ConfidenceScore=5.02e-01
MAPHPQTLCRARCSPSSLPILQQNQTRGHHGGGSQNRCTAEIKRVGKKKKNTQEFYTGSATTRAYIQSPSDLRSLRFLFNLVNSFTSKDPQGMYPLLVPQRMYPPMC

SEQ ID NO: 96421 - protein, 82 aa, Glycine max
  Coding DNA Sequence Number=SeqID_4736
MGLKAEINQVNIGCLIYPDGVQELALKKLSAKRSMRDAATKGTSAAPEFDSHRFRSAEHQQRFEDIKRMVVPQRETCLAQGR

SEQ ID NO: 96422 - protein, 160 aa, Glycine max
  Coding DNA Sequence Number=SeqID_4737
  Homolog annotation: Hit_ID=A5AJI1; Match level="QueryCoverage=74%, HitCoverage=16%, E-value=2e-14, Identity=39%"; Hit description =Putative uncharacterized protein
MDVQKLTAGASVHAAEHERLPLQVIVHVLFFDYVKSSISFRTPGNNSACDPLCSPMNRDEGYETTTGDSCQATLKNHISHLRIKDEELHKNGKLSKKNSKNNKTDIQLLPLRSRRIFDKKTSERVGEEKVEYIKYSDPQKGAVAMLPPAKTLLPEGSYSQ

SEQ ID NO: 96423 - protein, 221 aa, Glycine max
  Coding DNA Sequence Number=SeqID_4738
VLLRLKGSSRCGVSTEINSSLWWLKVAVGNGERAWNIGNGFGRKKGEEMAFFPKLLGPQGSKRTSEQCSRERKCRAHSKHLLRDPNGEIVDKCSLKMQTKFREDPTVKEGWAVFLPRQLHVASLRSFIKRLPREVFSVLQQASFGHDYHHSICLRVTTQLGIPKHDWEYCSTGNYDVTGPKTSGLTSSEPNPHLSVEMPFVGTLPSAPDTHALESSTRNTK

SEQ ID NO: 96424 - protein, 140 aa, Glycine max
  Coding DNA Sequence Number=SeqID_4739
MTPDLVTRGDTLRLSAPRHSVTPSVIDEQRPMWSSTPFPEMSASSGGDFFKSHKLSRTTQNLVIPHPFAIQTQPCPMAHRDKNWSFCTLCHPEAAGPMTRGDKIWSFRTPLPFRHSRVRWRAETKIGHSAPFVIQRRRAR

SEQ ID NO: 96425 - protein, 66 aa, Glycine max
  Coding DNA Sequence Number=SeqID_4740
MKHSSKLEGGGHMNSTRSRTHEQGLAITFMGLRKRKGGRMEDCLEGPHLGSPENIALKLEGGGQME

SEQ ID NO: 96426 - protein, 171 aa, Glycine max
  Coding DNA Sequence Number=SeqID_4741
SSSETFYTLVWRLACSLSKEALSRLLLRGSSVTLIMAGGFALRAFFLATEGGLSMENSMMPHPHGAAESTHSDGFTYTSDMVPDSSSSGRSISSVEQPIPEEKPYIALLQLEGERKRVMEEILHIVEGQLEDPGLPRGPHEQALRFCWFELDINDNSSLTDLQDWRGSLRG

SEQ ID NO: 96427 - protein, 217 aa, Glycine max
  Coding DNA Sequence Number=SeqID_4742
MDVKITVILHHRGRFTPRASDGKVEYIGGEFDVWEDISANYMNTFILCDLVQACKKLKSCTTDGDILYLVKDALKNENEINVYFHHEVDPIPEEVSLMLDLKCHPIPGASNEDDLDDVLVAGHEEDVGGGEKVINVDVGGGEERDVGGGEEKDVGNPDDEDDNDEDEWFIDFSCMRKEVEVEYETDGYHSEELKNPISSDDEDEDVHKVYPQYNESS

SEQ ID NO: 96428 - protein, 57 aa, Glycine max
  Coding DNA Sequence Number=SeqID_4743
MEGVVEFFGEFWLWRDWREPSMKRKLSCRALDEILSDCEKPPCYGELNPQLVLPMGT

SEQ ID NO: 96429 - protein, 43 aa, Glycine max
  Coding DNA Sequence Number=SeqID_4744
MACSPWLMFMDYVCQTWVIPHRKICESMDKQSDAFRKHNYKQD

SEQ ID NO: 96430 - protein, 107 aa, Glycine max
  Coding DNA Sequence Number=SeqID_4745
  Homolog annotation: Hit_ID=Q5MG92; Match level="QueryCoverage=56%, HitCoverage=4%, E-value=3e-08, Identity=51%"; Hit description =Putative retrotransposon polyprotein
MAFLEALYQIGILSSKATFGRPCRENWTQNFFSLPLVILKRVDKPRWDGLSKANFVKSLHEKVKAQIEKKVEQYARYANKGRKNMVFKSGDLIPLTSIRGQILPKKE

SEQ ID NO: 96431 - protein, 168 aa, Glycine max
  Coding DNA Sequence Number=SeqID_4746
  Subcellular localization annotation: CTP_CleavageSite=38; ConfidenceScore=5.26e-01
MPISPYGSISWSVPSRHRNRSHKTPSELGGVQQGPGVSSSGYGPLSVLQGARTPPPPARSCHPDIGKIAPAGHPMDPKKSNRVLGFPALITGLCQFYGVPVTPFKVIRPPTNRAFIKRYCAPRQAQGETPQQPGDGQQQATNAPSPPPEPLSSSTKRLEYCLRHMADQ

SEQ ID NO: 96432 - protein, 194 aa, Glycine max
  Coding DNA Sequence Number=SeqID_4747
  Gene Ontology: Mol. function=structural molecule activity; Cellular component=integral to membrane; Biological process=entry of virus into host cell
  Homolog annotation: Hit_ID=P04845; Match level="QueryCoverage=98%, HitCoverage=53%, E-value=8e-86, Identity=81%"; Hit description=Outer membrane protein A precursor
  Pfam annotation: Domain name=OmpA_membrane; Domain location=1-194; Score=360.1; E_value=3.7e-105; Accession=PF01389.8; Description=OmpA- like transmembrane domain
ALAGFATVAQAAPKDDTWYTGAKLGWSQYHDTGYYGNGYENNDGPTHESQLGAGAFLGYQANPYLGFELGYDWLGRMPNKGNQVNGAFKAQGVQLAAKLSYPIADDLDVYTRLGGMVWRADSTQANLNDGTRISNHDTGVSPLAAVGVEYALTKNWATRLDYQWVNNIGDAGTVGARPDNSMLSVGVSYRFRSG

SEQ ID NO: 96433 - protein, 61 aa, Glycine max
  Coding DNA Sequence Number=SeqID_4748
MAQVVEGKVEAQHPKFGQTQVVVGGSSMMDKRSSVTRDDLGRNNSRDGDGDNIEVTFLSST

SEQ ID NO: 96434 - protein, 80 aa, Glycine max
  Coding DNA Sequence Number=SeqID_4749
MVKGSRKTNLHSTLFKSLLILCPGDNLVVWFCPLRKKPDAAIKNAVNRVMFKQETTSVDTMLCTGYGASGNKRDHDHTPA

SEQ ID NO: 96435 - protein, 183 aa, Glycine max
  Coding DNA Sequence Number=SeqID_4750
  Subcellular localization annotation: CTP_CleavageSite=50; ConfidenceScore=5.54e-01
MHTRSFTNPQFLKIGLTHKKLPSGVANCRNVPFCGRARRGSRVRFPKEERCAESPPTFICGKCQKNQRKPVKMKILSSGVVFTLEEGISTSYVGLKGQQPIFRIVELCYLNCYFFLFFEVDKSGALAPMYPPSKRKSNLRSSSLCVNQGRSLPPSSPKRARLLPPEATAFWRKDLEGPSGPDC

SEQ ID NO: 96436 - protein, 101 aa, Glycine max
  Coding DNA Sequence Number=SeqID_4751
  Subcellular localization annotation: CTP_CleavageSite=34; ConfidenceScore=5.06e-01
MAPTRHPLDPDKSNRALGFPALITGHCQSFGVPVAPSKSQGFTSFPCPTPDQFKAEVAWPGDWPEARAGGAPAEAPDEADEAREDEEMTDLLDFLGGSEAT

SEQ ID NO: 96437 - protein, 63 aa, Glycine max
  Coding DNA Sequence Number=SeqID_4752
MGVLGRDLKFLQRVAEPSAVRGSVFWLPRGRVGAGRSSSEAQVVMQVRGEHSSPLGHALCTTK

SEQ ID NO: 96438 - protein, 115 aa, Glycine max
  Coding DNA Sequence Number=SeqID_4753
MTRANPGDLQSFDLEIDITLHRLVRHSVHPGHSEHFEHSEYSVAGDSEYSDFEHSITNFHTENMDQPPPPERTLKEMATPDFTYESLCIQYPDEGVPYVLKIGLIHLLPKFHGLA

SEQ ID NO: 96439 - protein, 204 aa, Glycine max
  Coding DNA Sequence Number=SeqID_4754
  Subcellular localization annotation: CTP_CleavageSite=47; ConfidenceScore=5.03e-01
MACGDKIMVIPHPFAIQTQSCPMARRDKLWSFCTLLSSRGGGPDDMRRQKLWSFRTPFAIQTQSCPMARRDKLWSFCTLLSSRGGGPDDMRRTNYGHSAHLLPFRHSRVRWHAETNYGHSAPFCHPEAAGPMTCGDKLWSFRTPFAIQTQSCPMARRDKLWSFRTPFAIQTQSYLMARRDILWSFCALLSSRGGGPDDMRRQIM

SEQ ID NO: 96440 - protein, 126 aa, Glycine max
  Coding DNA Sequence Number=SeqID_4755
CLHFSGENTETFPSLTSYPELRRSEFLIGGYVGARASLLSTTPPFVAITQELVARGDTLRLSAPRHSVTPSVIDEQRPIWSSAPFPEMSAFSDGDFSSLTSYPELRRSEFLIGGYKQRPSLVILHP

SEQ ID NO: 96441 - protein, 292 aa, Glycine max
  Coding DNA Sequence Number=SeqID_4756
MDKSLKVGEDEWRERERRSTKFRASNEVLNNFLRTRNLTYMCKMIHSVFFIIVMPRVGSRDYAFKGNLNPKVKKNFIPYGMLFIRIRRLAGVDVSSKEPSSGATSLKRETLALSSYVDHTIGTQANPLDLESGASPQQIQRSLIDAKEKARVEKVLLRKKKRRRAPTSYRARKDSCGRKGGSRCCNAQFVIKVSLQGFDVSTKNDSIETNLGVAPLQPRPITTEDEVDVEPLLAHPMMKRERRRHFKEKMSLEEAHHHRRPWIRAWRKKEMNEGRGREEHEILCSKRALKSE

SEQ ID NO: 96442 - protein, 157 aa, Glycine max
  Coding DNA Sequence Number=SeqID_4757
MNKAPKREGDSIGQGDLGRYIRKRCHVGIRELDKGALSAIPTEGNCAERPKSALSPFPIERKCAEHPEGLLSESCRVFGTCFGPRSYGGCCVCSWGAKCTGLPGSLALALGHVHTSYVVYVMGGTLIGPWSLELAFGHVHSSYDTGNRITVAECTLY

SEQ ID NO: 96443 - protein, 40 aa, Glycine max
  Coding DNA Sequence Number=SeqID_4758
MREIKVTTEEGKAKVEVEEAKTTTTMGEKIICEWFSSFRR

SEQ ID NO: 96444 - protein, 135 aa, Glycine max
  Coding DNA Sequence Number=SeqID_4759
MEADTRVWNPGGASMTISMRGEIGKHSTGLIGCWNSSLGIEINLGIGSPGRTRGVGNWLKCVSKASFMTVKQGLNLSDGWSMLLALNDRDHQRIIGRESFKKRVNVFLMTDRNSNTSKLILPRLALLFLAGPKPG

SEQ ID NO: 96445 - protein, 260 aa, Glycine max
  Coding DNA Sequence Number=SeqID_4760
  Homolog annotation: Hit_ID=Q2HVW1; Match level="QueryCoverage=36%, HitCoverage=39%, E-value=2e-07, Identity=28%"; Hit description =Putative uncharacterized protein
MGEKDLWFEFKKWGDVREIFIAKNRNGSGRRYGFVPFKGVEDVRKLERQLEQHGRERKLTRKTNITDQYNKGHQRDKLAKRDENIGRMKTTQTMWNRGAWNQYPQRNTLTVSYAEAVATGSKMTTKRSIPTHKQAMMQPSHSSIQLMIPIKQRTWFSDAWEELMWDRGEDVRPKYLGGDMVLLMGLSDTRAEDLCREEDESGLSMFHTLEKWSPTMKSGFRLVWVLCWGVPLHAWNMENIKKIAGVVGEVVKIDDDAVDL

SEQ ID NO: 96446 - protein, 295 aa, Glycine max
  Coding DNA Sequence Number=SeqID_4761
MDRFAFTLNGSQELPRLPAKAKAMADVYSAPEEVDMEALKDQMTSMMEAMLSMKRLIKSNAAAAAATNVATEADPTHPFAINQASQLIPDVLGQGGEVLGRTSGGAHEEPREHAQGDFDPYPTFTTEGLAFNAILQPNTATAPQHRPLQPLHFSVGGCLRQWKGGRNSISSRRDEGLSKGVCPIVERLGGTGGASHGGKRNDNYDSGHAANLVFANERIEVGLKRGKFDCVAPANMGNRRFGASEAKKKEEDAHAITLAPTWTKPQQTAHNTYQYAQHKLSFSARVGNPSILAPV

SEQ ID NO: 96447 - protein, 108 aa, Glycine max
  Coding DNA Sequence Number=SeqID_4762
MVGYTPSSFADLVFAGEMIEVGLKRGKSDHFALINAKKTGASKEDEKEGETYAVTAILIRPSFPPTQQYHYSANNNPSHYPPPSHPQRPSLKSTTKPTYRTSNDKHHL

SEQ ID NO: 96448 - protein, 68 aa, Glycine max
  Coding DNA Sequence Number=SeqID_4763
MHTKRCTVKRVQKLEAELNKLESEAEHRQLTSQENMKRKKLQQDFWSAAQAHESLMRQKARSRWIKEG

SEQ ID NO: 96449 - protein, 33 aa, Glycine max
  Coding DNA Sequence Number=SeqID_4764
MASINLTIIPHPKPYKLQWLKKQGEMIVNQQMK

SEQ ID NO: 96450 - protein, 98 aa, Glycine max
  Coding DNA Sequence Number=SeqID_4765
MHCHHLIRLIQLGHLAWSGIYNTWFASRRPTTWGRARVFLLFACPTPDQFRDEVAWLGDWPEAQAGEAPAEAPSDAEEARMDEEMTDLLGFLGGSGAT

SEQ ID NO: 96451 - protein, 121 aa, Glycine max
  Coding DNA Sequence Number=SeqID_4766
KCGLYIEANPPRLVALGRVYEGSTVHNIPLLPGQVKVGVEEVKDAQALVPVPTNEATVSPAKPPQRPDPEVDDPLYLMTLTIPELFLKPFQVNWDAIMFGVFNPVFPLYIKHEDLSEIAHG

SEQ ID NO: 96452 - protein, 157 aa, Glycine max
  Coding DNA Sequence Number=SeqID_4767
MPSPSEDYTSSPLEDYTSSPSEDYMFPIFKGGHALTFGGLHVLAFKGSCTFNFRGLHVLAFKGSCTFNFRGLHVLAVKGSCAFTFVGLHALTFRGLHVLTFRGLHVLAIRGLHVPHFQRGACPHLQRIARPCHHRTTLPRLRKATRPELQRATRPRL

SEQ ID NO: 96453 - protein, 128 aa, Glycine max
  Coding DNA Sequence Number=SeqID_4768
KYCTARQAQGGDPQAPDAPPPPQADPAGSFDTERYLRHLVRQQAANHKAHVQTHDSLYQLSLSRQSQGFASFPCPTPDHFRAEVAWPGDWLETQAGEAPAEAPGEADEARMDEEMTNLLDFLGGSGPT

SEQ ID NO: 96454 - protein, 75 aa, Glycine max
  Coding DNA Sequence Number=SeqID_4769
  Subcellular localization annotation: CTP_CleavageSite=52; ConfidenceScore=5.42e-01
MFVFNSALKGLDDTPQSKSKAVARWIVVKMMTKSPKNDFKIESTSSRSSLISSFMRRNQEDSRIKRSLISRFKKR

SEQ ID NO: 96455 - protein, 45 aa, Glycine max
  Coding DNA Sequence Number=SeqID_4770
VVLRDMSRGSGDLGDVRLENEIRKLGELLVIDYQGIVMAAQLIHD

SEQ ID NO: 96456 - protein, 258 aa, Glycine max
  Coding DNA Sequence Number=SeqID_4771
  Subcellular localization annotation: CTP_CleavageSite=45; ConfidenceScore=5.62e-01
MNSLPSAVHVSSTFESRAPRIDCLALFANSPFSTFIRSPMNSLPRAVHVSSTFESGAPRIDLALFANSPFSTFIRSPMNILPSAIHASSTNESGGPRIDCLALFASSPFSTFIRSPMNLWPSAVHVSSPFESGAPRIDRLALFANSPFSTFIRSPINSLSSTVHASSTIESGVPRIHCLALFANSPFSTFIRSPMNSLPRAVHVSSTFESGAPRIDRLALFANSPFSTFIRSPINSLSSSVHASSTIESGVPRIDCLA

SEQ ID NO: 96457 - protein, 219 aa, Glycine max
  Coding DNA Sequence Number=SeqID_4772
  Gene Ontology: Mol. function=peptidase activity
  Homolog annotation: Hit_ID=A5BP60; Match level="QueryCoverage=65%, HitCoverage=56%, E-value=1e-20, Identity=39%"; Hit description =Putative uncharacterized protein
MASANFLFPEGNSINRPPIFNGEGYHYWKTRMQIFIWAINFNIWDAIEVGPYVPTMVAGNTIEKPREEWSEDERRLVQMKTNESIQDMQKRFTHIVNHLASLGRTFQNEDHINKVLRCLSREWQPKEHEMELQRLNQHEENDKKKKGISLKASSSIQEESDIEDSIDLDEDEDLSLFVQRFNKFIRMREIKEDKTSNLKEELKSHLKSKNALSAINLDI

SEQ ID NO: 96458 - protein, 89 aa, Glycine max
  Coding DNA Sequence Number=SeqID_4773
MSAHVFFGSFVRPISWRAKSVSIGKAYWVDDPSSFGFWVNDLAWVGDPDFEGGFILEDGFGRVNLKPLRVLLLPRKEVLDALGGMTISL

SEQ ID NO: 96459 - protein, 615 aa, Glycine max
  Coding DNA Sequence Number=SeqID_4774
  Homolog annotation: Hit_ID=A8LZZ4; Match level="QueryCoverage=29%, HitCoverage=78%, E-value=1e-37, Identity=50%"; Hit description=Phage prohead protease, HK97 family
  Pfam annotation: Domain name=Peptidase_U35; Domain location=406-571; Score=96.5; E_value=8.2e-26; Accession=PF04586.8; Description =Caudovirus prohead protease
  Pfam annotation: Domain name=Phage_portal; Domain location=16-349; Score=30.9; E_value=8.9e-09; Accession=PF04860.3; Description=Phage portal protein
  Pfam module annotation: Pfam domain module=Peptidase_U35::Phage _portal; Domain location=406-571::16-349
MFREQREAKFSDLPSRVGWRRNVTSKRGALGHSAAWACIRLRGDLISTLPIDTYRKVPWGQVEVPKPPVLVEPGGTKVDITEWMYSTQTDLDTLGNTFGSITEVDGAGLPRRIDLVARDEVSVTSLKGKVTYRFNGKVQDEDTVWHERQYTSSGMILGLSPLAHAALDMQSHAAAQEFAAAWFGGGLVPLAHLKYDAAAVPAREAEAIKLRHKLAIENGDALVTGKDWEYKPIDVASAQANFIAAMQFSDTQLCRFFGVPGDLIDANTAGSSVTYANITQRNLQLLVMNLGPAIKRREVALSRALAQPRFVKLNTDALLRMDPETVSRMLGQQVRDRLRAPSEAREKLNLAPFTPEQLEEFKELFPAHANTIEADVAGRRAAARSNPADVPSTPNRSQEFGAQLRASLVERDGKKFYHFNGCASTVEQPYEMYDFWGPYTEIVDRGAFDKTLAADPDVAFLLNHRGTTMARTKSGTLELSFDPEQGLISDAYCNPERTDVKDLAHAIADRDIDQMSFAFRIVRGQWSPDYEEYRILEVDLDRGDVSAVNYGANPNTSISARAKQALAAVDELPGQRPPRGRCSCRGTPRPQHARGGSSPGNRRRARGADRASRAT

SEQ ID NO: 96460 - protein, 123 aa, Glycine max
  Coding DNA Sequence Number=SeqID_4775
MAQLISNAIHYLQGSRPQDTQWTRRSPTGPWGFQIWLWASISPTRCPSPQDRARKTPSGPEEFQQGPGVSSSDYGPLSVLRSAHRPSKVIRPLTNRSFMKKYCAPRQAQGETPQQLGNAGSGQ

SEQ ID NO: 96461 - protein, 49 aa, Glycine max
  Coding DNA Sequence Number=SeqID_4776
YGLMTWGSYSATKPLMGNAREAIDKIVKPLGFYWHWDSHSTHIRRDKED

SEQ ID NO: 96462 - protein, 126 aa, Glycine max
  Coding DNA Sequence Number=SeqID_4777
  Gene Ontology: Mol. function=oxidoreductase activity; Cellular component=cytoplasm; Biological process=metabolic process
  Homolog annotation: Hit_ID=A7QG33; Match level="QueryCoverage=97%, HitCoverage=38%, E-value=3e-32, Identity=62%"; Hit description =Chromosome undetermined scaffold_91, whole genome shotgun sequence
MWWPFSRIGSSGFSSYSTAEEVTHGIDGSGLTAIVTGASSGLGAETARVLALRGVHVIMGVIDMIGAKTIKEAILKEIPIAKVDVMELDLSSMTSIRNFASNFNSSGGLQCSLFDDNDEIMVVLQI

SEQ ID NO: 96463 - protein, 215 aa, Glycine max
  Coding DNA Sequence Number=SeqID_4778
  Homolog annotation: Hit_ID=Q2HTA0; Match level="QueryCoverage=82%, HitCoverage=25%, E-value=5e-13, Identity=30%"; Hit description=IMP dehydrogenase/GMP reductase, related
MYENLNDASKSTTKQLAGHITLLQCWIYEHFPFVASSIASSIDVEDYDERKSRVYYWKLTYDVVCWIPYGDHRAFREFKIIFLFSEHFKWGPSIVTHQPKRVVRQFGYVQTIPPHPIAHFLCIEDIDDRWIQFSEYIAPMGQICVAPEQCLSYYKKWFYMIFHPFMSSTQLGDPPRHPLVVHDDTFVELDVPQHPMAAVAMDESPEDAYVDVEHP

SEQ ID NO: 96464 - protein, 310 aa, Glycine max
  Coding DNA Sequence Number=SeqID_4779
  Pfam annotation: Domain name=Transposase_23; Domain location=173-243; Score=-8.7; E_value=0.011; Accession=PF03017.5; Description=TNP1ENSPM transposase
MARTKKTGQMTSEAAKEISDKILSHFQLLIAIIYDWLEEQASQGSFVTHERQDVLTTAIRRPEHPGRVCAPGAGVMIKQYFGPAPRTSTMSSSMAPEDLEQLTQKIRDQLEELITEKVTRQLMLSFSQMQFQFQLQMQSQGLVLPPKPEVGPSTSCVSTKESCVDPSGNDPDMGDSDKCRLYVEENHPCLVALGRLYEGSTTVHNIPLLHDQVKVGVEEVRDADALIPVPTEEVKLVGHTLKTFLAWCSPQLTVHFFFFSFLFETRKWGCMCYRQAHRIVKYFKLKQSNPSIEHRDVWIRQRFVQESDIV

SEQ ID NO: 96465 - protein, 216 aa, Glycine max
  Coding DNA Sequence Number=SeqID_4780
  Gene Ontology: Mol. function=catalytic activity; Biological process =cellular metabolic process
  Homolog annotation: Hit_ID=O64438; Match level="QueryCoverage=33%, HitCoverage=30%, E-value=5e-28, Identity=80%"; Hit description=ARG10
  Pfam annotation: Domain name=RNA_pol_III_C17; Domain location=63-142; Score=-33.2; E_value=0.045; Accession=PF09417.1; Description=RNA polymerase III subunit C17
MEKQSKSRKLQRPPTIGLMASTEALGVAKPSVASYLSQEILVEQEANRVHGLPGQPLVKFNNMVGNVGALTNFEVLDFLLTKGTSKDPTRVIAKVAQSEYKVYDYLVDTAASVQTRESINEFLTTDGYVAFADDADLLKGSCGKSLASFPQGCFYFTEIGGLKCYENPKNKIIAVPAEEEEIWGVFFKNRESLISPNSNIRLMSIETALGTKGKCE

SEQ ID NO: 96466 - protein, 104 aa, Glycine max
  Coding DNA Sequence Number=SeqID_4781
MLRLRGGGHNPLFEDSPNECGGGAATDSHQKILPRRIGMLYAFGTTLTARLSFQGRVLIVTRPKGVTDSKEHRGNQLTSRLTHDPSQGTTRIRIGIANSVIAVG

SEQ ID NO: 96467 - protein, 275 aa, Glycine max
  Coding DNA Sequence Number=SeqID_4782
MGYVGVRELSWRWATGDGGFMRALWMWKTCCAPSPDCHLVPHVMVVPGDMSRGSGDLGDVRRAPGSQQIKGTKTTKQGGLWWLANCEFCVIYGLWPLVIDYQGLENEVRKLGKPLVIDYQGASSNRLPACVIDYTEEWVTGNRLPASGNRLPRLCNRLPEMKSLKIPLLIACSGYETHCVAAYGDGVPRGSLGDPRRQHERTVEWILPTPTPYRLVEPVQLIEVTSSEEDLEEDPEELPPEPAVDALDFLEGDEDPLLEALHPSGQLFGLVLYTF

SEQ ID NO: 96468 - protein, 155 aa, Glycine max
  Coding DNA Sequence Number=SeqID_4783
  Gene Ontology: Mol. function=heat shock protein binding; Cellular component=integral to membrane
  Homolog annotation: Hit_ID=A7QY81; Match level="QueryCoverage=49%, HitCoverage=14%, E-value=4e-23, Identity=70%"; Hit description =Chromosome chr2 scaffold_241, whole genome shotgun sequence
  Pfam annotation: Domain name=DnaJ; Domain location=47-104; Score=0.5; E_value=0.0037; Accession=PF00226.22; Description=DnaJ domain
MPSKAMTSPSWGTDPWYLERWWCLRARVVETVVTGSRGGDVCSGIGYLGFGLGRRTSKKRTTLETKKKKRKRKRRMKDIATKNFQQICEAYEILSNPNKRQIYDIYGMEGLTSGLELGPKLNGAKEINAELERLKRMKEQEKVATYFLSFNIILK

SEQ ID NO: 96469 - protein, 150 aa, Glycine max
  Coding DNA Sequence Number=SeqID_4784
  Gene Ontology: Mol. function=metal ion binding; Biological process =metal ion transport
  Homolog annotation: Hit_ID=Q39815; Match level="QueryCoverage=49%, HitCoverage=100%, E-value=9e-20, Identity=66%"; Hit description =Putative uncharacterized protein
  Pfam annotation: Domain name=HMA; Domain location=18-93; Score=46.2; E_value=1.2e-10; Accession=PF00403.17; Description=Heavy-metal -associated domain
MIITIDPKSSIIFVRQKVVLKVELHDDKIKKKAMKAVSGISGVESVSVDMKDQKMTIIGDVDPVTVVGKFTKFSLGKLRKFCHVEILSVGPAKEEPKKEEKKPEAKKDPKEEYAELLKVVEANYYQTRHLQYPYYYSRTVEENPTGCVIC

SEQ ID NO: 96470 - protein, 173 aa, Glycine max
  Coding DNA Sequence Number=SeqID_4785
MNSGHHTTQTLPTLAMTEPSTKKYLGIYESTTINFLACEQKWIFDLHFTPPLDQQSCGRPLLTSRMHVGTLELTQGLLGTPDPLRLPHIAAIHLPSCGFHMTVLRRLDPPLQWTVVTLDVGVGDKYVVQPWYQFLANGDFNHGDELSFYYRPHNKIWEIVIRRKRNWGDNNSD

SEQ ID NO: 96471 - protein, 56 aa, Glycine max
  Coding DNA Sequence Number=SeqID_4786
MAREVLAAEDQDSHKDKATKRNYYATKNCRSPNQAMMIQDQESCQVDMTKDGAGKP

SEQ ID NO: 96472 - protein, 215 aa, Glycine max
  Coding DNA Sequence Number=SeqID_4787
DPASSTIPFDEIFKILRWVSCTLGSLHHVHHASGLLLDLLPPEATLLRKYFGRLFLTSGMLRNFWDYATILAFDFRNVAELHGLPNDGCLSTSRRSSEGEDAKQAELGCEDSRKKKKQVSGGCFQCGNPLEELVELGGNVVLRGGIVELIRSQLGNGFFDSLRDPTSSAIPLDVIFEMHGWASCALGSLHHVHHGALLVCYGGALLVCLFPKRHL

SEQ ID NO: 96473 - protein, 136 aa, Glycine max
  Coding DNA Sequence Number=SeqID_4788
  Gene Ontology: Mol. function=RNA binding
  Homolog annotation: Hit_ID=A2Q620; Match level="QueryCoverage=94%, HitCoverage=36%, E-value=7e-19, Identity=33%"; Hit description =Cyclin-like F-box; Agenet
  Pfam annotation: Domain name=Agenet; Domain location=8-64; Score =17.7; E_value=0.0041; Accession=PF05641.3; Description=Agenet domain
  Pfam annotation: Domain name=F-box; Domain location=90-136; Score =25.3; E_value=0.00022; Accession=PF00646.24; Description=F-box domain
  Pfam module annotation: Pfam domain module=Agenet::F-box; Domain location=8-64::90-136
MEPKAIVFEPGSAVYFIIYGGSWFSGTIIGCVDSDRFLVQYRRNSVESTVVSLHQLRLLPPPESHREFKSGDKVVVDSEEMMLPKEQLRDRISELPDTVLLHILNFMDTKDAVKTSVLFNRWKNFCKALSLGYSVP

SEQ ID NO: 96474 - protein, 585 aa, Glycine max
  Coding DNA Sequence Number=SeqID_4789
  Gene Ontology: Mol. function=protein binding; Cellular component =membrane of vacuole with cell cycle-correlated morphology; Biological process=mitochondrion organization and biogenesis
  Homolog annotation: Hit_ID=A7QG88; Match level="QueryCoverage=68%, HitCoverage=77%, E-value=1e-115, Identity=55%"; Hit description =Chromosome undetermined scaffold_91, whole genome shotgun sequence
  Pfam annotation: Domain name=CBS; Domain location=214-325; Score =15.2; E_value=0.0016; Accession=PF00571.19; Description=CBS domain
  Pfam annotation: Domain name=DUF21; Domain location=18-195; Score =85.1; E_value=2.2e-22; Accession=PF01595.11; Description=Domain of unknown function DUF21
  Pfam module annotation: Pfam domain module=CBS::DUF21; Domain location=214-325::18-195
MSSYFEERAPCCGTHFWILLSMCSAFVLFAAITSGLSLGLLSFSQVDLEVLVKAGQPKIQKNAAKIMSIVKNEHLLLCTLLIAKSMALEGVSVFLEKMFPEWLSVLIAATILGLTAEIIPQALCSQYGLSVGAAMSPFVRVLMMVFFPIAYPLSKLLDWLFGKGHTALLGRAELKTLVHLHAIEAGKGGELSLHETRIIAGALDLTQKTAKDAMTPISETFSLDINSKLDMHTMGLIMSIGHSRIPVYSGKQTNIVGIILVKNLIFCHHEDEMPIKFMTIRRVPRVGEDWPLYDILNQFKKGQSHMAVVLKCGGNIRTAATGHCPSFEPGDHFRISTDASNWHSQETEYYSATLKSVMHREGDSDLLQRRSEQPDASSSFENLESLSTEVEEVIGIITLEDVMEELLQYQNQTRTCKKSVIRVLQKGFKYSSTTEKFRCISIFIHQLSFFFAAEVQHMVIIVIIRMNIMDCQSVCFLRIVNPYELYRLSIRMNHMTYQSIVNSYELYGLSISIIHTDCQFPNAQKPQHYKEKSTHGDDDGDNDSDGKNRRRNHQQVKTNKGLKEGDRDARRESENRSSVGGGRWV

SEQ ID NO: 96475 - protein, 144 aa, Glycine max
  Coding DNA Sequence Number=SeqID_4790
MGIVNGDEGERENGDTHGSHGGGDIGELRSGGGTTEFDRRDDTEISSGIGEKTSRIEPIGGELLKCQYSREKIRWAGFKITISQRFHASNLGIPFQALLALEQEETVQEFIGQFEKQVGMVKGLEEPFLVEVSLKGLKEEINTE

SEQ ID NO: 96476 - protein, 64 aa, Glycine max
  Coding DNA Sequence Number=SeqID_4791
MMIIDPPIAVRFHAAAAFRSAAAPPPHSNRSMWSADDLNGVRYFASCRLACSCGFDAPWYTDFA

SEQ ID NO: 96477 - protein, 504 aa, Glycine max
  Coding DNA Sequence Number=SeqID_4792
  Homolog annotation: Hit_ID=A2WM97; Match level="QueryCoverage=95%, HitCoverage=73%, E-value=4e-77, Identity=51%"; Hit description =Putative uncharacterized protein
MPVRTPEWLKKVFAAITKSERNGPVFRFFIDLGDAVSYVKKLNIPSGVVGACRLDLAYEHFKEKPHLFQFVPNEKQVKAANKLLKTISEHGEKKKVDGVPVFSAQNLDIAIATTDGIKWYTPYFFDKNMLDNILEEAVDQHFHTLIQTRHMHRRRDVVDDNLAAEVIEEMGDSLGEPPEGWTTELEVQELLDEMGHPSIPLSVISKAAELQFQYTVDKVFLGNRPLKLKISTCGIFTPVLSSVAPHPNRFLCHPQSMTLLSLLERSLSSRRWPSNELGCYMGYPTNLDNLYWLTKCTRDHGKNRKQGSLNILSSSETGCLELQSTFKVGCLELSEASLLRATESSSSLENSKVEDDRKNAECIDSSKCSLDGNTEAIKQSSPRLSLPFGNWFHHLWPKQCRKKVGSSRKGVNKEEMKPAPFLPKITMVGLSTEEAGQMSKANLKKTMDDLTRELEKTELDIMTDGGSKECKVEDRDPLFVANVGDYYSSLGKPGSGRWIRGGSN

SEQ ID NO: 96478 - protein, 354 aa, Glycine max
  Coding DNA Sequence Number=SeqID_4793
MVGQRVKVLLTLALLDWTANALGRALRADTLARALGAGALARAVMAALVALGRPGRLVVPTATPLPKAPASAVLPVPTPPLLPPNHVTAEESTPGRPGIATQINLKRGNAVAGTSGSISVSGQSGSPGTSVASFSSVSDLTDMGESSEFEEHAFSIITQDTVSWVSVPVNGFRVFVVAGVGHDERVGFAGASLYLLSRSASFAATASSEIESVMLWITGYVTEKGWLVLLWLLLFWGLELLLLEPVKTSSGGCSNEGVICGSRNEMVVETLLYLLLSNESRNFRKRGIGIDAKATSASASASNGVAIFLAQTRARGSVGGGGGGSGGWGFCVCGGSKCSSFATSNDGKEIPILM

SEQ ID NO: 96479 - protein, 78 aa, Glycine max
  Coding DNA Sequence Number=SeqID_4794
MENSSLTVNHLIQPYFNLLSENQLRVFNTRLGTTYTRKTARKPHYKRNLKESWASSSKGNNTRKSSLPWIQTENADET

SEQ ID NO: 96480 - protein, 98 aa, Glycine max
  Coding DNA Sequence Number=SeqID_4795
MKKIQGLQDPHGATSGDTSGVATDDDAIDVEVDDDYVVDNSDAHRAWDLGPTQDWGPIFNQDFFLVSYWKVMKYELKHNNEEVSKSKQKSVGQVASIT

SEQ ID NO: 96481 - protein, 52 aa, Glycine max
  Coding DNA Sequence Number=SeqID_4796
MDTSEPYTGAMRGTVHEPQANLKADQNFSPVNKRYKRGALEVLTQYNPLNTL

SEQ ID NO: 96482 - protein, 97 aa, Glycine max
  Coding DNA Sequence Number=SeqID_4797
MTKIVQNTFKRVDFPHPLGPISIQNYLQGMQIEQSLRIGRKRKIRGKNGKREEKIEKEKEKDERVGRPRWNVIGEEEKWWLWRCSEQEVKQCRLGWD

SEQ ID NO: 96483 - protein, 157 aa, Glycine max
  Coding DNA Sequence Number=SeqID_4798
  Gene Ontology: Mol. function=oxidoreductase activity; Biological process=metabolic process
  Homolog annotation: Hit_ID=A5BG80; Match level="QueryCoverage=42%, HitCoverage=21%, E-value=4e-23, Identity=80%"; Hit description =Putative uncharacterized protein
MKRTAIEQRKEGRVVNVSSRRHKLSYPEGIRFDKINDKSGYNSLSAYGQSKLANVLHTNELARRLKSVSVCVVLFYLPLQNKGNMRTGKQGTNPAYQENGCGGGLLTPTVCEMLFVYVKQIVVSGSTGVGDCGDFEGNEDTYDEKVEFSLKGLFLAH

SEQ ID NO: 96484 - protein, 98 aa, Glycine max
  Coding DNA Sequence Number=SeqID_4799
MRKYNSRTFHLKVRRSRLFRFFRRFPQINVGGDSARIPFVEHASRESRVALPPKGRLRQVENIFVHVSNVRMGDCNDPPRRYEVILSQHKFIQQHAIT

SEQ ID NO: 96485 - protein, 777 aa, Glycine max
  Coding DNA Sequence Number=SeqID_4800
  Gene Ontology: Mol. function=solute:hydrogen antiporter activity; Cellular component=integral to membrane; Biological process =metabolic process
  Homolog annotation: Hit_ID=A7NY62; Match level="QueryCoverage=99%, HitCoverage=97%, E-value=1e-167, Identity=36%"; Hit description =Chromosome chr6 scaffold_3, whole genome shotgun sequence
  Pfam annotation: Domain name=Na_H_Exchanger; Domain location=32-428; Score=38.3; E_value=2.8e-08; Accession=PF00999.12; Description =Sodiumhydrogen exchanger family
MDLPPRVNSEMSWSTTKGILPENALPMLQMQMCLIFLATFFLHTFLGRLGVPRFTSMSVVGLIFATTFSEKWAQKCRDLFIFDSQANLGLLSVFGYMLFLFYTGVKTDMSVVHRSRRNATNIGSIAIMAPFLCSMAVVHFHSIKYLDIGQATKLGVISGLFSMTPFSTICTVLSDLKILNSELGRLAQSSTLVTEVFNLFLITILTFSKIVFQEPSRAWFSLAAAVFFVLLVVFIIRPAMFWIIKQTPEGSPVSDHYVYCILILVLLSSYATHRIGFFALFGPCVLGLATPEGPPLGTAITKKIDTFVNWVLVPAFVTTCAMRVDLRDFMNWTEKVNGGVDEFMVQTLIIIVVTSVVKVVACTLPPLYSNMPLNDSVSLALIMNCKGVVEMAGYSMVRDVMGMPDNVFALVMVCIILNATAIPMVLTHLYDPMKKYAGNYTKRNIFDLKTNGELRVLTCIHRPDNIPPTINLLEATFPTKEDPVCAYVLQLIELIGRASPLFVCHQLQKKKRADSNSSMAEKLVDAFQNFEQEFKGALVVNTFTSISPQENMYDDICTLALDKFASLIVLPFHKKWSSDGNFIEIEDESLRELNYRVMERAPCSVGILIERAQMTHIFSPETPYTVCMLFIGGKDDREALFFAKRMTKNPHVRLTVVRFFVDSCNEMNTRDWQGMLDTEILNDIKVNKKVGEAYVNYIEKTVKDGPDTALVIRSLVTEYDLIIVGRQAGVETPQTSGLLQWSEYPELGVLGDLLASTDAAGKASVFVMQQQRTAKDA

SEQ ID NO: 96486 - protein, 126 aa, Glycine max
  Coding DNA Sequence Number=SeqID_4801
MARTSDGGGEYHQLDGSQHLLLDVITTQMQCLLNRNNEELCGKIEGLENQLNHNARRHYGGNRGGNDGPRQNRMQGQNKIEGPKRTQKNDFKIESTSSRSRLISRFKKRHQEESREDEFKIQEKKS

SEQ ID NO: 96487 - protein, 87 aa, Glycine max
  Coding DNA Sequence Number=SeqID_4802
  Subcellular localization annotation: CTP_CleavageSite=58; ConfidenceScore=5.19e-01
MFSPSDIEKSLEISEKNCFRGKNPSRGASVTLSRRCYKRFRGDSSPFFIVLRSFFGLQSMNGSGMEKEEREETSLKGEDESRRSSPP

SEQ ID NO: 96488 - protein, 101 aa, Glycine max
  Coding DNA Sequence Number=SeqID_4803
MLGKLERIDGDPVLRETRIWAMWEYVSSVGGGQQGMVEWYLEICRGGQETLGTSGGVLLPKTKLDQSRPNPGIVSHCESCVIYGLWLLVIDYQGWVIDYKA

SEQ ID NO: 96489 - protein, 198 aa, Glycine max
  Coding DNA Sequence Number=SeqID_4804
  Homolog annotation: Hit_ID=A5BEV8; Match level="QueryCoverage=57%, HitCoverage=15%, E-value=1e-07, Identity=32%"; Hit description =Putative uncharacterized protein
MTFSAAFAYLEGERFNNVVWVLQRFHGLFMKGDALPGVIVTDKDLDLINAVKTVFPDAMNLLCRLVDCPCESYFDEYLKNFEMALRDLYLSTMCAKHGYALNEIAAKYERVTYAGKNPSRCGCVTRTTHSIPWLCETKVTIIEEMETISKRFEQLDVCGKVHLKTKLWEIVYPDLNSMCPPSKKVVGSSGLGIIQKRG

SEQ ID NO: 96490 - protein, 156 aa, Glycine max
  Coding DNA Sequence Number=SeqID_4805
  Subcellular localization annotation: CTP_CleavageSite=43; ConfidenceScore=5.09e-01
FSSTASPAAASFGWTPFPFEGRRREQETPKKWLTAESSGRPVRGSSEKFPEEVFFRKVSGRSVLPEVTKRLPEEHFFRKTPRTPFPKTFRKKWFFRKNSRRWALPDDLSNFRKKWFFRTGKTRGLGRAIGRVVGRDRPTDQDATDVPERRRPTASA

SEQ ID NO: 96491 - protein, 145 aa, Glycine max
  Coding DNA Sequence Number=SeqID_4806
  Homolog annotation: Hit_ID=A5BFU1; Match level="QueryCoverage=79%, HitCoverage=9%, E-value=1e-19, Identity=44%"; Hit description =Putative uncharacterized protein
MIKTIPGTLEQNGVAKRMNRTLNERARCFWDDQNKKAIKSRNVTFNENLFYKDKFSTESTCAGKLSEISEKATLEKISESDVTNRNHSIGVEVESEPEPLTPLRKSSRISIPLDRYSPSLHYLLLTDAGEPEYFSEATQENDSIE

SEQ ID NO: 96492 - protein, 73 aa, Glycine max
  Coding DNA Sequence Number=SeqID_4807
MTKQRIEGDQGVINKDMSTNPYKSRKTNLLNKLEASSTLSQAYFPMEDYPTSPESVISTASKTSMSIVSMSRH

SEQ ID NO: 96493 - protein, 167 aa, Glycine max
  Coding DNA Sequence Number=SeqID_4808
  Homolog annotation: Hit_ID=A7PJZ4; Match level="QueryCoverage=52%, HitCoverage=18%, E-value=2e-10, Identity=40%"; Hit description =Chromosome chr12 scaffold_18, whole genome shotgun sequence
MRSRSCVRHRPTTSARRQRVPVPEDLTQRVEDVPQLPEDVPHVSDGSPEMTDTADGVETDRVASDGSLGAPANHEGFPGGPRDPSVLIGFADHVAHSIWSGQERPDLKLVSYDRKVDKFGRPAAEIEGMIAATGFGPLIRCSVITTDPGLISTFVERWHRETSSFHL

SEQ ID NO: 96494 - protein, 46 aa, Glycine max
  Coding DNA Sequence Number=SeqID_4809
MESSITLETMKYAKNLRKCLLIFSHGGQDLSSGNEKGGKLSEKRFE

SEQ ID NO: 96495 - protein, 380 aa, Glycine max
  Coding DNA Sequence Number=SeqID_4810
  Homolog annotation: Hit_ID=A7UQU7; Match level="QueryCoverage=71%, HitCoverage=55%, E-value=6e-29, Identity=30%"; Hit description=IMP dehydrogenase/GMP reductase, putative
  Pfam annotation: Domain name=DUF1723; Domain location=130-179; Score =47.7; E_value=4.1e-11; Accession=PF08330.1; Description=Protein of unknown function (DUF1723)
MFVGAFSSTIRDWVVRINHLYRESNSVADSLAALTYSKALGLPVAPILRHRTCYTSVFVRTKGNIHHPSALIYSFPPSPPRSTRPLMKCTELKFASHERKVEKVGRHAPEIEDIVAAIGLIYLITYSMETDDKGLLYAFAERWYKETSSFHLFIGELSITLDDVASLLHLPITGVFQTYDAIDVDQVVDLLVKLLKVRRQDTKDETYRTKCCTLFANKSVTHITVVFLDSFCDLNQPGGFSWGAIALVHMYENLNVASKHSTKHLVGYITFLQSWIYKHFPTIANMIADENYYERKPHACHWKCGKTLLVTTYRKCLDRLMSDVVCWIPYGDHHGFREFELISSIVRHLSGRVLRQLGYVQFIPPLNTSTSLSTEEIDDK

SEQ ID NO: 96496 - protein, 100 aa, Glycine max
  Coding DNA Sequence Number=SeqID_4811
MTGEMRGAFELLGEAGSGRVVGSLLDEVDVGEATFPELAHDAKAVTREEWSILEARLRHRVRVMELQGPRCGAVGGGVDVVLVGADDFSDCWYRSEKKAA

SEQ ID NO: 96497 - protein, 274 aa, Glycine max
  Coding DNA Sequence Number=SeqID_4812
  Gene Ontology: Mol. function=citrate transmembrane transporter activity; Cellular component=integral to membrane; Biological process=citrate transport
  Homolog annotation: Hit_ID=Q1RU51; Match level="QueryCoverage=99%, HitCoverage=48%, E-value=2e-73, Identity=55%"; Hit description =Transporter, putative
  Pfam annotation: Domain name=C4dic_mal_tran; Domain location=50-250; Score=-87.0; E_value=0.058; Accession=PF03595.8; Description=C4 -dicarboxylate transportermalic acid transport protein
MVLSSTKDSTTNTNASKEGTNDAKEETNIPSKVVAIVVDKPIEAHAVMHSSQGKVDYLSIKWKRIVWKSCVYAITLVMVIAMLLGVNMAWAAIAAAITLVGLDIKDAGPSIDKCFILLGTGLLFIVDILFFCGMFITVDDFKKTEIPGALWDLMEPYSRIDHASGIAILAIVILILVLSNLASNVPTVLLLGARVAASAAAISKEDEKRAWLILAWVSTIAGNFSLLGSAANLVVCEQARKAPNIGYTLTFWTHLKFGLPSTLIVTAIGLTLIK

SEQ ID NO: 96498 - protein, 110 aa, Glycine max
  Coding DNA Sequence Number=SeqID_4813
MVRTRGLRHVFGTGRGRDLSQDVPEADVPRCRRPTASARRQRVTQRAEDVPQLPKDVPHVSDGSPERTGAADGVETDRVASDGSLGAPADDEGFPGGPRDPSVLIGFADH

SEQ ID NO: 96499 - protein, 87 aa, Glycine max
  Coding DNA Sequence Number=SeqID_4814
  Gene Ontology: Mol. function=cation transmembrane transporter activity; Cellular component=integral to membrane; Biological process=cation transport
  Homolog annotation: Hit_ID=A7PP44; Match level="QueryCoverage=97%, HitCoverage=20%, E-value=5e-28, Identity=71%"; Hit description =Chromosome chr8 scaffold_23, whole genome shotgun sequence
MDISLGVTMGSATQISMFVVPLSVFVAWIMGIRMDSDFNLLETRCLSFTIIITMFTLQDGTSRYMKGVTLCYIVIGACFFVLKSSNW

SEQ ID NO: 96500 - protein, 234 aa, Glycine max
  Coding DNA Sequence Number=SeqID_4815
  Homolog annotation: Hit_ID=Q5NRP4; Match level="QueryCoverage=41%, HitCoverage=6%, E-value=5e-07, Identity=29%"; Hit description =Putative gag-pol polyprotein, identical
  Pfam annotation: Domain name=zf-CCHC; Domain location=121-138; Score =21.2; E_value=0.00093; Accession=PF00098.14; Description=Zinc knuckle
MKLCFYINGEGTSHKDPLSRILDELSSLKREKERKPQEANIDLPYFHGKDNEETNLDWEIRVEQQLKRKSTSKSYDSHSYPKKDQGQGILGVTPSKPKDDKGKTIEKQPLKACMQEKTNSMKCFKCLGKGHITSQCPTKKMLIMRGQDIYSCQDEATTSPSSSESAEAKGEESSEEIYPQEVGQPLMVKEECKETLVSIATPLRLEFIPQVKEVLDKGLVRKSLNPCALLVPKI

SEQ ID NO: 96501 - protein, 143 aa, Glycine max
  Coding DNA Sequence Number=SeqID_4816
MWWHMKEGVQYDKEFGKENKVLQMKKAEDQLHGIPIVINIQGVTWLRLVTNIVLFKIIIEACNGYNYKGRSVKWRSKQRWIIWIRNLGLLNCYGERATCFSRGNYNYMQLQSTKTLTKVILAVKKDELPNLDSTDQVGIVGVC

SEQ ID NO: 96502 - protein, 91 aa, Glycine max
  Coding DNA Sequence Number=SeqID_4817
MDKCQRRSPQTRSPQCGCSHGSAGDFDTRRKKKNDRVQAQGERRRTIGFYKTDVNNGILTSVLEKPMLTKSTYLQKCHHAFVNIGFSYNRC

SEQ ID NO: 96503 - protein, 67 aa, Glycine max
  Coding DNA Sequence Number=SeqID_4818
  Homolog annotation: Hit_ID=A5AL99; Match level="QueryCoverage=82%, HitCoverage=10%, E-value=3e-11, Identity=61%"; Hit description =Putative uncharacterized protein
MGAKHLTRTKQKLHVIKQRSPDEIRKNVCDSVIGTFLNIQGKTKDGLNTHKDLVEMGIRDQLHPRFD

SEQ ID NO: 96504 - protein, 76 aa, Glycine max
  Coding DNA Sequence Number=SeqID_4819
MVVEAMSSKRVHLLEDCYTENKREYISCGSVQVEGTSTWFFKENKGGYIPYGSLACKEFYKVKRNLKNRRLLGDWM

SEQ ID NO: 96505 - protein, 55 aa, Glycine max
  Coding DNA Sequence Number=SeqID_4820
MERSPNLSHKNDDLGLIHRWIVVKFEHHVRNPISSILTVGNFDILSDIREIPLTL

SEQ ID NO: 96506 - protein, 52 aa, Glycine max
  Coding DNA Sequence Number=SeqID_4821
MSEIGGAVKQTCPARKNVGEAAGANIGVLDLNLLLQQVQQLLLLHQILQPPL

SEQ ID NO: 96507 - protein, 402 aa, Glycine max
  Coding DNA Sequence Number=SeqID_4822
  Gene Ontology: Mol. function=transmembrane receptor activity; Cellular component=intrinsic to membrane; Biological process=innate immune response
  Homolog annotation: Hit_ID=Q8W2C0; Match level="QueryCoverage=93%, HitCoverage=91%, E-value=2e-50, Identity=48%"; Hit description =Functional candidate resistance protein KR1
  Pfam annotation: Domain name=TIR; Domain location=14-137; Score=60.0; E_value=8.1e-15; Accession=PF01582.11; Description=TIR domain
MAVPSSSSSFTYDVFLSFRGEDTRYGFTGNLYKVLHDSGIHTFIDDEELQKGDEITTALEKAIEESIIFIVVLSQNYASSSFCLNELTASSSAGFELNVEKLKKWKMALREAANLSGYHFKQGDGYEYKFIKRMVERVSSKINRAPLHVADYPVGLELPSSFVMMPRLAKIIAWELKGWLFPEQVEGEERVSSMVSSNVDCLYLSGCNLSDEILSIGLTWFANSLREIRGILPNIEHFSARNCKSLTSSCRSSLLNQKLHEAGNTMFWLSGAMFPEWFDRHSQGPSNCFWFRNKFPAIALCIAIGPRPIHYKHIEIVGPIVIINGIECLLDPENDSYLWLDTDHTCLFDLQKTDFADKLNKEVLENEWNHVEITYSVEQRFHEKEKHLEIPVFIESVIYVFK

SEQ ID NO: 96508 - protein, 157 aa, Glycine max
  Coding DNA Sequence Number=SeqID_4823
  Homolog annotation: Hit_ID=Q2PEQ5; Match level="QueryCoverage=31%, HitCoverage=13%, E-value=7e-12, Identity=70%"; Hit description =Putative uncharacterized protein
  Pfam annotation: Domain name=HABP4_PAI-RBP1; Domain location=66-157; Score=13.1; E_value=0.00081; Accession=PF04774.6; Description =Hyaluronan  mRNA binding family
MYMLILSLSLTIDLLLLMYYNQIGVCGRDKDVVMVDPMGPTVVAAADMVIVEVLAMVKLVMKDVQEEHLNSTVGLDEGFGRGNWGTQNDDIAEVIEEVVNETEKILADEKRIGEEDAAEGNKDSPANENEEKESEDKGSDKDKHKDALEKEEKSKKV

SEQ ID NO: 96509 - protein, 136 aa, Glycine max
  Coding DNA Sequence Number=SeqID_4824
  Homolog annotation: Hit_ID=A7PHX6; Match level="QueryCoverage=58%, HitCoverage=18%, E-value=9e-17, Identity=53%"; Hit description =Chromosome chr13 scaffold_17, whole genome shotgun sequence
MAIYVVQESNLESPRIIKELIHTKKRKDERIKHLTEIMGDAIISIDIELAGPEITASSSQAPSFLPTTITKDVFDLELPNLARGGTLISDYVSITMDNSCPKYVPGPQRGMEGCHDILATSGRIPCTLLASLFTLC

SEQ ID NO: 96510 - protein, 107 aa, Glycine max
  Coding DNA Sequence Number=SeqID_4825
  Gene Ontology: Cellular component=cis-Golgi network; Biological process=intracellular protein transport
  Homolog annotation: Hit_ID=A7PDP7; Match level="QueryCoverage=79%, HitCoverage=10%, E-value=2e-27, Identity=75%"; Hit description =Chromosome chr11 scaffold_13, whole genome shotgun sequence
MMRSNALVVLKGASSQFQEAIRGSGGGKACISEGVEAFVIYVRFKVATSELKPLLEEIESRSSRKEYGQILAECHRLYCEQCLSLSLLTSLYWAIVELLELESAFLI

SEQ ID NO: 96511 - protein, 427 aa, Glycine max
  Coding DNA Sequence Number=SeqID_4826
  Gene Ontology: Mol. function=drug transporter activity; Cellular component=membrane; Biological process=multidrug transport
  Homolog annotation: Hit_ID=A7QG51; Match level="QueryCoverage=93%, HitCoverage=89%, E-value=1e-115, Identity=48%"; Hit description =Chromosome undetermined scaffold_91, whole genome shotgun sequence
  Pfam annotation: Domain name=MatE; Domain location=227-390; Score =95.0; E_value=2.4e-25; Accession=PF01554.9; Description=MatE
  Pfam annotation: Domain name=MatE; Domain location=42-168; Score =17.3; E_value=0.00023; Accession=PF01554.9; Description=MatE
  Pfam module annotation: Pfam domain module=MatE::MatE; Domain location=227-390::42-168
METPLVTEKFTSESDYLPVKSLKDVKFVLWTETVKIWRIAFPMALSALFQFLTISSTSIYAGHIGDIELSSISVYQGVISALYFYLLFGMSSALVTLCGQAYGAGQIQSTYQEIADLAGRYSIQVIPYMFSCAIAFPFQTFLQSQIKVKVITCIALAVLVIQNVLLYIFINVFGWGTTGLAMVTNIIGWVYAAALVVYTIGWCKEEWTGFSWMAFRDLWSFAKLSLASSVMSCLDQWYSTCIILLAGLLDNPVIDVGSYSICFNVQGWHSMLLLGISAAISIRVSYILGKSHPRAAIYSFCVTMFQSLLLGIVFMTVIFLSKDEFAKIFTNSKDMIRAVADLAYLLGVSMVINSASHVMSGVAVGSGWQVMVGYINLACYYIVGLPIGIFLGFNQHLGVKDSSNVSPLSHYLEDQLVQGGTHLDVLR

SEQ ID NO: 96512 - protein, 337 aa, Glycine max
  Coding DNA Sequence Number=SeqID_4827
  Gene Ontology: Mol. function=drug transporter activity; Cellular component=membrane; Biological process=multidrug transport
  Homolog annotation: Hit_ID=A7QG47; Match level="QueryCoverage=97%, HitCoverage=53%, E-value=8e-59, Identity=40%"; Hit description =Chromosome undetermined scaffold_91, whole genome shotgun sequence
  Pfam annotation: Domain name=MatE; Domain location=47-273; Score =49.4; E_value=1.3e-11; Accession=PF01554.9; Description=MatE
MVSNIIGWLYAGALVVYTISWCKEEWSGFSWMAFRDLLAFAKLSLQSSVMGCLEQWYMTCIMLLAGLLDNPVIARSGLALHAAPWNKYGYKHDSYDDNHDDARSSTRVTLGGLLYDAVSGFHKLVDSEQTRESIQTRPSLRKIGRVYSGFDSTSDLTRQPLVKSVRISNALGMSQPRAAKYTFCVTMFQSLLLGVLFMNVIFLTKEDFAIIFTNSEDMIQAVADLAYLLGVTMVLNSASQVMSGVAIGSGWQVMVAFINLACYYIVGLPIGYFLGFKQHLGVKGLWGGTMCGSVLQILILLLIIRKTNWTKEVEQTAHRMRIWNVNNFRSDLAENVT

SEQ ID NO: 96513 - protein, 133 aa, Glycine max
  Coding DNA Sequence Number=SeqID_4828
  Gene Ontology: Mol. function=drug transporter activity; Cellular component=membrane; Biological process=multidrug transport
  Homolog annotation: Hit_ID=A7QG47; Match level="QueryCoverage=69%, HitCoverage=18%, E-value=3e-26, Identity=58%"; Hit description =Chromosome undetermined scaffold_91, whole genome shotgun sequence
MILADSDLAHLLGVTIVLNSASQVMSGVAIGSRWQVMVGYINLACYYIVGLPIGIFLGFKLHLGVKGLWGGTMCSSILQILVLFTIILKTKWSKECLPFAFAGFIFSMSGILRLRGMYDADGTNSSSHAIMEQ

SEQ ID NO: 96514 - protein, 125 aa, Glycine max
  Coding DNA Sequence Number=SeqID_4829
  Gene Ontology: Mol. function=drug transporter activity; Cellular component=membrane; Biological process=multidrug transport
  Homolog annotation: Hit_ID=A7PZN2; Match level="QueryCoverage=64%, HitCoverage=16%, E-value=3e-21, Identity=58%"; Hit description =Chromosome chr15 scaffold_40, whole genome shotgun sequence
  Pfam annotation: Domain name=MatE; Domain location=10-122; Score= -27.0; E_value=0.054; Accession=PF01554.9; Description=MatE
MESSIPNGIVCTALDSFNLLNFHLCWWLWWWEWGGGFGMSSALATLCGQAFGAGQIQSTCIYVQRSWIILTATCTILLPIFVYATPILKLLGQDEGIAELAGRYSIQVIVRIWDVVMPFFYGKIW

SEQ ID NO: 96515 - protein, 140 aa, Glycine max
  Coding DNA Sequence Number=SeqID_4830
  Gene Ontology: Mol. function=structural constituent of ribosome; Cellular component=ribonucleoprotein complex; Biological process =ribosome biogenesis and assembly
  Homolog annotation: Hit_ID=P50346; Match level="QueryCoverage=45%, HitCoverage=21%, E-value=1e-15, Identity=68%"; Hit description=60S acidic ribosomal protein P0
  Pfam annotation: Domain name=Ribosomal_60s; Domain location=34-108; Score=-2.0; E_value=0.015; Accession=PF00428.10; Description=60s Acidic ribosomal protein
  Subcellular localization annotation: CTP_CleavageSite=55; ConfidenceScore=5.09e-01
MAQCSSLSFLILLRMTSLRSLMVVVTSLSLAISYPTLAATPHMFVNAYKNVLGVVVETDYSFLEADKDPSKFVVIVVAALVVESGAHVAAKEEEKKEEAAKEPDDGIAHPLGIWFRFCKNIWVLCDSSGMLMMASNIMFF

SEQ ID NO: 96516 - protein, 73 aa, Glycine max
  Coding DNA Sequence Number=SeqID_4831
MKKIQGLQAPQGATSHSLKVKGEVQMKKGLWWITRYPETRKGIAVAWLRETTGAVAKASLHRAIVTAYGPKPG

SEQ ID NO: 96517 - protein, 58 aa, Glycine max
  Coding DNA Sequence Number=SeqID_4832
MSIWTSRTCTKPRRDTSKATVTMAVLKVTTLCPCKGCNNRIHGTVVGDVKRKIEVLLF

SEQ ID NO: 96518 - protein, 84 aa, Glycine max
  Coding DNA Sequence Number=SeqID_4833
MTHSSWQRKLDRCFMSKIHATQDGQWFYKGEQLVSVTTLMTYGNTPKVPSIFRYSFKGYVEEDQTIHTAKKVDYLKLGSATTND

SEQ ID NO: 96519 - protein, 46 aa, Glycine max
  Coding DNA Sequence Number=SeqID_4834
MVPKYFVHILVLLLIFVDVKSNQQVHRVVKTKIPNTGVSSFWTDLN

SEQ ID NO: 96520 - protein, 353 aa, Glycine max
  Coding DNA Sequence Number=SeqID_4835
GDLDTYCLVFLTESVVWTRLGYFLGDGTTLHLRVEVSNKASRYSRGHPWCFFSILAKRKRDKGVGVSCHKKLRAPLSLSALRQAVGLMPGSGHPSSLQDLPLAPLSVEAFIALIVVIPPSSPPPVVPIQEVSSTAKVSVLAALASMVTMNALVMPPHFSSAPPVPPSVVLASTSTYSHPCVSLDHIYTSSDADSLWNVSYKPEQKTMVGFVSAFDKNLIQATGFQHVMDSTKGYCSQSLENGAPEVVNATVAFTEAMKSNHQLSSKGIVAKKDEFAKVVADLEARLKESEFRLKESELQVGREREASKELEEELLMYKKELDLGIFYSFKDVKDDVLLNKEDIDVEEKDASEE

SEQ ID NO: 96521 - protein, 74 aa, Glycine max
  Coding DNA Sequence Number=SeqID_4836
  Gene Ontology: Mol. function=nucleic acid binding
  Homolog annotation: Hit_ID=A5BMX7; Match level="QueryCoverage=95%, HitCoverage=9%, E-value=1e-14, Identity=49%"; Hit description =Putative uncharacterized protein
MDSFEDSESEVVNLSLMAKNYESEEEDSLKKSWYIDSGCSKHMTGDALKFTHISPKNSGHVTYGDNNKGRILGV

SEQ ID NO: 96522 - protein, 274 aa, Glycine max
  Coding DNA Sequence Number=SeqID_4837
  Gene Ontology: Mol. function=hydrolase activity; Biological process =lipid catabolic process
  Homolog annotation: Hit_ID=A7PUA1; Match level="QueryCoverage=41%, HitCoverage=30%, E-value=1e-41, Identity=71%"; Hit description =Chromosome chr7 scaffold_31, whole genome shotgun sequence
MRRVHTHLPRLMDQEDSLANPLWKRIWKFPVQEKLRFFLWQFVHAAFLTNERRFGGSSSYYLRLSSRSKELQGLGYGGYYFGALDTQNSYTGFQILAAGLAPPAIPGGLWRLPTRAGPYLAPSTTPSLFTPFHFSSIDGKTSCAAIDGGLVMNNSAAAAVTHVLHNKRDFLSVNNMEDLLVLSIRNGAQAKRMNNAGECSTSMVVDIALDDISETVDQMLGNAFCWNRTDYVRIQDEEILHTIHRWEIALVVEDLRDGSCCRIVHHQAAIDGGA

SEQ ID NO: 96523 - protein, 100 aa, Glycine max
  Coding DNA Sequence Number=SeqID_4838
MVVIYMLFFLTSAMKIITSSFEGMSNQGAPRWVEPKSNVQSGRFECGYYVMHWMWCIVTAGLKDDWHKWFSDGSSLDVETITTVRQKWATYFLTFRKSSC

SEQ ID NO: 96524 - protein, 315 aa, Glycine max
  Coding DNA Sequence Number=SeqID_4839
  Gene Ontology: Mol. function=protein serine/threonine kinase activity; Cellular component=integral to membrane; Biological process=protein amino acid phosphorylation
  Homolog annotation: Hit_ID=A7QG60; Match level="QueryCoverage=92%, HitCoverage=35%, E-value=5e-94, Identity=57%"; Hit description =Chromosome undetermined scaffold_91, whole genome shotgun sequence
METQKLITHFILLFLLPLLFISCSSAFTTIDNYLISCGSQNNASIFNRIFISDSTSQGSIFLSADKSISLTNQNPPPNLPTLYHTARVFPSTGSYRFNMRMNGSHFVRFHFSPFKAQRFDLKSANFSVLVDGNLVLRNFKPSNGALLKEFILKIESNLLEIVFRPEGNSGFGFVNAVEVFTAPADFVVDYGARLVGPSGVVEYKNLSSQVLETVHRINVGGVKVTPFNDTLWRTWIPDEEFLVFKDAAKRVGITHTPNYQKGGATREIAPDNVYMTAQEMNKDHSIIASQFNITWNFPVAPGGVRHLVRLHFCDI

SEQ ID NO: 96525 - protein, 232 aa, Glycine max
  Coding DNA Sequence Number=SeqID_4840
  Gene Ontology: Mol. function=pyridoxal phosphate binding; Cellular component=chloroplast; Biological process=cysteine biosynthetic process from serine
  Homolog annotation: Hit_ID=A5C903; Match level="QueryCoverage=51%, HitCoverage=42%, E-value=1e-32, Identity=51%"; Hit description =Cysteine synthase
  Pfam annotation: Domain name=PALP; Domain location=16-232; Score= -43.7; E_value=1.1e-05; Accession=PF00291.16; Description=Pyridoxal -phosphate dependent enzyme
MVFIEPLAVIDFVAQILGKDVLCMPLSDADCVKIYDVLTSVNVQNVRIAYGMLSDAEEIGAISPGKIILVDPTTGNTALGIAFVAATKGAKGEVDKPEEIVRNTPNECMFWQFDNMTNTKIHFQTTWPEIWEDTMGNVDVLVARIGTGGTVTGIGRYLKMMNKNIKCADSMCIIFLVFETSSELALCPVLEDNYDSKIEAVLIPLLFMFQFLCSKVVSFYIDMDMPLQFATS

SEQ ID NO: 96526 - protein, 77 aa, Glycine max
  Coding DNA Sequence Number=SeqID_4841
MEMGGDLHDHINKFNWLALLLLVSLPRSFKALVQTFLVGRSTLNLDEVIAALRENERMMRAENVDDEHNAIVVMESE

SEQ ID NO: 96527 - protein, 74 aa, Glycine max
  Coding DNA Sequence Number=SeqID_4842
  Homolog annotation: Hit_ID=A9PC04; Match level="QueryCoverage=67%, HitCoverage=100%, E-value=3e-16, Identity=75%"; Hit description =Putative uncharacterized protein
MILMILHALCSLLCSWEGHTRTRVMGKCKGCGKLGRMRPSHMSAYEFSLMLAPVVSVWDCIVRKMRYSYRPEWV

SEQ ID NO: 96528 - protein, 67 aa, Glycine max
  Coding DNA Sequence Number=SeqID_4843
  Subcellular localization annotation: CTP_CleavageSite=38; ConfidenceScore=5.25e-01
MDDFLSNQKRQTSNNFGNSFINNSFKIINRQRIKLNVLMMPKVHMRLKALFKTKKLKIFKMDDQDSL

SEQ ID NO: 96529 - protein, 190 aa, Glycine max
  Coding DNA Sequence Number=SeqID_4844
  Homolog annotation: Hit_ID=A7P5B0; Match level="QueryCoverage=50%, HitCoverage=43%, E-value=6e-18, Identity=42%"; Hit description =Chromosome chr4 scaffold_6, whole genome shotgun sequence
MAIIGNALCQAFMMKHEYRSLREEDKAWGKLQRPIMVASVAIIMLAIIVFIVICLKIVFPSSDGRRTFYEIANYYWMIVFIPSMIVFMLSVVYLIAEIYPEVHENPRAFFSSSSPILLLMALVTGPFLGRIASPWRPVRATLFCENAPTMWDRHRLKGALKLGVFTHKVYTLKSPSGPLPPNSGPTQKTF

SEQ ID NO: 96530 - protein, 91 aa, Glycine max
  Coding DNA Sequence Number=SeqID_4845
MTDTTTLQQLQNRIAEMERRHEEELTNDEDMTKSKGKDPLEGLGGPMTRARARKAKETLQQVLSILFEYKLKFQGEKSKVVSCIMAQMEED

SEQ ID NO: 96531 - protein, 745 aa, Glycine max
  Coding DNA Sequence Number=SeqID_4846
RVKEFDGTCISEGLIVCLSWTSQGGLGHAVRPTSGVLRTESFDEGVEVVYGPRFACVRKTSRCSFGSVVISYHSRLSGFHPKSIVACASRCNSPWVHSGKEPLAGHGQPLALSTLPNDVAPSPRCDRVLTMDGCERIDERPWVSPKLHTLAWRGAFDRRETYKTKDSDAQTCLILPSVWVAAILGARLSNPSSGGNLDSGGASRPRRGVWPSDATGKPVPVNVILPPSSFGGVRRHSGGGDWVRDDVLKYKSCLTSVARVTALKRQVKLANPENSCKLVVKAYGWDDFPFFRVAHSRLPFFFMYRCLFEVLGVILPLTAFRCSAGALECGPFPTLPKQLSDATDVMANDMPLMLNRGRDPCYPFYWKSNPTSDPLAALDVECLTLPSFVFEVKPVGGTVPPFIVAPSVGEGGQPAGEVGPVAEAVWPQEVEGPYEYLCPEAGCRAFAATFATPATIAPSPPPIVFVQEVTPTITEAVVPATQADYVMALLSTIATPLLSAGVAATSAPTVLPYSSATLVASPSVVLATVASSSLSSRLHILLDHLYTSSDADSLWAFNKNLIRSTRVQNATDSAKVAIARTLWRVEHPKGANATIAFAKAVRSNRQLPAKIGGVLVKLLCTRLDGDKLFRRYKDLHVEKMNLGGKVESMVAEKDGLAKGGSMELKEELILYKKEVVEQHEKGFQKAVRMQDLVDVEVGPWWSCENFSPDGCEELCLTRPWLKVLPNQCRDRSIDRLSSSSDGYEE

SEQ ID NO: 96532 - protein, 224 aa, Glycine max
  Coding DNA Sequence Number=SeqID_4847
  Homolog annotation: Hit_ID=Q33BC0; Match level="QueryCoverage=83%, HitCoverage=17%, E-value=3e-07, Identity=27%"; Hit description =Transposon protein, putative, CACTA, En/Spm sub-class
AEFDILEAFDGRTKKKVLQTVGEQWRQFKSDLTRKWALAANKDSVDDTVCEKYDISKEKWAQFCQTRRDPSWEDVQKKTDVIQKQNTAPHVLSRGGYEYLEQKLMAEKTKKKLEEATQFKSTEGVIDLPSPIRQHMKWKMARTKKTGQMTSEEAKEIAETIISHFQLRIVSQGSFVPHGRQHLLIAAIGRPEHPGRVRAAGASPDAVPVAITCPITGTCTTSGA

SEQ ID NO: 96533 - protein, 315 aa, Glycine max
  Coding DNA Sequence Number=SeqID_4848
  Gene Ontology: Mol. function=ATPase activity, coupled to transmembrane movement of substances; Cellular component=integral to membrane; Biological process=transport
  Homolog annotation: Hit_ID=A7NW00; Match level="QueryCoverage=44%, HitCoverage=14%, E-value=1e-38, Identity=51%"; Hit description =Chromosome chr5 scaffold_2, whole genome shotgun sequence
MEIGGLGKGTSFVVQVEGTSTWVVVTENKRGYISCGLVQVEGTSTWLFKENKGGYIPCGSLLVKDFTRLKRNLKDCSWNYLFPLGTISAVGTYNTITDKSDVYSFWVVLIELISSMPVVLAARERDETSLILTAFAAGQAATFKMFEAIKRQPDIDAYDTDGRLLDDISGDIELKKVCFSYTSRPDKQILNGFSISIPSGTTAALEPVLFACSIKQNIAYGKNVPTDEEIEAAAELANVAKFIDKFLHGLDTMVGKHIRTSTNLRGAMGYIAPEWLRNAPITAKVDKYSFGAKECTLLSMYVCDNTTLPLGELLS

SEQ ID NO: 96534 - protein, 467 aa, Glycine max
  Coding DNA Sequence Number=SeqID_4849
  Gene Ontology: Mol. function=hydrolase activity, acting on glycosyl bonds; Cellular component=cellulose and pectin-containing cell wall; Biological process=cell wall organization and biogenesis
  Homolog annotation: Hit_ID=Q2HUV5; Match level="QueryCoverage=92%, HitCoverage=93%, E-value=0.0, Identity=77%"; Hit description =Glycoside hydrolase, family 28
  Pfam annotation: Domain name=Glyco_hydro_28; Domain location=75-431; Score=30.9; E_value=1.1e-10; Accession=PF00295.8; Description =Glycosyl hydrolases family 28
MAVVGVIFTVLLLGLQGVRVVECRVANGLDCFEYPAISCRKHSAVLTDFGGVGDGKTSNTKAFQYAISNLSHYASDGGALLVVPPGKWLTGSFNLTSHFTLFLQKEATILGSQDESEWPTLPVLPSYGRGRDAPDGRFSSLIFGTNLTDVVITGYNGTIDGQGSYWWDKFHKGELKLTRPYMIEIMFSDHIQISNLTLIDSPSWFVHPIYSSDIIIQGLTILAPVDSPNTDGINPDSCSNTRIEDCYIVSGDDCVAIKSGWDESGIKFGMPSQHIIIRRLECVSPDSAMIALGSEMSGGIRDVRAEELTALNTQSAVRIKTAVGRGAYVRDIFVKGMNLNTMKYVFWMTGSYGSHPNTDFDPKALPNITGINYRDVIADNVTYSARLEGIANDPFTGICISNVTIHSGKKKPQWNCTDIEGVTSNVYPKPCELLPLKEKIECPYPDDKLPIESVQLKTCSFKSVSFF

SEQ ID NO: 96535 - protein, 256 aa, Glycine max
  Coding DNA Sequence Number=SeqID_4850
  Gene Ontology: Mol. function=DNA binding; Cellular component=nucleus; Biological process=response to salicylic acid stimulus
  Homolog annotation: Hit_ID=Q0PJI5; Match level="QueryCoverage=80%, HitCoverage=65%, E-value=3e-91, Identity=85%"; Hit description=MYB transcription factor MYB136
MVFVIFSMLPHIRSHAQKYFLKVQKSGTSEHLPPPRPKRKAAHPYPQKASKNAPVLSQVSGRFQSSSALLEPGYISKNDAPPMLKTPIMNTVSSSWSNNTLQTVNLSPVKKVNNPCSSGESTPKVRPVGESNGQGNKIHPLRGKFNVLFLSAVLPDFTEVYGFIGSLFDPNATEHLQKLKKMDRIDVETVLLLMRNLSINLTSPDFEHHIHGMPLSSAMSIAFHFSSYYQCPFIHFVLELSSIKKHQTRRLLLIII

SEQ ID NO: 96536 - protein, 318 aa, Glycine max
  Coding DNA Sequence Number=SeqID_4851
  Pfam annotation: Domain name=Transposase_24; Domain location=69-206; Score=-25.5; E_value=0.097; Accession=PF03004.5; Description=Plant transposase (PttaEnSpm family)
MECFIHLRLWKRLSHCPLGNNLLTHGQHGEQFQKIIRNSFSSILRENWSGDPRKRMKLRKLLTRKPLIDFLICLGMPEMKIKDHIRLEIVSGIITLECTWTGGSISLQDHTIRLSDELGRSAYVGEIFQQTHLRKDIGQFVDDRSRQTHARLSQARSNAASSVGESKITPLDLAKEQRLRTWCWVAATGPKRKGCLYGTGEILLILINVEMTTSCSIHKDLPVALKIHRSLTEGRSFVNQRRRCVYFSQLFFNFYLLKRGTIFINFNNLTSSIRNINNNKTMINQMTSNQMTNNKTMTNRDTLPMNILIIDITTQSYY

SEQ ID NO: 96537 - protein, 402 aa, Glycine max
  Coding DNA Sequence Number=SeqID_4852
MGSKGSFCNVELGEPAGTAELVEELVNCRYREAILDCCKVGEQGRDVWVNGGWGNGCKEELYVEEGTSGIGLDQSSKLWRRDCLQVLSRITFELNDRTTMDELHGVALNLDGGVRAHMVAFELVIDPNKDTQGWGGFSGQVQVPEEPRLHKIVCAPTVNEDDNGMLFFICNEKIEARGTSVPMGVLLVAVEAETMLLPVSHFGGCQLLQGGGVDQQVFPHGGEPIPRPVPGFKLMQVIANRAPLCEFEEDSCWVLVWGVGEARLNGLQKRHPRRELVVAGHPLEPRKSGAFHSEGGDEGSVPLNFGTLSFIFGGLWVVFGAGLGEEEDGEAEGQALQWLPQDVLRWIWSESPPLERRNESTRMLRTEKEPSIQGLGTFRIKFFMMLSSNNYPNGLMAYALEE

SEQ ID NO: 96538 - protein, 259 aa, Glycine max
  Coding DNA Sequence Number=SeqID_4853
  Gene Ontology: Mol. function=calcium ion binding; Cellular component =late endosome membrane; Biological process=protein transport
  Homolog annotation: Hit_ID=A5CAE2; Match level="QueryCoverage=30%, HitCoverage=13%, E-value=1e-24, Identity=70%"; Hit description =Putative uncharacterized protein
  Subcellular localization annotation: CTP_CleavageSite=50; ConfidenceScore=5.63e-01
PVPSTTAAKNPQTPPPLQVPPASSPRWWHRNWGFRRVVPTPHRAVRVSVRLFQDVEGEADCHPRAVIPALRAAYNVTVMDREGTTKGQEEQEGSPLPDHIDFYNEVSTAARLNDDVLLLVNVVEGILHPDPHHPPLEGEKARKSLFFLGFLVLFLSLPSSMAKFVVEKNSLTVTSSDNIKGTHDRAIWNFRILQYEGSIVGNILYPKDNKKGCKEFDEYGISFKSKPSALPTTVLLDRGSKILLPSNLFMFDFKVSGFA

SEQ ID NO: 96539 - protein, 62 aa, Glycine max
  Coding DNA Sequence Number=SeqID_4854
MDVQPEVQYQQKPKDPRGTDQYFHPVSLTACLNFMSKPPIIHIFGANCTVIVPTPLAIIVLD

SEQ ID NO: 96540 - protein, 61 aa, Glycine max
  Coding DNA Sequence Number=SeqID_4855
MGKSFPESMLFSHGHAREVADIHVEEEGEDLCGEGEEAKQGRRLLFGVFLVARGGIVDETL

SEQ ID NO: 96541 - protein, 214 aa, Glycine max
  Coding DNA Sequence Number=SeqID_4856
  Subcellular localization annotation: CTP_CleavageSite=47; ConfidenceScore=5.50e-01
MEAPLKSEVFCSSFMLFFPAFGGTMSAESVIPNSSSSVNLEKATTVNSFLAVRLSINRLVVWSQQLSLRYFADLLSIFGLPLVGLFARCLDSNAFDFVFFIQGFVFVSILDPLLSSKLAINEPVDWNHQLNRRHFANLLCISLSTFDRAICQARLTGALSKGGKMRGVATNEGISTSYVDKSGAFAPAYPPSKRKSDLRSSFLRVNQAILFTWK

SEQ ID NO: 96542 - protein, 166 aa, Glycine max
  Coding DNA Sequence Number=SeqID_4857
MRIFAGQVEPLNINHYGICKDFAMFQKETGKELKVGAKGSILDNLGEKQPARLGELLAWASYSPRRASANFHLLAKPICQLSEPSTERNTPLAECDEESGRRMSCACSLSEGFLERKVQIPESFESFCYAKTGRELSMKRKPSWEHEMSLKLPRYGELNPLLVLPC

SEQ ID NO: 96543 - protein, 68 aa, Glycine max
  Coding DNA Sequence Number=SeqID_4858
MEVKMEETDHKNGEERKHGGNLVSEETTGEGWRRRHVEQPKLEAGCGWLCSNRKRIEENRRRKKERGT

SEQ ID NO: 96544 - protein, 52 aa, Glycine max
  Coding DNA Sequence Number=SeqID_4859
DATTDPWFQLLDEKKLIPGDEVVFYYRFDDHAWELLVRKDIEWENDDINFEE

SEQ ID NO: 96545 - protein, 104 aa, Glycine max
  Coding DNA Sequence Number=SeqID_4860
MNKQQLKRKSTSKSYGSHSYPKKDQGLGILGASPSKPKDDKGKPIEKQPPKATPLIELVRNNVPSWEDVNERGVEGRGPEYEEPRDLRSNHFQGGGDDAILPPK

SEQ ID NO: 96546 - protein, 185 aa, Glycine max
  Coding DNA Sequence Number=SeqID_4861
MREVTISLDDVMSLLHLPMVGSLHVFQPLHVDDAVQMLVELLMVSTEAARAETGQCRGLYVHLQWSDWEVHLGSSCAGAYVRPPKWCFYLHQPTTWRLHHTVAEDCEEHTYTDVQGVPGPTPDSGCLLDPIWGAPTDPGVPYDFMLFWSAALGARRCVLPTREGHAAVWIHPNHSCSACRFMGVV

SEQ ID NO: 96547 - protein, 74 aa, Glycine max
  Coding DNA Sequence Number=SeqID_4862
MFLQKAVASTGSNLALLGELGGKLLPYFPINRGRSEGERVSPSENPSRGASIMFLWVISRRFSTVLRRSSVFNR

SEQ ID NO: 96548 - protein, 58 aa, Glycine max
  Coding DNA Sequence Number=SeqID_4863
MERIQKFTSSDNSQGWFHGLSAKMHHQKRKTLDEAPLSSSKSKTQHDHRSTSTPYGSH

SEQ ID NO: 96549 - protein, 126 aa, Glycine max
  Coding DNA Sequence Number=SeqID_4864
MGETHEAPRDHNLADFDPHLGHAAEGQAFCSVPMPNTLGAPQYCPQLQPLHFMVGRAPPAMVEREKFDHIEERLRVIEGVVPSARRGHSSEVQGVGFRKYKGTTCPKNYLKMYYRKMGAYANDDNL

SEQ ID NO: 96550 - protein, 61 aa, Glycine max
  Coding DNA Sequence Number=SeqID_4865
MGACPRKEYARSRHQHLFEENVGKTGKEENRGEACHLARPGEPGCFLQKQPPSGGRIWKAQ

SEQ ID NO: 96551 - protein, 49 aa, Glycine max
  Coding DNA Sequence Number=SeqID_4866
  Homolog annotation: Hit_ID=A8AES9; Match level="QueryCoverage=100%, HitCoverage=45%, E-value=2e-18, Identity=89%"; Hit description =Putative uncharacterized protein
MSKLYSPESAASGVEQVIQLLEGRWKLIILFHLFDGQVQRYSDFEKLIP

SEQ ID NO: 96552 - protein, 109 aa, Glycine max
  Coding DNA Sequence Number=SeqID_4867
YHQGLETRDQEARREEHGRNKFRGALWGSNNELKLWREERDQSRVDSLILKDELKVCSRSKRNLSQCLCETKTNMLASVSKYQEELNLATTHEHRVADEYAQVYAEKGG

SEQ ID NO: 96553 - protein, 183 aa, Glycine max
  Coding DNA Sequence Number=SeqID_4868
MASRKRKAPSTPTQVRFDRSRFTSQEAWERYTNIIVPRKLLPERNVVVYYTEFDEFKEELERRHWDKELTDFRDGNIDVAIVKEFYANLYDPEDKSPKQELAAKLCIPGRGFELNADGQPLKILRKNMTTLAQTWSVLSFSNLIPTSHTSDVTLDRARLIYGIIMKMDMNVGYLISHQISLTA

SEQ ID NO: 96554 - protein, 44 aa, Glycine max
  Coding DNA Sequence Number=SeqID_4869
MDLFGSRRGSITMLIGWTSQKSGADIEEEEPTDLRSNPLQGGRG

SEQ ID NO: 96555 - protein, 27 aa, Glycine max
  Coding DNA Sequence Number=SeqID_4870
HTRESRVALSLKGRLRQLATPLGMIVR

SEQ ID NO: 96556 - protein, 107 aa, Glycine max
  Coding DNA Sequence Number=SeqID_4871
  Subcellular localization annotation: CTP_CleavageSite=29; ConfidenceScore=5.42e-01
LPSLGTDVWGANTFPVRKYNSRTFHLKVRRSRLFRFFRRFPQINVGGDSACIPFVEHASRESRVALPPKGRLRQHGLEIGPIFRQGQGPQGPPEMETRPRKTMTWPM

SEQ ID NO: 96557 - protein, 151 aa, Glycine max
  Coding DNA Sequence Number=SeqID_4872
MQSQFQSQMQSQGLALPPEPMAGPSGRFYEGSTVHNIPLLPGQVKVGVEEVKDALAPVPVPTDEEIVSPTKPPQRVDPEVNDPLYMMILTILELFLKPFQVNWDATVFKVFNPDFPLYIKHKDLSKIAHGGQCLSISIIQLWILYVNLAHC

SEQ ID NO: 96558 - protein, 144 aa, Glycine max
  Coding DNA Sequence Number=SeqID_4873
  Homolog annotation: Hit_ID=A5AK77; Match level="QueryCoverage=67%, HitCoverage=12%, E-value=4e-10, Identity=37%"; Hit description =Putative uncharacterized protein
MAQPPPRERNLREMAAPDFTYESLCIQYPDEGVPYVLKTGLIHLLPKFHVLACEDPHKHLKEFHIVCSTMKPPDVQEDHIFLKDFPHSLEGVAKDWLYYLAPSNMERSMIDATSGGALGDMTPAEARNLIEKIGFQLPTIQCKK

SEQ ID NO: 96559 - protein, 133 aa, Glycine max
  Coding DNA Sequence Number=SeqID_4874
GVPVAATKVIRPPITWAFIEKYYTQRQAQGDAPQAADAPPPHQAGQAGSFDTERYLRHLVRQQAANHRAHSQGFASFSCPTPDQFRAEVAWPGDWPEAQAGEAPPEAPGDGEEAHEDEEMADLLDFLGGSGAT

SEQ ID NO: 96560 - protein, 88 aa, Glycine max
  Coding DNA Sequence Number=SeqID_4875
MALGFPALVMGLYQSYRVPIPPARSCYRDIGITLARHPVDPEKSNRVLRFPVLITGLYQFYGVPVAPSKVIRPRNNRAFIKKYCAPRK

SEQ ID NO: 96561 - protein, 87 aa, Glycine max
  Coding DNA Sequence Number=SeqID_4876
MAKDPLGHQGMMSFQKEEMKCGYKKRKKGIKEMRQLQGVERGLRGLLEVKGLYPTTTTTPFPTRWGRLHGSTSAIMFYQVPYFYPNH

SEQ ID NO: 96562 - protein, 58 aa, Glycine max
  Coding DNA Sequence Number=SeqID_4877
MSFNTNIITSGFLEILRMREATANTCQEHHSGIGILGQERESRLSSGKTEICITLSLR

SEQ ID NO: 96563 - protein, 2353 aa, Glycine max
  Coding DNA Sequence Number=SeqID_4878
  Gene Ontology: Mol. function=nucleotide binding; Cellular component =cytoplasm; Biological process=defense response
  Homolog annotation: Hit_ID=A5AWL3; Match level="QueryCoverage=99%, HitCoverage=94%, E-value=0.0, Identity=30%"; Hit description =Putative uncharacterized protein
  Pfam annotation: Domain name=AAA; Domain location=174-378; Score= -25.8; E_value=0.0036; Accession=PF00004.20; Description=ATPase family associated with various cellular activities (AAA)
  Pfam annotation: Domain name=Dynamin_N; Domain location=175-402; Score=-46.8; E_value=0.072; Accession=PF00350.14; Description =Dynamin family
  Pfam annotation: Domain name=LRR_1; Domain location=1048-1075; Score =2.4; E_value=1.1e+02; Accession=PF00560.24; Description=Leucine Rich Repeat
  Pfam annotation: Domain name=LRR_1; Domain location=1107-1136; Score =0.1; E_value=2.9e+02; Accession=PF00560.24; Description=Leucine Rich Repeat
  Pfam annotation: Domain name=LRR_1; Domain location=1308-1332; Score =1.7; E_value=1.5e+02; Accession=PF00560.24; Description=Leucine Rich Repeat
  Pfam annotation: Domain name=LRR_1; Domain location=1358-1383; Score =7.3; E_value=14; Accession=PF00560.24; Description=Leucine Rich Repeat
  Pfam annotation: Domain name=LRR_1; Domain location=1558-1583; Score =7.8; E_value=11; Accession=PF00560.24; Description=Leucine Rich Repeat
  Pfam annotation: Domain name=LRR_1; Domain location=1585-1606; Score =7.5; E_value=12; Accession=PF00560.24; Description=Leucine Rich Repeat
  Pfam annotation: Domain name=LRR_1; Domain location=1780-1800; Score =0.3; E_value=2.7e+02; Accession=PF00560.24; Description=Leucine Rich Repeat
  Pfam annotation: Domain name=LRR_1; Domain location=1810-1835; Score =0.6; E_value=2.4e+02; Accession=PF00560.24; Description=Leucine Rich Repeat
  Pfam annotation: Domain name=LRR_1; Domain location=2003-2028; Score =1.8; E_value=1.4e+02; Accession=PF00560.24; Description=Leucine Rich Repeat
  Pfam annotation: Domain name=LRR_1; Domain location=2030-2051; Score =5.0; E_value=36; Accession=PF00560.24; Description=Leucine Rich Repeat
  Pfam annotation: Domain name=LRR_1; Domain location=2083-2106; Score =0.4; E_value=2.6e+02; Accession=PF00560.24; Description=Leucine Rich Repeat
  Pfam annotation: Domain name=LRR_1; Domain location=560-581; Score =7.5; E_value=12; Accession=PF00560.24; Description=Leucine Rich Repeat
  Pfam annotation: Domain name=LRR_1; Domain location=583-604; Score =4.3; E_value=50; Accession=PF00560.24; Description=Leucine Rich Repeat
  Pfam annotation: Domain name=LRR_1; Domain location=606-627; Score =14.2; E_value=0.51; Accession=PF00560.24; Description=Leucine Rich Repeat
  Pfam annotation: Domain name=LRR_1; Domain location=629-652; Score =12.2; E_value=1.7; Accession=PF00560.24; Description=Leucine Rich Repeat
  Pfam annotation: Domain name=LRR_1; Domain location=791-812; Score =3.1; E_value=80; Accession=PF00560.24; Description=Leucine Rich Repeat
  Pfam annotation: Domain name=LRR_1; Domain location=883-904; Score =4.6; E_value=43; Accession=PF00560.24; Description=Leucine Rich Repeat
  Pfam annotation: Domain name=LRR_1; Domain location=907-927; Score =2.6; E_value=1e+02; Accession=PF00560.24; Description=Leucine Rich Repeat
  Pfam annotation: Domain name=LRR_1; Domain location=966-994; Score =1.2; E_value=1.9e+02; Accession=PF00560.24; Description=Leucine Rich Repeat
  Pfam annotation: Domain name=MMR_HSR1; Domain location=173-275; Score= -19.3; E_value=0.062; Accession=PF01926.14; Description=GTPase of unknown function
  Pfam annotation: Domain name=NACHT; Domain location=173-344; Score= -22.0; E_value=0.0031; Accession=PF05729.3; Description=NACHT domain
  Pfam annotation: Domain name=NB-ARC; Domain location=134-446; Score =70.6; E_value=5.1e-18; Accession=PF00931.13; Description=NB-ARC domain
  Pfam module annotation: Pfam domain module=AAA::Dynamin_N::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::MMR _HSR1::NACHT::NB-ARC; ...
  Pfam module annotation: Pfam domain module=Domain location=174 -378::175-402::1048-1075::1107-1136::1308-1332::1358-1383::1558 -1583::1585-1606::1780-1800::1810-1835::2003-2028::2030-2051::2083 -2106::560-581::583-604::...
  Pfam module annotation: =606-627::629-652::791-812::883-904::907 -927::966-994::173-275::173-344::134-446
MEAVSSALLEPVTNSVLDLLKKQVDYIRYRRNFDELDECVKQLKLEKARVDHQCDEAVKNGHKIEGKAREWLGKVGKFETEVEKYWNDDGHKKTRFSNCLFPYFRHRLGRLAKKMAVEGKKITDDCPKSAEIAYRVNVTSNDAILSNTDLMDFGSRKSIMEQIMATLEDPTVKMIGVHGPGGVGKSTLIKAIAEIARDKKLFNVVAFSEITVNPNLKKVQEDIAYVLGLRLEGEGENVRADHLRRRLKKEKENTLIILDDLWDRLDLNRMGIPLDGDVDDNDKQGLKGPTKEKSLGDYKGCKILLTSRNKNVLTDKMEVKSTFCVEELDEKDALKLFRKEARIQGEMSQWKQEIVKKYCAGLPMAIVTVGRALRDKSDSEWEKLKKQDLVGIQNSMEISVKMSYDRLENEELKSIFFLCAQMGHQPLIMDLVKYCFGLGILEGVYSLGEARGRISTSIQKLKNSGLVLDGSSSIHFNMHDLVRDAALSIAQKEQNVFTLRNGKLDDWPELEKCTSISICNSDIIDELPEEINCPQLKFFQIDSDDSSLKIPNSFFKGMKKLKVLMLTGIQLSSLPSSIESLSDLRLLYLERCTLDHNLSIIGKLKKLRILSLSGSRIENLPTELKDLDKLQLLDISNCSIVTMIPPNLVSRLTLLEELYVRKCFMEGSEEGERNQCQISFISELKHLHQLQVVDLSIPCAEVFPKELFFDNLSDYKIEIGNFKTLSAGDFRMPNKYEKFKSLALELKDDTDNIHSQKGIKLLFKRVENLLLGELNGVQDVINELNLDGFPHLKHLSIINNPSIKYIINSKDLFYPQDVFSKLESLCLYELRKIEMIYFSSGTEIICFSPFTDCSFTKLKTIKVKKCDQLKNLFSFCMVKLLASLETIGVSNCGSLEEIIKIPDNSDKIEFLKLMSLSLESLSSFTSFYTTVEGSSTNRDQIQITVTENEHSEMAPPLFGELVEIPNLENLNLISMNKIQKIWSDQPPLRKLKGLFVSKCKMMEKIFSTEGNSAGKVCVFPKLEEIHLEGMVELTDIWQAEVSADSFSSVTSVNIDSCNKLDKNFPSHMEGWFASLNSLKVYYCQSVKVIFEIKDSQQADASGGIDTNLQVVDVCGLPKLERVWSRDPGGILNFKKLQSIQVFSCDRLRNVFPASVAKDVPKLEYMSVRWCDGIVEIVACEDGSETNTEQLVFPELTDMKLCNLSSIQHFYRGRHPIECPKLKKLEVRECNKKLKTFGTGERSNEEDEAVMSAEKIFPNLEYLYIDFDEAQKWLLSNTVKHRMHRLKELRLTEVNDGERLCQILYRMPNLEKLYLSGAKYLLKESSESRLGTVLQLKELDLWWSETKDIGFEREPVLQRLELLSLNGCDKLRNLGPPSVSLAYLTNLEVWYCKGLRNLMASSTAKSLVQLKSMKIGGCDELEEIVSDEGNEEEEQIVFGKLITIELEGLKKLKSFCSYKKCEFKFPSLEVLIVRECRMMERFTEGGARAAKLQNIVTADEEGKEEAKWQWEGDLNATIQKGFNKLFESASTESSLSLIDSPLQVIWLDSRRIPKSCFSKLKSLTVDGCQFLTDVVIPFYLLPFLTNLEELEVSDCRSVKSIFEVKTAMGLGAAAFPRPLPFSLKKLTLERLPKLENVWNEDPHGILTMQLLQHVIIEKCKCLTSVFPASVAKDLVKLEDLFVQDCEELMEIVAEDNADPRGENLELTFPCPCVRSLKLQDLPKFKYFYYCSPQFDMFQTPSEDEMPTSNLQCLSLGEKGLEMIKRGEFQRNFLHKLQPAPNIEKLVVCDGSFKEIFCFDSLNVDEAGLLLQLKVLCLDSLPELVSIGLENSWIQPLLGNLETLEVIAKSLTRLKRMEIEWCDSIEEVVSKKGGESHEDEIIFPQLKCLKLEGLGKLRRFYRGSLLSFPLLEELSVIYCEWMETLCPGTLKADKLVQVQLEPTWRHSDPIKLENDLNSTMREAFWEKLWKYARWESVLHLKDSRLQEIWLRLHSLHIPPHFRFIWLQTLIVDGCHFLSDAVLPFSLLPLLPNLETLKVRNCDFVKIIFDVTTMGPLPFALENLILERLPNLENVWNSNVELTFPQVKSLSLCDLPKLKYDMLKPFTHLEPHPLNQVSIQKLTPNIEHLALGVHELKMILRGEFQGNHLNKLKVLALFFHTESDVFLQRVPNIEKLEVLDGFFTETFCFDSLNVDEAGLVSQLKVICWDSLPELVSIGSENSGIVPFLRNLETLQVVSCFMSLINLVPCTVSFSNLTYLKVKSCKSLLYLFTSSTARSLGQLKTMEIGWCDSIEEIVSSTEEGDESDENEIIFQQLNCLKLIRLGKLRRFYKGSLSFPSLEEFTLKDCERMESLCA

SEQ ID NO: 96564 - protein, 83 aa, Glycine max
  Coding DNA Sequence Number=SeqID_4879
  Subcellular localization annotation: CTP_CleavageSite=66; ConfidenceScore=5.00e-01
GTFGIFIKFVESFSLGSLLNQSQTYQGNPCGVYPDLSSFTGSGVIQISEPVSSDLLLGRITSSGIRASTLDTAYSNSVWVKIT

SEQ ID NO: 96565 - protein, 213 aa, Glycine max
  Coding DNA Sequence Number=SeqID_4880
MQSQGLALPPEPEVGPSAVCVSTKESCVDPSGNDPDTGRVYEGSTTVHNIPLLHDQVKVGVEEVKDADAPVSVPTNEGAVGPAKPVDRPDHEVDDPLYLMTLTIPQLFLKSLQVMWDATVFGVFNEDFPLYIKHEDLSEIAHGGQCLSISVIQLWTLHLIETSMQAGNFDVYGFIEPQSIQRSGQSQFESKSYMKNWMQNSKWNVYLGAYMNG

SEQ ID NO: 96566 - protein, 123 aa, Glycine max
  Coding DNA Sequence Number=SeqID_4881
MTTMIVDTLPVFYYEKMVSYTPSSFDDMVFTDERIDVGLKRGKFSHPAWTNEKTGANEEGEDEGEARAVTAIPIQPSFPPTQQCHYSANNKPSPYPPPNYPQRPSLKSTTKPTYRTSNDKHHL

SEQ ID NO: 96567 - protein, 262 aa, Glycine max
  Coding DNA Sequence Number=SeqID_4882
MASRKRKSTTSRPQPNYDTRRFTLEEAWNRYADNTLDRNILPERNMKLYIMEFDEFRRELERRNLHKHLTNLADGSIDVTVVKEFYANLYDPEDNSPKQVRVRGHLIKFDADTLNTFLETPVVLEPGETIPRYSRFCRLRMDPQEIAARLCIPGRGFVLNAEGMPWKLLRRDLTTLAQTWSVLSYSNLASTSHTFDLNLDRARLVYGLVTRMDMNIGALISGKISLIAQSNSSRLGFPALITTLCKAMGVTFDSLSYESLSV

SEQ ID NO: 96568 - protein, 100 aa, Glycine max
  Coding DNA Sequence Number=SeqID_4883
MWGYLMVIRTFCQPEASEHVDTQRLTSSFAPFVNQRQGYLMVIRTFLLILTSEVRWQAEIPEWLSVQRQLLLILTREVKWHARVPYGYPHFLSTRGKRAR

SEQ ID NO: 96569 - protein, 272 aa, Glycine max
  Coding DNA Sequence Number=SeqID_4884
  Gene Ontology: Mol. function=inorganic diphosphatase activity; Cellular component=cytoplasm; Biological process=phosphate metabolic process
  Homolog annotation: Hit_ID=P65749; Match level="QueryCoverage=55%, HitCoverage=86%, E-value=1e-83, Identity=98%"; Hit description =Inorganic pyrophosphatase
  Pfam annotation: Domain name=Pyrophosphatase; Domain location=1-151; Score=185.0; E_value=1.9e-52; Accession=PF00719.10; Description =Inorganic pyrophosphatase
NADPIKYEVDKESGALFVDRFMSTAMFYPCNYGYINHTLSLDGDPVDVLVPTPYPLQPGSVIRCRPVGVLKMTDESGEDAKLVAVPHTKLSKEYDHIKDVNDLPELLKAQITHFFEHYKDLEKGKWVKVDGWDNAEAAKAEIVASFERAKQKRPKNNATRRWRCRFQLLVSVQPVSALNLRKPLDGALVDIHPRAAVRRLDQMARVFTALGAQRIQLGQRRCVDTIHFTMYCALARHRAWIVAQAVQLIIVDTMSAQQLGVGHPVAVALFAS

SEQ ID NO: 96570 - protein, 129 aa, Glycine max
  Coding DNA Sequence Number=SeqID_4885
MVGYTPSSFADLVFASERIEVGLKRGKFNHPAWTNEKTGANEEGENEGETHAATVVPTWKIPHQLNNIITQPISALLITHHAVIHKAITPARVPQPPFFRGYDLNATCAYHGGVPRHSIEHCMTSKRKV

SEQ ID NO: 96571 - protein, 104 aa, Glycine max
  Coding DNA Sequence Number=SeqID_4886
MATARWALKHPVYGIVILRLGIYTNRPNVSKTTSLNEKILRDSGISTNTIDNNEVNTNVTVQTICMYKTKILDVSISFLNDHLEETLGPTKIGENHSKCINLTQ

SEQ ID NO: 96572 - protein, 77 aa, Glycine max
  Coding DNA Sequence Number=SeqID_4887
  Homolog annotation: Hit_ID=A1FYH1; Match level="QueryCoverage=85%, HitCoverage=26%, E-value=1e-22, Identity=83%"; Hit description=Two component transcriptional regulator, winged helix family precursor
MGFRWRNCGDTMEASTLRPRPCMHAAPALAALVLIVEDEAEIADILTAYLEREGLRTLRAADGHSALDLHRSARPDL

SEQ ID NO: 96573 - protein, 142 aa, Glycine max
  Coding DNA Sequence Number=SeqID_4888
MRGQDIYSSQDKATTSPSSSESEEAKGEESSEEIYPQEEGQPLVVKEKCKEISVSSKRQPPHFLFCKKTLVSIATPLGLEFIPRVKKLLDEGLVHKSLNPCALLVPKIGIIRHQVPKIGGMMNVLSGATLFCKITRTPNIFM

SEQ ID NO: 96574 - protein, 186 aa, Glycine max
  Coding DNA Sequence Number=SeqID_4889
  Homolog annotation: Hit_ID=Q0ZCD0; Match level="QueryCoverage=91%, HitCoverage=15%, E-value=8e-08, Identity=26%"; Hit description =Integrase
MERSMIDSSNGGALGDMTPAEARNLIEKMASNSPQFSARNDAIVLRGVHEVATDSSSSTENKKLEGKLDALVNLVTQLVMNQKSTPVARVSGLCSSADHHTDLYPSLQQSGVNEQPEAYAANIYNRPPQQQNQQQQNNYDLSSNRYNPGWRNHPNLRWASPPQQQQPVPPFQNASGPSKPYAPPPI

SEQ ID NO: 96575 - protein, 251 aa, Glycine max
  Coding DNA Sequence Number=SeqID_4890
  Homolog annotation: Hit_ID=Q84VH5; Match level="QueryCoverage=69%, HitCoverage=25%, E-value=7e-60, Identity=71%"; Hit description =Envelope-like protein
MAPVTMGLCTVIVQIQCWLGIVMLIGLEVQMTEKALLVDVSIWATILFHGSARSRTVCPYLLQKLSILQQEAAPPVPEKLVPKRQQGVKISENPSLATSPREVDTEMDKKIRSIVSNILKNASVPDADEDVPTSSIPDVAVPDAEKDVPTSSTPNTEAVSSPSKEESTEKEEQATEETPAPRAPEPAPGDLIDLEEVESDEEPIANKLAPGIAERLQSRKGKTPIKRSGRIKTMAQKKSTPITPTSSRRSK

SEQ ID NO: 96576 - protein, 61 aa, Glycine max
  Coding DNA Sequence Number=SeqID_4891
MGIQKTSQAGEGRHKRIQAVSPLFFWKREKRDIKRIPAVSPWQFFLAKGEENEKMIAQGIL

SEQ ID NO: 96577 - protein, 52 aa, Glycine max
  Coding DNA Sequence Number=SeqID_4892
MAGIISDDESGEGTNTEDPDVDFERIASQAEDGEDNDMGFSPELERMVAQED

SEQ ID NO: 96578 - protein, 23 aa, Glycine max
  Coding DNA Sequence Number=SeqID_4893
MGCGGGRERRKKDDGGGGEGRKR

SEQ ID NO: 96579 - protein, 71 aa, Glycine max
  Coding DNA Sequence Number=SeqID_4894
MCLLGKHIHNLTVNETSFLGRPSILSSEGKGKSSYLGSRFMAEGLRLWLKKACRRQDMTYVRLFAWQAVQG

SEQ ID NO: 96580 - protein, 345 aa, Glycine max
  Coding DNA Sequence Number=SeqID_4895
  Homolog annotation: Hit_ID=Q84VH5; Match level="QueryCoverage=100%, HitCoverage=51%, E-value=1e-141, Identity=75%"; Hit description =Envelope-like protein
MATSPKETSAPGSPSAPSNQERPEFNIQPIQVIPGQAPVPEKLVPKRQQGVKISENPSPATSPREVDPEMDKKIRSIVSNILKNAAVPDAGEDVPTSSTPNVSVPDVDKDVPTSSTPNAEALPSPSEEESTEEEDQASEETPAPRAPEPAPGDLIDLEEVESDEEPIANRLAPGIAERLQNRKGKTPLKRSGRIKTMAQKKSTPITPATSRRSKVAIPSKKRKEISFSSSDSDDDVELDVSTSKRAKKSGRKVPGNVPDAPLDNISFHSIGNVEKWKYVYQRRLAVERELGRDALDCKETMELIKAAGLLKTVTKLGDCYEGLVREFIVNIPSDITNRKSDEYQK

SEQ ID NO: 96581 - protein, 77 aa, Glycine max
  Coding DNA Sequence Number=SeqID_4896
  Homolog annotation: Hit_ID=Q94LS3; Match level="QueryCoverage=79%, HitCoverage=4%, E-value=3e-07, Identity=45%"; Hit description =Putative helicase
NIWNSRPYVSSLSHMLDERNAHAKSFRMVRDRLANDEADNIKLQLIATREKDGCVYNMPNVLEITALIVTPFTPTYI

SEQ ID NO: 96582 - protein, 100 aa, Glycine max
  Coding DNA Sequence Number=SeqID_4897
ELFPEEPWCLPTWMAKSYLHPDFPSAVSLVIISQRNERGFEALVLTLGQDHLELPSGVGTKHGKQKPIKGRMQVGMGSRPTDRCPFSALDKQRTSLQGSP

SEQ ID NO: 96583 - protein, 167 aa, Glycine max
  Coding DNA Sequence Number=SeqID_4898
MSKSCGFGMTGPLDESISCFLIRRTTRPHLERTTCPRHQRTTCPRHQRTSCPRHQRAARPHLQRTTCPRLERATRPHLGYQLPSPLRGLHVLAIRGLYALTFRGLHVLALRGLHALTFGTSYPHLQRATCPRHQRTSCPRHQRAARPHLQRTTCPRLERATRPHLGY

SEQ ID NO: 96584 - protein, 49 aa, Glycine max
  Coding DNA Sequence Number=SeqID_4899
MAHRGGFLWGRGYLGIGIGGCGVAETVVARSVGGGICSGGGYLVFELGR

SEQ ID NO: 96585 - protein, 156 aa, Glycine max
  Coding DNA Sequence Number=SeqID_4900
  Subcellular localization annotation: CTP_CleavageSite=31; ConfidenceScore=5.31e-01
MAESSKKRKGSLSRSQQHSKAQDTPIPYSISSSSLFSSEEQRTRYTNLFSSRSIIDPKFIDMDFFFDDSFECIKHFRTQISFPLSLKLPVYSELVKAELVHWMIGNFIFLCMMPPGLMQSYLARALDRRLQEDWARDAREGLMVLMSLRVDFRPMG

SEQ ID NO: 96586 - protein, 76 aa, Glycine max
  Coding DNA Sequence Number=SeqID_4901
MVSQPTLRRQGEGTRKSASSHEENAKKNRKEEGVALTPAYPQSLSRQLYNSSDRLRLNFAKENKIIYDRWRRWMCT

SEQ ID NO: 96587 - protein, 170 aa, Glycine max
  Coding DNA Sequence Number=SeqID_4902
MSHPSRHAEYVNKKTIAAKVLGVKVVLSCDTSAKEKIWAYILNKSVHYETSFKTTLSDLHKFVLFHLMENLPFDLPHTIYINMIWNLKGLGSLDDIYYAALINKLMWDKGVYYMFNKMDENSKHTLIVKGSVVAKQQKFSKTNLKAMKVALEQSLKEALEVDMDATNKRK

SEQ ID NO: 96588 - protein, 132 aa, Glycine max
  Coding DNA Sequence Number=SeqID_4903
MKADKTRNELKVSYSKTYRLKNEEWMKNGEERWKTFTDLFMETSQKRYRITSAWIFFTETIFSPKKAEMHSQGGKRGRRLPPSSPRRAGLLPLQVTQLPKCSRRPKFEKWKIAIGTPILISSSPLFRNLRKS

SEQ ID NO: 96589 - protein, 59 aa, Glycine max
  Coding DNA Sequence Number=SeqID_4904
MSPDFMGQDDKGAEDDLGYLRMSPDFTGMTQTVCTDNRLGISACHLASLVRMTKVQKTT

SEQ ID NO: 96590 - protein, 116 aa, Glycine max
  Coding DNA Sequence Number=SeqID_4905
MNLEVTVESEIIVVSNQLVVVHYSYWYLQHQGLHSLVHMRPRQRMVELCLQTGVKLIKFLFQKIIISKRKSISPKYVDTFGGMKQSSQGRDPSPEPWLGDSRKIGPGMQEKVLWFS

SEQ ID NO: 96591 - protein, 318 aa, Glycine max
  Coding DNA Sequence Number=SeqID_4906
  Gene Ontology: Mol. function=motor activity; Cellular component=cell projection
  Homolog annotation: Hit_ID=UPI00006A2D9E; Match level="QueryCoverage =94%, HitCoverage=93%, E-value=1e-18, Identity=18%"; Hit description =UPI00006A2D9E related cluster
GGPLGTSTLTFRGLHALTFKGLYVFTFRGLHALAFRGLHAHAIRGLQVLAFVGLHALTIRGLHAFSFRGLHALTFRGLHVLAIRGLHALTIRGLHVLAIRGLHDYMHVLAFRGLHTLTFRGLHTLTIRGLHALAIRGLHVLAIRGLHALTFRGLHVLTFRGIHVLTFRGIHALTFRGLHVLTFRGLHALAFRGLHVLAFRGLHALAFRGLHALFFRGLHALALRGLHALALGTSILTFKELHALAFRGMHAFTFRGLHVLAFRGLHALAFSGLHALAFRSQHVLDFRGLHTLAFRGLWVLTFSGFHIRTLREFKVLCP

SEQ ID NO: 96592 - protein, 46 aa, Glycine max
  Coding DNA Sequence Number=SeqID_4907
MNKKKYRNGYNSSYMAPNENKVEDEMVEGKNHSFRRGQHTKDVKDL

SEQ ID NO: 96593 - protein, 118 aa, Glycine max
  Coding DNA Sequence Number=SeqID_4908
LCCLNANYLDVGKLGRIDGDSVLRETRIWATWEYMSSVGVGQQGMSGTWRYVAGVRRPWGRQVGRAPGSQQIKGTKTTKQGGLCGGWPAVNLVLENEVRKLWGLLVIDYQGGVIDYQA

SEQ ID NO: 96594 - protein, 458 aa, Glycine max
  Coding DNA Sequence Number=SeqID_4909
  Homolog annotation: Hit_ID=A8GF10; Match level="QueryCoverage=81%, HitCoverage=42%, E-value=0.0, Identity=84%"; Hit description =Putative uncharacterized protein precursor
DSELVLDKLSTGFDKLKYGLVTVAAPRVSLNRPLRWRRDEQSPQFNGELQLAADKVSFSDGGHLPAPVLALQVNGLSPDSFQLQGKLQAQQIGPIALRGRWDGERLRGEAWWPKQSLKVFQPLLAPDLNLTLRDGEFYAQSAFSAAREQGFEAGGHWVVKNGGMWLKDGEMSGLDFILSYRFKQHQWLLGAKQPVSLRIKSFSNLFEMQNISADLQGTYPYSEGQPLTLSNVGVDMLNGHISLSALRLPQHDAAVLKLDKVDLSALFTALKPKQFAMSGRVDGELPLFLNHPKWLVQNGWIANAGTLTLRLDKDMADAIGSNNLATGAAIDWLRYMEINRSHARVDLDNLGELTLSARIDGINPQKNAKREFALRRQFTGVAGAGPLTTWGATMKIMSVSTLAALLCVSLLSGCVPRIEVATPKDPITINMNVKIEHEIHIKVDKDVENLLKTQSGLF

SEQ ID NO: 96595 - protein, 281 aa, Glycine max
  Coding DNA Sequence Number=SeqID_4910
  Gene Ontology: Mol. function=serine-type endopeptidase activity; Biological process=proteolysis
  Homolog annotation: Hit_ID=A8GF05; Match level="QueryCoverage=100%, HitCoverage=100%, E-value=1e-129, Identity=82%"; Hit description =Peptidase S1 and S6 chymotrypsin/Hap precursor
  Pfam annotation: Domain name=Trypsin; Domain location=52-267; Score =8.3; E_value=2.2e-05; Accession=PF00089.17; Description=Trypsin
MDDPYLSGKRSMRKSVLLLLCSLPLIAAQAARADGPSKAEQTRLFFGKDERIKVTDTTAQPWQAIGQVETASGNLCTATLISPHLALTAGHCVLAPPGQLDKAIALRFVAGDKSWRYQTDNIETLVDSKLGKKLKPDGDGWIVPPAAAAYDFALIRLKDKKPLPIAPLPLWQGDSKALTQALKQAKRLITQAGYPEDHLDDLYSHQNCKVTGWAQQGVLSHQCDTLPGDSGSPLLLKTADGWQLIAIQSSAPAAKDRYRADNRALAVPGIREALDALAAGK

SEQ ID NO: 96596 - protein, 117 aa, Glycine max
  Coding DNA Sequence Number=SeqID_4911
MACPLACVPKDPSCTHPHIEAVPCHGSSCIGYSRSRRSRLPTFTMFSCCCQRLPACVEAKLHGESKVIQRCFDDNNDDDKGDDKKLKDQSKNNSSESRTIQEFKKRIKKNSRLKKKA

SEQ ID NO: 96597 - protein, 81 aa, Glycine max
  Coding DNA Sequence Number=SeqID_4912
MDGFWLKPRADLENLRFPLRIRSILTRDLRMAILFMAIPAEALYSETWCECHVRCLKVVMRSNVGLEGGKKLKWWNCKLLQ

SEQ ID NO: 96598 - protein, 159 aa, Glycine max
  Coding DNA Sequence Number=SeqID_4913
DRECAELIGQSADEVNRLKIEDGDVDLNASLQVLDRLLDCFLAFKVKVQPRFRNAVVLRYSDESNLINVVLDMLPDTEIERSILDSIDPTELESQSMFITSDDDRSMLDSTEPTELESQFVSVTADNDPLLRIPLTPTKRASFDELDDGPKNFEISHAK

SEQ ID NO: 96599 - protein, 250 aa, Glycine max
  Coding DNA Sequence Number=SeqID_4914
MIIDQSLSFSLTKLPSQGAAFEGTIVDDWKFDYSCHDARRMVCNDQAKMTGRLLAGSLTFDNRIMHYIIVRILLPRSSNLAQASEEDLILMWAFLTDRQIDWAHLVRYRMHKALRANAPLPYPQLVTLFLCHFQIPLDDEQFVQVKRSFAIGAGAITSFGYRKDRNGQLLKKDAFPPQDERTPSPPPQRDDSALMTEVLSELRGLCTYVGERFDSLDNRFAGMDICLTHLEEDVGYIRQSFDLPPPPPPS

SEQ ID NO: 96600 - protein, 60 aa, Glycine max
  Coding DNA Sequence Number=SeqID_4915
  Homolog annotation: Hit_ID=A0PAV3; Match level="QueryCoverage=63%, HitCoverage=17%, E-value=5e-07, Identity=76%"; Hit description =Restriction endonuclease
MVKVGTSYVPINVSFSPKVGPGLPGINRDTRIYLFCEVIFRHRCSKWLLFLIKLSLLFSY

SEQ ID NO: 96601 - protein, 197 aa, Glycine max
  Coding DNA Sequence Number=SeqID_4916
MASRKHKSISSRPTTQYDTRRFHFLDAWNWYTDNVLGRNILPERKVKLYHIEFDDFKTKLERRNLHKHLTNLVDGSIDVALVKEFYANLYNFEGPSPKQSRVRGHLVKINADSLNTFLETPVVLAEGETLPTYSRYCRLPLDPREIEVALCIPGRGFILNVEGHLGRILRKDLTTLAQVWSVLSYSNLADQGRTRIK

SEQ ID NO: 96602 - protein, 212 aa, Glycine max
  Coding DNA Sequence Number=SeqID_4917
  Gene Ontology: Mol. function=nucleoside-triphosphatase activity; Cellular component=intracellular; Biological process=transport
  Homolog annotation: Hit_ID=A4W8A2; Match level="QueryCoverage=95%, HitCoverage=41%, E-value=5e-81, Identity=74%"; Hit description=ABC transporter related
  Pfam annotation: Domain name=ABC_tran; Domain location=29-212; Score =95.9; E_value=1.3e-25; Accession=PF00005.18; Description=ABC transporter
MASLQISQGIFHLSDSRTLTLPDLTLHSGESWAFVGANGSGKSSLARALSGELTAAKGELRQDFQRRTRLSLEQLQQLVTQEWERNNTDLLSEGEDDTGRTALEIIQDEVKDEARAQVLAQQFGISALLTRRFKYLSTGETRKTLLCQALMAQPDLLILDEPFDGLDVASRASLADTLHQLHRDGYTVVLVLNRFDDIPDFVQQSACWRSAR

SEQ ID NO: 96603 - protein, 69 aa, Glycine max
  Coding DNA Sequence Number=SeqID_4918
MGEFNHDSWDWNLRWRRNLFDQESDLAALPIYLLSFFKIPKKVVHKASVEMKGKSTSLTEQLQSSLFTI

SEQ ID NO: 96604 - protein, 146 aa, Glycine max
  Coding DNA Sequence Number=SeqID_4919
  Homolog annotation: Hit_ID=Q51617; Match level="QueryCoverage=27%, HitCoverage=57%, E-value=3e-14, Identity=95%"; Hit description =Putative uncharacterized protein
MTVKTSDTCSSRRRSQLVCKRMPGADKPVRARQRVLAGVGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPEKFKWS

SEQ ID NO: 96605 - protein, 75 aa, Glycine max
  Coding DNA Sequence Number=SeqID_4920
MVQKKTQYTKLARKQKESHRKKTHFIENNQDSLTNIPHRTGIEIEEENVYYYYFAAFNTQDRIQISFEVSPPSSS

SEQ ID NO: 96606 - protein, 71 aa, Glycine max
  Coding DNA Sequence Number=SeqID_4921
MYLHFFSFRRRYGNSRIAQQHLFLVSVTLRNFTDRITLLPFDFRRVSRLTYCATKGAKYLEATNQRLHVIN

SEQ ID NO: 96607 - protein, 132 aa, Glycine max
  Coding DNA Sequence Number=SeqID_4922
MILKDELKTCLRSKMSLSQRLSEIEANMLAIISKYKEELDLATTHEHKVADEYAQVYAKNEARGRVIDSLHREAMMWMDRFALTLNGSQDLPRLLAKAKAMTDVYSTPEEIHGLLSYCQHMIDLMTHIIRNR

SEQ ID NO: 96608 - protein, 100 aa, Glycine max
  Coding DNA Sequence Number=SeqID_4923
MGCTHGPEIYPKAYKNPRAFSCISGPIYLEFSIQCPCGSSIIVPGGPCGSCPYFKIELISRPCNCGPELLGGRPWERTSVLALLVCTGRRSHSAAPDPCD

SEQ ID NO: 96609 - protein, 221 aa, Glycine max
  Coding DNA Sequence Number=SeqID_4924
MKADMEALKDQVTSMMKAMLSMKRMMESNAAAVAATSTTAEADPTHPSAINQANQPAPDVVGQGGEVLGSTSGPHMGYNRNAYPYGLPPNYTPPTMHLPNENVHHVVPISFEGQQPLSVGGAREEPRKHAQGDFNPYPTFTAKGLVCNDMPKPNTAGAPQPRPLQPLHFSVGGPPLAMEVREKLDLIEERLRVVEGFGDYPFAEMTELCLVPDVVIPPKFK

SEQ ID NO: 96610 - protein, 42 aa, Glycine max
  Coding DNA Sequence Number=SeqID_4925
MALGTMKIVGSMASCYVATDAIGDVIEKNDRKKIETCKEKIH

SEQ ID NO: 96611 - protein, 169 aa, Glycine max
  Coding DNA Sequence Number=SeqID_4926
MDALRVPIDDDQDDGELVGLRKVGDKVHRNVFPDFGGKWQGLEKTGQPTSTHLRLLANTAFMNKSLNVLMQGGPIETRFESVGSLGYAEVTAPRCGMELKQEGGDIGQLIVDAIVRKLGLACSVHRRSSRKLKLGTESRRSWPEEHSVNNLHGRAEGVSFDGERLCKIQ

SEQ ID NO: 96612 - protein, 198 aa, Glycine max
  Coding DNA Sequence Number=SeqID_4927
MGSRSREVVGSGQGKKGVEKSGLGSSGSEVSGWCCGLVLEEGDWPDAGDSSHTTYLLGVWRGPLLAAGRLVEEPILLGGFSEGANRDSNACKKPDQEVMNPLWNIHCYQLRAAPSSDYDWALVGGSDRESNTLCRKVQSTIGEVAWSAMAAAAGRTSVRAEVVSVDACSLEAVVRSRSLACTHVLWLSFWTFLDWTLD

SEQ ID NO: 96613 - protein, 101 aa, Glycine max
  Coding DNA Sequence Number=SeqID_4928
MSLILDAVVLATLLVFTYASRALRIFKGIVALKAHQNQESELGRVPLRSMFAFSRARLTGALSKGGKMRGVATDVYLWKTSEKPKETGQNENSKFGSYIYA

SEQ ID NO: 96614 - protein, 92 aa, Glycine max
  Coding DNA Sequence Number=SeqID_4929
MESPTVATCPSRASEGEAHGCAFQRRKDARSRHQRLFVENVGKIEGNCKIGEKLAAQLTQASKVASSRSNSLLEESSGGPKWAWLLFTPPIY

SEQ ID NO: 96615 - protein, 105 aa, Glycine max
  Coding DNA Sequence Number=SeqID_4930
MHLPGLNKFLAPLPGNFFLFGKSPTGNLVPLDLEIEATLRRNKAERRRKLLQDRTVASILEEETHFSNSSSSDSPSSRESATYLPEAVSMADEHNKELPLRTIQE

SEQ ID NO: 96616 - protein, 105 aa, Glycine max
  Coding DNA Sequence Number=SeqID_4931
MGTNQTDKRFYQVKVKSLDTTSIKELGRLMEPLQMQAFRKTYGKILELTLAEKYLEDKARGMANQGDWVPFMDVLALLIFGVVLFPNVDGLIDIAAIDAFLAYPP

SEQ ID NO: 96617 - protein, 176 aa, Glycine max
  Coding DNA Sequence Number=SeqID_4932
VDCYEEDREEHTYTDVQGAPGPTPDFGCLLDPIWGAPTGPGLPYDFMLFWSPALGARCYVLRSERVMRQFGYTQIIPTPPVDSWASNPLPDGHAPQPQVIPQVPETDIPHVPEPGAPSTSARPTVDEPRHAVEVCYGIAERLERHLSLGVVTPGSSTHEVIEECLKMARSVTQDQL

SEQ ID NO: 96618 - protein, 50 aa, Glycine max
  Coding DNA Sequence Number=SeqID_4933
MEVDEPWLGLWLPLNYQAFSLQNSFLVGGFGFAKGGVRHWKCGRQTLWLI

SEQ ID NO: 96619 - protein, 148 aa, Glycine max
  Coding DNA Sequence Number=SeqID_4934
MAPRKLSMKRSRRDAAAEGTNAAPEFDSHRFRSTEHQQRFEAIKGCRRCTSLVTPMAKFDPYIVLEFYDNAWPTEEGVRDMRSWVRGQWIPFDADALSQFLGEPLVLEEGQECEFSQRRNRADGFDKEAIAQLLCIPGQDFARTAAGR

SEQ ID NO: 96620 - protein, 86 aa, Glycine max
  Coding DNA Sequence Number=SeqID_4935
MGAKYLEVVKRGSHPNNGWFPDEIRTQNDHNLSLRVVGHDRAWAARHRMTIICLCVPPDTIASGWQKGVRNDHNLSPPTSRLTVPE

SEQ ID NO: 96621 - protein, 560 aa, Glycine max
  Coding DNA Sequence Number=SeqID_4936
  Gene Ontology: Mol. function=5'-3' exonuclease activity; Biological process=DNA recombination
  Homolog annotation: Hit_ID=Q1GZK5; Match level="QueryCoverage=68%, HitCoverage=68%, E-value=1e-148, Identity=69%"; Hit description =Exonuclease RecJ
  Pfam annotation: Domain name=DHH; Domain location=197-360; Score =167.3; E_value=4e-47; Accession=PF01368.11; Description=DHH family
  Subcellular localization annotation: CTP_CleavageSite=46; ConfidenceScore=5.18e-01
MTYAPAGGHGPDVLNSLWFASVGDLPQSPSSAAIIGGQGAIFSGLLASQLPGVQSNSMATMWADKKITNAVWVADQWQSVDWADIADAIQTGQVSELNVVLPFAERSVHIQYKKQFRWQFWRKAYTLETLLQQLETTLSTISNFETLLAQGLPPLLARLLAARAVSADDWVLQEMPHLLKPDALTGATQMAQLLADAIAQQKRILIIGDYDADGATATSVAMRGLLMMGAQVDFLVPNRFEYGYGLTPEIVALAATQQPDVILTVDNGIASIDGVIAAKALGMQVLITDHHLPAEQTPAADCIVNPNQRGCDFPSKHLAGVGVMFYVLIALRAELKQRGMLAEDRVHLGSLLDLVALGTVADLVKLDANNRILVRQGLKRIRQGQACPGILAILKLAGRDPEQVNAQDLGFYVGPRLNAAGRLDDMTIGIRCLLAETPQEAMQYAQQLHVLNAERKQIEAEMQWDAMADLAQDFKDTQYTISVFQPDWHQGVIGILASRIKERYHRPVIAFADAGEALIKGSGRSIAGLHLRDALDLVTKQQPDLIVKFGGHAMAAVKSI

SEQ ID NO: 96622 - protein, 45 aa, Glycine max
  Coding DNA Sequence Number=SeqID_4937
MPEGDARAHGCVFQGRKARGVATNVYLRKTLEKPEKGVSFAPTYP

SEQ ID NO: 96623 - protein, 36 aa, Glycine max
  Coding DNA Sequence Number=SeqID_4938
LKTQSIQAMVELRRQCAKAASTSDFNLEIKSSVYVA

SEQ ID NO: 96624 - protein, 300 aa, Glycine max
  Coding DNA Sequence Number=SeqID_4939
  Gene Ontology: Mol. function=penicillin binding; Cellular component =plasma membrane; Biological process=peptidoglycan-based cell wall biogenesis
  Homolog annotation: Hit_ID=P74872; Match level="QueryCoverage=100%, HitCoverage=48%, E-value=1e-145, Identity=83%"; Hit description =Penicillin-binding protein 2
  Pfam annotation: Domain name=PBP_dimer; Domain location=1-117; Score =33.9; E_value=5.7e-07; Accession=PF03717.6; Description=Penicillin -binding Protein dimerisation domain
  Pfam annotation: Domain name=Transpeptidase; Domain location=148-300; Score=-5.3; E_value=1.2e-05; Accession=PF00905.13; Description =Penicillin binding protein transpeptidase domain
  Pfam module annotation: Pfam domain module=PBP_dimer::Transpeptidase; Domain location=1-117::148-300
KQSSRYKPVELKAELTDEEVARFSVNQFRFTGVTIDTYQDREYPYGADLAHVVGYVSKINDNDYKRLNAEGVGENYAADHNIGKQGIEGYYESLLHGKTGYQEVEVDNHGRIVRVLKEVPPVAGKNIWLTLDLHLQQYVESQLAGQRAAVLIEDPHDGGVLAMVSSPSYDPNPFVKGISYKAYKTLLQDKNLPLINRVTQGLYPPASTVKPYMAMSALLSKVITPGTTFFGAPTWTLPGTDRKYRDWKKSGHGMLDVTKAIEESADTFFYQVAFMMGIDRIHSMLSQFGYGKPTGIDLNE

SEQ ID NO: 96625 - protein, 235 aa, Glycine max
  Coding DNA Sequence Number=SeqID_4940
  Homolog annotation: Hit_ID=A9IMT1; Match level="QueryCoverage=86%, HitCoverage=45%, E-value=2e-34, Identity=39%"; Hit description =Putative uncharacterized protein
MPAQPDALQQLCAHVRQLAEQGVQHDRHHHHVGLQEFTRVHRQVADARIGRNGFGDDQRQPHEAESETHADHNRRQCARQHHLCKQAETAQAVAAGHLQQAAIDRTERHQKDLGGFIDAEPQDHQRDQRQVRHVADHLHRAVQQAFAPARQPGNKAEDQPDAAADGKADQRALAADAQVLPQFAALAQAPEGGQHRARRRQNAVGQPAGFYGDLPEDHQRQRQRPGGPADTGCVA

SEQ ID NO: 96626 - protein, 137 aa, Glycine max
  Coding DNA Sequence Number=SeqID_4941
VVYAEHNVNLRVSTGLLPAIDKGLSARKTTYICACQRACWPRLTKGAEDDVVCAEDDVNLRVSTGLLTANDKGCCRNVPSSGRARARLTGALSKGGKMRGVATNEGISTSYVDKSGTLAPTYPPSKRKSDLRSSFLR

SEQ ID NO: 96627 - protein, 148 aa, Glycine max
  Coding DNA Sequence Number=SeqID_4942
NNNNFQVDIKIAERGFIMLEGVWLVESQRVVVANIYASWDFNCIKHPAERMGSTLCNADTNLIAEFNEWLAEMEVDDIPCLGKPFTWVRPNGSWDFNCIKHPAERMGSTLCNADTNLIAEFNEWLAEMEVDDIPCLGKPFTWVRPNGS

SEQ ID NO: 96628 - protein, 93 aa, Glycine max
  Coding DNA Sequence Number=SeqID_4943
MSASKEQMASMMEAMLGMRQLMGKNVATAAVVSSVAEADPTLLATAHHPPPNAVGQERSTLGHNSNPHLGYNRVAYPYGLPANYTPPVMPDDA

SEQ ID NO: 96629 - protein, 72 aa, Glycine max
  Coding DNA Sequence Number=SeqID_4944
MISLEHSCRIWPKDVSRNWAFRLINLKIKFIFDAILPRKGPITRTMSKRLQEDWARAAEEGPRVLMNLRVDF

SEQ ID NO: 96630 - protein, 140 aa, Glycine max
  Coding DNA Sequence Number=SeqID_4945
  Gene Ontology: Mol. function=protein kinase activity; Biological process=protein amino acid phosphorylation
  Homolog annotation: Hit_ID=A7Q5D4; Match level="QueryCoverage=78%, HitCoverage=6%, E-value=5e-39, Identity=69%"; Hit description =Chromosome undetermined scaffold_53, whole genome shotgun sequence
MTYRVMFYFSGKTLGDILDALPREWISEDLMEALMKKGVCLSPAIFEVGDWVKFRKTSMTPTNGWEGDRQKQVGFVQRVPDKDNLIVSFCSGEYYSVLANEVVKVIPLDKGQHVQLKEDYELQEEPSSKSELISPGTNHP

SEQ ID NO: 96631 - protein, 103 aa, Glycine max
  Coding DNA Sequence Number=SeqID_4946
MWMLREWFPADFRREEKEKSDFRQEDKEKRECKEGEALTNSLECRPWWSPGLSAPLSLCRSHMIGAFSQNSVTLTGLPMILLSESDLTYPLCGVSCHVLLGAR

SEQ ID NO: 96632 - protein, 72 aa, Glycine max
  Coding DNA Sequence Number=SeqID_4947
MYLDQPRPMVYVNLRCSGRQRRRGERRRHPLGNKPWKKELHHQDEPWIRSLERMLQWRKRKRERKREGGARN

SEQ ID NO: 96633 - protein, 242 aa, Glycine max
  Coding DNA Sequence Number=SeqID_4948
  Gene Ontology: Cellular component=integral to membrane; Biological process=cell division
  Homolog annotation: Hit_ID=P0AC31; Match level="QueryCoverage=100%, HitCoverage=68%, E-value=1e-111, Identity=85%"; Hit description=Cell division protein ftsX
  Pfam annotation: Domain name=FtsX; Domain location=61-236; Score =93.2; E_value=8.4e-25; Accession=PF02687.12; Description=Predicted permease
ITVYLDKALDDNAAAQVVGQIQAEQGVEKVNYLSREEALGEFRNWSGFGGALDMLEENPLPAVAVVIPKLDFQGTDSLNTLRDRITRINGIDEVRMDDSWFARLAALTGLVGRVSAMIGVLMVAAVFLVIGNSVRLSIFARRDTINVQKLIGATDGFILRPFLYGGALLGFSGAFLSLILSEILVMRLSSAVTEVAQVFGTKFDISGLGFDECLLLLLVCSMIGWVAAWLATVQHLRHFTPD

SEQ ID NO: 96634 - protein, 213 aa, Glycine max
  Coding DNA Sequence Number=SeqID_4949
  Gene Ontology: Mol. function=metabotropic glutamate, GABA-B-like receptor activity; Cellular component=outer membrane-bounded periplasmic space; Biological process=amino acid transport
  Homolog annotation: Hit_ID=A6TF73; Match level="QueryCoverage=100%, HitCoverage=60%, E-value=1e-106, Identity=88%"; Hit description=High- affinity branched-chain amino acid transport protein
  Pfam annotation: Domain name=ANF_receptor; Domain location=44-213; Score=-20.2; E_value=0.00018; Accession=PF01094.19; Description =Receptor family ligand binding region
MKRNAKTIVAGVVALAISHAALAKDIKVAVVGAMSGPVAQWGDMEFNGARQAIKDINASGGIKGDKLVGVEYDDACDPKQAVAVANKIVNDGIQYVIGHLCSSSTQPASDIYEDEGILMISPGATNPELTQRGYQGRPPRNISSNTVKPQRIAIIHDKQQYGEGLARSVQDNLKKAGANIVFFDGITAGEKDFSALLARLKKENIDFVYYGGY

SEQ ID NO: 96635 - protein, 222 aa, Glycine max
  Coding DNA Sequence Number=SeqID_4950
  Gene Ontology: Mol. function=chlorophyll binding; Cellular component =integral to membrane; Biological process=photosynthetic electron transport
  Homolog annotation: Hit_ID=Q2MI75; Match level="QueryCoverage=100%, HitCoverage=54%, E-value=9e-98, Identity=67%"; Hit description =Photosystem II P680 chlorophyll A apoprotein
  Pfam annotation: Domain name=PSII; Domain location=1-221; Score =174.4; E_value=2.9e-49; Accession=PF00421.10; Description =Photosystem II protein
RLLSVHIMHTALVAGWAGSMALYELAVFDPSDPVLDPMWRQGMFVIPFMTRLGITNSWGGWNITGGTITNPGIWSYEGVAGAHIVFSGLCFLAAIWHWVYWDLEIFCDERLYGPGIWVSDPYGLTGRIQSVNPAWGVEGLFHLSVRPPQRLYKGLRMGNIETVLSSSIAAVFFAAFVVAGTMWYGSATTPIELFGPTRYQWDQGYFQQEIYRRVGAGLAENQ

SEQ ID NO: 96636 - protein, 146 aa, Glycine max
  Coding DNA Sequence Number=SeqID_4951
MSISPYRSISWFVLSRHRGRSHKTPSGPEEVQQGPGVSSFGYRPLSILQGDHTPRQGIAPAGHQVDPKKSNRVLGLPALITGLCQFYGVPITPSKVIRPPTNRAFIKKYCVLKKAEGETPQQPGDGNRQQMHRRHLLSPSSHPQKG

SEQ ID NO: 96637 - protein, 61 aa, Glycine max
  Coding DNA Sequence Number=SeqID_4952
MDEMAPKKLSAKRSRRDAAVEGISAAPEFDSHRFRSTEHQQRFEAIKGWSFHRETRPAQGR

SEQ ID NO: 96638 - protein, 146 aa, Glycine max
  Coding DNA Sequence Number=SeqID_4953
  Homolog annotation: Hit_ID=Q9SJS1; Match level="QueryCoverage=51%, HitCoverage=10%, E-value=1e-07, Identity=41%"; Hit description =Putative Athila retroelement ORF1 protein
MHRSPTVTLVPLDLEIEATLRRNRAERRRKLLQDRTVASILEEETHFSDSLSPDSPSSRESANQYSEAVTMADEHDQRTTLEDYSSGSVPQFFTSIAHPEVQAHNITYPHSLIHMIQGNLFQGLPNEDSYAHLATFIEICNIVKIV

SEQ ID NO: 96639 - protein, 42 aa, Glycine max
  Coding DNA Sequence Number=SeqID_4954
MLLGHVSFMTYGIELFGYCESLEGLMGPGAERNEDKGYVGVR

SEQ ID NO: 96640 - protein, 211 aa, Glycine max
  Coding DNA Sequence Number=SeqID_4955
  Homolog annotation: Hit_ID=A5BU47; Match level="QueryCoverage=95%, HitCoverage=12%, E-value=1e-14, Identity=29%"; Hit description =Putative uncharacterized protein
MDEPFIMAEQARQVFDVQDPCDSRFSVILQGRPSGITHQNDDPTLDFCEAPAFSKLMPSISEQQDVDDVQANCTDHHEGDGYTAKPRPTVNIDPATSRGSCPHKEKFQSYLGVVAQEKIPIIHSNWKDVPHSLKDLVWDDILAKFDIPKVPNAKKKVMSKVATRWRQFKSTLTMKFVYHNNEVQDKQDPFYKYGLDPQTWEEFAATQQTLN

SEQ ID NO: 96641 - protein, 74 aa, Glycine max
  Coding DNA Sequence Number=SeqID_4956
MMTKVMNKKLKRSKNNSSESKNISSESRTSQDFKNQEESLQTRIKIQDSRSQESRSRFKTQDSRIKKGLNQDKY

SEQ ID NO: 96642 - protein, 321 aa, Glycine max
  Coding DNA Sequence Number=SeqID_4957
MELDEFKAELERRNFHKCLTNLADSSIDLALVKEFYANLYSPEGPSPKQVRIRGHLIKIYVDSLNTFLKTPVVLAEGESLLTYSRYCRMPIDIREIEVALCIPGRVFVLNAEGHLGKILRKDLTILAQVWRVLSYSNLASTSHTSDLTLDRARSRGVAFDSLVFERLSPIINLAYIRKNYWNPADLTVTIRGVRRARARPAEAPSTSAAPSPAHTSAAPSTPSYADFQRLEAMLQSIHQGKIVLLQSLQLVAPPNSIPSIEQFNEWVAWPGTQPPLHREDEGLTAQVADPSTPKDRTTPVLSPNTSPPATLVLRLTDEEDV

SEQ ID NO: 96643 - protein, 59 aa, Glycine max
  Coding DNA Sequence Number=SeqID_4958
  Subcellular localization annotation: CTP_CleavageSite=41; ConfidenceScore=5.07e-01
MSVKKLVGRLGVHDKTNHTLASQVTLTRLKGALKLGVFTPKAYTSKSPLGSLPSNSGLT

SEQ ID NO: 96644 - protein, 40 aa, Glycine max
  Coding DNA Sequence Number=SeqID_4959
TERELSLMRKPSCGALDEILRDCEVSRGGGDTHIGKWFDP

SEQ ID NO: 96645 - protein, 82 aa, Glycine max
  Coding DNA Sequence Number=SeqID_4960
MTDPLDESISCFLIRVNPWVLVTLTFRGLHVLTFRGIHAFAIRGLHVLTFVGLHVLTLEDCTSSPSEGFTPSPSEDCMSSPS

SEQ ID NO: 96646 - protein, 37 aa, Glycine max
  Coding DNA Sequence Number=SeqID_4961
MEVEEPWLGLWLPLHYSVDMGGGVWYLMCGRRALWLI

SEQ ID NO: 96647 - protein, 50 aa, Glycine max
  Coding DNA Sequence Number=SeqID_4962
MEAKNVSTNTMMQSYLARALGRRLQVDWARDPRDGPRVLLSLRVDFEPMG

SEQ ID NO: 96648 - protein, 70 aa, Glycine max
  Coding DNA Sequence Number=SeqID_4963
MASYGEAKESIDEEDPRPTSSNGACTMWYQEHLHLGVEGKSPEFQEPRDLRSNPFQGGGNDAILPRKGIG

SEQ ID NO: 96649 - protein, 79 aa, Glycine max
  Coding DNA Sequence Number=SeqID_4964
  Homolog annotation: Hit_ID=A0ST23; Match level="QueryCoverage=34%, HitCoverage=55%, E-value=2e-08, Identity=100%"; Hit description =Putative reverse transcriptase
MVELHALQDLVVIKLIDTVDLEGGPVGKPVVPAALMNRPTRGERRFAYWALAECILAYYVGTDEGVSEVLHVAGEKRLH

SEQ ID NO: 96650 - protein, 60 aa, Glycine max
  Coding DNA Sequence Number=SeqID_4965
MGAKYLEVVKQGSHPHNGWFPRTKLGDQGIAMNPKRIKVILEWPTPPSIKKFGASKREVT

SEQ ID NO: 96651 - protein, 89 aa, Glycine max
  Coding DNA Sequence Number=SeqID_4966
  Gene Ontology: Mol. function=oxidoreductase activity; Cellular component=cytoplasm; Biological process=L-ascorbic acid biosynthetic process
  Homolog annotation: Hit_ID=Q8ZRM7; Match level="QueryCoverage=100%, HitCoverage=33%, E-value=7e-27, Identity=69%"; Hit description=2,5 -diketo-D-gluconic acid reductase B
MTLAYGKALKDEVIMRIAEKHNATAAQVILAWAMGEGYAVIPSSTKRENLASNLLAVDLQLDADDKKAIAALECNDRLVSPEGLAPNWD

SEQ ID NO: 96652 - protein, 63 aa, Glycine max
  Coding DNA Sequence Number=SeqID_4967
MVKVGTFYVPINVSFSPKVGPGLPAVPPVQLLTGWWVTAKAPPDISAGKCSGHAARNHHPRRA

SEQ ID NO: 96653 - protein, 110 aa, Glycine max
  Coding DNA Sequence Number=SeqID_4968
  Gene Ontology: Mol. function=phosphoinositide phospholipase C activity; Biological process=intracellular signaling cascade
  Homolog annotation: Hit_ID=A7PHV0; Match level="QueryCoverage=82%, HitCoverage=28%, E-value=4e-17, Identity=44%"; Hit description =Chromosome chr13 scaffold_17, whole genome shotgun sequence
MEARNTYVSHEMRRVFIGGVLFVDKSSSKISLRYLQFLRDFEQCSTYAWGPAVLAFLYTEMCSATDYKIKSIGGMCILIQMWAWERCTTLAPKRTHPVIENKPLGNRLVV

SEQ ID NO: 96654 - protein, 48 aa, Glycine max
  Coding DNA Sequence Number=SeqID_4969
MTLLEAPHGATSCGATSLLEASRLTSSTWSYIMWYQEHLHLGSIIFQS

SEQ ID NO: 96655 - protein, 154 aa, Glycine max
  Coding DNA Sequence Number=SeqID_4970
MEKESRDNEILSGGAKNVFALKLNPQPRMESACTYFDKKDAQKNEDKKLRRLMRKQVPKKLKTLKRLHKRLLKMLRMSLKLHNHLNRWKNFHTEFHLRKKTLLKNHWTMEKLILVISILIMQQKELRKTNDVLNVENIIDVLAKLKNADSGVDK

SEQ ID NO: 96656 - protein, 129 aa, Glycine max
  Coding DNA Sequence Number=SeqID_4971
  Pfam annotation: Domain name=zf-CCHC; Domain location=57-74; Score =13.4; E_value=0.014; Accession=PF00098.14; Description=Zinc knuckle
MSLAIIFGKLQEHERKRKRSIALKASSSMQEEEEEEEEEEEESDDEEDFSLFVKKFHKCYKCNRPSHIKAHCPTNESWPEKNEKKSHEERRSKKAYIAWDDNDSSDGSEKEINLLSKDYESDENISQED

SEQ ID NO: 96657 - protein, 63 aa, Glycine max
  Coding DNA Sequence Number=SeqID_4972
MTKLRGDDDEHWNDEDEHDGNNDCNERRDQEMIWAQRIILYFKRTSIRNRDIFRKRERWQDTS

SEQ ID NO: 96658 - protein, 141 aa, Glycine max
  Coding DNA Sequence Number=SeqID_4973
MRRHLLENKPWKEKFHHQESALDKKFREKASMEEKNEIERGGHKIEGEKEGEKLNFEVCLTSFTFIKVMASVTHASIYSLEIYLEVHENPRAFFNSSSLILLKSFMQYPWGVGLHHPLPLGKDLTSNPKVLDTLGFFPQHL

SEQ ID NO: 96659 - protein, 66 aa, Glycine max
  Coding DNA Sequence Number=SeqID_4974
MAKSVKHLNSVGKNLNGEKTFCNRSSKGHLVTDPNDLITTLSLKRDYWQCVMVNLFLKDTPTHGMV

SEQ ID NO: 96660 - protein, 108 aa, Glycine max
  Coding DNA Sequence Number=SeqID_4975
MYPLLFSVTTTQIDVPSTCTTKDVPSNVLRQSSQAFSPLKLCEGETKDISGDDVKGDDKKLKDQSKNNSSESKINQRTTQVNQEDSRFKISKIKIKIQDSRLKNQEKA

SEQ ID NO: 96661 - protein, 111 aa, Glycine max
  Coding DNA Sequence Number=SeqID_4976
  Subcellular localization annotation: CTP_CleavageSite=44; ConfidenceScore=5.14e-01
MTETRQKRVRKVNENENKSTRNKWGPPRGSSLPPSSPRRSQLAQARQLSKKLRKLTDYATTPPFGSATLQNFTDRVTLLPFDSRRISGLTYCATKGAKYLEAANQRLHVIK

SEQ ID NO: 96662 - protein, 245 aa, Glycine max
  Coding DNA Sequence Number=SeqID_4977
MASRKRKSIGTRPTSYSEDRPPKQFRVKSHLVKIDANSLNAFLETPVVLADGETLPAYSRYCWLPTDFKEIEASLCIPGRGFILNSEGHPGKILRKDLTTLAQVWSVLSYSNLAPTSHTSDLTVDRARLIFGRVSHLDMNIEALISVQMTSIAQSNTSRLGFPALITALCRARGVVSDSLTFERLSPIINLAYIKKNCWNPEDLTVSIQGARRARARPEELPSTFAAPTPASTSATPSVPIQTNF

SEQ ID NO: 96663 - protein, 89 aa, Glycine max
  Coding DNA Sequence Number=SeqID_4978
PGAQPSPSRGYGAFAAQETVPEEPAAEGEDELTPPEPFYFDAGVHMAQEEETSTDQIPEPSPTPIPDDPIPSALASELEHPISQDSPAA

SEQ ID NO: 96664 - protein, 157 aa, Glycine max
  Coding DNA Sequence Number=SeqID_4979
MTQELVARGDTLRLSAPRHSVTPSVIDEQRPMWSSAPFPEMSASSGGDFFKSHKIRRSKSIAFVGRPTRSVILTMRSCDMRRQNLVILHPFAIQTQSCPMARRDKIWSFCTLVSSRGGGPDDTRRYLTVIRTLLSSRGGGPDDTQRQNLVILHPCVI

SEQ ID NO: 96665 - protein, 41 aa, Glycine max
  Coding DNA Sequence Number=SeqID_4980
GAETLVGAQSSKLSPRDLTAIVTVWVRAPVEITSDKDPVIV

SEQ ID NO: 96666 - protein, 68 aa, Glycine max
  Coding DNA Sequence Number=SeqID_4981
MYRGPRGSFGVEGRSKVGPCDHTSTNAPDPIRTPQFKRAWARVIEFLQPGGSTSSRAAATAVELQFAL

SEQ ID NO: 96667 - protein, 196 aa, Glycine max
  Coding DNA Sequence Number=SeqID_4982
MQFINEEGLRKPKPLVIYFTRDAAPQTPQYPSVVRLVPFPYKNNHPVPWRYAPPSERKEEATDISSLSTKVTNITGLSGVTCSGHMFAPPDLPTPPANVKGKAKVAEEQSDKVIPTLDEDIPVKSLSGKWDGYGKKEVSLEEAAQDISIEGFGGLVNNITTNNYLAFAEEGIPAEGRGHNRALHVLVKCMDHVVAK

SEQ ID NO: 96668 - protein, 127 aa, Glycine max
  Coding DNA Sequence Number=SeqID_4983
MAPTRHPLDPDKSNRALGFPALITGLCQSFGVPVAPSKVIRPPITRAFIEKYCTQRQAQGDAPQDVDAPPPHQAAPAESFDTEQYLRHLVRQQAANHWALVQTHDCLYQMSLSLQSQGFTSFPCVIP

SEQ ID NO: 96669 - protein, 83 aa, Glycine max
  Coding DNA Sequence Number=SeqID_4984
  Gene Ontology: Mol. function=N-acetyltransferase activity; Biological process=metabolic process
  Homolog annotation: Hit_ID=A6TBL7; Match level="QueryCoverage=100%, HitCoverage=45%, E-value=6e-40, Identity=91%"; Hit description =Hypothetical acetyltransferase
MGGRGIGSALLTRLIAQCEQGPWRQMLAIIGDGHNNAASIAIHKKFGFTVTGQLRSVGYKMGDWRDTLIMQRQLGDGDWTLPE

SEQ ID NO: 96670 - protein, 70 aa, Glycine max
  Coding DNA Sequence Number=SeqID_4985
MDYVHHVAVTVWNEEEHSELKLSSHGRKVEKFGRPAPKIEDLVATIGLSPLIACSLDTNDRRLISAFAER

SEQ ID NO: 96671 - protein, 26 aa, Glycine max
  Coding DNA Sequence Number=SeqID_4986
MTKGIKHFEVVAGGRMLTNNGLRMKL

SEQ ID NO: 96672 - protein, 212 aa, Glycine max
  Coding DNA Sequence Number=SeqID_4987
  Gene Ontology: Mol. function=protein dimerization activity
  Homolog annotation: Hit_ID=A5B5G2; Match level="QueryCoverage=61%, HitCoverage=22%, E-value=4e-26, Identity=42%"; Hit description =Putative uncharacterized protein
  Pfam annotation: Domain name=hATC; Domain location=46-128; Score=9.3; E_value=0.0035; Accession=PF05699.5; Description=hAT family dimerisation domain
YEPVWKIIYERWDHQLHRPLHAAAYYLNPHLHYEPTFRHDDPQLKEGGLFSMEKAKDSRKIMQPGEWWEMFSDGTPELRRFAIRVLSFTCSSSGCERNWSSFEMLKGKQNRKTIALPFDEIESDNEWITEEGYNDEDEQPQAEGHGDNVELVGDVGGSSNDPVVDAFNLDNLIFVEPNDDAQSEEDLDDDGDGDESDDIHGDDPIIGLDMLL

SEQ ID NO: 96673 - protein, 250 aa, Glycine max
  Coding DNA Sequence Number=SeqID_4988
  Homolog annotation: Hit_ID=Q6WAY6; Match level="QueryCoverage=90%, HitCoverage=52%, E-value=6e-14, Identity=25%"; Hit description =Putative uncharacterized protein
DMANQEEWVPFMDVLALLIFRVVLFPNMDGLVDLAAIDAFLAYHHSKESPVVAVLVNLFDTFDRRIINWFPRWKEGKEGVLFSCGDYPNIPLIGMRGCINYNPALAIRQLGYPMRGAPTKESLSLFLVKDFSVRDKELRGIHNGIIGGYHEWLKVRTRGLDWLSKLKIINEQNFEAPKEDEEVRALKTELGKARLAKEKFKLVATNVRKECAGLREENEATARALERETKKARKEEYGRDKFRGALWSSN

SEQ ID NO: 96674 - protein, 141 aa, Glycine max
  Coding DNA Sequence Number=SeqID_4989
  Homolog annotation: Hit_ID=Q2HW90; Match level="QueryCoverage=49%, HitCoverage=14%, E-value=4e-08, Identity=37%"; Hit description =Putative uncharacterized protein
MGSSQTPSLKNRFYQVKVKSLGITSLKELGQLMGQLQQQAFRKAYGKIWDLAMVEVSTESIASLAQYYDQPLRCFTFGDFQLSPMVEEFEEILGCPLGGRKPYLFSGPNLGAGIRPPKASRKWGGRDNDKMFGGKSKNLGR

SEQ ID NO: 96675 - protein, 131 aa, Glycine max
  Coding DNA Sequence Number=SeqID_4990
MLVRMICTRLFAAAWVKSCPGMHSSYVLASSFGCACTVGLPPGLGGGPGIDKRKLLPSKGEGMQPSKVEDVSPYEGEGVQPSEGEGVSPLKVRACSPLKVRACSPLKARTCSPLKAWMCSPLKVRMCSPLK

SEQ ID NO: 96676 - protein, 305 aa, Glycine max
  Coding DNA Sequence Number=SeqID_4991
  Pfam annotation: Domain name=PAAR_motif; Domain location=19-43; Score= 27.2; E_value=6e-05; Accession=PF05488.4; Description=PAAR motif
  Pfam annotation: Domain name=PAAR_motif; Domain location=50-74; Score= 30.7; E_value=5.5e-06; Accession=PF05488.4; Description=PAAR motif
  Pfam module annotation: Pfam domain module=PAAR_motif::PAAR_motif; Domain location=19-43::50-74
MGMPAARAFVDKAAHDGPIQCGSPDVIIGGFPAARKGDEFSCKQHGGGIIVSGSGSVFVNGMALARQGDKTQCHAGGASAPAKCKPAPPQYWGGSLAKKAGEDGMLHGEHYDARILGAYASLKDSTNDGSYDTVSTGFSLENLTMGNIKSHDLFRGEFRNKIADADATGAFYNGDSNIYGINGTATATGMQYGVTGAAGSEGTLYANATGDVTIATADAKATAEVYTGNKGRYGFNLGGGGGLAAVKEKVGAKVSLFGLVIAKAKAEAHLGAVGASAGAAAYFDKTDYSVTLKANGRFAVLLGLA

SEQ ID NO: 96677 - protein, 241 aa, Glycine max
  Coding DNA Sequence Number=SeqID_4992
MTDPLDESISCFLIKVDPWVLVPITFRGLYVLAIRGLHILACRGLHALTFRRLRILVFSVLHIQTLGEYKVIALRCFTETCALGKGAGSFLFISFWATPFDIRGRPNCASTSREGGYHASTMHTGARFHPVPAAKRRGSRPQDPSGPEEVQQGPGVSSSGYGPLSVLQGARSPSEESHPQRHPVDPEKSNRALGFPALVTGLCSPTGCLFPPARSRHHRDRVCKAPSGPEEVQQGLGVIKL

SEQ ID NO: 96678 - protein, 108 aa, Glycine max
  Coding DNA Sequence Number=SeqID_4993
MKRRREERGFPEIKVSRRSKKATSGSNRCFGHSVDSASQAESSQRKETPLRESVITIRNIGLFTQLGNKTNLISLFTEPKTKGKENFLCSLPSTYRMEPGLLTKPSSD

SEQ ID NO: 96679 - protein, 40 aa, Glycine max
  Coding DNA Sequence Number=SeqID_4994
MGAKYLEVVKRGSHPNNGWSPDEIRGSKPELVKMKGPIPI

SEQ ID NO: 96680 - protein, 86 aa, Glycine max
  Coding DNA Sequence Number=SeqID_4995
MGENDIIIDKQHRSDWRSGSQSQDWCDRVIWHLKHWGRCRQRIRLYTKDQAESFDDAKGLHELYASQRFTQDKAIRDIQDDNQDSL

SEQ ID NO: 96681 - protein, 225 aa, Glycine max
  Coding DNA Sequence Number=SeqID_4996
  Subcellular localization annotation: CTP_CleavageSite=73; ConfidenceScore=5.27e-01
MGNQQRQGYNQGGFSGFQQGPYNQQGQWRSHPGNQFNKDQGGPSNRPPQQGPNFFQRTTKLEETLAQFMQVTMSNHKSTESALKNLEIQVGLLAKQLAEKSSSSFGANIEKNPKEECKVVMTRSRKLMAAEDKDIVALKEQVVLKDTTDKENDEVKDERSQWREKQIIVGKKEIKDNEKEIKGEKQKEKEEFEKYKEEKKSKSEKAREKRKETTSDEGKEMPYPL

SEQ ID NO: 96682 - protein, 185 aa, Glycine max
  Coding DNA Sequence Number=SeqID_4997
MRETSWFSSSGDNIEHKNIVRSPTGNLVPLDLEIEATLRRNRAKRRKKLLQDRTVASILEEEASSSDFASSYSPSSRESTTNLPEASVMAEEHQHRVTLEDYSSSSVLQFFTSIVRPDVQAHNINYPHSLIHLIHRNLFHGLPNKVMQSYPARALDRRLQVDWARDAREGPRVLMSLRVDFGPMG

SEQ ID NO: 96683 - protein, 196 aa, Glycine max
  Coding DNA Sequence Number=SeqID_4998
MSEIEEVQEQMKVNMEAMKEQMTTMMSMRRMMEVNVAIVVATGTATEVDPTHPSGLNQVNHPASDMVGQGGKALGSTGDPHFVQVQSKHSFPPYGLPPNYTSPNVPHTPDENVDNSTPIPTESQHPQFGLAQVSQHIEETREASRDHNLVDFEPHVGYAAEIQKRFPANPFTSKPSSFKLWKFIHILGINQSSGKA

SEQ ID NO: 96684 - protein, 207 aa, Glycine max
  Coding DNA Sequence Number=SeqID_4999
MVRKFVQVGCCMDIGSFHLRRSKSLSYEDNILYSRSSPTIGQLSALETPYVINVVYKRKGETKYIELVEEEQARIGADSSSGTSNKSENYKEEARNATQEHKPKRVESVNADAEAFAAPLKHTKKRDTRHQSVSLDNKTGDSTVLKIGNSAKVVIKQDMKGRRHKYGFNNNKREKAEKKTVVDDETGDKHQLHEVLRMPCTCVFMKI

SEQ ID NO: 96685 - protein, 279 aa, Glycine max
  Coding DNA Sequence Number=SeqID_5000
MVTKGWSFVGQQWWMREKKKKADVTRGAPTEENLSPFLVRDFGAQSLKVIQRVHKAWTSLLRKDKELWGVRNGIIGVISEEKFEAPEEDEEVQALKLELGKARLAKEKFKSAARNIRKECIELREENAATARALEQETKRARKEEHGRDKFRGALWGSYNELKLRREERDQSQVHGMILKEELAACARSKRSLAQHLEATEQSMLAIIGQYKEELNQSLTHEQKLVEDFAQVYAKKEARGRVIDALHQEVTMWMDRFALTLNGSQDLPRLLAKAKAIAE

SEQ ID NO: 96686 - protein, 101 aa, Glycine max
  Coding DNA Sequence Number=SeqID_5001
MGETHEIPHLNLADFEPFLGYAIEGQAVGGIPLQNTLEGPQFCPQPQVLFLSFFDPAKSESEYPTKLHKEFLGYHNLKLTVPNKYLIILFTAIKCENFGSD

SEQ ID NO: 96687 - protein, 208 aa, Glycine max
  Coding DNA Sequence Number=SeqID_5002
MAPRKLASKRSRKDKAAEGTSSAPEYDSHRFRSAEHQQRFEAIKGWSFLRERRIQLRDDEYTDFQEEIVRRRWASLVTPMAKGQWIPFDADAIGHLLGYPLVLEEGQECMYGQRRNRSDGFDEEAIAQLLCIPGQDFARTAAGRRVRIMRTNMTTLTQIWMTLLLSNIQPSDHNSDLPLPKCQLVYAILTRMSIHVAQLIVDAIYIFA

SEQ ID NO: 96688 - protein, 245 aa, Glycine max
  Coding DNA Sequence Number=SeqID_5003
  Gene Ontology: Mol. function=peptidyl-prolyl cis-trans isomerase activity; Cellular component=periplasmic space; Biological process =protein folding
  Homolog annotation: Hit_ID=A8GKP2; Match level="QueryCoverage=52%, HitCoverage=67%, E-value=2e-56, Identity=84%"; Hit description =Peptidyl-prolyl cis-trans isomerase cyclophilin type precursor
  Pfam annotation: Domain name=Pro_isomerase; Domain location=1-127; Score=154.9; E_value=2.2e-43; Accession=PF00160.12; Description =Cyclophilin type peptidyl-prolyl cis-tr
GYYNNTIFHRVIPGFMIQGGGFTADMQQKSTKAPIKNEADNGLRNLRGTISMARTADKDSATSQFFLNVADNAFLDHGQRDFGYAVFGKVVKGMDVVDKIAQVPTGNVGPYQNVPTKPVVILSAKVLPLAFITVFSRASCSNRQTIIRPEIRRAVAVAADVRLSRYRLSAEQNPAVHPADAGDHPPAAQAAVLRDLLGVLHHGHLFRAAHSGFDRQHPRDRRGPGRSAGRAVGGLSGRADRRPAP

SEQ ID NO: 96689 - protein, 118 aa, Glycine max
  Coding DNA Sequence Number=SeqID_5004
LQVVPFVVRLMNQVIAFPLKNTLRKFITWEINKGKDTTKEDFQVSSKVGQLAKQLAEKSSNNFGANTEKNPKEECKAIMTRSMKLVAAEDEDIVTLKEQVVLKDTADKKNDEVEDERS

SEQ ID NO: 96690 - protein, 68 aa, Glycine max
  Coding DNA Sequence Number=SeqID_5005
MSQHVGIQPKIVSTLSQMLDEYNIHAKSFRMAKDRLADTQVDNTQEGILLLKLKMENYKESMNYTLAI

SEQ ID NO: 96691 - protein, 183 aa, Glycine max
  Coding DNA Sequence Number=SeqID_5006
  Gene Ontology: Cellular component=integral to membrane; Biological process=response to stress
  Homolog annotation: Hit_ID=A7ZT30; Match level="QueryCoverage=30%, HitCoverage=50%, E-value=2e-19, Identity=82%"; Hit description =Universal stress protein B
MSATQANNCYIPSIARVGSKCCKPKPGCESDHGLSLFSLALNENHRWKKFKQISYTENEGHSRPGSALSFSPLQVTSLRLQPGGEHDQHYRAFLGSVCGLSGEYGALLLIVALTAGGAARVRSVAVSPSKQVRLVRYIWEKRYRDHHDDEFIRRCERVRGQFVLTSGLCFLVVVSLIALAIWH

SEQ ID NO: 96692 - protein, 103 aa, Glycine max
  Coding DNA Sequence Number=SeqID_5007
MARECFPNEYMMWNCPSSVDKWHESFFSNASMCETKWPRGNLPQRDLGRIKRLKELVPLLSMTVTALGVLYTNSASRPSRDGHFSGSDASSSETMSILISRRR

SEQ ID NO: 96693 - protein, 143 aa, Glycine max
  Coding DNA Sequence Number=SeqID_5008
MAAQLIHDRVVMECLKGVWETLEGNERCRFRGTIRLTATSLVHPEQPARTLQQPVEWILPTPTPYRLVEPVQVIEVSSSEEDLEENPEELPPEPAMDALDLPEDDEDPLPDVDSPEDFMSASEANSTEESVPGGTTISDDSSS

SEQ ID NO: 96694 - protein, 70 aa, Glycine max
  Coding DNA Sequence Number=SeqID_5009
MQGAGSTIKPPQRRRWSWNGWSKGFQKSGIDDGEAAEQEDEAAEEEEEAAEEEEDAAEDTESDDDSEATP

SEQ ID NO: 96695 - protein, 51 aa, Glycine max
  Coding DNA Sequence Number=SeqID_5010
NHARKTPSGPKEVQQGLEAQGETPQQPGDGRQRATNAPPPPLEFTSAHPQK

SEQ ID NO: 96696 - protein, 156 aa, Glycine max
  Coding DNA Sequence Number=SeqID_5011
  Gene Ontology: Mol. function=phosphoprotein phosphatase activity; Biological process=intracellular signaling cascade
  Homolog annotation: Hit_ID=Q9LNG5; Match level="QueryCoverage=85%, HitCoverage=9%, E-value=3e-26, Identity=42%"; Hit description =Serine/threonine protein phosphatase 7 long form homolog
MKQNEFVWEPYTATVMAASPLICVVGSVVWFAVVPLICFHVVEWHQPDRVLRQFGMQQPIPGCPSQSQNLHGITLKGKQDENWFQLLAPMISQWNNRAEFRVDVYPRQEGLLSFNSDYMVWYRRKTKMFVDPNNANTTTLGEVVSPQGRNTLLLYV

SEQ ID NO: 96697 - protein, 124 aa, Glycine max
  Coding DNA Sequence Number=SeqID_5012
  Subcellular localization annotation: CTP_CleavageSite=99; ConfidenceScore=5.31e-01
MMEAMMSVKKIMEANAVAIAATSVVAKVNPTSPSGLKQMNHPTSNMVGKNLGSRAAPMMCKFKTSTPSRHMACLSTIRHPMWRTLPIRMSITPLLYPLKASNPKLIMHMSLKPWKRLMKFPITI

SEQ ID NO: 96698 - protein, 201 aa, Glycine max
  Coding DNA Sequence Number=SeqID_5013
YLGTDASRGYGHDRWIVVPCPALGNWKALLQGNPKMASKKLFAKRSRRDAAAEGTSAAPEFDSHHFRSTEHQQDDEYADFQEEIARRRWTSLVTPMAKFDPDIVLEFYANAWPTEVGVWGMRSWVRGQWIPFDADALSQFLGDPLVLEEGQKCEFSQRRNRADGFTEEAIAQLLCISGQDIARTAAGRRVRIMRTSMTTLT

SEQ ID NO: 96699 - protein, 175 aa, Glycine max
  Coding DNA Sequence Number=SeqID_5014
MSISPYGSISWDHTHKTPSGPGEVQQGPGVFSSGYRPLLVLPVIAPARHPVDPEKSNRVLGFPALITGLCQFCGVPVAPIKVIKPPINRAFIKKYCAPQAGVGRDTTTAWGCRQQAIDAPPPPLEPLSSSSKARALPTTRGRPAGDKSKAKGKQSTRSVTDKSSRVQLKTLKKRY

SEQ ID NO: 96700 - protein, 47 aa, Glycine max
  Coding DNA Sequence Number=SeqID_5015
MKSLRGKEIALVKVQWGPDDGDSTWELEDRKYVHWGRNTRVRLINEE

SEQ ID NO: 96701 - protein, 370 aa, Glycine max
  Coding DNA Sequence Number=SeqID_5016
  Gene Ontology: Mol. function=citrate transmembrane transporter activity; Cellular component=integral to membrane; Biological process=potassium ion transport
  Homolog annotation: Hit_ID=A4WCS1; Match level="QueryCoverage=100%, HitCoverage=60%, E-value=0.0, Identity=92%"; Hit description=Citrate transporter
  Pfam annotation: Domain name=CitMHS; Domain location=31-318; Score= -77.1; E_value=0.001; Accession=PF03600.7; Description=Citrate transporter
  Pfam annotation: Domain name=DctM; Domain location=38-370; Score= -220.7; E_value=0.011; Accession=PF06808.3; Description=DctM-like transporters
  Pfam annotation: Domain name=Na_sulph_symp; Domain location=21-370; Score=-287.3; E_value=0.0057; Accession=PF00939.10; Description =Sodium:sulfate symporter transmembrane region
  Pfam annotation: Domain name=TrkA_C; Domain location=1-66; Score =30.8; E_value=5.1e-06; Accession=PF02080.12; Description=TrkA-C domain
  Pfam annotation: Domain name=TrkA_C; Domain location=86-157; Score =36.0; E_value=1.3e-07; Accession=PF02080.12; Description=TrkA-C domain
  Pfam module annotation: Pfam domain module=CitMHS::DctM::Na_sulph _symp::TrkA_C::TrkA_C; Domain location=31-318::38-370::21-370::1 -66::86-157
MVGQRLDDLKLRERYGANVIGVERWRRFRRVIVNVNGVSEFRARDVLLIDMSTAEVDLREFCSEQLLEPMVLRGEYFSDQALDVGMAEVSLIPESELLGKTVREMGFRTRYGLNVVGLKRDGVAMEGAVVDEPILLGDIFLVVGNWKLISQLGQKGRDFVVLNMPVEESDASPAHSQAPHAIFCLVLMVALMLTDEIPNPVAAIIACLLMGKFRCIDAESAYKAIHWPSIILIVGMMPFALALQKTGGVDLVVKGLMDVGGGYGPYMMLVCLFIMCATIGLFISNTATAVLMAPIALAMAKSMGVSPYPFAMMVAMAASAAFMTPVSSPVNTLVLGPGNYRFSDFVKLGVPFTVLVMLVCVVLIPVLFPF

SEQ ID NO: 96702 - protein, 217 aa, Glycine max
  Coding DNA Sequence Number=SeqID_5017
  Homolog annotation: Hit_ID=A9BV71; Match level="QueryCoverage=68%, HitCoverage=29%, E-value=2e-63, Identity=77%"; Hit description=4 -amino-4-deoxy-L-arabinose transferase and related glycosyltransferase of PMT family-like protein
MTHPVPSQAASTITRSAPLAMPAPSLSLDIKVLIGLLLFSVVWLLQIDSSSLTAPKDNLEQLTWVHSLEWGYYKHPPLPTWMFSVPVNVFGLSARTSYVTGALFTLAGLLVFWKLMQTLRGSRHATLALLAALCITYYNERLHFFNHEVATALVGRPGLLPGAGRTGQVPDDPGRRGGIPVLAGVRRLARAGPHDRPGAGGGHLAGHHLAAPVLAVS

SEQ ID NO: 96703 - protein, 115 aa, Glycine max
  Coding DNA Sequence Number=SeqID_5018
MASNLSKAQKKAKSSKRKQDECSRAALDRLDTCKGSISLICWKHKKEVAGLDMGGVYKFEETTDGYSKMQTYKGMLLDPAKNLKNLLRVGGLTTEDKMLVYLITYILTPRSSNHA

SEQ ID NO: 96704 - protein, 134 aa, Glycine max
  Coding DNA Sequence Number=SeqID_5019
MTGRLLSGSLALESRILHYLFVRILLPRSSNLAQAFHTGRQIDWAYLVWYRMHKSLRLNAPLPYPYLVTLFLQHLNIPLDSEPYVPIKRSFLIGAVVVASFGYRKERDASWVKKGAQPNDDEGNLPVERDSSLL

SEQ ID NO: 96705 - protein, 233 aa, Glycine max
  Coding DNA Sequence Number=SeqID_5020
  Gene Ontology: Mol. function=transporter activity; Cellular component= periplasmic space; Biological process=transport
  Homolog annotation: Hit_ID=UPI00005FA4A6; Match level="QueryCoverage =81%, HitCoverage=36%, E-value=1e-50, Identity=55%"; Hit description =COG4166: ABC-type oligopeptide transport system, periplasmic component
MGQGQIPAYGLTPPCIHGISLNTPAWAQQTQAQRNAAAKQLLAEAGFNAQHPLRFTLLYNTSEQNKRQAIAAASMWQKNLGAQVTLQNQEWKTLLETRHQAQFDVVRATWCADYNEPSSFLNLLLSGSSINTAFYHSAAFDALMAQTLNTADDAQRAQLYQQAEQQLDQDSPIIPVYYRVSVRLVKPWVGVGRHVAVVTLQGGSDLRADRRRSPGNGVRRAVSRPGDDNKTGA

SEQ ID NO: 96706 - protein, 161 aa, Glycine max
  Coding DNA Sequence Number=SeqID_5021
LLSEVVVSSTLSARLALSQISLTRAKRAFEKTEEKLSKEAKVLTFRNFSIDKCIVSSKLDRAGLDNCSARHSVQVESLLREPFQVQKLRTHILHDINHLEVSLLILVCEPNIQPIESCLRALSLLPFRGLGFLLSFGRIAGHFSEQGLKVEERLGFWKRQL

SEQ ID NO: 96707 - protein, 41 aa, Glycine max
  Coding DNA Sequence Number=SeqID_5022
MAREPMVQVGDRLRRVCKYRRWPEWLAAQRAPQVKRGGQNG

SEQ ID NO: 96708 - protein, 66 aa, Glycine max
  Coding DNA Sequence Number=SeqID_5023
MKMNDSRIEKEKRERRRHFKEKMSLEEARHHRRPWIRAWRKKEMNEGRGREEHKILCSKRALKSEV

SEQ ID NO: 96709 - protein, 68 aa, Glycine max
  Coding DNA Sequence Number=SeqID_5024
MGNKWEVRKSSRLIWLEAYKNKMPKSSPNMHVKQEVSTRVKPRLLCKQSMGQNTLNKIDDDGSNSHQG

SEQ ID NO: 96710 - protein, 22 aa, Glycine max
  Coding DNA Sequence Number=SeqID_5025
MVEEPIDYIWPYQGLLTHLTPT

SEQ ID NO: 96711 - protein, 128 aa, Glycine max
  Coding DNA Sequence Number=SeqID_5026
  Homolog annotation: Hit_ID=Q6WAY6; Match level="QueryCoverage=96%, HitCoverage=20%, E-value=8e-07, Identity=29%"; Hit description =Putative uncharacterized protein
MVEEFEEILGCPLGGRRLYLFSGFYPSLARIYKIVQISTQELDHGKQVENGVVGIPRKCLEAKTRILAGRGEWAPFIDILALLIFGGVLFPNVDGLVDLAAIDAFLAYHDREESPVVAILADLYDTFD

SEQ ID NO: 96712 - protein, 224 aa, Glycine max
  Coding DNA Sequence Number=SeqID_5027
  Gene Ontology: Mol. function=phosphogluconate dehydrogenase (decarboxylating) activity; Cellular component=nucleus; Biological process=valine metabolic process
  Homolog annotation: Hit_ID=Q4UZW8; Match level="QueryCoverage=98%, HitCoverage=75%, E-value=3e-66, Identity=59%"; Hit description =Dehydrogenase
  Pfam annotation: Domain name=ApbA; Domain location=3-129; Score= -25.3; E_value=0.029; Accession=PF02558.7; Description=Ketopantoate reductase PanEApbA
  Pfam annotation: Domain name=F420_oxidored; Domain location=2-160; Score=-59.6; E_value=0.074; Accession=PF03807.8; Description=NADP oxidoreductase coenzyme F420-dependent
  Pfam annotation: Domain name=GFO_IDH_MocA; Domain location=1-109; Score=-16.0; E_value=0.027; Accession=PF01408.13; Description =Oxidoreductase family, NAD-binding Rossmann fold
  Pfam annotation: Domain name=NAD_binding_2; Domain location=1-160; Score=158.1; E_value=2.4e-44; Accession=PF03446.6; Description=NAD binding domain of 6-phosphogluconate dehydrogenase
  Pfam module annotation: Pfam domain module=ApbA::F420_oxidored::GFO _IDH_MocA::NAD_binding_2; Domain location=3-129::2-160::1-109::1-160
  Subcellular localization annotation: CTP_CleavageSite=39; ConfidenceScore=5.16e-01
MKIGFAGLGGMGSAMAANLLQAGFALTVWNRSPQAAQPLVSTGAQQAERPEQLADADVLITMLADDAATQQVVVDSGLLQRMKPGALHINMATISVELAKRLTALHAEHGIGYLAAPVLGRVDVAAAGKLNILAAGDSELLKQAQPLFDALGQKTWHFGADPAQANVVKIATNFTLASAIEAMAEGSALVRNYGVSGADYLQMLSSTVFAAPAYQGYGALIAAE

SEQ ID NO: 96713 - protein, 32 aa, Glycine max
  Coding DNA Sequence Number=SeqID_5028
MGETKKPTTTQRRKGTKAPDQGSKENRRHMQN

SEQ ID NO: 96714 - protein, 46 aa, Glycine max
  Coding DNA Sequence Number=SeqID_5029
MTGRRTLVCSYRATVNAGASGSTAETAMGSLPQRGWSERSFENSRE

SEQ ID NO: 96715 - protein, 123 aa, Glycine max
  Coding DNA Sequence Number=SeqID_5030
  Gene Ontology: Mol. function=nucleic acid binding; Biological process= DNA integration
  Homolog annotation: Hit_ID=Q2LEC5; Match level="QueryCoverage=31%, HitCoverage=31%, E-value=2e-10, Identity=76%"; Hit description =Integrase-like protein
YILCGTSRGYIYLGLTENKRGYISCGSVLVEGTSTRFKENKGGYIPCGSLLVAILAYRGQLTRCLTAVSIGPPSSRMRGESVVLGIDFMGHFPVSFGLVYILLAVDYVSKWVEAKPTRTNDAK

SEQ ID NO: 96716 - protein, 54 aa, Glycine max
  Coding DNA Sequence Number=SeqID_5031
THLLLEVASPLSLPFSIPLPFIFQEAKESIDDEDPRPTSSNGDCIIEFLGYHNP

SEQ ID NO: 96717 - protein, 17 aa, Glycine max
  Coding DNA Sequence Number=SeqID_5032
MDTRLRVIGDPMNGVQR

SEQ ID NO: 96718 - protein, 79 aa, Glycine max
  Coding DNA Sequence Number=SeqID_5033
TRYVRRYMEKNEETTMEEKGGIFELQWGPLMVIFHHGDAAEDKGKELGEDASMEEKKEGEKEGGGSTKLKEEKGREVEL

SEQ ID NO: 96719 - protein, 72 aa, Glycine max
  Coding DNA Sequence Number=SeqID_5034
MEDTPVSLASLARKKVGCNNLKTFLLSDFYGQSLIWKKKGGGCRPARPSELGCFHQKAPPSVGTPWKAQVGL

SEQ ID NO: 96720 - protein, 95 aa, Glycine max
  Coding DNA Sequence Number=SeqID_5035
MHLSHKHFFMHSSIFPVTDVGVLICTGAWAQKEVLSGQDQEPRSRQSEKVRAVDGSTPAMSLSQDLWCFTIGDFQLTPTAEEFEEILGCPLGGRK

SEQ ID NO: 96721 - protein, 147 aa, Glycine max
  Coding DNA Sequence Number=SeqID_5036
  Homolog annotation: Hit_ID=A7R5Q5; Match level="QueryCoverage=58%, HitCoverage=18%, E-value=8e-10, Identity=39%"; Hit description =Chromosome undetermined scaffold_1022, whole genome shotgun sequence
MTRGNPSDLQPFDPEIDRTFHRLVRHHLVPFEHPEHAVIGDFEHYCFEHSENIAQPPPRERTLREMVAPDFTYESLCIQYPDEDVPYVLKTGLIHLLPKFHGLAGEDPHKHLKEFHIVYSTMKPPDAQEDHIFLKAFPYSLEGVAKD

SEQ ID NO: 96722 - protein, 108 aa, Glycine max
  Coding DNA Sequence Number=SeqID_5037
MWAIIDQYKEKLSLVATHEQMLEDEYAKVSVLQAEREARERVIDSLHREAMMWMDRFAFTLNGSEELLRFLVKAKVMVDVYSAPKEVHGLLDYCQHMINLMAHVVRNH

SEQ ID NO: 96723 - protein, 244 aa, Glycine max
  Coding DNA Sequence Number=SeqID_5038
  Homolog annotation: Hit_ID=A5B5G7; Match level="QueryCoverage=87%, HitCoverage=14%, E-value=6e-11, Identity=26%"; Hit description =Putative uncharacterized protein
MASRKRKAPASASQAFYDRHRFTSQEAWDRYSDIVIGRKILPERNVMLYDTEFDEFTEELEHMNWHKVLTNFMDGIIDVAIMKEFYANLYDPEDKLPKKVRVRGHLVKFDADTLNTFLKTPVIIEEGENLSAYSRYSQLRPDPQELATRLCIPGKGFELNDDGLPLKILRKNLTLLAQTWSVLSFSNLVLTSHTSDITLDRARLIYDIIQKMDMNVGHIISSQISVIAQHDCSRLGFPTLITAL

SEQ ID NO: 96724 - protein, 93 aa, Glycine max
  Coding DNA Sequence Number=SeqID_5039
MQKTMLVSARQQARFPWLTKGAGDDETTLVSACYWTLSLTDSKRVCPGYPIGRLRVPMDSWVMVTKDGVVDKSGAFTPTYPQFVLKNSDLRSS

SEQ ID NO: 96725 - protein, 66 aa, Glycine max
  Coding DNA Sequence Number=SeqID_5040
MLVFPINRREGRLIKGFQGSKVERIERREKEEEEERRGNKAEALPNHDCDQSLHRSFFGVHHATIS

SEQ ID NO: 96726 - protein, 171 aa, Glycine max
  Coding DNA Sequence Number=SeqID_5041
MERSMIDAASGGALGDMTPAEARNLIEKMASNSQQFSARNDVIVLRGVHDVATDSSSSAENKKLEGKLDVVVNLVTQLVVNQKFALVASVCCLCSSADHHTDLCPSLQQSGFNEQPEAYASNIYNRPPQQQNLQQQNNYDLSNKRYNLGWRNHPNLRWANPPQQQQQQQQQ

SEQ ID NO: 96727 - protein, 41 aa, Glycine max
  Coding DNA Sequence Number=SeqID_5042
MALPCLHNPVHLWPIGGGVMMLDLEIPAHFLHHFVIQIGAI

SEQ ID NO: 96728 - protein, 164 aa, Glycine max
  Coding DNA Sequence Number=SeqID_5043
  Subcellular localization annotation: CTP_CleavageSite=50; ConfidenceScore=5.63e-01
MGVFPFLLCSLSAMPGANLLAMGSSSDSTSSRSMRSPGAGSGALGAGGTSAFGVEDVGTSLSASGTETFGLEDVGHLHQHQGQKHFSECYSQDCGSSDPSHFSGTGPGPGIICMGWILNSGCSWFDGVLEDDGDDGTEGETGDEASFGEVAMEKQSFWSGFVNI

SEQ ID NO: 96729 - protein, 70 aa, Glycine max
  Coding DNA Sequence Number=SeqID_5044
  Subcellular localization annotation: CTP_CleavageSite=33; ConfidenceScore=5.71e-01
MWSPQKVRMHSPLKARTCSPLKVRARSPLKVRTCSHLMARTCSPLKVRACSPLMARTCSPLKVRVCSPLK

SEQ ID NO: 96730 - protein, 95 aa, Glycine max
  Coding DNA Sequence Number=SeqID_5045
  Subcellular localization annotation: CTP_CleavageSite=78; ConfidenceScore=5.16e-01
MVAITPAKAPQPPFFQGYNSNATCGYHGGVSGHSIEHCRTWKRKAQPASTVMRESRRAQESRPHAKCEISSLSETFVSCQAQRTTGAKPKSTYSR

SEQ ID NO: 96731 - protein, 422 aa, Glycine max
  Coding DNA Sequence Number=SeqID_5046
  Homolog annotation: Hit_ID=A5B5G7; Match level="QueryCoverage=54%, HitCoverage=15%, E-value=2e-11, Identity=25%"; Hit description =Putative uncharacterized protein
MVSRKRKAPVSASQDRYDRSKFTSQEAWDRYSDFVIGRKIQPKRNVMIYHTEFDEFKAELERKNWHKELMNFRDGSIDVALVKEFYANLYDPEDRSPKQVRVRNHLIKFDVDALNTFLKTPEIIQEGETMTAYSRFAQLRLDPQQLVAKLCIPGRRFELNANGLPLKILRKNLTTLAQTWSVLSFSNLAPTSHTLDITLNRVKMIYGIIQKMVMNVGYMISAHISMITQHDSSWLGFLALITALCKAKGVTSDSLSFKSLSPTINLAYMKKNCWNLDDPSVTFRGPRKAKGKRSETLPSSKIPPSAAPSITVPASSAPYASAPLPTPITAPPIGPSSFTSETLYAMLQSLHRVQVAWPGVQPSPFGRGEAFAAQELVPVAKDELIPPKPFIIETNPVIQEEAAAQEPISPFPISPTPITDDS

SEQ ID NO: 96732 - protein, 109 aa, Glycine max
  Coding DNA Sequence Number=SeqID_5047
  Subcellular localization annotation: CTP_CleavageSite=36; ConfidenceScore=5.37e-01
MAPLSSLQNGQVTKSNRTYTLREFPERFAKNRTRFPKSNVQTFEFGMRGPFDESISGMRGLYNLAFKGLHVFTFRGLHVLNFRGLHVLAFRGLYILAFKGLHVLAFKGL

SEQ ID NO: 96733 - protein, 318 aa, Glycine max
  Coding DNA Sequence Number=SeqID_5048
  Gene Ontology: Mol. function=transporter activity; Cellular component= integral to membrane; Biological process=transport
  Homolog annotation: Hit_ID=A7NYJ6; Match level="QueryCoverage=89%, HitCoverage=55%, E-value=1e-152, Identity=91%"; Hit description =Chromosome chr6 scaffold_3, whole genome shotgun sequence
  Pfam annotation: Domain name=MFS_1; Domain location=1-257; Score= -9.5; E_value=0.039; Accession=PF07690.7; Description=Major Facilitator Superfamily
MNNILSKWVPVSERSRSLALVYSGMYLGSVTGLAFSPFLIHQFGWPSVFYSFGSLGTVWCSVWLSKAHSSPLEDPELRPEEKKLITANCSSKEPVKTIPWRLILSKPPVWALIVSHFCHNWGTFILLTWMPTYYNQVLKFNLTESGLFCVLPWFIMAISANVGGWIADTLVSKGLSVTRVRKIMQTIGFLGPAFFLTQLSHANSPVMAVLCMTCSQGTDAFSQSGLYSNHQDIAPRYSGILLGLSNTAGVLAGVFGTAATGYILQHGSWDDVFKVSVGLYLVGTVAFVPHRMVNFVDRGALEHIDQRDDNVSLKEELA

SEQ ID NO: 96734 - protein, 101 aa, Glycine max
  Coding DNA Sequence Number=SeqID_5049
MITKDDDKGDDKKLNEFKMFKIESRTLQDSRGKLISRIKNQDSGDQDSRLKIQESREGLIKISVKKFFQKLSSIWIFLKTCLSKSFYSLVIDYQIVVIDYQ

SEQ ID NO: 96735 - protein, 117 aa, Glycine max
  Coding DNA Sequence Number=SeqID_5050
  Subcellular localization annotation: CTP_CleavageSite=40; ConfidenceScore=5.66e-01
MVRNAHRSKCPNSLKTVPSGVANSRNLPFGRRATGGTRVRLPRKEGARSRHQRLFEENVRKSKTCDLRTLIVKGSGVVFTHGEGVVDKSGASAPTYPRFVVRNSDLRSSCKNGKVTC

SEQ ID NO: 96736 - protein, 92 aa, Glycine max
  Coding DNA Sequence Number=SeqID_5051
MTQLKRSSNMLKKLVLMPRIFQVGCVIVYVDHVAVIVWKGELSSLGRKVQKFGRPDAEIEGLVVATGLSPLIACSLHTGDRGLCWIKWPWNN

SEQ ID NO: 96737 - protein, 103 aa, Glycine max
  Coding DNA Sequence Number=SeqID_5052
MEAIKEQMATMMKAMMSMKKIMEANAVIVAAISAVAKVNPMLPSGLKQINHPTSNMVGKDLGRQAVGGIPFENTLEGPQFRPQPQPLHFAEEPLLLWPKRRII

SEQ ID NO: 96738 - protein, 68 aa, Glycine max
  Coding DNA Sequence Number=SeqID_5053
VINGVRVGDEAEKKITLVMKRERRCHFKEKMSLEEAHQHRRPCIRAWRKKEMNEGRGREEHEILCSKR

SEQ ID NO: 96739 - protein, 69 aa, Glycine max
  Coding DNA Sequence Number=SeqID_5054
MLGFTSDSPQISASPHQLDFAPYASGPYNAQWNALRLLHDKHTLCLSRILREMEIEEPSRGYGYHCIIK

SEQ ID NO: 96740 - protein, 59 aa, Glycine max
  Coding DNA Sequence Number=SeqID_5055
MFASGNCGFSGELMNASKMHLLLLVPPRTVEQRSIPNLHRGIDGDSQISQNRTEWDTMR

SEQ ID NO: 96741 - protein, 72 aa, Glycine max
  Coding DNA Sequence Number=SeqID_5056
MTKLGLCLSSGPPPLDDKRVRITISLHRKMLTSPERAQMTILVSARQSHLGSLNDEVRITVRCLRGLPALES

SEQ ID NO: 96742 - protein, 86 aa, Glycine max
  Coding DNA Sequence Number=SeqID_5057
MSHGRFVSTKDKERIRQEGTPAQVQRGGPRNRGKWAPNYEGPFMQGAESSQVKVRSQDKLTAKINQGTWGRMQVGIDRPIVALSRR

SEQ ID NO: 96743 - protein, 60 aa, Glycine max
  Coding DNA Sequence Number=SeqID_5058
MAEVTLHIDSRSFDDNKDDDKKLKSQDHFMITKMMTFKNKFKIEFKIESRTLQGSRGNLI

SEQ ID NO: 96744 - protein, 153 aa, Glycine max
  Coding DNA Sequence Number=SeqID_5059
AFSEELAKRTYCAKRVRPLRTNTHPLAELPMAKRDGFQKEKEYWYKTHISVGYKEDELERHNFHKCLTNLVDSNIDLALVKEFYANLYSSEGPSPKQVRVRGHVVKIDVDNLNTFLETSVVLAEGETLPAYSKYCGLPADIREIKVALCIPSR

SEQ ID NO: 96745 - protein, 80 aa, Glycine max
  Coding DNA Sequence Number=SeqID_5060
MTLSLWEDTGKLSSTKLNVSICDIHGLDLNQEGEALTDSSECRPWGSPGLSAPLKPMLIPYGWSILAKHRDPDLSPYDLT

SEQ ID NO: 96746 - protein, 73 aa, Glycine max
  Coding DNA Sequence Number=SeqID_5061
MDGEPARRVTLEDFSNTATPQFFTSIARPEVQAANISCPHSLIQLIQGNLFHGLPSKDPYAHLASYIEICNTV

SEQ ID NO: 96747 - protein, 125 aa, Glycine max
  Coding DNA Sequence Number=SeqID_5062
  Homolog annotation: Hit_ID=A2Q1D6; Match level="QueryCoverage=70%, HitCoverage=14%, E-value=1e-12, Identity=42%"; Hit description =Ovarian tumour, otubain, related
ELLKQASITIISEEVDINVKNEEDVGVKVEHIDCSYVFNTSQLFATRDEVLHWARSVAHEIGFVVVIMRSDTNTNVGGRASFLLIACERSGEYRPKKKDLVRTCTGSRKCGCPFKLRAKPVLGGE

SEQ ID NO: 96748 - protein, 405 aa, Glycine max
  Coding DNA Sequence Number=SeqID_5063
  Homolog annotation: Hit_ID=Q6WAY6; Match level="QueryCoverage=92%, HitCoverage=66%, E-value=3e-15, Identity=25%"; Hit description =Putative uncharacterized protein
MANQEEWVPFMDVLAFLIFGVVLFPNVDGLVDLAAIDAFLAYHHSKESPVVAVLADLFDTFDRRCEKSSARIICCLPALCVWLVSHLFQQDIRHPCPLRSHRSCVEKRKVDWDQHLAGIGDSQLVSTMERRKGGSSLLMWGLPKHPADRKRGCIKYNPALAIRQLGYPMRGAPTEESLSLFLVRDFGAQNFKVIQRVHKAWESPLRKDKELRGIRNGIIGGYHEWLKVRTRGLDWLAKLKIINEENFEAPEEDEEVRALKTELGKARLAKEKFKLVATDVRKECVGLREENAAIAKDLEQETKRAHKEEHGRDKFRGALWGSNSELKLRREEKDRSRAHNMILKEELAVCSRSKRNLSQRLCEAETNMLAIITKYQEELSLATAHEHRVRTSMPMCTRKRRLEEG

SEQ ID NO: 96749 - protein, 79 aa, Glycine max
  Coding DNA Sequence Number=SeqID_5064
MQASIYQIEGNVQRQATAPRGGLWWSWVVEKEILLSKLISLSGSPLFTLSATIGTERNSLCINSRSAQFPLRLKLHLAC

SEQ ID NO: 96750 - protein, 221 aa, Glycine max
  Coding DNA Sequence Number=SeqID_5065
  Homolog annotation: Hit_ID=Q8H6Q8; Match level="QueryCoverage=98%, HitCoverage=52%, E-value=2e-08, Identity=37%"; Hit description=CTV.20
MEYNIMNTLQHMIMVVTAYQTSHECLEETIIDILVAGFSGQLKAQHFIGDPSLWKYKSAELLSNLKCRTLADLRLKKKLRNLNLEPAIEEQINNLLIETSEEEIKTSSSVLFDENLNIIQQDDQLSSTDDDGQINTLTREQDLLFEAISSIPDPQEKKVFLEKLKKTLEVKPKQKDFITNNKFDVNNIFERLENSSAKPTTVQDLQTEINNLKREVKELRQ

SEQ ID NO: 96751 - protein, 103 aa, Glycine max
  Coding DNA Sequence Number=SeqID_5066
MSYVPILRSIFVPYSTYMHICKALGYLFNISQTKCWPKGETSPTCSHFHAFLHSNSKAWVPRPKSHFGIYPNLCKLSTHPKMATMYAQTNSIRKIHKFMRECH

SEQ ID NO: 96752 - protein, 206 aa, Glycine max
  Coding DNA Sequence Number=SeqID_5067
MSRGSGDLGDVRWGAIAQNQACPIPTQPGHSQAVRTCDVPQQASFWQSTNKGTKVHKAGRLIAMAAQLIQDRVVMECLEGVWETLEGNERCRFRGTVRLTATSLVHPEQPARTLQQSVEWILPTPTPSQLIEPVQLIEVSSSEEDLEEDLEELSPEPAMDSPDLPEDNVDPLPDVDSLENIMPASEADSTEESGPGGTTNSDDSSS

SEQ ID NO: 96753 - protein, 96 aa, Glycine max
  Coding DNA Sequence Number=SeqID_5068
  Homolog annotation: Hit_ID=A5BZZ9; Match level="QueryCoverage=91%, HitCoverage=9%, E-value=3e-09, Identity=38%"; Hit description =Putative uncharacterized protein
MSLPTGRSKMVKDNNDKPVMATPFKTKDVNEEITPKDIRSLMEQANYTNKYLQVLGESISKEKVFTKPKDHESSSSPFQMKKPLFKPFKELMKHWA

SEQ ID NO: 96754 - protein, 119 aa, Glycine max
  Coding DNA Sequence Number=SeqID_5069
MVTLGTFSNPGPIRKLRDEVTSSPGRARLLLEEASSSPGQVELAWGEGRHKRIQAVSPLFFWKREKRDTKRIQAVSPWRILFGKGRREWKRRITQVFEQRTFLGRESFEQKLFRKMKRR

SEQ ID NO: 96755 - protein, 344 aa, Glycine max
  Coding DNA Sequence Number=SeqID_5070
  Gene Ontology: Mol. function=identical protein binding; Cellular component=cytosol; Biological process=electron transport
  Homolog annotation: Hit_ID=A7PCX2; Match level="QueryCoverage=99%, HitCoverage=99%, E-value=1e-141, Identity=68%"; Hit description =Chromosome chr17 scaffold_12, whole genome shotgun sequence
  Pfam annotation: Domain name=WD40; Domain location=112-149; Score =0.1; E_value=31; Accession=PF00400.23; Description=WD domain, G-beta repeat
  Pfam annotation: Domain name=WD40; Domain location=155-194; Score =16.5; E_value=0.1; Accession=PF00400.23; Description=WD domain, G -beta repeat
  Pfam annotation: Domain name=WD40; Domain location=201-240; Score =25.8; E_value=0.00016; Accession=PF00400.23; Description=WD domain, G-beta repeat
  Pfam annotation: Domain name=WD40; Domain location=289-337; Score =3.6; E_value=11; Accession=PF00400.23; Description=WD domain, G-beta repeat
  Pfam annotation: Domain name=WD40; Domain location=56-98; Score=11.1; E_value=1.4; Accession=PF00400.23; Description=WD domain, G-beta repeat
  Pfam module annotation: Pfam domain module=WD40::WD40::WD40::WD40::WD4 0; Domain location=112-149::155-194::201-240::289-337::56-98
MDIAHCYLKGNADAVEFCPHDPYHNVLAVSTYTLQEGSQPCRHGSISLFNVDVEPGHLDMVFSEETAGIFDIKWNPPGGHASPFLAQADADGYLRIKMLEGCCNGVEGVNLKEITNEKISNSMCLYLDWNPSATSITVGLSDGSVSIVSFLESKLEIQEEWKAHDYELWTTSFDIHQPNLVYTGSDDCKFSCWDLRDKPPNVVFQISKVHKMGVCCIEKSPHDPNTLLTGSYDEFLRVWDLRSISKPLNSINLGGGVWRVKHHPFIPGLVLAACMHNGFAIVAIKGDNAEVSETYKKHDSLAYGADWQKGEANHIGENTKPLVATCSFYDKLVRVWRPGNDFIL

SEQ ID NO: 96756 - protein, 93 aa, Glycine max
  Coding DNA Sequence Number=SeqID_5071
MVEGRLVIVSREEDILVSCPSSMSYVEAAEESLETTFQSFEVVSNASMESLSMRPCMSDTMMMVAYVMLGHGYKPGMGFVGSSGLKIIKKEGD

SEQ ID NO: 96757 - protein, 146 aa, Glycine max
  Coding DNA Sequence Number=SeqID_5072
MKKAFSGGALVLASMDDEELPSPVNTDISEDKQRFGRYHTEFKAKARDQHIIIPHLAQDVKEALLGGSLEMAPRKLPTKRSRKDTTGEGSSAAPQADMDFDRHRFRSAEHQQHFETIKGWLFLRERQIYVRDDEFPDFQGEIAHRR

SEQ ID NO: 96758 - protein, 160 aa, Glycine max
  Coding DNA Sequence Number=SeqID_5073
MWFVHRRNPPRLVVVGKVYEGLTTIHDIHFSHDQVKVGVEEVRDADAPIPIPTEEVELVGQALHTFLAWSTHLIKCLSEHGAVGPAKPANRPYHEVDDPLYLMTLTIPQLFLKPLQVMWDAIVFGVFNEDFPLYIKHEDLSEIAHGGQCLNISVIQLWIL

SEQ ID NO: 96759 - protein, 45 aa, Glycine max
  Coding DNA Sequence Number=SeqID_5074
MKAWVIDDRITLLGVTGTPNDWQRPMISAGNPRPLLDLSRSRGCL

SEQ ID NO: 96760 - protein, 98 aa, Glycine max
  Coding DNA Sequence Number=SeqID_5075
MMRLSKANEPAIMRPVISAWLVQTNWRASYAEKSNFQSSFSVPSNAEKKSISMNLGSIMERDEKRFEYRICCSSEENSVEDDKEGGIGAVDVLVAPER

SEQ ID NO: 96761 - protein, 86 aa, Glycine max
  Coding DNA Sequence Number=SeqID_5076
ALKGLNDMSQPKSKVGARWIVVKCNRQKGSTECDYYVMHWMSTIILGSFKNNWEMYFNDARPLESERLKALHIQWAKYYLKVRNET

SEQ ID NO: 96762 - protein, 102 aa, Glycine max
  Coding DNA Sequence Number=SeqID_5077
MPSGDAVGHDIFGMLTICGTSHMDTTITFLHARWRAFQTSPHGLPRSCDLPPWHPHIAGVSCRDFSYTVCSAHEETGCQPPQCPFIVVGNLWRGILCLRHIA

SEQ ID NO: 96763 - protein, 45 aa, Glycine max
  Coding DNA Sequence Number=SeqID_5078
MEKPDKKTFKDKKGKKVYITWEDNDMDSSSLMAKDYESEEEDSLK

SEQ ID NO: 96764 - protein, 190 aa, Glycine max
  Coding DNA Sequence Number=SeqID_5079
  Gene Ontology: Mol. function=binding; Cellular component=cell outer membrane; Biological process=intein-mediated protein splicing
  Homolog annotation: Hit_ID=Q7AFL0; Match level="QueryCoverage=98%, HitCoverage=14%, E-value=1e-50, Identity=58%"; Hit description =Hemagglutinin/hemolysin-related protein
  Pfam annotation: Domain name=Haemagg_act; Domain location=7-140; Score=126.3; E_value=9.2e-35; Accession=PF05860.4; Description =haemagglutination activity domain
MPVVAQAEISIKNGSVTEASNGVPIVNIAKPNSNGLSHNVYDTLNVGAEGVIFNNATSAAQSVLAGQIAANPNLTDRSAMVILNEVTSTNASTINGMMEVAGDSAHLIIANPNGITTQGGGFINAEKGTLTTGTPKLGEDGLLNGYSVNGGTINVSGFQSESPTEILARSVVVNGALSASELKIVAGSNA

SEQ ID NO: 96765 - protein, 152 aa, Glycine max
  Coding DNA Sequence Number=SeqID_5080
  Homolog annotation: Hit_ID=Q6WAY4; Match level="QueryCoverage=86%, HitCoverage=24%, E-value=2e-12, Identity=35%"; Hit description =Putative uncharacterized protein
MGTNQNGKRFHQVKIKSLDVTSLKELGRLMGPLQRQAFRKVYGKILDLTAVEVFTEAVVSLAQYYDQPLRCFTFGDFQMVPTVEEFEEILGCPLGGRKPYLFSGFLPSLSKTAAVVGDSAKELDHMKQTRNGVVGLPQKYLEGKARDMASQE

SEQ ID NO: 96766 - protein, 133 aa, Glycine max
  Coding DNA Sequence Number=SeqID_5081
  Pfam annotation: Domain name=G-patch; Domain location=2-43; Score =24.1; E_value=0.00023; Accession=PF01585.14; Description=G-patch domain
MMEARVMLGYGYVSGMGLGKNNGGRTILVSTRGNRRKFGLGYKLTQADIRKSIAERKSRSQAKSEDESLEGTNTRDPAIDFKQEAGQTESEEDEDVGLPLELEKIVAQEDREIGPHQEETELVDLGTGSGKKE

SEQ ID NO: 96767 - protein, 107 aa, Glycine max
  Coding DNA Sequence Number=SeqID_5082
MRLQTRNFTRNPKCHAWGWVGLLYRTNESCPRCGRLNTNPISKRKFNPIKHFPLERKQLTKRQELPHQTPLLLKRVLLMAYFFSRMLLGIEASFSQSKRYWNEFVPY

SEQ ID NO: 96768 - protein, 477 aa, Glycine max
  Coding DNA Sequence Number=SeqID_5083
  Gene Ontology: Cellular component=integral to membrane
  Homolog annotation: Hit_ID=Q5H6E3; Match level="QueryCoverage=88%, HitCoverage=59%, E-value=2e-42, Identity=32%"; Hit description =Putative uncharacterized protein
MAGEKKKPYCPRIVSENDVGVHKSLGLEAQTCRVGIPRPMPGIVILVHGVNDVGEAYQNQEKGIIAGLKKRLNRPDFYAHVWKDYRITVPGRSPIIPFYWGYKPVTHADYVADQKRYRNEVGKLRDQAHLPFDAYQEDNEAKKASLGNDGKGAFKYQNDNFKNALDVNFAKGGGTFANATTNIPDMLGPGAGGVALAAAGFSTLYMNGGDFTHPIFPNPHRIYQFFAAQRLADLILTIRSEPVTENDVINIVAHSQGTIITMLANMLVKQAGSQPVNCVILNHSPYSLEGRLSEDIQPGHHQTDNARQTTFKNFCALMATQYKGGEISEANLLAMEGACTLRKASDSPLRQDEKYRRDNNGKVYNYFCPNDGTVSLKNIQGIGWRGIPRNIASAIPNLYQRVFYQHGQTGIAPTGKPFELPPSHKGDAEYSSLTNTAYTAHDVVVNGEELPQPFVFKLQGQDNHPDNDPKTSDKPYT

SEQ ID NO: 96769 - protein, 68 aa, Glycine max
  Coding DNA Sequence Number=SeqID_5084
MARSVSASCPYLRDLYGRELTRLLVIIPKVVISLLMVSRGIIPFEERNTRGVATNVYLRKTSEKPEKT

SEQ ID NO: 96770 - protein, 178 aa, Glycine max
  Coding DNA Sequence Number=SeqID_5085
  Gene Ontology: Mol. function=chitin binding; Cellular component =extracellular region; Biological process=chitin metabolic process
  Homolog annotation: Hit_ID=UPI00006A17C9; Match level="QueryCoverage =58%, HitCoverage=100%, E-value=1e-12, Identity=34%"; Hit description= UPI00006A17C9 related cluster
MLLSNVIHICVRVVKLVRMIRTRLFVVARVKSCPGMHSSCVIASLFGCIRTVGALQYQGVAQELIKGNYWPLNRECKSRPPKARTCRPLKARACSPPKAKTCSPLKGRTYSPLKMRVCSPLKVRTCSPLKVRACSPLKVRTCSPLEVRTCSPLKLRTCSPLKVRACSPLMARTCSPQK

SEQ ID NO: 96771 - protein, 371 aa, Glycine max
  Coding DNA Sequence Number=SeqID_5086
  Gene Ontology: Mol. function=ribonuclease activity; Cellular component=ribosome; Biological process=RNA metabolic process
  Homolog annotation: Hit_ID=P30851; Match level="QueryCoverage=63%, HitCoverage=28%, E-value=1e-117, Identity=90%"; Hit description =Ribonuclease R
  Pfam annotation: Domain name=HTH_12; Domain location=158-221; Score =81.5; E_value=2.6e-21; Accession=PF08461.1; Description=Ribonuclease R winged-helix domain
  Pfam annotation: Domain name=OB_RNB; Domain location=223-280; Score =105.8; E_value=1.3e-28; Accession=PF08206.2; Description =Ribonuclease B OB domain
  Pfam annotation: Domain name=OB_RNB; Domain location=290-349; Score =18.6; E_value=0.00011; Accession=PF08206.2; Description=Ribonuclease B OB domain
  Pfam annotation: Domain name=Rrf2; Domain location=1-103; Score =113.3; E_value=7.3e-31; Accession=PF02082.11; Description =Transcriptional regulator
  Pfam module annotation: Pfam domain module=HTH_12::OB_RNB::OB _RNB::Rrf2; Domain location=158-221::223-280::290-349::1-103
MASLPDDRMTSISEVTDVYGVSRNHMVKIINQLSRAGYVTAVRGKNGGIRLGKPAKMIRVGDVVRDLEPLSLVNCSSEFCHITPACRLKQALAEAAQSFLKELDNYTLADLRKENSQSGGVRHPETFIGDDNGGTDMSQDPFQEREAEKYANPIPSREFILEHLTKREKPASRDELAIELNIEGEEQTEALRRRLRAMERDGQLVFTRRQCYALPERLDLVKGVVIGHRDGYGFLRVEGRKDDLYLSSEQMKMCIHGDQVLAQPLGADRKGRREARIVRVLVPKTSQIVGRYFTDAGVGFVVPDDSRLSFDILIPPEEIMGARMGYVVVVELTQRPTRRTKAVGKIVEVLGDNMGTGMAVDMALRTHEIPY

SEQ ID NO: 96772 - protein, 151 aa, Glycine max
  Coding DNA Sequence Number=SeqID_5087
TLEDPRVIFTLNRSQELPTLLAKAKAMADVYSAPEEVQEQMKADMMALKDQMASMMEAMLSTKKMMESNAAAVSATNVAAQAKPAHPSTINQAHQPVPDMVGQGGEGQKPQPVGGAHEEPRERADFDPYPTFTAKGLAFNAMPQPNTLGAP

SEQ ID NO: 96773 - protein, 89 aa, Glycine max
  Coding DNA Sequence Number=SeqID_5088
MHKALRANAPLSYPHLVTLFLHHFNVPLEDEPFVKVKRSFAIGAGAVTSFGYQKDMDGQWVRKQDLPPPIPDERVGQVASDILRRGGGG

SEQ ID NO: 96774 - protein, 66 aa, Glycine max
  Coding DNA Sequence Number=SeqID_5089
MERSERKTFNDKKAKKTYITWEDNNMDSFRDSENEVVNLSLMAKNYESEEEIHSLICIKNQSNLKN

SEQ ID NO: 96775 - protein, 62 aa, Glycine max
  Coding DNA Sequence Number=SeqID_5090
MERYLQHLLSLSQFRAEVAWPGDWPKDQTEEAPAGAPNDAEDARMDEEMTDLLGFLGGSGAT

SEQ ID NO: 96776 - protein, 74 aa, Glycine max
  Coding DNA Sequence Number=SeqID_5091
  Pfam annotation: Domain name=G-patch; Domain location=1-42; Score =24.6; E_value=0.0002; Accession=PF01585.14; Description=G-patch domain
MVVRVMLGNGYEPGMGLGKDNGGRTSLISARGNRWKFGLGYKGHTSGHKEKCCGKEERRSRLVIGTRRPALPHQ

SEQ ID NO: 96777 - protein, 48 aa, Glycine max
  Coding DNA Sequence Number=SeqID_5092
LKEEKVQVANDSLSEADPLSEWHPLSEAYISLSRLGNPRRGLVRDVLT

SEQ ID NO: 96778 - protein, 126 aa, Glycine max
  Coding DNA Sequence Number=SeqID_5093
  Pfam annotation: Domain name=zf-GRF; Domain location=16-62; Score =32.4; E_value=1.6e-06; Accession=PF06839.3; Description=GRF zinc finger
MERSSSSYTSETRSRMLCLYNVEAPLVTSWTEDNPGRRFYGCGLYKVTGRKGCNYFEWHDPVANIRQKKIMVTLMKKVDELESREKDLQSRIRDTKRKEIFLGILLVVCWVVFRLYIPECTIVEYA

SEQ ID NO: 96779 - protein, 178 aa, Glycine max
  Coding DNA Sequence Number=SeqID_5094
MENLGLDLGLVEVVASIQAKASAKVVDETIMRRVIIGLTNTGVMDETREASNGKHVVVIVYSTSFGPFPLNYAQSATVTRDQGHDMIGQAMESFVKRQCQENEQFPLSMQNAITTQFSYLDVFLLQNTQQAQMSMLEAVVAAAFVPQPPLIPAPLDPSLPPLAPIPPPPTTFPPPSQD

SEQ ID NO: 96780 - protein, 295 aa, Glycine max
  Coding DNA Sequence Number=SeqID_5095
  Homolog annotation: Hit_ID=A5APQ3; Match level="QueryCoverage=28%, HitCoverage=5%, E-value=1e-07, Identity=34%"; Hit description =Putative uncharacterized protein
MRQFGMQQPIPRLVMQPNNIHDLTLKGKEGKNWMRLMQLALNEWNSRYERRVEQAPPQTGTLSMNSEYMRWYRRKTKGEIVETMHFMVSPLGRRVCTFDDLLPCIEKITLLSDEEDRILEAHEDAPPSQPQFEHQQFNILQRSVDTRGLAQRRETVDAAPYSFPPMPERQHEMYCTPQTFTQELLQMPPMYSYTHDLQPGYNMTDIFGSSPPSRGTPSFTQSDELSTPNAPLGGPWNVLGNILDMDDLLGVDLRHDFSVEADQVDERVNHRRRNPDRAARNWGRPCGTLSRHHRH

SEQ ID NO: 96781 - protein, 199 aa, Glycine max
  Coding DNA Sequence Number=SeqID_5096
MSSIITLVYLNGKIYKTDDGITFEGPKKAIQIKRGISFESLKKRIHDKDSLDEDDDIDEISDTDDEAARLIKQLTVVQSGEGGSQTPLWDSASHYSNINWSHPDQEDICGLDMGSTFDMGQELYVGMEFDTKSAIKNALQQYVMKVHQSFKVVESKSQKYVVCCGNRSVDIPCSFYMRAILSKKMIHGKLRNREDHIVP

SEQ ID NO: 96782 - protein, 96 aa, Glycine max
  Coding DNA Sequence Number=SeqID_5097
MALDLSLGVRSRVMKQKGLFCLPRNQRGMVFTSLENHHALISPTATEVVNNVVFKIATLKREKAMKMDEILKLRKETDSLLCKAVLESEMSAVEKA

SEQ ID NO: 96783 - protein, 285 aa, Glycine max
  Coding DNA Sequence Number=SeqID_5098
  Gene Ontology: Mol. function=nucleoside-triphosphatase activity; Cellular component=membrane; Biological process=transport
  Homolog annotation: Hit_ID=A7QU38; Match level="QueryCoverage=96%, HitCoverage=37%, E-value=1e-142, Identity=90%"; Hit description =Chromosome chr2 scaffold_176, whole genome shotgun sequence
  Pfam annotation: Domain name=ABC_tran; Domain location=90-266; Score =107.7; E_value=3.5e-29; Accession=PF00005.18; Description=ABC transporter
MTFDVLLFCQTFIDKFRYNAKRASLVQSRIKALDRMGHVDEIVNDPDYKFDFPTPDDRPGAPIISFSDASFGYPGGPILFKNLNFGIDLDSRIAMVGPNGIGKSTILKLIAGDLQPSSGTVFRSAKVRIAVFSQHHVDGLDLSSNPLLYMMRCYPGVPEQKLRAHLGSFGVTGNLALQPMYTLSEIMYVGTLGGCCGQKSRVAFAKITFKKPHIILLDEPSNHLDLDAVEALIQGLVLFQGGILMVSHDEHLISGSVEELWVVSEGRVAPFHGTFQDYKKILQSS

SEQ ID NO: 96784 - protein, 191 aa, Glycine max
  Coding DNA Sequence Number=SeqID_5099
  Homolog annotation: Hit_ID=A7UQU7; Match level="QueryCoverage=41%, HitCoverage=13%, E-value=5e-07, Identity=37%"; Hit description=IMP dehydrogenase/GMP reductase, putative
MGCSSQHVSTPLDGLYSFHQQEFNPCTCRAPEGFQGPGPGRGFRLGSDCRWLTGKTHMTGDQGIPISETYGCPDVCWMPYVEHRGVRGFDLILSYNSQLRWGQIVVYVRPERVLRQFDYIQNVPPPSVDCEGCQGMAEDLGAIVEDLERDINLRMVTEDTHLYDIMTRCLRRVRGDAIDESLRLRQRRRID

SEQ ID NO: 96785 - protein, 197 aa, Glycine max
  Coding DNA Sequence Number=SeqID_5100
MLLFLSGAGSYPCSVSYSLKASKLTINEPVAPIEDFNQKYRVEVMVNYKDESTKFLLRDRECTELIGQSADEVNTLKVEDGDLDLNASPKALDKLLGHLLAFKVKIQAQYSNSAVLKCSTDLTLINDVLDMLPAAETCSKIKVTTPFDSNDPVHDESQSISITTYHDPLIGLPLTPTKRQPFHECDDEARNSHISPT

SEQ ID NO: 96786 - protein, 148 aa, Glycine max
  Coding DNA Sequence Number=SeqID_5101
MDIKGGLTKRITDPEVVIFGPFVVERDTKKRLNPGLLRLAILVLITPHVQTWIFLDLRADRMSRGKGKGRHAIGQNVPTASFDSDMTKTFKVLGYKCEVKSHIGLPYVVARGPLVYPSNLPNNWYPNRWFKLVTGLDEYVSTAGGQNG

SEQ ID NO: 96787 - protein, 139 aa, Glycine max
  Coding DNA Sequence Number=SeqID_5102
MVSPQGRKTWTVDDLVPYVEKLTILSKEQERITEPVVHGPTLERRFPPQQFHMLQSSVETRGHDTDMSASEHSYDGVTKTHPHFSWPPMTPSQQHDAPMATPNAPLAPQWNVPGAIPDMGDLLGVDLRHEFFVEAEGIL

SEQ ID NO: 96788 - protein, 123 aa, Glycine max
  Coding DNA Sequence Number=SeqID_5103
MTVWENYAIQLHHAIDKNLLLQEPLIVMLSLGKIKDAIDKYPLSVQNIKYGSRLYVNTDIAEIQQFRNSLCVPFYSGGITDDNGGSQSQPSQSNLVDKFLHNAQVECYCLTIGTVDKIIIDAP

SEQ ID NO: 96789 - protein, 346 aa, Glycine max
  Coding DNA Sequence Number=SeqID_5104
  Gene Ontology: Mol. function=helicase activity; Cellular component =chromatin; Biological process=protein amino acid phosphorylation
  Homolog annotation: Hit_ID=Q2A9E0; Match level="QueryCoverage=89%, HitCoverage=21%, E-value=5e-69, Identity=43%"; Hit description =Putative uncharacterized protein
  Pfam annotation: Domain name=DUF889; Domain location=248-346; Score= -44.7; E_value=1.9e-08; Accession=PF05970.5; Description=Eukaryotic protein of unknown function (DUF889)
MMLSSAKGAQSYKDIRTVNDVVYGTFREACFAKSFLGIQLTEKEAIHLCLTEIENMLQANRKRPRDFPSMKYPIGYAPNQDHNKLIFNEMAYDKQILAAEFNRSYHLLTDKQKSIVDTIIRVVDTQSAEFYFLYGYGGTNKAFVWTTLSSAICSNGGIVYIVASSGIASLLLLGGRTTHFKFVIPVPATQNSTCNIHQGSNLAELLKVTKLIVWDEAPMCHKFTFEALDKSLKDIIHNNLPFGGKVIVFGGDFRQILPIIPKGNRSDIFHATINASYIWGHCQILRLTKNMRLLSNVSGQPNNQELKQFSDCLLDIGDGKVGQANDGFSEITIPDEFLIKDYTDPI

SEQ ID NO: 96790 - protein, 184 aa, Glycine max
  Coding DNA Sequence Number=SeqID_5105
MDMWHWSRPSHWRFDHAGGLAGHIASGTGKLRLEIASATGKITDIAIGTGEIIRVYEENDGVIFEGSKKAIQIKLSGKYVALQICDDEDVETMLESFQQQNQMSVLELYIEKDVVGGSMFHFANSLTSCGNNLSNNEAQPPTNVSNLHGDEDDDDDNYLVSNSYVEESSDEDDSVNSISDTDDE

SEQ ID NO: 96791 - protein, 162 aa, Glycine max
  Coding DNA Sequence Number=SeqID_5106
MARATNQFDWRVALEELFQGKVAGTRNRRRAGCSEGRTSRRKSQALVAIWLEEIPGFSGDLVEGNRRLQWRFGLSMTSSSSCSSNIQIKSGPIDGDVLWMQAKHVSEHVWNGEEDWKLHIKRVIPTYQGEEEIPEEVIPLLRQYGFYWIMKMGSLKINVGIN

SEQ ID NO: 96792 - protein, 73 aa, Glycine max
  Coding DNA Sequence Number=SeqID_5107
MLSGTEASCTLQTSSQSSQQSNHGQMSCEAADQILKDPTVNKVWEAFLPRQLHVASSRSFIKRLPQEGSSWLL

SEQ ID NO: 96793 - protein, 232 aa, Glycine max
  Coding DNA Sequence Number=SeqID_5108
MGEEWHCPNLRSKWALDVVQPLPLDIEDVGSHLGTMLRVDQNMCVHSCGVTPYMFWVWKVWTSALKNPNLEEKDKVDASLANLNPLQSVEQEDTSAFRPLMLARKPTRRRKTFSNLMHDLIMIYGLQLVALVEPRISGAYSNLVVNKVGVDGAFHEKVGGRRLDYNVSSKMLQCLSSYELMDMDFFGPFLTLSKGSLKKHIDRVVANKSWQVAFLNSKVIHLALPAYDHRGL

SEQ ID NO: 96794 - protein, 28 aa, Glycine max
  Coding DNA Sequence Number=SeqID_5109
MVPGYTYTEKMHWRDLGDIHANKPSAAE

SEQ ID NO: 96795 - protein, 68 aa, Glycine max
  Coding DNA Sequence Number=SeqID_5110
MASLLCNAHVAGKPPFVMASWCQVELATSAGESANGFGNRWRGAGVGGAATVQVQEEQVDWLGNRHHD

SEQ ID NO: 96796 - protein, 386 aa, Glycine max
  Coding DNA Sequence Number=SeqID_5111
MSLIMFRSCLEGLKIHDGNSCNWSGLGRLLKWIVGLGCLLRLVLGLCSMNILELRPLRWSYYLILFVDGFYIRPVDDVLLRVMVLLIPGTENMDVLIGERGFLVCRGSGLDGYGMGVGLASNSCLPLLFQRRGDHMLVSPLLDDRVLFLLPWDDKRVVLPLTLPDWSSQWTSPLGLYWIGGFRLLMSFLGLFLLGHNFLFLFLLGLLSCLNQALLLSKNPLNLFSESKDLQSFVFISHCSGQFLLPPLLNIILINKRDKRQSQKEEQNGLFMKVSDSKFAQARSSSLGLRCNFNPKQATRLGKSMPSPLSHNSLGRATACLGEFPCTPWLFSINSHAWLKRKIVQQSKTIEKTHKKKEKRKSGAEALHGAEALQSCDHGSLPSLFL

SEQ ID NO: 96797 - protein, 79 aa, Glycine max
  Coding DNA Sequence Number=SeqID_5112
MYVKVDGLGCSTIPSQFNEVSSCMLQTIVDSNEDDGDYVVSNSFVEETSDEEHVANMDSSDMNDEATSIEPKKIDHRAS

SEQ ID NO: 96798 - protein, 169 aa, Glycine max
  Coding DNA Sequence Number=SeqID_5113
GAPFEGTLVDDGKFDYSSHDARRMVCIDQADMTGRLLAGSLAFNFRIMHYIIVRILMPRSSNVAQASKEDLILMWAFLTVSLDSEPFVLVKRSFAIGACAVTSFGYHKDMDGKWVKKDAYVGERFDSLDGRIDSIDARFEGMVTRITQLEEDVSYLRQCFNLPPPPSLT

SEQ ID NO: 96799 - protein, 236 aa, Glycine max
  Coding DNA Sequence Number=SeqID_5114
  Gene Ontology: Mol. function=metal ion binding; Cellular component =nucleus; Biological process=regulation of transcription, DNA -dependent
  Homolog annotation: Hit_ID=A7Q311; Match level="QueryCoverage=63%, HitCoverage=26%, E-value=6e-31, Identity=48%"; Hit description =Chromosome chr12 scaffold_47, whole genome shotgun sequence
MGKSKEELFAMMTGHEAKKEFSLTTELTLKEEPPFADGINYEESKKEEINNQTMSRLTSACGKAYSSTVKKASSVIQNNGVKVEESHADRNIGQKKLKLSGEDRPSMTDLSGYSFKQEEFDVEYDNDAEQVLAVMEFKDTDTEAEYEMKLQHEILHSHPLIHLLPRAQSSRSSQDPNTNNTQGIIGTPVRVTVFYENAPPYGINIGLKEHSNRVIPKAYTPKSPSRPLPRPTQKIF

SEQ ID NO: 96800 - protein, 129 aa, Glycine max
  Coding DNA Sequence Number=SeqID_5115
  Gene Ontology: Mol. function=aspartic-type endopeptidase activity; Cellular component=small subunit processome; Biological process=DNA integration
  Homolog annotation: Hit_ID=A5ACK0; Match level="QueryCoverage=100%, HitCoverage=34%, E-value=3e-27, Identity=45%"; Hit description =Putative uncharacterized protein
MAASGPVFSFSGTPTITTAKLNWKNYLSWSASVELWFLSQGHYDHLERGVSAVPNDKKAEWEKLDFQLCVVLWQSVESDVLEIIRSFKTCCSFWKKAQEIFANDIQSLFDATQKVTALKQTSHDMIAHI

SEQ ID NO: 96801 - protein, 148 aa, Glycine max
  Coding DNA Sequence Number=SeqID_5116
MVESNTLQEVFPTPYLGPSPSLQESESTADSTIDIPNNLPLEQTQRSPIVYRRRPQIPDVELEGNERPAESCPTLANNPTMDLPEENLDLPIALTKGTRSTSLLYEDKGNTQIVGYYDANWVNSPIARQGLLYEDKGNTQTVGYYDAN

SEQ ID NO: 96802 - protein, 170 aa, Glycine max
  Coding DNA Sequence Number=SeqID_5117
MMWKILKIKVITEYVFDYSHRIRKYMFPYCAFVCQVRSPVNVMDLDDIMSELESSDNFCSFVNGDGDNDVTEVYPNDDDDQHDVRLEDEDEVDSEVHNDDGGDYDDFWIPGLLKEECISIDSMIDIRQFDMEEITDEVVRRLDFGDLELAYQFYCWTMDIGRCSHLILCK

SEQ ID NO: 96803 - protein, 73 aa, Glycine max
  Coding DNA Sequence Number=SeqID_5118
  Pfam annotation: Domain name=zf-CCHC; Domain location=11-28; Score =13.7; E_value=0.013; Accession=PF00098.14; Description=Zinc knuckle
  Subcellular localization annotation: CTP_CleavageSite=43; ConfidenceScore=5.10e-01
MDECGRQMRVQKCGQCGGSGHNKRSCTNRPRNANASFGGSCISSSEQTNTMLQPTDEYNYELDYRLESNLCKH

SEQ ID NO: 96804 - protein, 57 aa, Glycine max
  Coding DNA Sequence Number=SeqID_5119
MWDQYKLKGALKPRNKPWKKELRHQECALDKKLGEDASMEEKKEREKEIGGSTKLKE

SEQ ID NO: 96805 - protein, 275 aa, Glycine max
  Coding DNA Sequence Number=SeqID_5120
  Gene Ontology: Mol. function=metal ion binding; Cellular component =mitochondrial intermembrane space protein transporter complex; Biological process=intracellular protein transport across a membrane
  Homolog annotation: Hit_ID=A9PDK1; Match level="QueryCoverage=37%, HitCoverage=55%, E-value=5e-14, Identity=48%"; Hit description =Putative uncharacterized protein
  Pfam annotation: Domain name=zf-Tim10_DDP; Domain location=21-108; Score=57.8; E_value=3.7e-14; Accession=PF02953.6; Description =Tim10DDP family zinc finger
MDSFSNPSSGSSHQLSAHDLKNQLKNQLAIEYAQQFLEEKGEDIGGWKEEIVMGIGISGMGTVGRKCFEKCVTKPGSSLGGSESSCISRCVDRYIEATGIISKAKDLGGVQGLQQSNPYHHVDTKWHVGQINWVKAITDGSVTQKGKQVACAGVFRDMHCSAPHGMAKWHSQVNSGKLEIGDMGLGFKDWEYGFRIWGFGFGIGVVNSWISRDIDLKPVSCSLSVSQFKNPPPSPIQTWAQTSFSLQECVPSIIAGAPSTNHEKTEIPLTDQVDP

SEQ ID NO: 96806 - protein, 112 aa, Glycine max
  Coding DNA Sequence Number=SeqID_5121
WKYSRSTVGERPCIGNAKIFQHASRGDTNLVNQAEWCILLKTQSDEAQALGRRLQVDWARDPREGPKVLMSLREVSLAIRELSSSFSRKFLKEASQGSFLKKASQGSYLVYK

SEQ ID NO: 96807 - protein, 257 aa, Glycine max
  Coding DNA Sequence Number=SeqID_5122
MSRKENLISELHTRKGTWKIVVRITNLWEVRKQNSKQAIKMVLMDQMVFQGTKIGATLWQELFVEFWHKTTFVKEIQHPEIPSNVYMITLFADIISGVAPRHTLVDIVGVVADLIDVKTVNPPHRMTVRLKDNSNSDIIMIVWEYYTIQLHDAIDKNLLLQEPLIVLLSLGKIKDAIDKYPLSIQNIKYGSRLLCVPFYSGGITHDKGGSQSQSSQSNLVDKFLHNAQVVNICEINSLKQVIAVEPESSPPIYHPTD

SEQ ID NO: 96808 - protein, 680 aa, Glycine max
  Coding DNA Sequence Number=SeqID_5123
  Gene Ontology: Mol. function=methionine-tRNA ligase activity; Cellular component=cytoplasm; Biological process=tRNA aminoacylation for protein translation
  Homolog annotation: Hit_ID=A7QHL2; Match level="QueryCoverage=97%, HitCoverage=74%, E-value=0.0, Identity=73%"; Hit description =Chromosome chr5 scaffold_98, whole genome shotgun sequence
  Pfam annotation: Domain name=tRNA-synt_1; Domain location=2-442; Score=-424.1; E_value=0.043; Accession=PF00133.13; Description=tRNA synthetases class I (I, L, M and V)
  Pfam annotation: Domain name=tRNA-synt_1g; Domain location=18-466; Score=607.2; E_value=1.6e-179; Accession=PF09334.2; Description=tRNA synthetases class I (M)
  Pfam module annotation: Pfam domain module=tRNA-synt_1::tRNA-synt_1g; Domain location=2-442::18-466
MAENVKGSKLPMEGKRNILITSALPYVNNVPHLGNIIGCVLSADVFARYCRLRGYNAIYICGTDEYGTATETKAMEENCSPKEICDKYHAIHKEVYNWFNISFDEFGRTSCPQQTEVCHAIFKSIYDKWLSENTIQQMSASPGITVKLCIGDRLIISSNLELSIYTCKEKTADNNLFLTSAKVKSLKQWSIDLYCDSCERFLADRLVEGTCPTQGCKYDSARGDQCEKCGKLLNPTELKNPRCKVCEKPPRIRDTDHLFLELPLLKDRLEKYISEMSVVGGWSQNAIQTTNSWLREGLRSRCITRDLKWGVSVPHEKYSDKVFYVWFDAPIGYVSITSCYTRDWEKWWKNPENVELYQFMGKDNVPFHTVMFPSTLLATGENWTLMKTISVTEYLNYEAGKFSKSKGIGVFGNDVKDTSIPVEVWRYYLLTNRPEVSDTLFTWPDLQAKLNCELLNNLGNFIHRVLSFIAKPAGRGYDSVIPSIPDDVSGESHIQTKIFADKVVAYIDQYIEAMEKVKLKQGLKTAMSISSEGNAYLQEAEFWRLYKENRPLCSLVMKTAVGIVYLLACLLEPFIPSFTREVFKQLNLPAVTHVSLCQDKGDIDRVKRPWDIISAGHKIGTPEPLFRELKDEEVEFYRKKFAGSQADRTVRAEAEAENVAGQLKKTKLSIIGKEEISLNP

SEQ ID NO: 96809 - protein, 167 aa, Glycine max
  Coding DNA Sequence Number=SeqID_5124
MPSLPLDCSNACLPPPSEVFRDLGQSRGYAWGVAALVHIEHQAVRGFELISCYQGQLRWGHVVVYVRPERVLQQFGYKQAIPLPPVSTDYMDWFFQISHSFVTPTQEGDAPRQSATPYVDAYVEPHVPEVSDADDLPRHSMVSCEGCEAITERLERVLNLRMVTAGT

SEQ ID NO: 96810 - protein, 84 aa, Glycine max
  Coding DNA Sequence Number=SeqID_5125
MMTKVMTKSSKINQRTTQVNQRSIKEQLKSIENNSRVQDKNQEEFKTQEESLETRIKIQGSKISRIKIMIQDSSFKNEEKTQSR

SEQ ID NO: 96811 - protein, 254 aa, Glycine max
  Coding DNA Sequence Number=SeqID_5126
MVYNTSSIEPYGVNALSPNRPSLRVNVHGISIMNVLRYPSWMVYNRLIIEPYGLNALSPSCRGSFSRPNSLPGMPIMEVSFSRDDDDNQHIHSGEATKRAFSSFFVNLLFSVPKIDPLDNSNESIMGFISQFEEGDIKNTSVEYALGGPTMMKLLIIYFDDIRDAFDGETRYKGNGIEDVEGTNKDVPIDIGVGGNNLVKVESCSDNERICESPPIGVDEFTYMYELLARKFSVVFPLSNFHCSAVCTIYCAPS

SEQ ID NO: 96812 - protein, 153 aa, Glycine max
  Coding DNA Sequence Number=SeqID_5127
MVFASGMTYQFKVVFHVDRNIIEVPSIYHKQWAPDYPDYVVLDYNGKKHHIRVRKFSNRVYIANGLKHFRSDMGIYEGDDYVTVLGVRGRRHFWKLSMHNGLKCFAEPWFQFLTENDLMAVDEVVFYFRPNQLLWEVIARKKTVWDEDEDDSP

SEQ ID NO: 96813 - protein, 236 aa, Glycine max
  Coding DNA Sequence Number=SeqID_5128
MTKSKGKDPLEGLGGPMTRARARKAKEALQQVLSILFEYKPKFQGEKSKVGDQSGSQCFARMLQPYGINIGLKEHSNRVTPKAYTPKSMSGPLTPDSGFPNVKEDEKRLKPLFVLSSCDSFFSLLEYYFANNNGEALDFCGKGKCYNARGISLSLDMISQFPTDARPCGGFFGWIISVLLPFMAIDGGRSRNFLSPHVGRQIFLLSLEESSHNGNPSQAPPWTRVEVPTKILRRSN

SEQ ID NO: 96814 - protein, 605 aa, Glycine max
  Coding DNA Sequence Number=SeqID_5129
  Gene Ontology: Mol. function=protein dimerization activity
  Homolog annotation: Hit_ID=A5C1A1; Match level="QueryCoverage=17%, HitCoverage=23%, E-value=5e-12, Identity=42%"; Hit description =Putative uncharacterized protein
  Pfam annotation: Domain name=Retrotrans_gag; Domain location=147-226; Score=1.5; E_value=0.038; Accession=PF03732.8; Description =Retrotransposon gag protein
MTMPASAVDGGGDPLPNGVLMPPYQNSVHTNFNHSITEKLDSIILIADLMLLENKSLMLLKVIIFVFENNTLSEVLSTGIRVPILEHRIVNSDKGICKNGDVHESHGESDRRESRSSGMAVEFNRRDDTKGKEQIGGCYGRNEWGNSGWFQWWESWNPNHSWDGFKITVTQRFQASSLGNPFQALLVLEQEEKVQGFIGQFKKCVGMVKGLEEPFLVEVFFKGLKEEISTEVRLHEPKNLMEAMVKARRVEDKNRILGNLPMSNANNKVTDLHNAVKTGTSGWKGRRTFRNLSPTEFRLMIMEEEEEGDPKSQQWENREEEMGEFHQLSLPIEGFTTRKSLKLLEVTPTNPYSVEVGDGHRVRCQGGWNGWLDWGRSVLSNGGHDGAMAEKCGGFLEKCHRIVVAWRLSNGGRHSHGGVGLTRPNPTRRDAPHPGATRCTQNTASSNDPTAATRMARTAATSTGTNNSNDPHEGSEHRDPTQCRVTLQLPRKDIDVCNNNQQLKQRYNARDEIDPISLNDIDVCNEWLVGEMDQDGDNDAGNDLVFEDDDALNWATVYQASGENIDLESEEEIMVNFEVFDGEEGDAPLPYDNNEDDYVGIEEDD

SEQ ID NO: 96815 - protein, 278 aa, Glycine max
  Coding DNA Sequence Number=SeqID_5130
  Gene Ontology: Mol. function=helicase activity; Biological process =viral genome replication
  Homolog annotation: Hit_ID=Q8RV60; Match level="QueryCoverage=100%, HitCoverage=22%, E-value=1e-76, Identity=50%"; Hit description =Putative uncharacterized protein At2g05640
  Pfam annotation: Domain name=DUF889; Domain location=1-194; Score =195.9; E_value=1e-55; Accession=PF05970.5; Description=Eukaryotic protein of unknown function (DUF889)
MRLQSNPTDHSNLDELKQFSEWLLDIGDGKLAEPNDGYGEITIPDEFLIKDFQDPIQEIVEATYPDLLHNYNNGDFLQKRVDLASTKDEKEHCSADSVDKSDELLNPAFGVLTVEFLNSLKTSGIPNHKLIIKVGTPIILLRNLDQADGLCNETRLIVTRLGSSVVEAKIITGSNIGHRTYIPRMNLSPSDSPWPFKLIRRQFPFMVSFAMTINKSQGQSLAHVGLYLPTPVFSHDQLYVALSRVQSKKGLHILIHDNQGTPKNTTINVVYKEVFSNL

SEQ ID NO: 96816 - protein, 274 aa, Glycine max
  Coding DNA Sequence Number=SeqID_5131
MDEVMGMRLLSMSRATSEKLMAHLKGFLRLTSTINVQNVPRKDIENFVSKEQESLAQASERKSHVEATKIIEDMPSNPYKNYRDKRIVRRLVKQVEAHRGRECPVSNALAHAMEEVNYAGVQSIGYDPYFNTFNQDVMIQYIAKNDEHMKFMETQLSTMKDLLSQRAPKTLPSQIEVNPKNEEFNVVSTSIGKPMVESKKTKKATPTLEKEALTEESHKIEKVGEKRVLAPPQDPHLPTTGNAKLIGQGALIDVQEGKLTSRLGDEKEVFKVFD

SEQ ID NO: 96817 - protein, 148 aa, Glycine max
  Coding DNA Sequence Number=SeqID_5132
  Homolog annotation: Hit_ID=Q84VH5; Match level="QueryCoverage=95%, HitCoverage=21%, E-value=1e-55, Identity=75%"; Hit description =Envelope-like protein
  Subcellular localization annotation: CTP_CleavageSite=35; ConfidenceScore=5.65e-01
MAFLFSSAFPNTSRNFTKTFQRLCFSMATSPKETSASGSPSVPSSPHQGQPEFNIQPIQMIPGQAPVPEKLVPKRQQGVKTSENPSLATSPREVDTEMDKKIRSIVSSILKNASVPEADTDVPTSSTPNVSVPDADKDVPTSSTPNTE

SEQ ID NO: 96818 - protein, 43 aa, Glycine max
  Coding DNA Sequence Number=SeqID_5133
MAEEWRRKKDYWRCHFKDKSLKVEEDEWREKERSTKFYASNEV

SEQ ID NO: 96819 - protein, 109 aa, Glycine max
  Coding DNA Sequence Number=SeqID_5134
MDLGGGVACMRRDRSPTSYGVWVVDVVVAASVGDKIGDVDVGGTIMVVVEWCAHDLDDSYGYSNLDNSYGSPSSLPLPPFNSLAPQPTLSSSIAPLNLTPPSIGGNPFF

SEQ ID NO: 96820 - protein, 182 aa, Glycine max
  Coding DNA Sequence Number=SeqID_5135
MAFLGETSSQTIVNSRLAFIFPNGTVIHNECGVYFQSSSPVPMRVPNLCDFSTLKSRIHNSLRLNNNQVVDEIHYRRPVEDTGCSIDQLKDLIKQVAPKGNPPHGIHEFQVVRRLFYRQPSHLEYSEKVLEFEIVELKCDDDVLKVLVESNYWKQFVPIEILALFSKVVMENEDDVITSLHD

SEQ ID NO: 96821 - protein, 365 aa, Glycine max
  Coding DNA Sequence Number=SeqID_5136
  Homolog annotation: Hit_ID=A7UQU7; Match level="QueryCoverage=35%, HitCoverage=21%, E-value=1e-07, Identity=31%"; Hit description=IMP dehydrogenase/GMP reductase, putative
MDTQLPSNIRNWISQVDFGGIIGEGGDRWRWNLKWRRRWFEWERNLIDDVELSVEIHKEPSSSSFDFFFFFRDPKLLHLRVLLLPRPELQVSSSLLPASRLKTSLLPRKVRFFRACLGAVGGRAEDRFFRGLQRKMEDMALPWDSAEEPSSARRKYAISSIFRRHPRKKGSSAGVLFLLAEEPSFASTSRGRDLSQHVAEDVPRRLRPTASTRRQRVTQRVEDVPQLPEDVPQLAEDVPHASDGSPERTRAVDGAESDRVASDGTAADDEGFPDGPRDPSVLIGFADDVTHNIWSGHQPDLKLVSHGRKVDKFGRPAVEIEGMIAATELDPLIRCYVITTDPGLISAFVEKWHRETSSFHLPVGE

SEQ ID NO: 96822 - protein, 342 aa, Glycine max
  Coding DNA Sequence Number=SeqID_5137
  Gene Ontology: Mol. function=metal ion binding
  Homolog annotation: Hit_ID=A7PJQ4; Match level="QueryCoverage=82%, HitCoverage=53%, E-value=1e-80, Identity=58%"; Hit description =Chromosome chr12 scaffold_18, whole genome shotgun sequence
  Pfam annotation: Domain name=zf-C3HC4; Domain location=254-301; Score= 60.3; E_value=6.4e-15; Accession=PF00097.16; Description=Zinc finger, C3HC4 type (RING finger)
MDNAAAELQSEAADPALLLRHQTCAGNGIGDSTSLIPESSRRPSLSSLQIPARSVENALSSFNKTDGPTLISSAGSSRGLPPRPNSASAIKSTMRTLLSERSFRAKNSSQDSERTVLIVPDASPSDGPVDNKPSTSRSLSLNKFLFASSTKAGHSLPVTPTANSGVENVHGRHLGCDSDLSKVKVNQHMTRSVSVPVNIKTANLRHTDSRRLVRVISVRSLPGTSGGISADNALGSEIVNEDASEDIPEEDAVCRICLVELVEGGNTLRMECSCKGELALAHQDCAVKWFSIKGNKTCDVCKQEVQNLPVTLLKISNPQTVTRQPLNAPEPQQREVTSYRQA

SEQ ID NO: 96823 - protein, 75 aa, Glycine max
  Coding DNA Sequence Number=SeqID_5138
MENNVVHVDYGSDVGNGREGGHILVFVGSEYGRLGSVMDLDYECYKAITTRWCTNTSLFYKVTLQDELSFAATAA

SEQ ID NO: 96824 - protein, 124 aa, Glycine max
  Coding DNA Sequence Number=SeqID_5139
  Homolog annotation: Hit_ID=Q2HTA0; Match level="QueryCoverage=67%, HitCoverage=12%, E-value=7e-14, Identity=51%"; Hit description=IMP dehydrogenase/GMP reductase, related
  Pfam annotation: Domain name=DUF1723; Domain location=37-86; Score =56.5; E_value=9.3e-14; Accession=PF08330.1; Description=Protein of unknown function (DUF1723)
LVSHGRKVTLIGRPVHEIEGLVGATRLSPLIDCSVVTGDPGLESAFVERWHSETSTFHLPVGELTITLDDVSSLLHLPITGALHSFHALSTKEAIFLLTELLEVSAEEARTETTLTRGAYVRLG

SEQ ID NO: 96825 - protein, 203 aa, Glycine max
  Coding DNA Sequence Number=SeqID_5140
  Homolog annotation: Hit_ID=Q2HSY3; Match level="QueryCoverage=51%, HitCoverage=47%, E-value=2e-07, Identity=29%"; Hit description =Nucleic acid-binding, OB-fold, subgroup
MSQKENLISELHPRKGTWKIAMRITNMWDVKKHNGRQVIDMVLIDQTGVKIGATLWQELFPEFQPKLALGCSYLIQNIKVVDNQSEYKEVERLEIPANVHVITEIVDIISGIAPRHTLVDVVGVVAEVIERKIVNPAYRVTVKLRDNREPLVLMLTLAKIKDAKDKYSLSVQNIKNGSKLYVNFDDIAEIRKFRDRYDNCKTN

SEQ ID NO: 96826 - protein, 410 aa, Glycine max
  Coding DNA Sequence Number=SeqID_5141
  Gene Ontology: Mol. function=helicase activity; Biological process =viral genome replication
  Homolog annotation: Hit_ID=Q7XD07; Match level="QueryCoverage=98%, HitCoverage=40%, E-value=8e-64, Identity=34%"; Hit description =Putative uncharacterized protein
MYNNKDVLDEDIIIATKNMLDNNNHYAQKFRMARDKLQSSIVSDLKLKLIYDWQSDGRLYNLPNTTEVAVLIVGDEHTGNHRDIIIEKQTGLLKIINELHPAYLLLQYPLLYPRGEDGYRPDIPHKDHPNIHAAKRKKVTMREYFCYRLQSMNNEAQTILHSRRLFQQWIVDGYCMIESQRLNYVRQHQQQLRVEKYINLNVYNNAPETLGNEKVIYTIEWQKRGLSHAHILIFLQPANKYPNPEDIDKIISTEIQNKYTDPELYEIVSKHMIHGPCELPNRSAPCMADGKCIRFFPKKFNEAIIVDQDGFPVYMRTNDGHTVQKHGIELDNRFVVPYSLQLLLKYRTHMNVEWCNQSTSIKYLFKYINKGSDRITTSTVNVQNQNGRQHQVDNEIKQYLDCRYVSNISS

SEQ ID NO: 96827 - protein, 370 aa, Glycine max
  Coding DNA Sequence Number=SeqID_5142
  Gene Ontology: Mol. function=helicase activity; Biological process =viral genome replication
  Homolog annotation: Hit_ID=Q6UU02; Match level="QueryCoverage=95%, HitCoverage=49%, E-value=2e-37, Identity=27%"; Hit description =Putative uncharacterized protein
  Pfam annotation: Domain name=DUF889; Domain location=196-370; Score =78.4; E_value=2.3e-20; Accession=PF05970.5; Description=Eukaryotic protein of unknown function (DUF889)
MLAAKKTRKYNREADMGTPSTGELFYMRMMFSSAKGSQSYKDIRTVDNVVYHTFREACFAKGFLGSDQEFVGALREANTWGTPHFLRKLFVNLLFMNTMERPEYVWQQTWRWMADDIVFNHTSQGYAANPHQNKLIYNEMAYDMEVLAVEFNRCYHSMTDEQASIFDNIMRVVASQLGGVYFLYGYGGTGKKFMWKTLSSAMRSNGGIVLTIASSGIASLLLPGGDGKLGQPNDGHCEITIPDEFLIMDFEDPIQEIIDTTYPDLLQNYNNADFLQKRAILASTKDVVDKINDYVLSLIPGDEKEYCSADSVNKSDELLNPTFGVLTPEFLNTLKTSGIPNHKLRIKIDGLCNGTQLIVTKLGTNVVEAE

SEQ ID NO: 96828 - protein, 141 aa, Glycine max
  Coding DNA Sequence Number=SeqID_5143
MSEIEKVQEQMKADMEAMKEQMTPMMEAMMSMRRMMEVNTTTVVATSQGGKALGSAGGPHFVQAQNKHSFPPYGLPPNYTPPNVAYIPNENVDNSTPMPIESQQPQFDHAHVSQPMGETHEVPRHTVADFEPHLKYATEGQ

SEQ ID NO: 96829 - protein, 391 aa, Glycine max
  Coding DNA Sequence Number=SeqID_5144
MLSTIMFVSNAFNAFTRFNDDLVYTCGDSHVSDQVSSIRVGDAVASCTITHPNISVVAFVGGITAKERPHPYSGMCLIPVEDEAESSQLNPPQNVIDLDSEAMTIQVILGYLMQSYPPRALDRRLQEDWAKDAREGPRILMSLRTHLLLEVASPLSLPFSIPLPFIFQEAKESIDEEDPRPTSSNGACIITPGFIRKLDSTKEVVGPYTTSYKNFKGHFFQFIKKLVVYMFDSDQEDMVILYKFPKGLHCKALVDLPFSKTPDVMGKFDYRFIKKAQAEKVPPPPPSVITRISIQESHGPLSGGPSKRQRVELIPVATPSVIESLNAFLSMKRRVPSLWVVPCTPMDYIACFTKFWGDEFERANVECQRAQSDCAKVEKALVKATRSNEMC

SEQ ID NO: 96830 - protein, 634 aa, Glycine max
  Coding DNA Sequence Number=SeqID_5145
MRAKEVVQCRSRLPLIEGIYLTTGVVILTSRGSMWLVKPPSLDMCCLGCFYQVVRDGRVFGMLGKGISLAPASYRKVHLPYKWSGRVILSHCSLSSYFLAYSRSFLIPCAFLTFGFPFRPPQCLLFCMIPPLDWATMILGAQLSTHHGLKGHLDRRVRLSTAAGELVPVTMILPSCAFRGTRRASGDGDVRSSPRVRPSATSVAALQRQVKLANPEDSCKMVVQACKSDDFPFFRAAPGPGCHSTLTIFQCALLEHLNMASSQLHPISWAMLSGKIGWDSLNSVSKKLFEFDWNIFHRFKDHFFKSDPTRFKSYDEDLLTLVKRVVKVILEQLLASLDTWAILSLPLESGFAGIMSDFAWRPLVKQVELVGGIVPPSVAAPSAGEGGQPTGKVGPVFVVVEVALSAPSSILVKRKGDYAARPLGRKKSKAPMSLHALRQATELGPITGHLTIVQDVPPASPVVEALAPLSPPATVVQQVSFTVVETVVPATKAESVVVPLSIVATPLLSVNIATIGAPMVPPFSSLTLVALLVAVLVTMASHSSSSHRRISLDHLYTSNDADSLWGATYKLKQKTPADFVSAFDKNLIKLVVVQNATDYAKVFLQRSLAILEENGLRHREAVQKVASIKYRKEM

SEQ ID NO: 96831 - protein, 347 aa, Glycine max
  Coding DNA Sequence Number=SeqID_5146
  Gene Ontology: Mol. function=metal ion transmembrane transporter activity; Cellular component=integral to membrane; Biological process=metal ion transport
  Homolog annotation: Hit_ID=Q941P4; Match level="QueryCoverage=100%, HitCoverage=100%, E-value=1e-126, Identity=68%"; Hit description =Zinc transporter protein ZIP1
  Pfam annotation: Domain name=Zip; Domain location=40-344; Score =345.2; E_value=1.1e-100; Accession=PF02535.13; Description=ZIP Zinc transporter
MKRFHSKRKLLIFLVVIPSLVAAECTCDEEDQERDKSKALRYKIAALISILVASAIGVCIPLLGKVIPALSPEKNIFFIIKAFAAGVILATGFIHILPDAFENLTSPCLNKYPWDAFPFTGFVAMCTAMGTLMVETYATAYFKKHHHSQVQTTYVEKEESGDVHLHTHATHGHAHGHLPSHDHQSSALLRHRVISQVLELGIIVHSIIIGISMGASESPKTIRPLVAALTFHQFFEGMGLGSCIIQANFQRLSITIMGLFFALTTPVGIGIGIGITNVYDENSPTALIVEGIFNAASAGILIYMALVDLLAADFMNPRMQKSGSLRLGANLSLLLGAGCMSLLAKWA

SEQ ID NO: 96832 - protein, 81 aa, Glycine max
  Coding DNA Sequence Number=SeqID_5147
MYLPAHLQSSSISDTCLLIFKVPPSACTCLLSNGAWPPHGLGFGYSTQPMRTACYLDKDKAGQSIDIKKYRDIKPIPKNFT

SEQ ID NO: 96833 - protein, 118 aa, Glycine max
  Coding DNA Sequence Number=SeqID_5148
  Gene Ontology: Mol. function=metal ion transmembrane transporter activity; Cellular component=integral to membrane; Biological process=metal ion transport
  Homolog annotation: Hit_ID=Q941P4; Match level="QueryCoverage=57%, HitCoverage=19%, E-value=2e-18, Identity=70%"; Hit description=Zinc transporter protein ZIP1
MGLFLALTTPMGIGIGIGITNVYDENSPTALIVEGIFNAASAEILIYVARIDLLAADFKNPRMKKTATNKNFLCPSAVSKGPRMSIPQTMKGRGETIGCNFSAEHIVSLVLVKTFEYG

SEQ ID NO: 96834 - protein, 147 aa, Glycine max
  Coding DNA Sequence Number=SeqID_5149
  Gene Ontology: Mol. function=protein binding; Cellular component=ER -Golgi intermediate compartment membrane; Biological process=vesicle -mediated transport
  Homolog annotation: Hit_ID=A9PA64; Match level="QueryCoverage=76%, HitCoverage=30%, E-value=6e-50, Identity=83%"; Hit description =Putative uncharacterized protein
MGMKQVIKNLDAFPRAEDHLLQKTQSGALVSVIGLIIMATLFVHELGYYLTTYTVHKMSVDLKRGETLPIHINMTFPSLPCDVLSVDAIDMSGKHEVDLDTNIWKKIHLSLISIVSYWSIAKKAMLLQCVAVAYYCSRLIIESCIDA

SEQ ID NO: 96835 - protein, 205 aa, Glycine max
  Coding DNA Sequence Number=SeqID_5150
  Gene Ontology: Mol. function=aspartic-type endopeptidase activity; Biological process=DNA integration
  Homolog annotation: Hit_ID=Q9M197; Match level="QueryCoverage=49%, HitCoverage=9%, E-value=7e-09, Identity=31%"; Hit description=Copia -type reverse transcriptase-like protein
MALNTRSFSTILPIPDGKNWERWCIQMKAILNYQDVMDIMEEGYPSLPEGATEAQKTIHKENKKRDSATSKEAWDILEKGNSGANQLKKVRLQIMRHQYELISKNFKDPLKPMSNESMKEPLRGTQIRRCKHKLTKEEEAVVKATTKHEVGVEIQDQMLERLLNNKNLKNMTQNSLNRPMIKEGIGSIEEERKDLIEKGLNASIV

SEQ ID NO: 96836 - protein, 136 aa, Glycine max
  Coding DNA Sequence Number=SeqID_5151
KRFSGVFRKTFGYFQKNTSSGNFPENVLPELPEEPLTGLLEDTAVILFHHFFRRTLIFSPLVFYPKVTTLSKSNGELGRLTSKAVRREDGEEEEAWLVVSGRRRKLGSRCHGGSTGMEEEKKQQWSSEKRSAFLNF

SEQ ID NO: 96837 - protein, 129 aa, Glycine max
  Coding DNA Sequence Number=SeqID_5152
MWVSIGSNVYKLGRCLEEDGGIFCEKGCYFWDQTFYLLRGNILGCYRGVYSKGYRFTIMEGDWLQGLYLSADFWNKAKDEATEEKGHGQSNNPAIHIERGDSDAFFIWSIVIIKELGDLKDPSHGVLIG

SEQ ID NO: 96838 - protein, 169 aa, Glycine max
  Coding DNA Sequence Number=SeqID_5153
  Homolog annotation: Hit_ID=Q6VPE8; Match level="QueryCoverage=27%, HitCoverage=5%, E-value=1e-07, Identity=53%"; Hit description =Putative gag-pol polyprotein
MYDIDLNDHNMHELMNDIACWPWQYDRKTIYNGLTNEITLTHLGTKFVLHPQTPSQVAKDQLTMKDMRDEEEKLEKQKKKKDSKALSSKAKGKEKEERIPPRILLRRKTILQQKVISKEHFFLNNPSTFSCQGKHPLALPYLLSLRYYEAPNPYDRWYDECVEWCNPLL

SEQ ID NO: 96839 - protein, 113 aa, Glycine max
  Coding DNA Sequence Number=SeqID_5154
MEEIVCLLTCEKLEHKGEGSQGVFKDCKGFTRIVEKSQQCHIKSECPIYLRKHDEKKGKKDRKQKKAYIAWEYSASTTSSSSSDEEIVNMCLMAKSRPWRIDLFDPRHRASSC

SEQ ID NO: 96840 - protein, 1009 aa, Glycine max
  Coding DNA Sequence Number=SeqID_5155
  Gene Ontology: Mol. function=transferase activity; Cellular component= endoplasmic reticulum
  Homolog annotation: Hit_ID=A7Q020; Match level="QueryCoverage=100%, HitCoverage=100%, E-value=0.0, Identity=68%"; Hit description =Chromosome chr8 scaffold_41, whole genome shotgun sequence
  Pfam annotation: Domain name=C2; Domain location=292-369; Score=18.5; E_value=0.0027; Accession=PF00168.21; Description=C2 domain
  Pfam annotation: Domain name=C2; Domain location=443-527; Score=18.9; E_value=0.0024; Accession=PF00168.21; Description=C2 domain
  Pfam annotation: Domain name=C2; Domain location=601-688; Score=75.6; E_value=1.6e-19; Accession=PF00168.21; Description=C2 domain
  Pfam annotation: Domain name=C2; Domain location=7-98; Score=84.5; E _value=3.3e-22; Accession=PF00168.21; Description=C2 domain
  Pfam annotation: Domain name=PRT_C; Domain location=853-1009; Score =349.3; E_value=6.7e-102; Accession=PF08372.1; Description=Plant phosphoribosyltransferase C-ter
  Pfam module annotation: Pfam domain module=C2::C2::C2::C2::PRT_C; Domain location=292-369::443-527::601-688::7-98::853-1009
MGSVRKLIVEVVDAHNLVPKDGHGTSSPYVVVDFHGQRRKTRTAVRDLNPVWKETLSFNVDNVNSQSSQIFGDTLELDVYHDKSYGSTRRHNSLGRIRLSSAQFVNKGEEALVYYVLEKKYLLSMIQGEIGLKIYYVDEEKVLKIEEAPPPPPPPQKEAEITEPEKVEETPPPQPPEGEKPKEEEMKEKEKENAEPPPPPAPAAATEKPPPEAEQDYQPLDPLLDVKAASVSRSNSEIRFNGTNNGPAPPQPMRRSASTASFAASEASSETSSMMTMMERSSFDLVEKMHYLFVHVVKARYLPTNGNPVVKIAVSGQHHVTSMPARKSTVLFEWNQTFAFARDAPDSSSVLEVSAWDPQASEALLGGVCFDVNEIPVRDPPDSPLAPQWYRLEGGGALHGDLMIATWMGTQADESFPDAWKSDTFAHVNSRAKVYQSPKLWYLRATLLEAQDVFLLPLTSSKESCFRVKAKLGFQVLKSKTVVTRNGTVSWNNEDFIFVVAEPVSDHLMFTLENRQPDAPVTIGVLRIPLLAIERRVDDRSVASRWFTFDNESDDKASSRPRVHLRLCFDGGYHVMDEAAHVCSDYRPTARQLWKPPVGTVELGIIGCKNLLPMKTVNGKSSMDAYCVAKYGSKWVRTRTVSDNMEPKWNEQYTWKVYDPSTVLTIGVFDSSLLDMDNDKNTLIGKVRVRISTLHTGRVYKNTYPLLVLSPVSGLKKMGEIEIAIRFVRTTQRLDFLHVYSQPMLPLMHHVKPLGVVQQEALRNTTVRMVAGHLSRAEPPLRKEVVFYMLDADSHNFSMRKVRANWYRIINVIAAVVDIVRWIEHTRGWRNPTATILVHALLVMLVWFPDLIIPTFCFYVFAVGAWNYRFRARDPLPHFDPKISLAEVVDREELDEEFDTVPSNKASEVVRVRYDRLRALGARVQTVLGDLATQGERVQALVTWRDPRATGIFVFLCLTVAFMLYLVPSKMVAMAFGFYYLRHPIFRDRLPSPALNFFRRLPSLSDRIM

SEQ ID NO: 96841 - protein, 122 aa, Glycine max
  Coding DNA Sequence Number=SeqID_5156
MDCGGRRLYHVSACPLREVGKTLHITVSSLKYKLTCMLNASSVQRDLRYRHIIQCSGVSRYVSRHRWVVGTGTEVEIVVVGVAEEKLSPVPRRAPNVPTEFQRGPTNLLGPLLLSGIFDLRR

SEQ ID NO: 96842 - protein, 210 aa, Glycine max
  Coding DNA Sequence Number=SeqID_5157
AKANKKTKTMATQLKSMKFELGKTKELNLELAKIDDLEKQVKDISVRVEELTFEKMVEENLTTAEDKVVDLEKKIEDLKCELLKKEEAKFVLSTELDKAKRWIILNHREDSRRLNIKSNFCLPIGLGMLYRGCEMLDVKLVEEFFVAFFNELSSIVYHVGLSEVVHGDEEELDLVFGYGEWSKDVYSVHAKRPRRSDVVEHLGCVRGGHC

SEQ ID NO: 96843 - protein, 163 aa, Glycine max
  Coding DNA Sequence Number=SeqID_5158
MEDGSPIWGKSFVAREVRGIGEFGSKGELSFSSPSSIFDSERTKDFLASEINLTTLNDAELLTIEPYSVEERVFMRASKEQVKGGNAEVEIVHLGGPEMADKGVGEGNAVEELAEVLDKGQQFKQGYLERIRLLCIIITVNFIVWIMFFVAPEKDDGTHTNQE

SEQ ID NO: 96844 - protein, 208 aa, Glycine max
  Coding DNA Sequence Number=SeqID_5159
  Gene Ontology: Mol. function=nucleotide binding; Cellular component =nucleus; Biological process=ribosome biogenesis and assembly
  Homolog annotation: Hit_ID=A7QNT3; Match level="QueryCoverage=71%, HitCoverage=23%, E-value=4e-70, Identity=88%"; Hit description =Chromosome undetermined scaffold_134, whole genome shotgun sequence
  Pfam annotation: Domain name=MMR_HSR1; Domain location=12-135; Score =54.4; E_value=3.8e-13; Accession=PF01926.14; Description=GTPase of unknown function
  Pfam annotation: Domain name=Miro; Domain location=13-135; Score= -5.5; E_value=0.032; Accession=PF08477.4; Description=Miro-like protein
  Pfam annotation: Domain name=NOG1; Domain location=78-135; Score =116.7; E_value=6.7e-32; Accession=PF06858.5; Description=Nucleolar GTP-binding protein 1 (NOG1)
  Pfam module annotation: Pfam domain module=MMR_HSR1::Miro::NOG1; Domain location=12-135::13-135::78-135
MARLPSIDPNTTTILIYGYPNVGKSSFIKKIRRANVDVQPYAFTTKSLFVGHTDYKYLRYQVIDMPWILDRPFEDCNIIEMCSITALAHLRAAMLFILDVSGCCGYSIAQQAALFHSTKSLFMNKPLIIVCNKTDLQPLEGISKEDMKLEPCLLSYIQIFKKFVLEWEKKSGKARVHSLPEVLSYQIHKRSWSIALELIGVEVEEGSE

SEQ ID NO: 96845 - protein, 80 aa, Glycine max
  Coding DNA Sequence Number=SeqID_5160
MAMVSITMLVSMDGLLYDILHSFLFINVGQFGYGNTNVTDCSTTIPYGDFKITLAPHLVLRENSSLNNFQVSFLVPRLTL

SEQ ID NO: 96846 - protein, 61 aa, Glycine max
  Coding DNA Sequence Number=SeqID_5161
MEEMFIFRNEVRQARHKCNKREGSTKTESHKLDKRHKSDKHQPIPKRPRLSTWRYPSCYLQ

SEQ ID NO: 96847 - protein, 147 aa, Glycine max
  Coding DNA Sequence Number=SeqID_5162
MVLVPELIPFEFSLIHHLEKERERAWKNQKQEILHGNGWRGVELYDDRDTEKKAYLKEFLLVCYDPKWTFPVGAKLSCSGIFFGFTLNLPYEVTRLKVSWLNLCIVSPRYSEFGSYFPNPCHVFFNGDHGVCAICKSVWSFLGCCLG

SEQ ID NO: 96848 - protein, 143 aa, Glycine max
  Coding DNA Sequence Number=SeqID_5163
MPRRICGSWAVHKPPSSELEFVQCRRSLSDVWGSSFPIPLSMDECCLVSDVVALTSVRVVGRCGLSSPRAKTYVVWAASVKSFVMDLSLVVPHLRILAEVPLIACPPLQRREPVSVIVILPSSIFGGARRAGGGRDVRSSPRV

SEQ ID NO: 96849 - protein, 95 aa, Glycine max
  Coding DNA Sequence Number=SeqID_5164
MEEDGEKGVLESWENLLHSRHEWNLQGDWLPLHDEVKSFTKTYLVIAIRKNLHSKRFSFVEPQGFEEELNVAHELEGIHKRSTLVEVGDCWDMCL

SEQ ID NO: 96850 - protein, 91 aa, Glycine max
  Coding DNA Sequence Number=SeqID_5165
MSFLSLIFVFSLLLSKTLSFFYLSQKNDDPGLIHRWIVAKFEEKHKSHDDSTSGGFNLVSVSLTFGNSIGAVRGKKLEESQGTARDAAIAG

SEQ ID NO: 96851 - protein, 210 aa, Glycine max
  Coding DNA Sequence Number=SeqID_5166
  Gene Ontology: Mol. function=aspartic-type endopeptidase activity; Biological process=DNA integration
  Homolog annotation: Hit_ID=Q9C536; Match level="QueryCoverage=31%, HitCoverage=5%, E-value=4e-08, Identity=46%"; Hit description=Copia -type polyprotein, putative
MVEKGYKEPQDETSLSQVQNETLKDSRKRNKKAPFLIYQASKQLQGSLQAYEEKHKNKQEIIEQLFKMQLKEKEKVKEMKEVNEAEVEVEVIAEDRLDVATVDEIQISSTTITRKEKAQQENMEEAIQAQECRFAKNKVEEQTNYVGQKDEKFETLLLAHGGNKGSQENTWYLDTSASNHTFGKRSMFMDLDESLATLMHPGYGIIDLGT

SEQ ID NO: 96852 - protein, 62 aa, Glycine max
  Coding DNA Sequence Number=SeqID_5167
MDDDWEETPHAGIGHGVFTNHGYGSVLIKNAISDRSSVYLLYAIQPLLMNPYSSIMMRSIDP

SEQ ID NO: 96853 - protein, 70 aa, Glycine max
  Coding DNA Sequence Number=SeqID_5168
  Gene Ontology: Mol. function=metalloendopeptidase activity; Cellular component=mitochondrial respiratory chain; Biological process =proteolysis
  Homolog annotation: Hit_ID=A7P710; Match level="QueryCoverage=100%, HitCoverage=14%, E-value=1e-16, Identity=66%"; Hit description =Chromosome chr9 scaffold_7, whole genome shotgun sequence
MTALEDIERHVLTYGERKPLERFLNAVVDGITLNDITKISRKIISPPLTMASYGDAMSLPCSIPRKFHAK

SEQ ID NO: 96854 - protein, 58 aa, Glycine max
  Coding DNA Sequence Number=SeqID_5169
MVQYVQEASKQINTWRGGGWIGNGPRKQVRSGRERGSPSLEVEQVKQEKENDGEEYWN

SEQ ID NO: 96855 - protein, 449 aa, Glycine max
  Coding DNA Sequence Number=SeqID_5170
  Gene Ontology: Mol. function=metal ion binding; Cellular component =intracellular; Biological process=DNA repair
  Homolog annotation: Hit_ID=A5AT78; Match level="QueryCoverage=26%, HitCoverage=12%, E-value=1e-19, Identity=46%"; Hit description =Putative uncharacterized protein
MEMVNILWMHEDIISVVDVVFEWFSSHHLSVALGSASAFARNALSLPLCFGFYWFPDGNYPYYPQLGPSPSLSRPPLTSPSHRVSTWDFLNFFDNFDNGYPSYPPRFGSSVSNPDSKEVREREGILEFEDEAEHKMMKKKNKEFVLLKKEKKNMGEDKGFGVGVRDFGEGPSNTKTVSLQQVNSSEGSSKAVRFHDGNDNGSVKKEINSIPNTVASEEHGAKKGVSFKIDEAIVMTMDNDSSVLSSITTLSVHGTKDLRKDEFVAASNFGKEVALLLEVYKPPYRSRVPALRGDVDSSKMEVGGTRKKKKYKKMVQGNMESSSSDFAKPSFPAKKRVQVSQNLLSETPMKNLKIGDSLSEINKEKEGTEKVLVKESERPLQSEKDNPVLSPFFWSREENNGKMLSQQTDEDQIIDDSTPNPPSFSDLKDSDDEIHSNVDLMVSVGLTNK

SEQ ID NO: 96856 - protein, 132 aa, Glycine max
  Coding DNA Sequence Number=SeqID_5171
  Gene Ontology: Mol. function=phosphoenolpyruvate carboxylase activity; Cellular component=cytoplasm; Biological process=carbon utilization by fixation of carbon dioxide
  Homolog annotation: Hit_ID=Q8S569; Match level="QueryCoverage=100%, HitCoverage=43%, E-value=4e-52, Identity=70%"; Hit description =Phosphoenolpyruvate carboxylase
VSLDLVEMLFAKGDPGIAALYDKLLVSEELWPFGKRLMSMFEETKSLLLQVAGHKNLLEGDPYLKQILRLHDSHITTLNVLQAYTLKRFRDPDYHPAVELVKFKPTSDYAPGMEDTRILTMKGIVVGMQNTG

SEQ ID NO: 96857 - protein, 294 aa, Glycine max
  Coding DNA Sequence Number=SeqID_5172
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPEFDAKAAQQIAETTTVLNGGVSTAKTISAAKIIQTNGFQQIPNTQITLSNGTLKQNTGSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 96858 - protein, 121 aa, Glycine max
  Coding DNA Sequence Number=SeqID_5173
MTRGNPSDLQPFDPEIDRTFHRLVRHHFIPFDHSEHSITGESVHSVIGDFEHPDLEHYNFEHSDSENSDFAHSENMAQPPPRERTLREMAAPDFTYESLCIQYPDEDVPYVLKTGLIHLLP

SEQ ID NO: 96859 - protein, 57 aa, Glycine max
  Coding DNA Sequence Number=SeqID_5174
MQEMAPKKLSAKRSRRDAVAEGTSAAPEFDSHRFRSVVHQQRFEAIKGWSFHRERRV

SEQ ID NO: 96860 - protein, 318 aa, Glycine max
  Coding DNA Sequence Number=SeqID_5175
  Homolog annotation: Hit_ID=Q6WAY6; Match level="QueryCoverage=71%, HitCoverage=54%, E-value=4e-14, Identity=33%"; Hit description =Putative uncharacterized protein
MGSSQKPSLKKRFYPVKVKSLGITSLKELGQLMGQLQRQAFRKAYGKIWDLAMVEVSTEAIASLAQYYDQPLRCFIFGDFQLSPMVEEFEEILGCEWAPFIDILALLIFGGVLFPNVDGLVDLAAIDAFLAYHNHKESPVVAMLADLYDTFDRRCPSIRYKVTARASKKERRIGTNSWLAWRDEGRIRIVSSCEGCPNVPWMGTWGCINYNPVLAIRQLGYPMRGAPLDESITPFITWGFSDPNAKDRELRGSSNGIIGSYHKWLRVRTQGLDWLPNLKTVRDNEVKASEESDEVQALKAKLERARVVKEKFKSIAIK

SEQ ID NO: 96861 - protein, 120 aa, Glycine max
  Coding DNA Sequence Number=SeqID_5176
  Gene Ontology: Mol. function=oxidoreductase activity, acting on NADH or NADPH, quinone or similar compound as acceptor; Cellular component=photosystem II; Biological process=electron transport
  Homolog annotation: Hit_ID=Q85FG9; Match level="QueryCoverage=96%, HitCoverage=45%, E-value=1e-30, Identity=43%"; Hit description =NAD(P)H-quinone oxidoreductase chain H, chloroplast (EC 1.6.5.-) (NAD(P)H dehydrogenase, chain H)
  Pfam annotation: Domain name=Complex1_49kDa; Domain location=20-119; Score=-78.0; E_value=2.2e-07; Accession=PF00346.10; Description =Respiratory-chain NADH dehydrogenase,
MLELSRIASHLLWLGPFMADIGAQTPFFYIFRERELIYDLFEAATGSNKLGFIRTHASGFRNTMGFRKVDNYECYEEFDWEVQWQKEGDSLARYLVRIGEMMESIKIIQQALEGIPAESI

SEQ ID NO: 96862 - protein, 91 aa, Glycine max
  Coding DNA Sequence Number=SeqID_5177
MDPRAPQQTAVGGINIQDVFPSKARTTIELGFKWEALNGNFSKVLLGITFKLEPLSMSTLATIWSIHLTDTCKALLCPLPSARISSSAKAR

SEQ ID NO: 96863 - protein, 201 aa, Glycine max
  Coding DNA Sequence Number=SeqID_5178
MLESFQQQDQMSVLELYIEKDVAGGSMFHSANSLTSCENNLSNNEAQPPRNVSNLHGDEDDDYLGSNSYVEESLDEDDSIDGISDTDDEVTNMIQPVRIVHPAQGVQGIQNPFWNDAFHYNNINWSHPDEEDICGLEMSSSFKVGQELYVGMDFDSKDAVKNVVKQYVMKVHQSFKVVESKSNKHDQRRSINKSFFDSRED

SEQ ID NO: 96864 - protein, 103 aa, Glycine max
  Coding DNA Sequence Number=SeqID_5179
MLVCLTGYRRALWFKTNLCRSKEFDFDVLMMPYDRDDLMPYENVLLKFNSRQKFKNTRYNIRKISSVLGREFQIETTKGLAKKFKQKCLFQEIYSLVIDYQRM

SEQ ID NO: 96865 - protein, 355 aa, Glycine max
  Coding DNA Sequence Number=SeqID_5180
  Gene Ontology: Mol. function=nucleoside-triphosphatase activity; Cellular component=chloroplast
  Homolog annotation: Hit_ID=A8W3G3; Match level="QueryCoverage=97%, HitCoverage=19%, E-value=1e-116, Identity=55%"; Hit description =Hypothetical chloroplast RF21
MGSNVRDLVALTNEALSISIIQKKSIIDTNIIRSVLHRQTWDFRSQVRSVQDHGILFYQIGRAVSQNVLLSNCSIDPISIYMKKKSCDGGDSYLYKWYFELGTSMKKLTILLYLLSCSAGSVAQDLWSLPGPDEKNGITSYGLVENNSDLVHGLLEVEGALVGSSRTEKRLQSFRDKRIIYDEEDELQENDSEFLQGGTMQYQTRDRSSKEQGFFRISQFIWDPADPLFFLFKDQPFVSVFSHRQFFTDEEMSRELLTSQTDLPTSIYKHWFIKNTQEKHFELLIHCQRWLRINSSLSNGFFRSNTLSESYQYLSNLFLSNEALLDQMTKTLLRKRWLFPDEMVVAICSNNESLV

SEQ ID NO: 96866 - protein, 63 aa, Glycine max
  Coding DNA Sequence Number=SeqID_5181
MAPKTCSNPASVLDRASNIKCLILIKHHPQIPLVGQKSTRTALRQTYKQLGYRTPIPRDNTIN

SEQ ID NO: 96867 - protein, 220 aa, Glycine max
  Coding DNA Sequence Number=SeqID_5182
  Homolog annotation: Hit_ID=Q84VH5; Match level="QueryCoverage=83%, HitCoverage=29%, E-value=1e-44, Identity=53%"; Hit description =Envelope-like protein
  Subcellular localization annotation: CTP_CleavageSite=21; ConfidenceScore=5.21e-01
MATSPKETSSPGSPSVPSSPSSTKAPSNQEQPEFNIQPIQMIPGPAPVPEKLVPKRQQGVKIFENPSLATSPREVDTEMDKKIRSIVSSILKNASVPDADKDVPTSSTPNAEVLSSSSKERSTEEEDQATEETPAPRAPEPAPGDLIDLEEVESDEEPVATYPSAGGRRETRGMRVPRKEYARSRHQRLFEENVGKTGKDAIYELLSERFGSCIYARGRY

SEQ ID NO: 96868 - protein, 81 aa, Glycine max
  Coding DNA Sequence Number=SeqID_5183
  Homolog annotation: Hit_ID=UPI0000ECAFAB; Match level="QueryCoverage =40%, HitCoverage=40%, E-value=4e-12, Identity=100%"; Hit description= UPI0000ECAFAB related cluster
GTKAGTGPPLEVDGIDKLDILRNSHITKHLASGRHRGGAPIRPIVSRITIHWPSFYNVVTGKTLALPNLIALQHIPLSPAG

SEQ ID NO: 96869 - protein, 220 aa, Glycine max
  Coding DNA Sequence Number=SeqID_5184
MVITLDGAHVRYVGCCVCSWGAKCTDLVGWPIRGGQAWLKNLSISEGMLRRFNWSMVFGTCFGPRSYIVCSVCSWGVECIDLVGWPIRAGQALLKNLSISEGILRRFNWSMVFGTCFGPRSYIVCSVCSWGVECTDLVGWPIHGGQALLKNLSISEGMLRRFNWSMGTSLGPKLITYGGAVTCTTGWSRRTLHGFQSESVVWTRLGYFLGFGCWYVPHCI

SEQ ID NO: 96870 - protein, 110 aa, Glycine max
  Coding DNA Sequence Number=SeqID_5185
  Subcellular localization annotation: CTP_CleavageSite=24; ConfidenceScore=5.11e-01
MEYEGMVSPGSNTTGVPRNALRVSASNFIKFPFTLTCFGYASPQEAPFTIKEGNQEKLLAYTGGGMSAPPLGTSQSLKSSLISLKVEILAPYSASSFSAVHTQRLSVVSL

SEQ ID NO: 96871 - protein, 78 aa, Glycine max
  Coding DNA Sequence Number=SeqID_5186
  Subcellular localization annotation: CTP_CleavageSite=42; ConfidenceScore=5.44e-01
MKECKNTSGEDASFTSRISQSLTNSSQALKLALASSSGGLVRARALSASVRLANLYNLSSSGFFLVLSPGVLRLANAC

SEQ ID NO: 96872 - protein, 263 aa, Glycine max
  Coding DNA Sequence Number=SeqID_5187
  Gene Ontology: Mol. function=motor activity; Cellular component=cell projection
  Homolog annotation: Hit_ID=UPI00016621D1; Match level="QueryCoverage =98%, HitCoverage=40%, E-value=8e-22, Identity=34%"; Hit description =UPI00016621D1 related cluster
RRHVLAFRGLHVLAFRGLHVLAFRGLHVLAFRGLHALAFRGLHALAFRGLHVLAFRGLHVLTFRGLHVLAFRGLHVLTLKGLHVLVFRGLHVLAFSGLHVLAFRGLHILAFRGHHALALRGLQVLAFRGMHVLAFRELHILAFRGLHALTFRGLHVLAFRGLHVITFTELHVLAFKGQHVLAFRGLHILVFRGLHALAFRGLHVLVFRGLHALAFRGLHALAFRGLHVLAFNGLYTLVFRGLRVLTFSGLHICTLREFKVLYP

SEQ ID NO: 96873 - protein, 132 aa, Glycine max
  Coding DNA Sequence Number=SeqID_5188
DVRKKAQAIQKQNTAPHVLSRGGYDYLEQKLLAEKTKKKLEESAQSGSVDGVIDPPSPDSFEEQATQGPFIPHGRQDVLTAAIGRPEHPGRVCAVGAGVTTKQYFGSAPRTSRSSSSLPPEELQQLTQQIWD

SEQ ID NO: 96874 - protein, 106 aa, Glycine max
  Coding DNA Sequence Number=SeqID_5189
MSNQKSMESAIKNLEVQVGQLAKQLVERPSSNFTTNTEKNPKEECKAVMTKSRMAIQAEESRVDQKVEGFKHWLADELALEPIDDLVELEEIVEEAEGDEEEETTI

SEQ ID NO: 96875 - protein, 42 aa, Glycine max
  Coding DNA Sequence Number=SeqID_5190
MDKSSKVGEDEWREKEIRSTKFCASIEPKNPRSTPRFSSKCG

SEQ ID NO: 96876 - protein, 64 aa, Glycine max
  Coding DNA Sequence Number=SeqID_5191
MDQPGEEKKLQLKLGLMSVEIKSESTNKSFKVNGHRLKPFLTNPCLVDVVVEETSLLHLTSLPP

SEQ ID NO: 96877 - protein, 205 aa, Glycine max
  Coding DNA Sequence Number=SeqID_5192
  Pfam annotation: Domain name=zf-CCHC; Domain location=132-149; Score =17.7; E_value=0.0032; Accession=PF00098.14; Description=Zinc knuckle
MKREKHASYSSHNSCKSLSEEFRDYYEGRHRSHLRPHSHRREKERKPQEANINLPYFHGKDNVEANLVWEIRVEQQLKKKSTSKFYGSHSYPKKDQGQGILGVTPSKPKGDKGKTIENHAPKTSVLEKTSSIKCFKCLGRGHITSQCLTTKTMIMRSQDIYSSQDEATTSPSSSESEEAKGEESSEEIYPQEEGQPLMVKEECTE

SEQ ID NO: 96878 - protein, 212 aa, Glycine max
  Coding DNA Sequence Number=SeqID_5193
MAKRLQEDWARDAGESPRWRLQSPFLLLLHFAAIDLQEAKVSIDEEDPRTTSSTWSYIRSIYNFSKTYVIDYTNALHDESRLIQRSFDDNKGDDKKLKDLIKNTSRFKRKFDFKNQESRFKVQASKNQDQDLRLKIQESREELIRIRYIYLSLTENKRGYISCGSVLVEDTSTRLFKENKGGYIPCGSLLVKGFLQGWKRNLKDRRSLRDWM

SEQ ID NO: 96879 - protein, 150 aa, Glycine max
  Coding DNA Sequence Number=SeqID_5194
  Subcellular localization annotation: CTP_CleavageSite=41; ConfidenceScore=5.06e-01
MAESSKKRKGSSSTTAVAGHCRHEPSEAPTAPIHPSLSSPRSSTLFSSDDQRLRYNSQFSSRIILDPKYLDTDFFNDETFDYYQVFQNSGLVDFMSLKFSYYPKLVKVFYSNLKIQDGAPFEGTIVDDWKFDYSSHDARRMVCNDQAEMT

SEQ ID NO: 96880 - protein, 102 aa, Glycine max
  Coding DNA Sequence Number=SeqID_5195
MFIHTQVLKKVVSEQLSGVKNSRFLKAHIHYCNLPFGGRATRGSWVRLPRKENVRSCHQGRQKRVFCSYISSIAMRNSDLRSSLKGNKVMRGVDFRLLNGSF

SEQ ID NO: 96881 - protein, 67 aa, Glycine max
  Coding DNA Sequence Number=SeqID_5196
MEMIRKDELVLWVLQMVCGGDGQQEVVAQRKEAGCAAPLDFVSIYRRGRDVIDYKGVALAPRYPQVR

SEQ ID NO: 96882 - protein, 31 aa, Glycine max
  Coding DNA Sequence Number=SeqID_5197
MELPEKKSSSGEGVWEVEEVGSNSCYRVNQY

SEQ ID NO: 96883 - protein, 29 aa, Glycine max
  Coding DNA Sequence Number=SeqID_5198
MWAFMKQGVDAVSGISEIAGAANNCDETK

SEQ ID NO: 96884 - protein, 44 aa, Glycine max
  Coding DNA Sequence Number=SeqID_5199
MVRGRDKVLMDGRKERLGSRPIGRHPLPSPGQMESATAKQPSIL

SEQ ID NO: 96885 - protein, 163 aa, Glycine max
  Coding DNA Sequence Number=SeqID_5200
MRLVHCLIISLSQSCCALVGTWQGELINRLRLRLMLKCQTGCNNIRGFMGFKFPSRCGLFGGLGIKVFLRRRWGQLLSDMRKCSLLCIILKVVFVEHVNLHEQSRWICWVRPPLRAVTLKVDGSMMGSPPRAGFGGLCGVHHGSFLVGLYGHIGGQEILYAEI

SEQ ID NO: 96886 - protein, 96 aa, Glycine max
  Coding DNA Sequence Number=SeqID_5201
MEAMKEQMAAMMEAMMSMKKIMEVNPITIAATSTVAKVNPTSPFDINQMNHPTSDMVGKDLGSTGSPHDVQIQNEHTFPPYGLPLNYTPPNVVHSQ

SEQ ID NO: 96887 - protein, 71 aa, Glycine max
  Coding DNA Sequence Number=SeqID_5202
RKEGGGCRPARPGELGCFHQKAPPFVGIPWKAQIAQQCFFSTSGMSQNFTDYLTMGVKYLEAVKRRLHATK

SEQ ID NO: 96888 - protein, 76 aa, Glycine max
  Coding DNA Sequence Number=SeqID_5203
MKAKCNQRWLGGAKTVSPGLLAQASLACPSELTCHFSFGAIMSMALYGPAFAYSNPLQDTRLPCNGIFRLSRAGKG

SEQ ID NO: 96889 - protein, 87 aa, Glycine max
  Coding DNA Sequence Number=SeqID_5204
  Subcellular localization annotation: CTP_CleavageSite=66; ConfidenceScore=5.07e-01
MQGYLMVTRTFRQPGENEPVDAQRLTLSPAPFVVLTREARFLLSSFGNIQAQRRTGFFSAWQRRTSAMAKGSVVVVQLFRFQDTEVC

SEQ ID NO: 96890 - protein, 112 aa, Glycine max
  Coding DNA Sequence Number=SeqID_5205
  Homolog annotation: Hit_ID=A5AFJ8; Match level="QueryCoverage=95%, HitCoverage=8%, E-value=7e-19, Identity=53%"; Hit description =Putative uncharacterized protein
  Subcellular localization annotation: CTP_CleavageSite=54; ConfidenceScore=5.03e-01
MSVTPSCSLTKKGISFSTALLSSKPDSKAPWIIDFGASNHMTNYSKLFSTYSPCACHKKELSSGRMIGSSKEVDGLYLFEDEYGPKEKLQKNCLNSILIREDQEIMLWHYRL

SEQ ID NO: 96891 - protein, 109 aa, Glycine max
  Coding DNA Sequence Number=SeqID_5206
MDKFGIFVPHPLTNTSLLIQLSPECGCKPLVSLLKRPALLSLDFQDRSIKNYLCYTFGEGVVKRQPYTGAMRGTVHEPQANLGADQKFSPVDVFKQKNGGQTLAFQWID

SEQ ID NO: 96892 - protein, 72 aa, Glycine max
  Coding DNA Sequence Number=SeqID_5207
MPIGSTSQKSGADIEEEEPTDLRSNPLQLGGDNSILPRKGPITKSISKRHQEDWARAAKEGPRVLMNLREDF

SEQ ID NO: 96893 - protein, 46 aa, Glycine max
  Coding DNA Sequence Number=SeqID_5208
MAKVLIDNGSSLNVMPKNTLEKLPFNASHLKPSSKVVRAFDSTCRE

SEQ ID NO: 96894 - protein, 151 aa, Glycine max
  Coding DNA Sequence Number=SeqID_5209
MHFPVIHFRVKRVITNFGKRNCGKGSTRAERDESRVEGMILEDKLKACQRSKRSLTEQLSRTEENMWAIIGQYKEKLNLAAIHEQRLEDEHAKVSVLQAEREARERVIDSLHRKAMMWMDRFTFTLNGSQELPRLLAKAKAMADVYSSPEE

SEQ ID NO: 96895 - protein, 62 aa, Glycine max
  Coding DNA Sequence Number=SeqID_5210
DLEAAATPEEELQSSKASSSFPIAGHSHIEPVEDTIMVEEPRRVTLEDYSSSNVPQFFTSIA

SEQ ID NO: 96896 - protein, 71 aa, Glycine max
  Coding DNA Sequence Number=SeqID_5211
MNIRPQTYRHHLDRPIQLGHWAWSVIYSIWFASRWPTTGSAPFACPTPEQFGGEVAWLGDWPDAQAGEEPA

SEQ ID NO: 96897 - protein, 68 aa, Glycine max
  Coding DNA Sequence Number=SeqID_5212
MWKDGWMTIKIDLEKAYASLKWEFFHDTLADFFCLNNNGELIWGCMSGAKRIISNWAWIRNWVESAWT

SEQ ID NO: 96898 - protein, 218 aa, Glycine max
  Coding DNA Sequence Number=SeqID_5213
  Homolog annotation: Hit_ID=Q6WAY4; Match level="QueryCoverage=85%, HitCoverage=33%, E-value=3e-21, Identity=35%"; Hit description =Putative uncharacterized protein
MGSSQAPSLKKRFYQVKVKSLGVTSLKELGQLMDQLQRQAFRKVYGKIWDLAMAEVSTKVIASLAQYYDLLFRCFTFGDFQLSPTVEEFEEILGCPLGGRKSYLFLGFYPSLAKISKIVQISTQELDHRKQVKNGVVGIPRKCLEAKARVLAGKGEWAPFMDILALLIFGGVLFPNVDGLVDQAAINAFLAFHNRKESLVVAILADLYDTFDRRCEKS

SEQ ID NO: 96899 - protein, 87 aa, Glycine max
  Coding DNA Sequence Number=SeqID_5214
TPPIDQESECQMFDHLAMIVVGAMVVVALLMMEEGLARIPQPVDVGSNPKWVVKATTDASNKEEVLQGDRAYALFLPVQAPCDLFVN

SEQ ID NO: 96900 - protein, 108 aa, Glycine max
  Coding DNA Sequence Number=SeqID_5215
  Homolog annotation: Hit_ID=UPI00006A2939; Match level="QueryCoverage =98%, HitCoverage=73%, E-value=5e-08, Identity=33%"; Hit description =UPI00006A2939 related cluster
TLTVRGLHVLTFRGLHTLAFRGLHVLTFVGLHALTFRGLHVLANRGLHALTLKGLHVLILKGLHVLAKRGLHALTLRGLHVLTIRGLHALTSRGLHVLALRGLHALTL

SEQ ID NO: 96901 - protein, 128 aa, Glycine max
  Coding DNA Sequence Number=SeqID_5216
MTRWRFIANPICCNHVTKFCKSWIFNNIEWNGTCVPVATYTSAGGRRVTRGMRVPRKEYARSRHQRLFVRNVGKTEGNRSKRKILSSGVVFTLEEGDHFKALDLENDPFYLVRNRNDKLSKSYFCGQA

SEQ ID NO: 96902 - protein, 112 aa, Glycine max
  Coding DNA Sequence Number=SeqID_5217
MTRGNLGDLQPFDPEIDRTFHRLLRHSVHPMHFEHSEYFVSGDSEHSDFEHSTTNFHTENMAQPPPRERTLREMAARDFTYESLCIQYPDEDVPYVLKIGLIHLLPKFHGLA

SEQ ID NO: 96903 - protein, 445 aa, Glycine max
  Coding DNA Sequence Number=SeqID_5218
  Gene Ontology: Cellular component=membrane
  Homolog annotation: Hit_ID=A2A1E8; Match level="QueryCoverage=99%, HitCoverage=57%, E-value=0.0, Identity=81%"; Hit description =Nucleoporin
  Pfam annotation: Domain name=Nucleopor_Nup85; Domain location=1-445; Score=247.2; E_value=3.6e-71; Accession=PF07575.4; Description=Nup85 Nucleoporin
MVIEEDPRYWDLLSSALSVGWLDIVVKMLRLHGSYQLDQLSNRELENGLVEAVAVLISKMPRMRPESVGKLGECYKSKPDFIKAWEKWRSQITKLDCSRFWIQCDNQQTREGLRNLLQIMLGNTESLCMATCYWIELYISHFLYIRPFTMGIESMYNLAQKCIQLKPRSSTHRLSVLMIGILEENTEVVLAECSREFGPWLVAHAIELLTAGSEQAEILLHEERYNLGGISIVELHRLVYAQILSSHALTWQTESKDETDVSYTGFSMSKRPKQPMPNESFFYEIAPIYLTSCMKQGMGLLENLLYRQSAQHNDVLLKNIEICRLYELDHISSNIMKIAGVHHWKHGHKGAGVFWLQQAQDASCLDKIAQQLFDSVGKSISDESFKQWEGMIELLGSESKPAGGLEFLHKYRDFKKSLQKVSSGKSTDAARQAVGSLILVLHTPL

SEQ ID NO: 96904 - protein, 91 aa, Glycine max
  Coding DNA Sequence Number=SeqID_5219
MACTHIPVEAKIIRPCTYASGPYNVQWNAPGLLHDKHTLRSSRILGEMEIREQVSIGHHNWGEFYRLFAAKFLPWSVFWFLLKVMFSIGCV

SEQ ID NO: 96905 - protein, 90 aa, Glycine max
  Coding DNA Sequence Number=SeqID_5220
GTSFVVQVEDTSTWVVVTENKRGYISCGSVLVEGLYKVEKKSQGPQVAWGLDVGTVKPHFEFSSFDDTLSLVVPIAIMFDIKEDDISRNL

SEQ ID NO: 96906 - protein, 137 aa, Glycine max
  Coding DNA Sequence Number=SeqID_5221
  Homolog annotation: Hit_ID=A5AWV0; Match level="QueryCoverage=70%, HitCoverage=6%, E-value=4e-08, Identity=32%"; Hit description =Putative uncharacterized protein
MQSSKRDVYLGAYLNGEHWQMVVILPKENLVVWFCSLHNRPDNYLKGIINSTLKELDDTPQPKSKAAARWIVVKCNRQKGSTKYGYYIMHWMSTIILGSLRNNWEAYFNDARPLEPERLKALRIQWAQYYLRPRDQT

SEQ ID NO: 96907 - protein, 128 aa, Glycine max
  Coding DNA Sequence Number=SeqID_5222
MPISPCGRIVPTRHPVDPEKSNRTLGSPAFVTGLYQSYKVPIPPSKVMSSRHRDRAHKTPSGPEEVQQGLGVATSDYEPLSVLRSVCRPQQGHQAPLLIELSSRSTAPPGKRRARHHSSATRRQPSTF

SEQ ID NO: 96908 - protein, 68 aa, Glycine max
  Coding DNA Sequence Number=SeqID_5223
AHENPRAFSCISGPIYFESSIQCPSGVGLHHSSTRPLQPLHFSVGGPPPAVEGRVKLDLIEERLRAIE

SEQ ID NO: 96909 - protein, 147 aa, Glycine max
  Coding DNA Sequence Number=SeqID_5224
  Homolog annotation: Hit_ID=Q6WAY3; Match level="QueryCoverage=51%, HitCoverage=3%, E-value=4e-07, Identity=44%"; Hit description =Gag/pol polyprotein
MNFAARKPVEFIPIPVSYADLLPYLLDNSMVAITLAKVHQPPFLREYDLNATCACHRDAPGRSIEHCRALKRKVQGLIDMGWLKFEENRVIFNFHRKWVQAIGLFAQATCAPEFGLPRPFNQRLLVLRVGGAAVKQQIKFKTNKFQN

SEQ ID NO: 96910 - protein, 98 aa, Glycine max
  Coding DNA Sequence Number=SeqID_5225
MVEQFNEWVASPWTQPPLHREDEDPAAQVPHQLEDESSESSTPDPLIRKRRVVVTQEAAATSEKSLEVTLEPPAPVADTTSQAPVAHTTNKFSRETVV

SEQ ID NO: 96911 - protein, 43 aa, Glycine max
  Coding DNA Sequence Number=SeqID_5226
RLPDYGKLNPLLDLPWSFNSGNWSDSKVLDSTGLSCCAITRNW

SEQ ID NO: 96912 - protein, 155 aa, Glycine max
  Coding DNA Sequence Number=SeqID_5227
MPKNQESSKIQRFKNQASSFKIQDSRFKNQDSSIKIKIQDSRFKNQESREDSIKISIKKKFSKTLSNTRSFHKIITKEFYSLVIDYQKRVHLLGNCYTENKIGYISCRLVQVEGTSTWFFKENKGGDIPCGSLACKGFYKVGRNLKNRRLLGDWM

SEQ ID NO: 96913 - protein, 143 aa, Glycine max
  Coding DNA Sequence Number=SeqID_5228
FISSWDDLKRVFLEKFFPASRTTVIRKDILSISNLERSMIDATSGGVLGDMTPTEARNLIEKMASNSQQFSARNDAIILRGVHEVATDSSSSAKNKKLEEKLDALVNLVTQLAMNQKSASAPVARVCGLCSSADHHIDLSPSL

SEQ ID NO: 96914 - protein, 38 aa, Glycine max
  Coding DNA Sequence Number=SeqID_5229
MTTLASAYQSNLGSPNDEVRITGRCFHMLPDSWVMIAK

SEQ ID NO: 96915 - protein, 87 aa, Glycine max
  Coding DNA Sequence Number=SeqID_5230
MGDKLHRREGNSPGSPAKAPKCQPFELLVIQRRYGGKRQPGELKHLSSQTRKRKQKRFPSVRAKWERLRTERLWEITKESGRESVPP

SEQ ID NO: 96916 - protein, 66 aa, Glycine max
  Coding DNA Sequence Number=SeqID_5231
MGGILEVVSNPWRFMLENWLCDSDLDNPTRMDWVLTEKDLLADSHSDCLEASILDENEFLLLKGQV

SEQ ID NO: 96917 - protein, 72 aa, Glycine max
  Coding DNA Sequence Number=SeqID_5232
  Gene Ontology: Mol. function=acetyl-CoA carboxylase activity; Cellular component=acetyl-CoA carboxylase complex; Biological process=fatty acid biosynthetic process
  Homolog annotation: Hit_ID=P49158; Match level="QueryCoverage=100%, HitCoverage=23%, E-value=3e-29, Identity=70%"; Hit description =Acetyl-coenzyme A carboxylase carboxyl transferase subunit beta
SDRIELSIDSGTWNPMDEDMAVQTGTGQLNGIPVAIGIMDFQFMGGSMGSAVGEKITRLVEYATNQLLPLIL

SEQ ID NO: 96918 - protein, 94 aa, Glycine max
  Coding DNA Sequence Number=SeqID_5233
  Gene Ontology: Mol. function=transcription factor activity; Biological process=regulation of transcription, DNA-dependent
  Homolog annotation: Hit_ID=A1FSH4; Match level="QueryCoverage=100%, HitCoverage=31%, E-value=9e-28, Identity=73%"; Hit description =Transcriptional regulator, LysR family
  Pfam annotation: Domain name=HTH_1; Domain location=3-62; Score=62.4; E_value=1.5e-15; Accession=PF00126.18; Description=Bacterial regulatory helix-turn-helix protein, lysR family
MDIADLRLFLAIAEAGSITAGAAQANLALGSASERLRTIEADAGTPLLNRHPRGVSLTEAGAALAHHARLILQQQAQLRGELQAFAHGARGHLH

SEQ ID NO: 96919 - protein, 141 aa, Glycine max
  Coding DNA Sequence Number=SeqID_5234
  Gene Ontology: Mol. function=peptidase activity
  Homolog annotation: Hit_ID=A5C0I1; Match level="QueryCoverage=99%, HitCoverage=74%, E-value=9e-14, Identity=28%"; Hit description =Putative uncharacterized protein
MQIFIEAIDLNIWKTIEIGPYIPTMVTGNATIEKPREQWDEEERKMVQYNLKAKNIITSALGMDEYFRVSNCKNAKEMWDTLQEHEMELIKLNQHEENDKKKKEIALKASSSIQEESDKEDLNEIKEDDDFSFFIKRFNKS

SEQ ID NO: 96920 - protein, 139 aa, Glycine max
  Coding DNA Sequence Number=SeqID_5235
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=61%, HitCoverage=72%, E-value=2e-24, Identity=70%"; Hit description=LacZ protein
MYIQELSVASINYEISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 96921 - protein, 44 aa, Glycine max
  Coding DNA Sequence Number=SeqID_5236
LGNNIHGAPKKCGEWRIALRVRTKTIMKHSSKLEGGGHMNNAGQ

SEQ ID NO: 96922 - protein, 84 aa, Glycine max
  Coding DNA Sequence Number=SeqID_5237
MELMRLNQHEENDKKKKGITLKASSSIQEGSDKEDLNAIEEDDDFNFFIKRINKFLRNKGNQRRSNFKPKKRGEDSSSVPKCYE

SEQ ID NO: 96923 - protein, 33 aa, Glycine max
  Coding DNA Sequence Number=SeqID_5238
  Homolog annotation: Hit_ID=P33083; Match level="QueryCoverage=100%, HitCoverage=36%, E-value=6e-07, Identity=81%"; Hit description=Auxin- induced protein 6B
MGVRLLGIRKASFAANQASSKVVDIPKGYLAVY

SEQ ID NO: 96924 - protein, 195 aa, Glycine max
  Coding DNA Sequence Number=SeqID_5239
MRITIRCLYMSSDLPSLDDKGADDDVNLCMSTGSLASSWQKVQITVRHLRMSLDLSSLDDKGEDDDVSFCVSTGSLASSRQKVRIIVRHLCMSSDLPSLDDKGVDDDVRITIRYLRMSSNSPSLDEKGADDDVWITIRHFRMSSDFPSLDDKGADDDVRITIRYLRMSSDSPSLDDKGSDDDINLYVSTGLLASS

SEQ ID NO: 96925 - protein, 174 aa, Glycine max
  Coding DNA Sequence Number=SeqID_5240
  Homolog annotation: Hit_ID=A7PHZ5; Match level="QueryCoverage=32%, HitCoverage=25%, E-value=4e-09, Identity=54%"; Hit description =Chromosome chr13 scaffold_17, whole genome shotgun sequence
MAAPDNNDPRNMVSISRIMFVHAKLVQPQRVLTVSNLDRKLYNYMTPYVSKFLMKAYVNYRDLDLGMNKKNNTKHSTTPSFKYEAKRQEVQDLGMRHYVAGAIGVVATNLLWLGFEDMRHYVLYITLEVEATIASVKEEITDRKCELIHVNDLLSRVIEAQEKCPKLMLEKLEL

SEQ ID NO: 96926 - protein, 349 aa, Glycine max
  Coding DNA Sequence Number=SeqID_5241
  Homolog annotation: Hit_ID=Q6WAY6; Match level="QueryCoverage=51%, HitCoverage=29%, E-value=1e-19, Identity=34%"; Hit description =Putative uncharacterized protein
MDVPSNVLRQRSRAVKPLMLCEWGYKRILKQEKGDTKEFRRLVLGEFCLAKGEENEKMNSTSFQDVSVSDFVNILHRSSSFFVVLWSSTVASLKELGQLMGQFQQQAFRKAYGKIWDLAMAEVSTEAIASLAQYYDQPLRKCLEAKVRVLVGKGEWAPFVDILALLIFGGVPFPNVDGLVDQAAIDAFLAFHDRKESPVVAILADLYDNFDRRCENNSTRIVCCTLALYVWLVSHLFCQEVRYACLLEGHCSCTEKKEASWDRLLASKDGASVNWFPRWKEGRTGVLISCRGFPNFPLMGTRGCINYNPILAIRQLGYTMRGAPLEEDLTPTIAQGFNSTNAEALQKVH

SEQ ID NO: 96927 - protein, 87 aa, Glycine max
  Coding DNA Sequence Number=SeqID_5242
MKNGEKSKVVAAQLAQASWVASTRRHRLLLEHPGRPKTLRIARQCSLSTSGMPQNFTDYLTMGVKYLEEVKQRLQAIKQWSPDEIRV

SEQ ID NO: 96928 - protein, 405 aa, Glycine max
  Coding DNA Sequence Number=SeqID_5243
  Homolog annotation: Hit_ID=A7UQU7; Match level="QueryCoverage=65%, HitCoverage=53%, E-value=1e-18, Identity=26%"; Hit description=IMP dehydrogenase/GMP reductase, putative
  Pfam annotation: Domain name=DUF1723; Domain location=140-189; Score =37.8; E_value=3.9e-08; Accession=PF08330.1; Description=Protein of unknown function (DUF1723)
MVKTKGLGRALCRVGARGLGRGRDRDDTDSAEAEAIAAGDEPMVDAAAQDTGAETDAQDTDAETDGDEPMGFPGGPRDPSVLTEYADHVAGSVWSGQERPELKLCSHGRKVHNLGRPIPAIEDMVARTGLSPLIACSIDIGDRGFISSFVERWHRETSSFHLPEGEVSITLDDVVSLLHWPIIGTFHDFQPLRTDEAVVLLVELLMVSAETAVARDYLLHLLGCTLFANKSATHVHVSHLQAFRDLTLAGWYAWGAAGLVLMYDQLNDAIAESNVDLDYDEVSPCACRWIVTKKTVKKRVMCQLGYVQCIPAHPVHSWVSYDDVDDTWTHYSDHLEAAGDLCVVPSECAPDYMNCHIPHEAALASTHADPDANEPRHAVEACHAIAEALEQHLNAPGTSTHEEVI

SEQ ID NO: 96929 - protein, 113 aa, Glycine max
  Coding DNA Sequence Number=SeqID_5244
MMSFNGDFPPWRCSGRQRRRGERKRHPLGNKPCVATYPSAGGRRVTRGMRVPRKEYARSRHQRLFEENVGKTGKDAIYELLSERFGSCIYARGRVFPFAPTYSSIWDEKIRPT

SEQ ID NO: 96930 - protein, 109 aa, Glycine max
  Coding DNA Sequence Number=SeqID_5245
MTRGNPSDLQPFDPEIDRTFHRLVRHHFVPFDHPEHSVIGDFEHPDFEHYNFEHSENMAQPPPRERTLREMAAPDFTYESLCIQYPDEDVPYVLKTGLIHLLPKFHGLA

SEQ ID NO: 96931 - protein, 114 aa, Glycine max
  Coding DNA Sequence Number=SeqID_5246
MVKCLVKLQTKFREDPTVNEGWAAFLPRQLHASSRSFIKRLLAHSRYLLKDPNGQIMERCFVKLQTKFREDPTVNEGWEAFLPKQLHVAFSRSFIKRLPRGFFEKLSQETSLRS

SEQ ID NO: 96932 - protein, 51 aa, Glycine max
  Coding DNA Sequence Number=SeqID_5247
MVELMNLDVLSLMKSKLHMTLIIWGISLEAISIQRLGWFIFKATTADAKSL

SEQ ID NO: 96933 - protein, 206 aa, Glycine max
  Coding DNA Sequence Number=SeqID_5248
MHIRARFYPAAARRRMWIMLTNIWITLLLSNLLPNDHHSDLPLPKCQLVYAIMTYGSRPQDTQWTRRSPTGPWGSSSDYGPLSVLRSDHHSDLPLPKCQLGSRPQDTQWTQRSSIGSWGSSFDYGPLSTHRHHLQNPPQLIYKGWNVAYDMWPTNRRPTTRAEALLGGNLELAMKKLPTKRSRKGIIEEDSSLAPQADTGFDKHRF

SEQ ID NO: 96934 - protein, 161 aa, Glycine max
  Coding DNA Sequence Number=SeqID_5249
  Homolog annotation: Hit_ID=Q1J7G7; Match level="QueryCoverage=16%, HitCoverage=37%, E-value=7e-08, Identity=100%"; Hit description =Transposase
MVKVGTSYVPINVSFSPKVGPGLPGINRDTRIYLFCEVIFRHRWYDGVFEVLQWLLFLSAVPPVQLLTGWVRKRQKHRRTSALASVAVTLRVTTTPAALNAPLQGASHSPFRLRNCWEGRSVRASSLLRQLAKGGCAARRLSWVTPGFSQSRRCKTTASEL

SEQ ID NO: 96935 - protein, 97 aa, Glycine max
  Coding DNA Sequence Number=SeqID_5250
MTKTVCTDNRLGISARHLTSRVRMTETVCMDKRLGISIRHLTSRVKMTESTEENIITCVSPHVVGLTGHDSKRWGGRQKRGFCSYVSSICDEELIPT

SEQ ID NO: 96936 - protein, 136 aa, Glycine max
  Coding DNA Sequence Number=SeqID_5251
NLQDSGTLKRVAWGLDVGTRVRCGGWRRQTRYAKGGGYVADMDEDEWMYEIMSERADMDYENEEACGANEPHVDCLDAFNTSQDALWWARSVVHENGFVAVILRKKEFIRRDTGTRKWGCPFKLRCKPVVGGEGWM

SEQ ID NO: 96937 - protein, 374 aa, Glycine max
  Coding DNA Sequence Number=SeqID_5252
  Homolog annotation: Hit_ID=Q6WAY6; Match level="QueryCoverage=97%, HitCoverage=61%, E-value=7e-40, Identity=31%"; Hit description =Putative uncharacterized protein
MESNQMPSLKKRFYQVKVKSLGTTSLKELGQFMGQLQRHAFRKTYGKIWDLAMVEVSTEAIASLAQYYDRSLRCFTFGNFQLSPMEEEFEEILGCPLGGKRPYLFSGFYPSFARISKIVQISAQELDHKKQVENGVVGIPRKYLEAKARILAGKDEWALFIDILALLIFGGVLFPNVDGLVDLAAIDAFLAYHNHKENPVVAMLADLYDTFDRRCEKSSTRIVCCTPALYVWLVSHLFRQEVRHACPLESHRSCTEKGGANWDQLLSSKEGASVNWFPRWKEGRNGVLISCGGFPNVHLMGTRGCIIYNPVLPIRQLGYPMRRAPLEEELAPVISRGFYNTNMETLHKVHKAWEVVQKKDKELRGSNNGPIGGY

SEQ ID NO: 96938 - protein, 149 aa, Glycine max
  Coding DNA Sequence Number=SeqID_5253
  Gene Ontology: Mol. function=transferase activity, transferring glycosyl groups; Cellular component=cytoplasm; Biological process =purine ribonucleoside salvage
  Homolog annotation: Hit_ID=A4W7F3; Match level="QueryCoverage=44%, HitCoverage=36%, E-value=2e-29, Identity=100%"; Hit description =Adenine phosphoribosyltransferase
MMWVRILLLIILTCLLIFMWRIPVPVNSTVFEHRRAWLKVKRLLPLPTPLRVVSNTVSFRHKPMTATAQQLEYLKNSIKSIQDYPKPGILFRDVTSLLEDPKAYALSIELLVERYKNAGITKVVGTEARWLPVWRTGCAGDGRWVCASA

SEQ ID NO: 96939 - protein, 165 aa, Glycine max
  Coding DNA Sequence Number=SeqID_5254
  Homolog annotation: Hit_ID=Q1R4F7; Match level="QueryCoverage=63%, HitCoverage=74%, E-value=8e-07, Identity=28%"; Hit description =Putative uncharacterized protein
MPTPIIGLRRLAKGRQGTAFMMDAGRPPAAAGGGCREQQDQARCLVQQAGQLGLAHRTDLLADLLAVLEHDQVRNRTHVVLGGQRTIVVNVDLGDLGAALVGIGQLVQRRGDHLAGATPLGPEIDQHRFLGIQHCAIKVGVADMYNLVAHLGFSSWIAPGQAGGG

SEQ ID NO: 96940 - protein, 47 aa, Glycine max
  Coding DNA Sequence Number=SeqID_5255
  Subcellular localization annotation: CTP_CleavageSite=37; ConfidenceScore=5.10e-01
MRPYKVLMMRRQKQHKFYFKSKSRPRKQRSRRKLSLSLSLLKESLSD

SEQ ID NO: 96941 - protein, 176 aa, Glycine max
  Coding DNA Sequence Number=SeqID_5256
  Gene Ontology: Mol. function=oxidoreductase activity; Biological process=metabolic process
  Homolog annotation: Hit_ID=A9ISY6; Match level="QueryCoverage=100%, HitCoverage=19%, E-value=1e-90, Identity=92%"; Hit description =Pyruvate dehydrogenase E1 component
MVEDQENVYYYLTVMNENYPQPGLTAGDEEGIIKGMYKLKSHGKGKNRVQLMGSGTILREVMAAQELLEADWGVASDLWSVTSFTELRRNGLDAERHNMLHPDEKKPQVAYVTEQLAKTEGPIIASTDYMKLFADQIRPFVPKGREYKVLGTDGFGRSDFRAKLREHFEVDRHFVV

SEQ ID NO: 96942 - protein, 234 aa, Glycine max
  Coding DNA Sequence Number=SeqID_5257
  Gene Ontology: Mol. function=chloramphenicol O-acetyltransferase activity; Biological process=response to antibiotic
  Homolog annotation: Hit_ID=P62577; Match level="QueryCoverage=88%, HitCoverage=94%, E-value=1e-123, Identity=100%"; Hit description =Chloramphenicol acetyltransferase
  Pfam annotation: Domain name=CAT; Domain location=6-209; Score=521.4; E_value=1e-153; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELHSTAMSGRRGVIFLRQLLVPRNILSD

SEQ ID NO: 96943 - protein, 160 aa, Glycine max
  Coding DNA Sequence Number=SeqID_5258
MASRKRARTEDIPSSSTPAPPSVTIGQDVQSSQTLVPMLQSLFRGQFIIMHNLQELAHNRPIIPMEHFLEQVAWPEAQLPLVIPNEAAPPEPTPVQVDPGPANPQSPVVNPPSSPKHEAAAPPDSPVGETADPPASPIGGIADLSDSLSGEAVALTDSPI

SEQ ID NO: 96944 - protein, 150 aa, Glycine max
  Coding DNA Sequence Number=SeqID_5259
MLMGNDQFSCVGPIELLCTIGRTPDDILNLLQATITSTYDVLRYYNGRWNMSRQHDFVGHYEYSDKVIKFEIIELKIDDDMLKVLVQSNYWKQFGPIEILAVFSKQTNLYNAAFYLCTEWATALPENDNVYSTTTPLVVKDNSLVTKPVT

SEQ ID NO: 96945 - protein, 158 aa, Glycine max
  Coding DNA Sequence Number=SeqID_5260
  Subcellular localization annotation: CTP_CleavageSite=46; ConfidenceScore=5.29e-01
MAEPSKKQKGTSSQSQQHSGSQEAPIPPSIPSGSLFLSEEQLRTNQADMTGRLLAGSLAFESRILHYLIVRILLPRSSNLALVSEEDLIVMWAFHKGLQIDWAHLVRYRMHKALRLNAPLPYPHLVTLFPSRLSTFPLDFWNLYVPIKRSIPYRALHS

SEQ ID NO: 96946 - protein, 59 aa, Glycine max
  Coding DNA Sequence Number=SeqID_5261
MWKAYHVEIGTHHRKYPKRNVFGSVSARKKRTTYISMKFSRFKKLGLGFDMLMKDRDTG

SEQ ID NO: 96947 - protein, 85 aa, Glycine max
  Coding DNA Sequence Number=SeqID_5262
MGKRKPELGFEDQKIDFDLFVEDKLAPKHNVCLQVMEGDQEVLKPRAKLIFVHALCRESQALSAQPLHLRLIWSAKMAEDELSQL

SEQ ID NO: 96948 - protein, 139 aa, Glycine max
  Coding DNA Sequence Number=SeqID_5263
MPISPYRCISWDRAHKTPSGPEEVQQGPGVSSSGYGPLSVLQGARSPSKESHPQRHPVDPEKSNRALGFLTLVTGLCSPTGCLFPPARSRHHDIGITPARHPVDPKKSNKVLELPSSNYRPLSVLRSVCRPQQGHQAPY

SEQ ID NO: 96949 - protein, 145 aa, Glycine max
  Coding DNA Sequence Number=SeqID_5264
MPPEDLQQLTQKIRDQLQESITEKVTQQLMASFSQIQSQLQPQMQSQGLALPPEPEVGPLGARVSTKESCVDPSGNDPETSNLDKCGLYIEENLSRLVALGRLYEGSIAVHNISLLHGQVKVGVEMIKDAEAPISVPTDEVTLVG

SEQ ID NO: 96950 - protein, 180 aa, Glycine max
  Coding DNA Sequence Number=SeqID_5265
  Homolog annotation: Hit_ID=Q8GEG1; Match level="QueryCoverage=62%, HitCoverage=93%, E-value=9e-24, Identity=54%"; Hit description =Putative uncharacterized protein
GLPSGPSAAMIPRDPRSPAPDLSRKEQCSQPEGRAQKWSCKAFFHRLRPSITKIDAQVRGGETRQDYKDTRSQIRGVRLRRFGMALSHAHVFPTIKASYMISVRCRSFAPSWAVCTNPPFSPTAAPYPVTIVLSPTRISRARYVGGATEFLKWWPNYGYTRRTVFGICALLKPVTFGKRV

SEQ ID NO: 96951 - protein, 102 aa, Glycine max
  Coding DNA Sequence Number=SeqID_5266
MTFEKTKLRVITLNFFFKTVHCLESITWAFGIIKISRFIIMKLASTTMNLLSERAALSEFIKIHCRYAFPEELAKLTYHTKRVHLVRMNTHPPIEILVAKRG

SEQ ID NO: 96952 - protein, 142 aa, Glycine max
  Coding DNA Sequence Number=SeqID_5267
  Homolog annotation: Hit_ID=Q949K7; Match level="QueryCoverage=25%, HitCoverage=40%, E-value=6e-07, Identity=66%"; Hit description =Putative gag polyprotein
MGKAEEVQEQMKADMKAMKEQMATMVEAMISMKKIMEANAVTVAATSTVAEVNPMPPSGLKQMNHPTSYMKWEKLDHLEERLRAIEGSEDYAFASLEELFLVPNIITPPKFKVLDFDKYKGTTCPKNYLKMYCWKMEGIRKR

SEQ ID NO: 96953 - protein, 266 aa, Glycine max
  Coding DNA Sequence Number=SeqID_5268
  Homolog annotation: Hit_ID=Q2HW90; Match level="QueryCoverage=62%, HitCoverage=40%, E-value=9e-16, Identity=33%"; Hit description =Putative uncharacterized protein
PNLGTGIRPQKASKKWGGWEYREDVWRQRQEILAGRGEWAPFIDILALLIFGGVLFPNVDGLVDLAAIDAFLAYHNHKENPVVAILADLYDTFDRRCEKSSARIVCYTPALYLWLVSHLFHQEQAKKEHLSTGSLVGKKEEPGGCISYNPILAIRQLGCPMRGAPLEEELAPTIARGFNNTNVKALQKVRKAWEMVQKKDKELRGSNNWAHRRLPLRTTKGVEVEALEEDEEVQALRAELEQAQSVKERFKSAALKIRKENAKLRD

SEQ ID NO: 96954 - protein, 59 aa, Glycine max
  Coding DNA Sequence Number=SeqID_5269
MVENLHGFAHENVSEDLPSPIYRKRGEEVAAQLTQAIWVASSLSNPTSKMFWKSLDSKI

SEQ ID NO: 96955 - protein, 70 aa, Glycine max
  Coding DNA Sequence Number=SeqID_5270
AKFDIPEALDAKKKDQHKEDPSVRYGFDAQIWEEFATTRKTPSWQGRHDILNTTIGRPDHGGRVRVAGSG

SEQ ID NO: 96956 - protein, 107 aa, Glycine max
  Coding DNA Sequence Number=SeqID_5271
MAPKKLSTKRSRKEAAGEGSSTALEFDSHRFWSAEHQQRFEAIKGWSFHRERRAQLREDEYTNFQEEIAHRRWTSLVTPMAKFDPEIVLEFYANSWPIEEGVRDMHA

SEQ ID NO: 96957 - protein, 106 aa, Glycine max
  Coding DNA Sequence Number=SeqID_5272
APYALKPECHSDEAELSTTCYAKLQLSSILKIVDLDIVVPRKLLLKRNVVVYCTEFDEFKKELEIRHWDEKLTDFADSSIDIAIMKEFYTNLYDPEDKSPKQVRVR

SEQ ID NO: 96958 - protein, 88 aa, Glycine max
  Coding DNA Sequence Number=SeqID_5273
MMAHQNPPYLAFCTPGQNETKNKIQGYQRETNKNIHIFLNEHQGMKGMAHEDQKSFKVVMGPRTRYGKIRNKWLNPKGIEEQWGISAY

SEQ ID NO: 96959 - protein, 331 aa, Glycine max
  Coding DNA Sequence Number=SeqID_5274
MDQSRLILEDELKACSRSKRSLSQRLCKTETNLLAIITKYQEELNLATAHEHRVADEYAQVYEEKEARGRVIDSLHQEATMWMDRFALTLNGSQELPRLLAKAKAMADTYSAPEEIHELLGYWKNTITKRAPRHPYHTRSKSRTMGDQEKTQEQMKTDMSAMKEQMASMMEAMLGMRQLMEKNMTTVAIISSAAEADPTLLATAHHPPPNTVGRGRSTLGHNNNPHLGYNRVAYPYGLLPNYTPPVMQDDAGHISSPILEGEPPRQPDEVHEDHQEYAQRDVEFYPPIPVERVGTQHFASAQPHSTTNNLVHGRTTPGDRRRRNSISSRRD

SEQ ID NO: 96960 - protein, 133 aa, Glycine max
  Coding DNA Sequence Number=SeqID_5275
MTGRLLAGSLVFESRILHYLIVRYLTSKIFKPCTGASVIASFGYQKEHDGSWVKKGARHVDEEGHGGEDSSLLQKILDRFDGLQTFVGERFDTMELQVDMRFNEMESRITKVEEDVSYIRSSFDLPPPPPPSS

SEQ ID NO: 96961 - protein, 30 aa, Glycine max
  Coding DNA Sequence Number=SeqID_5276
MAATGGLGWWKISGLVALSRSSLLVLSTRI

SEQ ID NO: 96962 - protein, 36 aa, Glycine max
  Coding DNA Sequence Number=SeqID_5277
MSLYGFYRRFIKDFSKVALPLSNLLQKEVEFDFDDR

SEQ ID NO: 96963 - protein, 141 aa, Glycine max
  Coding DNA Sequence Number=SeqID_5278
MYKALRLNAPLPYPHLVRLGLQHFNIPLDFEPYVPIKRSFLIGASVIASFGYQKEHDGSWVKKGARNIGEEGHDGEDSSLLSEIMDRFDGIQTFVGERFDTLELQVDMRFNEMESRITKVEEDVSYIRSSFDLPPPPPPSS

SEQ ID NO: 96964 - protein, 570 aa, Glycine max
  Coding DNA Sequence Number=SeqID_5279
  Gene Ontology: Mol. function=transporter activity; Cellular component= integral to membrane; Biological process=transport
  Homolog annotation: Hit_ID=Q506K0; Match level="QueryCoverage=19%, HitCoverage=45%, E-value=1e-33, Identity=62%"; Hit description =Putative aquaporin
  Pfam annotation: Domain name=MIP; Domain location=424-549; Score= -75.1; E_value=7e-05; Accession=PF00230.11; Description=Major intrinsic protein
  Pfam annotation: Domain name=Transposase_23; Domain location=92-162; Score=8.2; E_value=0.00015; Accession=PF03017.5; Description =TNP1ENSPM transposase
  Pfam module annotation: Pfam domain module=MIP::Transposase_23; Domain location=424-549::92-162
MAIGRPEHYGLYVGMGQGLQLASTLVQHHEEWRREAEQENIKREEAWMRRVEEEKQCTMDTFKGQIQQAIKLELSQIASQHSAPLQPHDIQLLAARRRLHVTTENSNKLVAVGKQCDTFGTIHNMPYSDDVVRVSVVEVIVSDAEVPIPTSEIKFLKEALGSFVPWPTHLVKPMLPEDVSSPLKTVEEEKAAVVVDPLGELVKNLFEIYQRPVGVSWDGAKFGINNVKDGFFITHADVSEIILGDKCLNISILQLWLIASIGYGALYGFLELQCIHNANTRRQECENYIGRWAHLQLLVLCPGDNLVVWFCSLLKKPDASIKGVVNSAMKSVSKTAEGKPPQHGPQWIEAKSHVQTGNYECGYYVMHWIWCIVSAGLKDEWIHLPDEIKKGATSFEGVEAKLWQGGGDKDYKEAPPAPLFELGELKSWSFYRAGIAEFVATFLFLYITILTVMGVNKSPSKCAFVGIQGIVGWGHINLVVTFGLFLARKLSLTLGFAYSAAHFYDDHRDDTVVELSVSYDGHGTRPSSFYDGLFDTTVVEYIKDYDGLWEQTVVEFDHDLRRAATQDRRT

SEQ ID NO: 96965 - protein, 114 aa, Glycine max
  Coding DNA Sequence Number=SeqID_5280
MVAITLAKVPQPPFFRGYNSNATCAYHGGVPGHCIEHCMTLKHKRPVFLSLTSKFVQSEIARSTRLVRVLTYTSEPYTGAMRGTVHKPQANLGADQKFLPGRSKGQPKQKLGLI

SEQ ID NO: 96966 - protein, 624 aa, Glycine max
  Coding DNA Sequence Number=SeqID_5281
  Gene Ontology: Mol. function=DNA binding; Cellular component=nucleus; Biological process=regulation of transcription
  Homolog annotation: Hit_ID=A7PT17; Match level="QueryCoverage=23%, HitCoverage=43%, E-value=1e-68, Identity=81%"; Hit description =Chromosome chr8 scaffold_29, whole genome shotgun sequence
  Pfam annotation: Domain name=NAM; Domain location=11-139; Score =286.1; E_value=6.8e-83; Accession=PF02365.6; Description=No apical meristem (NAM) protein
MDKDANSKIQLPPGFRFHPSDEELIVHYLRNKVTSSPFPTSFIAEIDLYNYNPWELPSKALFREDEWYFFTPRDRKYPNGVRPNRAAASGYWKAIGTDKPIFTSCGIKSIVVKKALVFYKGRPPKGSKTDWIMHEYRLHDSTISNSKQGGSMRYCKVTTEEETLKSMMASLEEEMDEEEEVESSPVPPMQKKAQPKKKAVIGDDVETVEVQKPVEKRNIPNILNLEEGEFLEECRWFLLGKKVEVAVSTARRVSRLVDNEIVHFNFPCRSYPSKSQWIVRASTKCYGEDMTKSKGKDPLEGLGGPMTRARARKAKEALQQVLSILFEYKPKFQGEKSKANPDEASALPLIKRRKGGEPIVEQNNDEQALLESALTKLVGAAKIYNLRIENLVFQLQFLSSNLSLVSLVINPFASYMSLGEGLPDELTTMKFDSLGSSDVDALTFTSLYLQIIELLVDVWDDLLPAKRLYAQGMGKLEFKLGKLDRRVKELISRLSTLYLRVESMLKESSALPSNSVVELGKVFSSTSINGASCRKGWILRVQKEIYIPAGQPTLCNRRTIYVNIFTGEVSKKLPKAMQMARGILANAMGLGKIVMTIALILRTAGRGNSENQDVENGEWVSTNK

SEQ ID NO: 96967 - protein, 88 aa, Glycine max
  Coding DNA Sequence Number=SeqID_5282
  Pfam annotation: Domain name=Transposase_23; Domain location=9-73; Score=2.9; E_value=0.00057; Accession=PF03017.5; Description =TNP1ENSPM transposase
MDEGLTGHLIQHIKANPARLVALGRVYEGSTVVHNTPLLPGQVKVGVEEVKDPDAPVLVPTDEVSLVRQAIHTFLAWLTHLVKSLSHQ

SEQ ID NO: 96968 - protein, 354 aa, Glycine max
  Coding DNA Sequence Number=SeqID_5283
  Homolog annotation: Hit_ID=A5BSR3; Match level="QueryCoverage=52%, HitCoverage=59%, E-value=3e-15, Identity=32%"; Hit description =Putative uncharacterized protein
MATPTAQYSVSYPSLAQSPVNATAVATAIGTENCYTVDSHDQPEAAATESQNSPQHVARSVNVHPMITRGKDGIVQPTIHPSLLLVDAEPKFVKQAPQDSKWHSAITDGWLRILSQNTVLRMTTPPPSPTQAEIPSDGTSRKTRQATRLRRLTARTLDQPRAIVSVNPATGRGSGPHKDKFHSYLGVVARDKIPIVHSTWNDVPETLKNMIWDGIFGIQKKAQEIQKYNDSLHLLSRGGYELLEKKLMAEKRKIREEQAAFTEDPSLFLPSSPISRHEKWKSACTKQYGQMTSQAAKEIADKIDSLEEQSIQGSIVPSGRDDILNMAIGRPEHYGLVCGDGTGVTISQYFGPAS

SEQ ID NO: 96969 - protein, 244 aa, Glycine max
  Coding DNA Sequence Number=SeqID_5284
MYHCVFSVQDSFEEQATQESFVPHGRQDVLAAAIGRPEHPGRVHAAGASVTIKQYFGSAPRTSRSASSLPPNELQQLTQQIRDRLKESITEKVTRQVMASFSHMQSQLQSQMQSQGLAVPLEPLVGPSGPRVVVSPAKPPPKPDPEVDDPLYLMTLTIPELFLRPYQVRWDATVFGVFNPDFPLNIKHEDLFEIAHGGQCLSISVLQLWILHLTETCMRVRNSNIYGFLEPQSIQRSGQSQFES

SEQ ID NO: 96970 - protein, 192 aa, Glycine max
  Coding DNA Sequence Number=SeqID_5285
  Homolog annotation: Hit_ID=A5BSR3; Match level="QueryCoverage=63%, HitCoverage=47%, E-value=2e-11, Identity=34%"; Hit description =Putative uncharacterized protein
MRKWALAADQDGVDDTVCEKYDISKEKWAQFCQTRRDPSWEKKAQAIQKWNTSPHVLSRVGYEYLEQKLLVEKTKKQLEEAAQSGSVDGVIDPPSPVIRHVKWKMARTKKTGEMTTEAAKEIAEKIDCFEEQATQGSFVPRGRQDVLTAAIGRPEHPERVCAAGAGVTINQYFGSTPRTSRSSSSLPPEELQ

SEQ ID NO: 96971 - protein, 82 aa, Glycine max
  Coding DNA Sequence Number=SeqID_5286
TYQGNPCGVYPDLSSFTGSGVYPDLSSFTGSGVYPDLSSFTGNGIIQNLRSLYQTIRSYSGSHQPGPTLKALMINDDYALYL

SEQ ID NO: 96972 - protein, 110 aa, Glycine max
  Coding DNA Sequence Number=SeqID_5287
  Homolog annotation: Hit_ID=A7R5Q5; Match level="QueryCoverage=89%, HitCoverage=20%, E-value=3e-11, Identity=38%"; Hit description =Chromosome undetermined scaffold_1022, whole genome shotgun sequence
MAQPPPCESTLREMAAPDFTYESLCIQYSNEDIPYFLKTGLIHLLPKFHGLAGEDPHKHLKEFHIVCSTMKPPDGQEDHIFLKAFPHSLEGVAKDWLYYLSPRSITSSMT

SEQ ID NO: 96973 - protein, 122 aa, Glycine max
  Coding DNA Sequence Number=SeqID_5288
MMIWKQRAKLVMATARWALKHPVYGIVILRLGIYTNKPNVSKLCSFISSMNPSILISVIQENKLLASVPCFQKICLLSTNDLCFLTITCRPSSISFLNDHIEETLGPTEIGENHSKCINLTQ

SEQ ID NO: 96974 - protein, 164 aa, Glycine max
  Coding DNA Sequence Number=SeqID_5289
MGEVEEVQEQMATMMEAMMSMKKIMEANAVTVAATSTVAKVNPMPSSGLNQMNHPTLNMVGKDLGSRDGPHDVQIQNKYTFPPYGSPPKEDANNFAPILIESQQPQTNHAHVSQTVEETHEIAHHNPANSEPCLGYATEGQAVGDIPLQNTLEGPQPHPLDSTM

SEQ ID NO: 96975 - protein, 187 aa, Glycine max
  Coding DNA Sequence Number=SeqID_5290
  Homolog annotation: Hit_ID=Q2HU84; Match level="QueryCoverage=29%, HitCoverage=25%, E-value=1e-11, Identity=64%"; Hit description =Probable retroelement pol polyprotein-, putative
MWTTTGEELATQLAQASKVASSRSNSLLEEESGRPNFRRSYGNSRIAQKHPFLISATLRNFTDRNSLLPFDFRHVSGLHLLCNKGRQELSIGAAQRQTPAPLTALNAQARPNSNDKSRHGQNPAQSTQRTGTRKPFLGCCQWCNIKGHVLSQCKTFQQQHPSVPPPPRNSLAHTGQVQVNTATAGPS

SEQ ID NO: 96976 - protein, 171 aa, Glycine max
  Coding DNA Sequence Number=SeqID_5291
MQLPQEPLNKRPRGLARKSIAGTNFAELYGVAIVNSSCEGKKGTSREHIAWSKRSLSQRLCETETNMLAIVAKYQEELGLATAHEHRIADEYAQVYAEKEARGRVIDSLHQEATMWMDRFALTLNGSQELPRLLAKAKAMADTYSAPEEIHGLLGYCQHMIDLMAHIIRNR

SEQ ID NO: 96977 - protein, 97 aa, Glycine max
  Coding DNA Sequence Number=SeqID_5292
MGGVVTMMDIPDRENIVFLMRGNTCTWGHVTQFGTPLRLRLVTMGGVAYARQDDLDTCYLIFLSESVAWTRLGYFLTNSTILPLRVEIKCMHHTEHD

SEQ ID NO: 96978 - protein, 55 aa, Glycine max
  Coding DNA Sequence Number=SeqID_5293
MDEFDILVSLILSQTHLCLFNFHRNVVKTMMDTSEPYTGAMRGIMHEPQVNLGAD

SEQ ID NO: 96979 - protein, 123 aa, Glycine max
  Coding DNA Sequence Number=SeqID_5294
MPPTRHPLDLDKSNKALGFPALITGLCQSFGVPVTPSKAANHRAHVQTHDCLYQLSLSLQSQDFAPFPCPTPDQFRTEVTWPEDWPEAQAGEAPAEAPGDADEACMDEEMTDLLYFLGGNGAT

SEQ ID NO: 96980 - protein, 33 aa, Glycine max
  Coding DNA Sequence Number=SeqID_5295
MQVEPRNIDEALCDEQWLMAMHEELNQFKRNEV

SEQ ID NO: 96981 - protein, 142 aa, Glycine max
  Coding DNA Sequence Number=SeqID_5296
MVVIDLGSTGDPHDVQIQNEHSFPPYGLPPNYTPPNVAYTPDEDVNNSALILIESRQPHHACVSQPMGETYEIPHHNVADFEPCLGYATEGHAVGGIPLQNTLEGPQFHPQAQTLHSTAGKIPPLMEEMGKVGSSRGNAQGH

SEQ ID NO: 96982 - protein, 122 aa, Glycine max
  Coding DNA Sequence Number=SeqID_5297
MCHLTAYVCVYYNDQIYNTNEGTTFVSNNTKTFMVNKAITFTQLLELFHQKLNIEPQQHIQCLHFWGPIFELGQCYMYTSFIQRDDADVRKMFNIFYNNPLLPLVELFAIIYDNNNPTKHPT

SEQ ID NO: 96983 - protein, 155 aa, Glycine max
  Coding DNA Sequence Number=SeqID_5298
MSNQKSTESAIKNLEVQVVQLAKQLAERQSNSFTANIEKNPKEEFKVVMTRSRMAIQAEESRVDQKVEEFKQQLADEPALEPVDDLVELEEIVEKAKGDEEEETPIRDCQEKIKKKEEKEKEIKEEEEKEKKLKNENKKRRLLRLRRKRARVRLT

SEQ ID NO: 96984 - protein, 89 aa, Glycine max
  Coding DNA Sequence Number=SeqID_5299
MNRNPGANGENEKEGGTHVVIASPTWPNVPPAQQCQYSANISPSHYPPPYQPRTLNHPQRPPLNHPIPYTTLNTNRNTNQGRNFATKSL

SEQ ID NO: 96985 - protein, 94 aa, Glycine max
  Coding DNA Sequence Number=SeqID_5300
MASRKRKSTASRPQEPYDTTRFISEGAWEKYAQNVHSWNILPERNPDGHIDVALVKEFYANLYDPEDKLPRSALEALEEGPHHFGANLERPILF

SEQ ID NO: 96986 - protein, 187 aa, Glycine max
  Coding DNA Sequence Number=SeqID_5301
MPISPCRWIAPTRRPVDPKKSNKALGFPALVTGLCQSYRVPVPPARSCHCDIGIAPTRHLVDPKKSNRALGFPALVTGLCQSYRVPVPLARSCHRDIGIAPTKTPSGPGEVQQGPGFPALVTGLCSPTGCSFPPARSRHHDIGIAPAKHPVDPKKSNKVLELPSSNYGPLSVLQSACRPQQGHQAPY

SEQ ID NO: 96987 - protein, 63 aa, Glycine max
  Coding DNA Sequence Number=SeqID_5302
CNRQKGSTECSYYVMHWMSTIILGTFWNNWETYFNEVRPFEVERFKALHIQWTLYYPKVRNQT

SEQ ID NO: 96988 - protein, 137 aa, Glycine max
  Coding DNA Sequence Number=SeqID_5303
  Homolog annotation: Hit_ID=Q3E930; Match level="QueryCoverage=28%, HitCoverage=9%, E-value=4e-07, Identity=56%"; Hit description =Uncharacterized protein At5g26642.1
MHPAFGWIKVNTNGVARGSPGLAANVGLFRDDQGNFLGGFALCHTLISSGDLCSMTCDHSLVLVRCLAPIIRQFVKFQDMPKNQKNIDAQSHPGPLGPSGIFLQKAVASGGSNPARLGELSSPGRAGRQPPPLFCYK

SEQ ID NO: 96989 - protein, 393 aa, Glycine max
  Coding DNA Sequence Number=SeqID_5304
SVSDKRAETNVVFFALCHSGAESRVINTQRQIMVILCPLSFRFRKSSDKRAEKNYGHSAPFVIQRQDKLWSFCALPPRLGRVGGHTETNYGHYAPCVNQEERIRQYQDDASALLTFKIFVGSAAGRFTGRMTSKEGQLSYPNFVRGPSVVGMRPSFDHFEGGANSNQALLGLPGSSPEGTAFWRKQPSSPGRAGWEASPSSINRGRREEQKCSTLLIFNRSSSFFVRSSSFFGLQPTHPRALPPKGRLRHVTTCPLAGARKGLSYGPKVRLPSKNNARNRHQRLFEENVGKTKMEKVEGLRILKMRVPELFMHGEGEELATQLAQASWWLKPEVTCSPRITRWIDEGEERIKAIGENSLQYVIIDMTEKMVLDKPLDNLSVEGSIAPGLTRSQ

SEQ ID NO: 96990 - protein, 96 aa, Glycine max
  Coding DNA Sequence Number=SeqID_5305
  Subcellular localization annotation: CTP_CleavageSite=51; ConfidenceScore=5.04e-01
MAKIPLVFFFIIKAFFFLRFTQLSFLFAVFVVFVRHCLWFVGEGALWWSAVANEMDEDEWMYEIMSEQADMDYENEEACGVNEPHVDCLDAFNISQ

SEQ ID NO: 96991 - protein, 270 aa, Glycine max
  Coding DNA Sequence Number=SeqID_5306
  Homolog annotation: Hit_ID=Q5XM22; Match level="QueryCoverage=21%, HitCoverage=33%, E-value=9e-14, Identity=63%"; Hit description =Resistance-like protein HAAS-2
MLDDVASLLHLPIIGAFHNFEPLHVDEAVIMLVELLEVSHEEARAETAQCHGAYTRLSWLWDIYQRRCEARHWIVATRAYLLHLVGCTLFANKSATQTHIDALTIPDVCWMPYGDHRGVRAFDLISCFQGEFKWGPVVDMDDRWMHYSDHLVAAGQICLVPGQCATNYIDWFFGISHPFITPTQATDPPRHPLVPQHEKYMEPDIPEVPMAPEDACEAVTERLERVLNLKMVTAGTKLHDIMEDCLRITRGVTSYGNVYVRAQRRQRMDQ

SEQ ID NO: 96992 - protein, 480 aa, Glycine max
  Coding DNA Sequence Number=SeqID_5307
  Gene Ontology: Mol. function=hydrolase activity, hydrolyzing O -glycosyl compounds; Cellular component=cell wall; Biological process= carbohydrate metabolic process
  Homolog annotation: Hit_ID=A2TEJ2; Match level="QueryCoverage=58%, HitCoverage=83%, E-value=1e-139, Identity=81%"; Hit description =Xyloglucan endotransglycosylase/hydrolase XTH-39
  Pfam annotation: Domain name=Glyco_hydro_16; Domain location=177-362; Score=304.5; E_value=2e-88; Accession=PF00722.12; Description =Glycosyl hydrolases family 16
  Pfam annotation: Domain name=XET_C; Domain location=388-435; Score =61.0; E_value=4e-15; Accession=PF06955.3; Description=Xyloglucan endo-transglycosylase (XET
  Pfam module annotation: Pfam domain module=Glyco_hydro_16::XET_C; Domain location=177-362::388-435
MESVVIDAIEEDAIIWDEKSSGEYTTKSAYKCLIDTPPELFIHDVDEWIFQNLRAPQETTHHNISSLPSRMVCWSPPVDFDYKLNTDRSSLGNPSQAGIDRLIRDNLGLQIAWDKGVTSIICEYDSKLVVDMISLGGKACANLLARNGSSSFDKLVIFDKCPFFINVALLSDVCVTLHDGYTPLFGDHNLAIHRDGKSVHLSLDERTGSGFVSHDLYLHGYFSASIKLPADYTAGVVVAFYMSNGEMFQNNHDEIDFEFLGNIRGKDWRIQTNVYGNGSTSIGREERYGLWFDPAEDFHQYSILWTDSKIIFYVDNVPIREVKRTESMGGDFPSKPMTMYATIWDASDWATNGGKYRVNYKYAPYVAEFSDLILHGCAVDPIEHVAKCESAQGSEKVPSGVTPVQITKMRNFRLKHMAYSYCYDTVRYKVPPPECVINHQEAERLRKFDPVTFGNGQRHRGKRHHHSSKGSQEEITASSF

SEQ ID NO: 96993 - protein, 129 aa, Glycine max
  Coding DNA Sequence Number=SeqID_5308
MNKKPYRRTPNSNVPPPQPRPQLQTPTLLCRGLDHNPKPQRSFCHTPNPNVINDHTHSGPNKIHTKPQGKCKKGAYIKSFLSTGYHVVSISTLIRIQALLGSQYLKFTSIVHLGARSTVMVFSLKKAPS

SEQ ID NO: 96994 - protein, 158 aa, Glycine max
  Coding DNA Sequence Number=SeqID_5309
VCQETQQLEAEELATELGRSEIRQFGDVVDDGRVELGMQPRSMEVGLEDAEATVVLLLGHILLPELRLEAREVVLLVKKVVLILLLCCFTDGIRHHLTNQDVISGAGHDGKEEEEEGQEEGVASHKGSQKGEWIGEGEEAGLGHGEESDRHLRTGVSE

SEQ ID NO: 96995 - protein, 236 aa, Glycine max
  Coding DNA Sequence Number=SeqID_5310
  Homolog annotation: Hit_ID=P03851; Match level="QueryCoverage=35%, HitCoverage=100%, E-value=1e-43, Identity=98%"; Hit description =Uncharacterized 9.4 kDa protein
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSQAVVRSKLGCVHEPPVQPDRCALSGNYRLESNPVRHDLSPLAAATGNRISRARYVGGATEFLKWWPNYGYTRRTVFGICALLKPVTFGKRVGSS

SEQ ID NO: 96996 - protein, 87 aa, Glycine max
  Coding DNA Sequence Number=SeqID_5311
MKQKGKRKKDRKGRHVIVKKYKSFVKSKRIFWKQGTDAKSLFSGMNRDKDGESSFFPPKQRTAESPQGRANRMLKPDFPKKGMGKEK

SEQ ID NO: 96997 - protein, 92 aa, Glycine max
  Coding DNA Sequence Number=SeqID_5312
MEEFDAQVAWPGAQPSPSGGGGASTTQELAPKEPAAVQGISIDQIPEPSLALVPEETQPSTPVTEPEQPIQDSSAAPALDLNEDQPQDEQDI

SEQ ID NO: 96998 - protein, 112 aa, Glycine max
  Coding DNA Sequence Number=SeqID_5313
  Subcellular localization annotation: CTP_CleavageSite=66; ConfidenceScore=5.61e-01
MWDNVGVEGAVFESLFFSTPSSPNSSKPPPSRRSNCSSNPSTTISRKSHFLSLGFRAGIGTAIEVEDEAKPEKNLGKGAEAEIDTRKRDGEAGVEKDKRIVKDGDGKLRYFP

SEQ ID NO: 96999 - protein, 98 aa, Glycine max
  Coding DNA Sequence Number=SeqID_5314
RAFAKHDTPGLSARKNPEEDELYKFTKRTTSVHPLSEKGALSQKSLTCAKRSIRSLDWDSELCMSRVSRERKVQVLESFERFCRVKISRDQSLKQEPV

SEQ ID NO: 97000 - protein, 323 aa, Glycine max
  Coding DNA Sequence Number=SeqID_5315
  Homolog annotation: Hit_ID=Q6WAY4; Match level="QueryCoverage=91%, HitCoverage=60%, E-value=5e-30, Identity=30%"; Hit description =Putative uncharacterized protein
MEQLQLQAFRKAYGKIWDLAMVEVSTEAISSLAQYYDQPLRCFTFGDFELSPMVEEFEEILGCPLGGRRPYLFSGFYPSLARISKIVQISAQELDHRKQVKNGVVGIPRKYLEAKARILTSKGEWASFIDVLALLIFGGVLFPKCGWPTYMIPSTEDVRRAVRGLFVVLQLFMYGWFHTFFAKSKEGASVNWFPRWKEGRIGVLISCGGFLNVPLMGMRGCITYNPVLAIRQLGYPMRRAPLEEELAPVISRGFSETNMETLRKVHKAWEVVQKKDKELRGSNNGPIGGYRECLKAHVQGLDWLPSLRTAKREEVEAPKEDEE

SEQ ID NO: 97001 - protein, 158 aa, Glycine max
  Coding DNA Sequence Number=SeqID_5316
MSIYYGTQSHTRDKSYCLLNLLRASAFNFERFDILRDSIGHTCKTLLSFEFAQSFDIQFRASRYITGLNPTSELKSINIQFRAVATYPSAGGRRVTRGMRVPRKEYARSRHQRLFEENVGKTGKDAIYELFSEKVRELYLRTGKVLAPHTSVPRDDSL

SEQ ID NO: 97002 - protein, 115 aa, Glycine max
  Coding DNA Sequence Number=SeqID_5317
  Pfam annotation: Domain name=zf-CCHC; Domain location=64-81; Score =21.3; E_value=0.00091; Accession=PF00098.14; Description=Zinc knuckle
MDHLARISGFWLSASLLAQHGGLQAKDQGQGILGATPSKPKDDKGKTIVKQPLKASMQEKTSSMKCFKCLGRGHVTSQCPKKTMIMRGQDIYSSQDEATTSPSSSDREEAPAGRL

SEQ ID NO: 97003 - protein, 185 aa, Glycine max
  Coding DNA Sequence Number=SeqID_5318
MASMMDAMLGMRQLMENNVATAVAVSSAAEADPTLPATTHHPLPNVVGREKSTLGHISNPHLGYNRVAYPYGLPPNYTPPVMHDDAGHVPSPVLEGEPPRQSDEVHEEHREYAHGDIDFYPLIPVEGPAPNTLPQSNLPAQPIFLSTEGPPPEVEERRKLDLIEERLRAIEGFGDYPFTDLADLC

SEQ ID NO: 97004 - protein, 98 aa, Glycine max
  Coding DNA Sequence Number=SeqID_5319
MMIGCGITWMLWKLGRIDGDPVLKETRIRATWEYVSSVESGQQGMVGLYVICGCGELFCTIARPPPSTTCDGVVPGDMSRGSGDLGDVRWGAIAQNQA

SEQ ID NO: 97005 - protein, 69 aa, Glycine max
  Coding DNA Sequence Number=SeqID_5320
MVKYRANNRLSTLVFLEGEKVIAQRQYKWRLQSLLILSNVWEPYQSNQRKKLRNPRNLLKMPLSLSVDT

SEQ ID NO: 97006 - protein, 88 aa, Glycine max
  Coding DNA Sequence Number=SeqID_5321
  Subcellular localization annotation: CTP_CleavageSite=49; ConfidenceScore=5.09e-01
MLTSSRRLGGSSPESHFWHPSAAILLSRTMFVIITGLHRMMHAPDSTLRCNVVRTNNNQISGNSLSVFTRHSHLGNHAEFVETTRLCT

SEQ ID NO: 97007 - protein, 171 aa, Glycine max
  Coding DNA Sequence Number=SeqID_5322
  Homolog annotation: Hit_ID=A5BSR3; Match level="QueryCoverage=47%, HitCoverage=25%, E-value=3e-11, Identity=45%"; Hit description =Putative uncharacterized protein
MGPVCQTRRDPSWEDMCKKKLLAEKRKKKMEEAAQLGSVDGIINPPSPVRRHMKWKMARTKKKGEMTTKAAKEIAEKIDSFEEHATQGSFVPHGRQDVLTATIGRLEHPARVRAAGAGVTIKQYFGSAPRTSRSSSSLPPEELQQLTQQIRDQLEESITEKVTRQLMAFFS

SEQ ID NO: 97008 - protein, 59 aa, Glycine max
  Coding DNA Sequence Number=SeqID_5323
MVVGNAPIEKPREQWDEEERRRVQYNLKAKNIITSALGVNEYFRVSNSKNTKEMWDTLQ

SEQ ID NO: 97009 - protein, 115 aa, Glycine max
  Coding DNA Sequence Number=SeqID_5324
PQQQGPSLYDRTTKLKETLALFMQVSMSNQKSTEPAIKNLEVQVGQLAKQLADRPSSSFGANTEKNPKEECKAVMTRSKMVSMNEGEERIGAEKQQLVTEPTIDPVVEPLSETKE

SEQ ID NO: 97010 - protein, 164 aa, Glycine max
  Coding DNA Sequence Number=SeqID_5325
MLTRMSIHVAQLIADAIYIFAGLCQSFGVPVAPSKVIRPPITRAFIEKYCTQRQVQGDAPQAADAPPPHQAGPAGLFDTEQYLRHLVRQQAANHRAHSQGFTSFPCPTPDQFRAEVAWPGDWPEARAGEAPTEAPAEAPDEADEAREDEEMTDLLDFLGGSGAT

SEQ ID NO: 97011 - protein, 435 aa, Glycine max
  Coding DNA Sequence Number=SeqID_5326
  Gene Ontology: Mol. function=lyase activity; Cellular component=cell outer membrane; Biological process=intracellular protein transport
  Homolog annotation: Hit_ID=A7ZHR7; Match level="QueryCoverage=100%, HitCoverage=54%, E-value=0.0, Identity=89%"; Hit description=Outer membrane protein assembly factor yaeT precursor
  Pfam annotation: Domain name=Bac_surface_Ag; Domain location=77-435; Score=277.0; E_value=3.9e-80; Accession=PF01103.14; Description =Surface antigen
MEGAWLGSDLVDQGKDRLNRLGYFETVDTDTQRVPGSPDQVDVVYKVKERNTGSLNFGIGYGTESGVSFQAGVQQDNWLGTGYSVGINGTKNDYQTYAELSVTNPYFTVDGVSLGGRIFYNDFDANDADLSDYTNKSYGTDVTLGFPINEYNSLRAGLGYVHNSLSNMQPQVAMWRYLNSMGQYPDTTNDNNSFSADDFTFNYGWTYNRLDRGYFPTEGSRVNLNGKVTIPGSDNEYYKVTLDTATYVPIDDDHQWVVLGRTRFGYGDGLGGKEMPFYENFYAGGSSTVRGFQSNTIGPKAVYLPSTTSRDDYDTECASTESAPCKSDDAVGGNAMAVASLELITPTPFISDKYANSVRTSVFMDMGTVWDTNWDSTKYGGYPDYSDPSNIRMSAGIAVQWMSPLGPLVFSYAQPFKKYDGDKAEQFQFNIGKTW

SEQ ID NO: 97012 - protein, 28 aa, Glycine max
  Coding DNA Sequence Number=SeqID_5327
MNTRHSAFKLAKSHLFGTRMGTGVEVWK

SEQ ID NO: 97013 - protein, 140 aa, Glycine max
  Coding DNA Sequence Number=SeqID_5328
  Homolog annotation: Hit_ID=O82360; Match level="QueryCoverage=65%, HitCoverage=26%, E-value=9e-14, Identity=45%"; Hit description =Expressed protein
MHKKKKKKKQEVESLHNIDSTIKFGVREADGKHVSSRNPRIEKGFDASNVWNELEAVDASVKILYPTIQAGVDTVEIEWLLKTVEELCAGAEKLSQGNDLLAKGVDGFFEAVMTSRDTLLSSVRFDKTVNDRSPGRNRDM

SEQ ID NO: 97014 - protein, 153 aa, Glycine max
  Coding DNA Sequence Number=SeqID_5329
  Homolog annotation: Hit_ID=Q6L428; Match level="QueryCoverage=55%, HitCoverage=5%, E-value=8e-07, Identity=35%"; Hit description =Putative integrase, identical
MVEVPLSAFTKLNPWTFSNSDIHEDPQTFVDEGWYKTMRLVGPTRSPLLAWYEFVKLFLAYFLPQSVRDSRAREFETLVQTDQMSMEYNIQFMEIAAHGDMPYDQALNRALTIEAIVVEVLEMILIYIDETNMEDDYHRSLKLARLLVQPIVG

SEQ ID NO: 97015 - protein, 176 aa, Glycine max
  Coding DNA Sequence Number=SeqID_5330
MGDQEETQEQMKADMSALKEQMASMMEAMLGMRQLMENNMATTAAVSSAAEADPTLPATAHHPLPNAIGREGSKLGHISNPHLGYNQVAYPYGLPPNYMPPVMHDDAGHVPPLVLEGEPPRQSDEVHEDHREYAQVDVDFYPSVPVEGPAPNVLPQPNLPAQPIFLSTEGPPSTAK

SEQ ID NO: 97016 - protein, 156 aa, Glycine max
  Coding DNA Sequence Number=SeqID_5331
MVYHGHGEIYHDHCRMVGTVIEGSYAFIMVVLLTMFVIDSRSFDDNKDDDKKLKSQDHFMITKMMTFKNEFKIESRTLQGSRGNLIQGSRGNLISRIKNQNKRGYISCGSVLVEGTSTRLFKENKGGYIPRGSLLVKDFTRLKRNLKDHRSLGDWM

SEQ ID NO: 97017 - protein, 43 aa, Glycine max
  Coding DNA Sequence Number=SeqID_5332
MENKQFLIEQTWRSTQEHSNGINLEILMSHWRHLTTTFKLPHE

SEQ ID NO: 97018 - protein, 54 aa, Glycine max
  Coding DNA Sequence Number=SeqID_5333
MGKKMKGLRDEGGLLKRRELGERRGVLGSFSTIASGIMNIISKHQHMENWVNTR

SEQ ID NO: 97019 - protein, 126 aa, Glycine max
  Coding DNA Sequence Number=SeqID_5334
MACTHIPVGAKIFQNCPVCGTSGQCQDLHVILLKFQLARINLDLAPYASGPYNAQWNSPGLLHDRHMLRSSRILGEMEVDEPCDASSIGACRPRIFFINGFLCFLEDKWQRNGEGRERGDATSRRR

SEQ ID NO: 97020 - protein, 52 aa, Glycine max
  Coding DNA Sequence Number=SeqID_5335
  Subcellular localization annotation: CTP_CleavageSite=25; ConfidenceScore=5.12e-01
MVMSVTMAAAPALANPGNAPAKAITAAARASVRITANRITSIVISAIPPLAR

SEQ ID NO: 97021 - protein, 126 aa, Glycine max
  Coding DNA Sequence Number=SeqID_5336
  Homolog annotation: Hit_ID=Q5XM22; Match level="QueryCoverage=72%, HitCoverage=66%, E-value=5e-15, Identity=43%"; Hit description =Resistance-like protein HAAS-2
CTLFANKSATNVHVVFLEALRDLSQTERYAWGVAALVHMYDHLNNASINTSRQLGGYIMLLQCWIYEVFPSVVESTADPDYDEDSPHACRWIATKTTVKSILTPAYRERLYRLRIPNVCWIPYKEH

SEQ ID NO: 97022 - protein, 101 aa, Glycine max
  Coding DNA Sequence Number=SeqID_5337
  Subcellular localization annotation: CTP_CleavageSite=49; ConfidenceScore=5.33e-01
MVILRPLSFRSSESSDKRAKTNYGHSGSASRVINAQRQIMVILRPLSFRSSESSGGRRQIMVIPHTFSSSKGDCVQWHAETNYGSAGGEIDRPNGVSLERN

SEQ ID NO: 97023 - protein, 272 aa, Glycine max
  Coding DNA Sequence Number=SeqID_5338
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSPIDNDIGASEADQDDPNAYIARWQAAGLNQSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 97024 - protein, 90 aa, Glycine max
  Coding DNA Sequence Number=SeqID_5339
  Gene Ontology: Biological process=transposition, DNA-mediated
  Homolog annotation: Hit_ID=Q1J7G7; Match level="QueryCoverage=36%, HitCoverage=47%, E-value=1e-11, Identity=96%"; Hit description =Transposase
MVESWTSYVPINVSFRQKLAQGFPVSTGHQDLFILRSDLPSQVLQWLLFLSAVPPVQLLTGWCVTAKAPPDISAGKCSGHAARNHHTRRA

SEQ ID NO: 97025 - protein, 62 aa, Glycine max
  Coding DNA Sequence Number=SeqID_5340
MDAHPCQDDIHQLTLRQREVRVMIAGQDVAEQQCHPHLGQGGHAGAHDPHPPPGSSPGKIWT

SEQ ID NO: 97026 - protein, 132 aa, Glycine max
  Coding DNA Sequence Number=SeqID_5341
TTRPRLERTTCPRLERTTCPRHQRTTCPRHERTTRPRLERTGTTRPRLEGLRVLTIRGLHALTSRGLYVLALRGLHALTLGLALRGLHVLAIRGLHALTFRGLHVLAFRGLHVLTFRRLHALAFRGLRVLTF

SEQ ID NO: 97027 - protein, 322 aa, Glycine max
  Coding DNA Sequence Number=SeqID_5342
  Gene Ontology: Mol. function=hydrolase activity; Biological process =metabolic process
  Homolog annotation: Hit_ID=Q8GAW2; Match level="QueryCoverage=86%, HitCoverage=92%, E-value=5e-91, Identity=62%"; Hit description=5 -valerolactone hydrolase
  Pfam annotation: Domain name=SGL; Domain location=8-271; Score=144.5; E_value=3e-40; Accession=PF08450.3; Description=SMP-30GluconolaconaseL RE-like region
  Pfam annotation: Domain name=Str_synth; Domain location=100-179; Score=-4.7; E_value=0.0043; Accession=PF03088.7; Description =Strictosidine synthase
  Pfam module annotation: Pfam domain module=SGL::Str_synth; Domain location=8-271::100-179
MPQRELSVLASGYTFLEGLRWRDGRLWASDFYTGKVIAVDLEGRVEVICRVLEQPSGLGWLPDGRLLISSMKDRKLLRREPDGRLVTHCDLSALTGGPVNDMVVDELGRAYVGNFGFDLMAGEPFATTTLVRVDPDGVAQVVADGLWFPNGSFITPDGKTLIVNETFGNRISEFDILADGALGPRRDWAHFGALPESDDLSVLIEASAIGPDGGALDAEGALWVADAIGKRIVRLARGGEILEQIDTGELGIFATALGGPDGKTLFMAAAPDFIEAKPPRPARRADPGDAGGRAARRPPLAAGLLMGEAHGRGSGGRFSPGG

SEQ ID NO: 97028 - protein, 23 aa, Glycine max
  Coding DNA Sequence Number=SeqID_5343
MFNRDEEPNFSFYWQSDPTRYYE

SEQ ID NO: 97029 - protein, 112 aa, Glycine max
  Coding DNA Sequence Number=SeqID_5344
MRKTLDEVHCYQASRRPSMTTDSPPLLMFPWTRIKNGLTLLNKSPVELPTVATYPLAGGRREPHWCVFQGRKMHKIATNVYLRENVKKTGKVWSTNFNRERFGSCFYARGRY

SEQ ID NO: 97030 - protein, 65 aa, Glycine max
  Coding DNA Sequence Number=SeqID_5345
MLQPYGISIGLKEHSNPVTPKAYTLKSPSGSLPPDSGPHTRVLDMYNILRYNLGTYTISLTLVPK

SEQ ID NO: 97031 - protein, 49 aa, Glycine max
  Coding DNA Sequence Number=SeqID_5346
MPADNLIFVEPNDDAQSKEDLDDDDGDGDGDESDDIHGDDPIRGLDMLL

SEQ ID NO: 97032 - protein, 103 aa, Glycine max
  Coding DNA Sequence Number=SeqID_5347
  Homolog annotation: Hit_ID=A0ST23; Match level="QueryCoverage=24%, HitCoverage=51%, E-value=3e-07, Identity=100%"; Hit description =Putative reverse transcriptase
MEVLVASFDMKLYQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 97033 - protein, 131 aa, Glycine max
  Coding DNA Sequence Number=SeqID_5348
MSPTRHPLDLDKSNRALGFPALIMGLCQSFGVPITPSKYCTPSQAQGDAPQAAGAPPPPHQADPTGSFDTERYLQHLVRQQAANHRGQVQIHMCLYQPSISQQSQGFAPFACPTPDQFRAEVAWPGYWPEA

SEQ ID NO: 97034 - protein, 65 aa, Glycine max
  Coding DNA Sequence Number=SeqID_5349
MPISRNVHKEDEHSTTWMNLLSLFAKPICRLSEPSAERTTLETKRKEESGRRMSWTHALSESSSC

SEQ ID NO: 97035 - protein, 54 aa, Glycine max
  Coding DNA Sequence Number=SeqID_5350
MEGGASPPESALDKKLRKEAPMEEKNEIELWFNPVIQDQDSPLSVLRYHESCKA

SEQ ID NO: 97036 - protein, 111 aa, Glycine max
  Coding DNA Sequence Number=SeqID_5351
  Homolog annotation: Hit_ID=A5BP71; Match level="QueryCoverage=67%, HitCoverage=19%, E-value=4e-11, Identity=45%"; Hit description =Putative uncharacterized protein
  Pfam annotation: Domain name=zf-CCHC; Domain location=84-101; Score =18.9; E_value=0.0021; Accession=PF00098.14; Description=Zinc knuckle
MADKTCGYVSMNYYQYIDVVYTNEHILKVYSAQWWPLRNEVAIPPSDDAWTLIPDPTTIRAKGRPKSTRIRNEMDWLEPSEHRQKCSRCGAEGHNRRRCPMQSDHGSCSFN

SEQ ID NO: 97037 - protein, 50 aa, Glycine max
  Coding DNA Sequence Number=SeqID_5352
MEVIAAREEDLETKKKLQREKELQSDLQISRGKGNSTACSDTGEYDFKIQ

SEQ ID NO: 97038 - protein, 61 aa, Glycine max
  Coding DNA Sequence Number=SeqID_5353
MMRSIQMQEVMEEGEEIVGLGSSSSMDSFASWKMNGSGMEKEEREETPLQGEDESRRSSPP

SEQ ID NO: 97039 - protein, 61 aa, Glycine max
  Coding DNA Sequence Number=SeqID_5354
MVIYRKSHLGQGQLAQASWLLHPEGISSPRRAGYLRLKELTNNIKTLCDPLALHCNQCQTP

SEQ ID NO: 97040 - protein, 177 aa, Glycine max
  Coding DNA Sequence Number=SeqID_5355
  Subcellular localization annotation: CTP_CleavageSite=54; ConfidenceScore=5.19e-01
MHDAIKKQAKVSLLCVPNSRTKWKGSKSPLLVTTPKVTMHHQKRKTLDEASLLSSESETQHDHRSTFTPYGSHRPGYQLAKASWLLKAEGATSSSNDPLHGIGGLMTRSKTKRIKQSLQGLILMIKEKENQCELRVAPNWVTFLQIDEDSLKPTSRITKKHPWVELINFGGLLTLVD

SEQ ID NO: 97041 - protein, 131 aa, Glycine max
  Coding DNA Sequence Number=SeqID_5356
VAVSPTKPPQKPNPEVDDPLYLMRSTIPELFLRPYQVIWDATVFGVFNLDFPLYIKHKNLSIAHGGQCLSISVLQLHLTETSMQVGNSDIYGFLEPQPILRSGQSQFETESYIKSWMQSSKHDVYLGAYLN

SEQ ID NO: 97042 - protein, 67 aa, Glycine max
  Coding DNA Sequence Number=SeqID_5357
MAGSGQQMHCHHLLSSPQLIHKKVRALLTTHDRPIGDQVQSQRTHLVAHDPGNLNKTSASSEGRKIP

SEQ ID NO: 97043 - protein, 64 aa, Glycine max
  Coding DNA Sequence Number=SeqID_5358
MVSGNRLPRECNRLPGLKTRLRNGTGKLWRPLVIDYQSVQSITQRNRPLVIDYQIVMAAQLIHD

SEQ ID NO: 97044 - protein, 32 aa, Glycine max
  Coding DNA Sequence Number=SeqID_5359
VRPYAEIQRKGFLALCGDPRKGFRPYAEIQRK

SEQ ID NO: 97045 - protein, 112 aa, Glycine max
  Coding DNA Sequence Number=SeqID_5360
MKIQRLTKPGSWFYQDSFGFLREIKRLQCEGFSYKLKHDFEIPNSENAQNWVVNLVFQFHDDPTVNKSEIVIFLRQGCLTDYPSERQFDECLKKFKMAYSPWPMFVDYVKET

SEQ ID NO: 97046 - protein, 48 aa, Glycine max
  Coding DNA Sequence Number=SeqID_5361
MPGLSTDIMQHRLPLNPECSLVKQKLWRMKPEMSLKIKEKPKLLNLDP

SEQ ID NO: 97047 - protein, 231 aa, Glycine max
  Coding DNA Sequence Number=SeqID_5362
  Gene Ontology: Mol. function=chloramphenicol O-acetyltransferase activity; Biological process=response to antibiotic
  Homolog annotation: Hit_ID=P62577; Match level="QueryCoverage=69%, HitCoverage=73%, E-value=3e-93, Identity=100%"; Hit description =Chloramphenicol acetyltransferase
  Pfam annotation: Domain name=CAT; Domain location=6-179; Score=313.9; E_value=3.1e-91; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVAIWTTSSPRFHHGQILYARRQGADAAGDSVVLLHVFPGWTQDDSYRIRRSGRTERGVRAYSPAWSELPTRN

SEQ ID NO: 97048 - protein, 57 aa, Glycine max
  Coding DNA Sequence Number=SeqID_5363
  Subcellular localization annotation: CTP_CleavageSite=48; ConfidenceScore=5.24e-01
MVSAASMASVKFPKTLENPSRGASITLPRHSVSDFVEILHRSSPFFVRSSSFFDLQP

SEQ ID NO: 97049 - protein, 249 aa, Glycine max
  Coding DNA Sequence Number=SeqID_5364
  Gene Ontology: Mol. function=chitin binding; Cellular component =extracellular region; Biological process=chitin metabolic process
  Homolog annotation: Hit_ID=UPI00006A17C9; Match level="QueryCoverage =53%, HitCoverage=100%, E-value=1e-13, Identity=32%"; Hit description= UPI00006A17C9 related cluster
LLWCFALRLPGDAVLLDESSISRGPDALAGGDRPVTRAGNPRALLDYSGSTGCLVGAIPANNRWGRLALRSLGRILLSSNVIYIYVRVVMLVRMIHTRLFAAHGTLNSLKVWMWSTLKMRTRSPLKVRACSPLRVRTCSPLKARTCSPLKPYEGEDAQSSEGEDVQSSKVRTHSPLKVRTCSPLMVRTCSPLKVRACSPTKVRECSPLKARACSPLKARACSPLKARTCSPLEVRVCSPLMVRTYSPLK

SEQ ID NO: 97050 - protein, 81 aa, Glycine max
  Coding DNA Sequence Number=SeqID_5365
  Subcellular localization annotation: CTP_CleavageSite=39; ConfidenceScore=5.31e-01
MASRKRARADDIPSSSTPAPPSTTTGLDVQSSQTLVPMLQSLFQGQVIIMHNLRELAHQRPIMTMEQFLEQVAWPGALPSM

SEQ ID NO: 97051 - protein, 132 aa, Glycine max
  Coding DNA Sequence Number=SeqID_5366
MERSIIDAASGGALGDMTPAEARNLIEKMASNSQQFSVRNDAIVLRGVHEVATNSSSPTENKKLEGKLDALVNLVTQLAMYQKSTPVARVCGLCSSADHHTDLCPSVQQPGAIEQPEAYATNIYNRSPQPQQ

SEQ ID NO: 97052 - protein, 115 aa, Glycine max
  Coding DNA Sequence Number=SeqID_5367
MTGDASDFTHISPKKSGHVTYGEHNKGRILGVGKIDILGHYLLHIKVIHSKHLENLLKSYKTRKISRLHPLEVIMGVNLKIKILNYFVSGNGIEHNSFGTKTQLENGVVERKAQP

SEQ ID NO: 97053 - protein, 130 aa, Glycine max
  Coding DNA Sequence Number=SeqID_5368
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=47%, E-value=3e-22, Identity=100%"; Hit description=LacZ protein
MGFHPTKLNFVPSDADEAPLDVSICLHAFGIVGCGSFRSNSCSPGDPLVLERPPPRWSSNSPYSESYYNSLAVGGLQRRDWENPGVTQLNRLAAHPPFASWRNSEEARTDRPSQQLRSLNGEWDAPCSGH

SEQ ID NO: 97054 - protein, 397 aa, Glycine max
  Coding DNA Sequence Number=SeqID_5369
  Homolog annotation: Hit_ID=Q6WAY6; Match level="QueryCoverage=89%, HitCoverage=64%, E-value=2e-27, Identity=27%"; Hit description =Putative uncharacterized protein
AKVLASQGEWAPFMDILTLLIFGVVLFPNVDGLVDRAAIDAFLAFHDRKESPVVAILSDLYDTFDRRCEKNSARIICCTPALYVWLVSHLLRQEGASVNWFPRWKEGRTRILISCRGFPNVPLMGTMGCINYNPILTMKQLGYPMRGAPLEEGLTPIIARGFNSTNAGVLQKVHKAWELVQKKDKELRGSSNGPIGGYQRWLKAYTQGLDWLPNLRTTKGMEVETPEEDEEIQALKIELEKAQTVKKKFKLVAVRIQKENAELRDVNIATTKALEQETKRARALWGSNSELKLRREERDQSRVDSLILKDELRVCLRSKRSLSQRLCETETNMLAIISKYQEELNLATTHEHKVEDEYARVYAEKEARGRVIDSLHKEATMWMDRFALTLNGSQELP

SEQ ID NO: 97055 - protein, 96 aa, Glycine max
  Coding DNA Sequence Number=SeqID_5370
  Subcellular localization annotation: CTP_CleavageSite=29; ConfidenceScore=5.03e-01
MKKRLSFELQNVAVGLSSTIGLSAYPPLSAASVRLAQRRIWQSINIKAAVQLSTAFAHLLGQRAEWPGHRIPEQPQAYLGKRALEAEKRSSLCIEA

SEQ ID NO: 97056 - protein, 357 aa, Glycine max
  Coding DNA Sequence Number=SeqID_5371
MQQIAAKLHRAVVEVKSVAVIAKAAVAFVFQIRADVAQEHLTAITRRTRLLVTQFAETLVQVIDNRGGVIGEANRCRCPRTRSSLPAGSPSNCCRCRSAGAAPDRCCPARSCTAAVLASVAAHLRQRNAFVALNAAVAVEIGERRAACRIKPDVKQRGAAGVTADVDVVGELVAQRAAVIQAGHQIRLTAHRRQRAVDVQRIARRTAAIGEIQRAAVIHLQRIRCAARQRGMHVVTGIQRRAPINVDAAVRQLQIVGQRPAAIREVNDAPAAAEVNAFAQVIRAEAAAARRNLVKGQAVTGAVAAGEMVSSAEIDAADVGKIVVVCAHGQAAVERAAGPAERIAAATRINVAQHVTL

SEQ ID NO: 97057 - protein, 55 aa, Glycine max
  Coding DNA Sequence Number=SeqID_5372
MAAEWRWKKDDWRRHFKEKMSQEETHHHRKPYPLIQPQVQDSTLSVLRCHEACKA

SEQ ID NO: 97058 - protein, 61 aa, Glycine max
  Coding DNA Sequence Number=SeqID_5373
MPNPLKQPCTIFLVSIAAFCTKGAVLVCFLLQLVLYACDACQVTPKPLTFDIEAVTWIEVG

SEQ ID NO: 97059 - protein, 121 aa, Glycine max
  Coding DNA Sequence Number=SeqID_5374
SSNPSSFGSLRLELKAFHVYVAEPTPGPTPDYVELAGCGPIVTSYERGGVSKKAGEASVAQEPQPDQEDDSSEATPTPPKPFIFEDDPVTAEGTQLASPASTHALDLNKEAMDHDPPPPQD

SEQ ID NO: 97060 - protein, 57 aa, Glycine max
  Coding DNA Sequence Number=SeqID_5375
  Subcellular localization annotation: CTP_CleavageSite=19; ConfidenceScore=5.47e-01
MNSLSRHAALTKPASLAKRASLAKPPCLFSLNKPGLSESVSLSRRHFSVLKSCSCAK

SEQ ID NO: 97061 - protein, 104 aa, Glycine max
  Coding DNA Sequence Number=SeqID_5376
METCPAVEELLQRLIDWGQLEVSEGDREEPQICMQSEERKVPPTPKALVICFTRNVTGSRSKYPPTVPKPTPFSYQSNKVVPWKYTPPAFGERAATEVDSLSAK

SEQ ID NO: 97062 - protein, 318 aa, Glycine max
  Coding DNA Sequence Number=SeqID_5377
  Pfam annotation: Domain name=Transposase_23; Domain location=45-113; Score=-12.2; E_value=0.025; Accession=PF03017.5; Description =TNP1ENSPM transposase
MQSQFQSQMQSHILALPPELKVGPSAARVNTKESCVDPSRNDPNMSDSDKCRLYIEENPPRLVALGRVYDGSTTIHNIPLLHYQVKVGVEKVKDTDAPFPVPTDEVIWDATVFGVFNQDFPLYIKHEDLSQIAHGGQCLSISIIQLWILHLTETSMRAGNSDVYGFLEPQSIQRSGQSQFESKRYMKNWMQNSKRDVYLGAYLNGPDNYLKGIINRLVLFFNIFALALLNNINILMFLVFNNALKGLDDTPQPKSKVGARWIVVKCIRQKGSTRCGYYVMHWMSTIILESFKNNWETTIGSIEIEGVSHPVGTILSQS

SEQ ID NO: 97063 - protein, 83 aa, Glycine max
  Coding DNA Sequence Number=SeqID_5378
  Subcellular localization annotation: CTP_CleavageSite=50; ConfidenceScore=5.20e-01
MSGFTSDSPQISASPHQLDFAPYASRSYSAQWNASRLLLDKHTLRSSCILGKMEFEEPWLRLWLPLNYRVTMGASHHRIPELG

SEQ ID NO: 97064 - protein, 113 aa, Glycine max
  Coding DNA Sequence Number=SeqID_5379
  Subcellular localization annotation: CTP_CleavageSite=67; ConfidenceScore=5.16e-01
MSFKESTPLCTRIGSLYGWTEGLSQTRFNSFFAGIPGSSSREEKRKRNSLLSSYSFSLPCGGLSGVYGGSDQSREEVFSDLPLRKQVGDANLWFLCFNRVPIAWMRLKASRLL

SEQ ID NO: 97065 - protein, 51 aa, Glycine max
  Coding DNA Sequence Number=SeqID_5380
MAEEDEMATMMEAMMSMKKIMEVNAAAVATISTVSGVDPVATCLVTMISTL

SEQ ID NO: 97066 - protein, 96 aa, Glycine max
  Coding DNA Sequence Number=SeqID_5381
MSLATLFGKLREHEMELMRLNQHEENDKKKKGIALKASSSIHEESDKEELNEHNNIEEDDDFSLFEIEEDKTSVERGKEKIPPQFQNAMNAINLGT

SEQ ID NO: 97067 - protein, 201 aa, Glycine max
  Coding DNA Sequence Number=SeqID_5382
  Homolog annotation: Hit_ID=Q3JKW7; Match level="QueryCoverage=92%, HitCoverage=10%, E-value=1e-21, Identity=32%"; Hit description =Putative uncharacterized protein
MVDVAGLGVFVAGAHHVIDAHAGGKLAKLLARAVIKNIDVEFILRPVDTQRSIDGGFDHAERLVVGRHQNIDAGPAGDLRRHGDRLAVERPQRLEIAQHQYRPRVGFRANQQQAKRQAERIVPVKGFRIAPPQIAAGDGERQHDQHDGHQPARHTAHQHGQRPQQQHKHKLRGDIKRLRDAQQRQQAGGDRHYDEQQLTHA

SEQ ID NO: 97068 - protein, 131 aa, Glycine max
  Coding DNA Sequence Number=SeqID_5383
MGEVEEVQKQMKADMEAMKEQMATMMEAMMSLKKIMEANVVAVAATSVVAKVNLMPPSGLNQMNHPTSAMVGKDLGNDDKGDEQKAQRSKNNSSESKNISSESRTSQKFKNQEEFKIHDLKNQDSRLKIQE

SEQ ID NO: 97069 - protein, 82 aa, Glycine max
  Coding DNA Sequence Number=SeqID_5384
  Subcellular localization annotation: CTP_CleavageSite=40; ConfidenceScore=5.20e-01
MTVRIFPLDLMMKYAQFQLSLAHQWAKRASIAKRSFSMLSATEESGRASIARSCAKHEVSVLSATVVFSQAQRTTRAKAQTS

SEQ ID NO: 97070 - protein, 158 aa, Glycine max
  Coding DNA Sequence Number=SeqID_5385
MSDGFCGTHLQIMVRTRGLGRALGQVTGRGVGRGDRDDSDDAPQRRRPTASAWRQRVAVTADHVDEPVIPAPDVQDDPMEAPATVEDIPTDTGAEAAEDEHQGFPGGPSDPSVLTLYADHVACSVWTGDERPELKLSSHGRKVHSLGRPVPAIEGLLV

SEQ ID NO: 97071 - protein, 302 aa, Glycine max
  Coding DNA Sequence Number=SeqID_5386
  Gene Ontology: Mol. function=ATP-dependent helicase activity; Cellular component=nucleus; Biological process=embryonic development ending in seed dormancy
  Homolog annotation: Hit_ID=A6T4T7; Match level="QueryCoverage=88%, HitCoverage=33%, E-value=1e-116, Identity=81%"; Hit description =Helicase, ATP-dependent
  Pfam annotation: Domain name=DEAD; Domain location=38-201; Score =15.4; E_value=3e-06; Accession=PF00270.20; Description=DEADDEAH box helicase
MSGAPVNNLFLYRFRQFKSEKQPFRLGHDRDSPFVSSLPVAAILPELLSALQQAPQVLLNAPTGAGKSTWLPLQILADGNIDGRIILLEPRRLAARNVAQRLAELLGEKPGETIGYRMRAESCVGPNTRLEVVTEGILTRTLQHDPELSGVGLVILDEFHERSLQADLALALLLDVQQGLRDDLKLLIMSATLDNDRLQRLLPEAPVVVSEGRAFPVERRFAPLASHQRFAEAVAIAAADLLREEQGSMLLFLPGVGEIQRVQEQLSERVASDVLLCPLYGALPLSEQRKAILPAPAGMRKV

SEQ ID NO: 97072 - protein, 347 aa, Glycine max
  Coding DNA Sequence Number=SeqID_5387
  Gene Ontology: Mol. function=motor activity; Cellular component=cell projection
  Homolog annotation: Hit_ID=UPI00006A2D9E; Match level="QueryCoverage =46%, HitCoverage=85%, E-value=3e-13, Identity=15%"; Hit description =UPI00006A2D9E related cluster
GLHVLAFGGLHGLAFRGLYVLAIRRLHVLAFKGHHVLTFRGLHTLIFRGLYILPFSGLHALAFRGLHVLAFRGLHVLTVGGLHALAFRGLHVLAIRGLHVLAFVGLHALTFRGLHILTSRVLLVLAFRGLHALTFKGRHVLNFRVLHALAFRGLRVLSFKGLHICTLREFKLLCIPGQDFTRAAAKRQVRIVRTNMTTFAQICMTLLLSNILPSDRNADLPLRKGRAHKTPSGPGEVQQGPGVSSSGYGPLSVLQGARTPRQGYPMDPKKSNRVLGLPALITGLCQFYGVRVTPSKVIRPPTNRAFIKKYCAPRQAEGKTPQQPGDGQQQATNAPSPPPEPLSSSIK

SEQ ID NO: 97073 - protein, 91 aa, Glycine max
  Coding DNA Sequence Number=SeqID_5388
MKTKARSRITDNIVSEIKPEAPYQDDELVGLQEVLELDPDVINESLANVDGGGEEIDANLLKQLDLVEPDEDECMLSEKDIESDFDDTYTS

SEQ ID NO: 97074 - protein, 89 aa, Glycine max
  Coding DNA Sequence Number=SeqID_5389
  Pfam annotation: Domain name=zf-CCHC; Domain location=20-37; Score =29.7; E_value=1e-05; Accession=PF00098.14; Description=Zinc knuckle
MERSHNFNNGKRSQDVSPTLKCYKCNQPGHIKANCLSNESWPEKNEKKSYKERRSKKAYIAWDDNDSSDGSEKEINLLSKDYESDENDS

SEQ ID NO: 97075 - protein, 68 aa, Glycine max
  Coding DNA Sequence Number=SeqID_5390
  Homolog annotation: Hit_ID=A5BEV8; Match level="QueryCoverage=94%, HitCoverage=8%, E-value=9e-09, Identity=40%"; Hit description =Putative uncharacterized protein
MFVDYVNQTWIIPHKEKFVKAGMNEIMHLGNTTTNKVESTHWALKRLLQNSHRNLCSVWEAMNNMITV

SEQ ID NO: 97076 - protein, 136 aa, Glycine max
  Coding DNA Sequence Number=SeqID_5391
MGYIQTVPPPPIHDSLTDHVVPTGELCVVPGQVAPDYMEWTLLSRDLRPPPTHDDDFVEPPVAEVPVASNLPTHFVVDCTACIRIGRIAEHLERVINLRMVTEGTDLYDIMDLCLRIARDDDPDDSLRPRQRPRID

SEQ ID NO: 97077 - protein, 55 aa, Glycine max
  Coding DNA Sequence Number=SeqID_5392
MSTHHILGLKKVPRVRLFADSSGTENCEEPTLVREDWVGPTYGVPVVMPIAAPGC

SEQ ID NO: 97078 - protein, 121 aa, Glycine max
  Coding DNA Sequence Number=SeqID_5393
MAPPMVKREMITMMVDTLPVFYYEKLVGYMPSSFVDLVFAGERIEVGLKRGKFDYVSSTSTNARRIEATGEKGRKEIPMPSLQRLHRSSHSDLSRYPSVLATSPELLSSCRGLSQLSTHKS

SEQ ID NO: 97079 - protein, 48 aa, Glycine max
  Coding DNA Sequence Number=SeqID_5394
MTKNERRTVENLREITHGNENRGGACHPARLGELGCFLQKQPPSGGTS

SEQ ID NO: 97080 - protein, 58 aa, Glycine max
  Coding DNA Sequence Number=SeqID_5395
  Subcellular localization annotation: CTP_CleavageSite=31; ConfidenceScore=5.04e-01
VWIDKDLASQRSLLSVATCPFCGRAKARLTGAFSKGGKMRGVATNVYLWKMSGKPKET

SEQ ID NO: 97081 - protein, 62 aa, Glycine max
  Coding DNA Sequence Number=SeqID_5396
METLQKYVGLEGFWEPGAERNEEKNYIHVHELKLKVGNWGWCAYAWACGNGIFALCHCPTAT

SEQ ID NO: 97082 - protein, 128 aa, Glycine max
  Coding DNA Sequence Number=SeqID_5397
  Pfam annotation: Domain name=zf-CCHC; Domain location=97-114; Score =12.2; E_value=0.022; Accession=PF00098.14; Description=Zinc knuckle
MFKQGMTTKASRPQIELMRLNQHEENDKKKKGIALKASSSSIHEENDKEDSNEKNLEEDDDFSLFVKRFNKFLRNKGNQRRSNFNPKKKGEDSSLVPKCYECDQPGYLRFDCPVFKRRMKNPTRKIQR

SEQ ID NO: 97083 - protein, 102 aa, Glycine max
  Coding DNA Sequence Number=SeqID_5398
MERFEELRMSLLVDGLTKATMDKWMDITDMVHVIASRIDLTLFSHVQQVYLKEHCPLPPVALLWSSNCHPQAKSWPNPYISRMQHYKSFVMFKRDYVDINDD

SEQ ID NO: 97084 - protein, 61 aa, Glycine max
  Coding DNA Sequence Number=SeqID_5399
  Subcellular localization annotation: CTP_CleavageSite=25; ConfidenceScore=5.57e-01
MHPKITSPKLSLGLNKPRPPSLNPNQSTSKTSATCARYTFLSSGMELLHRISDEEPLKLPL

SEQ ID NO: 97085 - protein, 58 aa, Glycine max
  Coding DNA Sequence Number=SeqID_5400
MCETINKWNAELLAKANKEKILEEKMLQMMENHDHQNGTDHHVNDAQVDHPHDMENDH

SEQ ID NO: 97086 - protein, 76 aa, Glycine max
  Coding DNA Sequence Number=SeqID_5401
MATVRTSPSDEAISDDRANPSSLSSEKISSKDPSILPLLFLHLQEWRRKKDYWRRHFKEKMSQEEAHHHKKPWIRA

SEQ ID NO: 97087 - protein, 219 aa, Glycine max
  Coding DNA Sequence Number=SeqID_5402
YARNGYGQHFADTVATQREEGRSRNWRDASDVYSFYFTYFLEDMKEKDLWLEFKKWGDVREVFIAKNKNRNGLKLHANLPKHGREWKMKEKTSNNYQHKKWPLKENLVDTETCADAKNDLPLADPTSYTHGIEDMVRQCLDIKPRYLGDDMVLLMSLTDTRAEEICKEEAKNRSSMFHSLEKWNLNLKPVFSIKKIVTGIGEVVDIDDDVEDIHPRTEH

SEQ ID NO: 97088 - protein, 195 aa, Glycine max
  Coding DNA Sequence Number=SeqID_5403
  Pfam annotation: Domain name=GRP; Domain location=113-194; Score= -24.3; E_value=0.024; Accession=PF07172.2; Description=Glycine rich protein family
KREWFCFGGHALMKCSVSGRRGRGGVPAEGTRGARLEPLVDALRVEAVAALRNAPYRLLGKILAQANRARALVVGPGQALALSDHDLGPVAGLDGGLLQAQDHNTRPIRRVTKTAVIIVVVSLVSVDVVVVAASDDAAVGFDTDAGVGGEHDGGDQDQDAHGDGNAVAEAPASCGGGGGGWQSRRGHEGKRERGN

SEQ ID NO: 97089 - protein, 160 aa, Glycine max
  Coding DNA Sequence Number=SeqID_5404
MKAKIDEPKRSSPREETSGVVTNVYLRKMLEKPKRDKGVALAPTYPQKKRLTMIDGEDECGQNNKGGPLKVHRSHSNLKNKTNRWSHKGHQTRNDVGIGHSHDSAKGHFGAVAAHPGELKLNPAVLFGGPGKPDASLGELGQEKSSKDPFAPFLGILLYY

SEQ ID NO: 97090 - protein, 244 aa, Glycine max
  Coding DNA Sequence Number=SeqID_5405
MSEVDEVQERMKADMEAMKEQMGTMMEAMMTMKKIMEVNAAAVATVSAISGVDPTPPSGLNLINHPTTNTGDPHFVQVQNKQIFLPYGLPPNSTPPNENVNNSTPILIKSQQPQSDHAHVSQPMGETHEMPHHNLADFEPCLGYAIEGQKVCGIPLHNTLEGPEYHPQPHLLHSIMGKNPHAMAELGKLDHLEERLRAIKGGGDYAFANLEEFFLVPNIITPPKFKVSDFDKYKGTTCPEPSKD

SEQ ID NO: 97091 - protein, 85 aa, Glycine max
  Coding DNA Sequence Number=SeqID_5406
MVGYVPSSFVDLVFAGKRIEAGLKRGKCDHPALINEKTGANEEDENEERTHVVAAIPTWPNFPPAQQCHRSANIGPSHYPPPSHP

SEQ ID NO: 97092 - protein, 64 aa, Glycine max
  Coding DNA Sequence Number=SeqID_5407
MKKQQWKRSGRQRKRGERRRHPLRNKPWKKELHHQDEPWIRSLERMLQWRKRKRERKREGGARN

SEQ ID NO: 97093 - protein, 313 aa, Glycine max
  Coding DNA Sequence Number=SeqID_5408
MGNHHSRKLERPAYRSPQGFLASPSAGSYTGIQPPISAAASSHRTPGSIMGEDHSNQNWLPGSRKRSCPSMRVKSAPTSSMRSPHPSEEEDSLSEAPQRVSLYEELPIEMTSRSMMGCSHEPAELVPPSPMAELDRSTFGSWRKKKGKPKAIKHKSKQGSKKTMNNGPNSNVRELDKPHRLAILTLVKVVTPDTGQYSSILGGLTNSSPFACQDYCPEHQTNFFDTGQYLSVLGNIFHPQASSKLEGLMYCPRPTKSTWHPTWQSETRVNLPCQPCYRSANVFEYFIYWQVSSNHSTRLAHTLSTQQQLIFNI

SEQ ID NO: 97094 - protein, 89 aa, Glycine max
  Coding DNA Sequence Number=SeqID_5409
MTLGSATQECRLAENARLQCLQSWLSWQGPVLSLRLSEQGHSAQQMPQGISLGAGDPWLSGRPINKKLLLSYPGLANQPRLATGTVPGG

SEQ ID NO: 97095 - protein, 507 aa, Glycine max
  Coding DNA Sequence Number=SeqID_5410
  Homolog annotation: Hit_ID=Q1RU36; Match level="QueryCoverage=28%, HitCoverage=46%, E-value=7e-07, Identity=30%"; Hit description =Putative uncharacterized protein
MRLSPRIGPNMSVRSSLSTPAIAGYEWLALGEASEPRGLLCLFEVLGVILPLIAFKCALLEHLNVAPSKLHPNSWAMVRAFEILCPFFNVRPSVSVILFFFQIKLLGKIGWVSLNNVSKKLFEFESNVFHHIKDHLFKVLATNVVADGMPLMFNRDGEPRFPFYWQSYPTRFKSYDEDLLTLVERVNKAILEQLPASLDVWVIQSLPSVIDPLATLDGITNDFSWRRLVMQVEPVVGTMPLSVATPSIGEGGQTAGEVGPVVVVAEVAPSALSSALVKRKMDDVVQPLGRKKSKDPMSLRSLRQAAIEAPIAAIVVANPAPSPPPMAFVQEAKSVMVLSSTIAAPLLSAGEATTGALPMLPPSSSTLVALPDVVLASMASPSSSPHLPRSFEFGNYEGEWTATPIGGAKVYILGGGGRQVEGYCSDFVAEKMDLDGKVKSMVAEKDELTKRITNLEAQIRESESKLKESELRAVKEREASKELEEELILYKKKIMEQYEKGFLKVIR

SEQ ID NO: 97096 - protein, 54 aa, Glycine max
  Coding DNA Sequence Number=SeqID_5411
MMTTKDDDKGDEHKAQRSKNNSSESRTRVQESRRIQDLKNQDQDSRMKKRLNQD

SEQ ID NO: 97097 - protein, 522 aa, Glycine max
  Coding DNA Sequence Number=SeqID_5412
MCFDGHRRRKWKAATQSTTNKANQTLQILTTRWMVKTKRHLGVLVDGGIEIGEEIEAEEWELQIDTPNWQFGVRSRQISLILYPSPPLFWVIEEILNPTSNPVNKEEIDAEERAVDEGQGAAEQSDDASDRGGLVKSRMTQSHLRFDFNLIKGLVLPNQCGDRSADLLSSSSDDYEEADLGFCKNVYQGRTLGFGDVSTKGALSELVPLSPQWPLGRGKPQHPSPRSPMIPRDSLLRGPGNAELAQGLDPEFYSNLYDPEDKSPKLVRVRGKMIKFDAVFLNAFLEKPSIIQPGEQGALKAPEEGSDDTSPDMDHEDGHGRGLDYLKPDLTDGLKNCWNLDDPTIVFPGTCKARARGSEGSSSSASLAPASTPLAPSAPAPPPSTLVPAPFSTSMQSSDVLVPMLQSLHHDLCLVMLSIHNLAQHRPIMSMEEFTTQEPQLEPWPQPKATPETTPQTSSVTTPGVEVSDEEYGAADIDYVADMVVAQNTWDPWPVTAKDIPQPAQDAPSLPQDEPTAAQEEP

SEQ ID NO: 97098 - protein, 273 aa, Glycine max
  Coding DNA Sequence Number=SeqID_5413
  Gene Ontology: Mol. function=hydrolase activity, acting on glycosyl bonds; Cellular component=beta-galactosidase complex; Biological process=carbohydrate metabolic process
  Homolog annotation: Hit_ID=Q5CCP8; Match level="QueryCoverage=34%, HitCoverage=11%, E-value=1e-40, Identity=74%"; Hit description=Beta -galactosidase
  Pfam annotation: Domain name=Glyco_hydro_35; Domain location=83-271; Score=-125.7; E_value=4.2e-07; Accession=PF01301.10; Description =Glycosyl hydrolases family 35
MAQGISMRGVPRSLLKSGSLATCSTVSCDQYVDPAIIISSAMKTTNTTKDGTNNQGTPKWIEVKSHAQSGGYECGYYVMHWMWSIVSGGLKNDWSMSHVQSGGYECGYYVMHWMWNIVSGGLKNDWSMWFLDGTTLDNETITTIRQKWAMTNKVGKEIFQRAGELNVSKLQGAAGQNYVNWAAKMVVEMETGVPWVMCKEDDAPDLMINTCNGFYCHKFTPNRPYKPMIWTKAWSGWFTEFGGPIHKRPVQDLAFTTARFIKHAMQIRKRIYD

SEQ ID NO: 97099 - protein, 220 aa, Glycine max
  Coding DNA Sequence Number=SeqID_5414
  Gene Ontology: Mol. function=phospholipase D activity; Cellular component=cytoplasm; Biological process=phosphatidylcholine metabolic process
  Homolog annotation: Hit_ID=A2Q468; Match level="QueryCoverage=31%, HitCoverage=8%, E-value=2e-19, Identity=71%"; Hit description =Phospholipase D/Transphosphatidylase; C2 calcium/lipid-binding region, CaLB
MKDQELLKKLSSHLTLKSNNISWFYLYDDVQANADENPPRSKPVDNNMGKDFERNLALVYKEGPDHITTNTETFEERDRKQSGRNKGMGGEGEKHSFLQKAFMKGIGQSHSTDKRKISPPKKMTSIRTKQLMLILMQTFIMQLTKCICANGNPAYVTIKIDNQKFAKTSQEINRVWNQTFQIHYAHPADSCITITLKTSRSSVLGKFHIQTQQLLKKGEH

SEQ ID NO: 97100 - protein, 172 aa, Glycine max
  Coding DNA Sequence Number=SeqID_5415
MAPPKEIATIIYHNGYIVDDPFQGSIGAMETILQNPQLNSVEFYAVNELIPQPQSSSPQPSCPQLQLPPPQQLPYNNIDLNNPVSSYNNLESQDPFDIYTSYTQILSENDSFFHGQQTSFDQQNHPSSPFTPPSHYHKRKHQTEMNIPLLTKIPLYDFMMKTWMILLRMRIN

SEQ ID NO: 97101 - protein, 260 aa, Glycine max
  Coding DNA Sequence Number=SeqID_5416
  Gene Ontology: Mol. function=diacylglycerol kinase activity; Biological process=activation of protein kinase C
  Homolog annotation: Hit_ID=A7Q594; Match level="QueryCoverage=60%, HitCoverage=26%, E-value=4e-51, Identity=66%"; Hit description =Chromosome undetermined scaffold_52, whole genome shotgun sequence
  Pfam annotation: Domain name=DAGK_cat; Domain location=52-240; Score=- 22.2; E_value=0.099; Accession=PF00781.15; Description=Diacylglycerol kinase catalytic domain (pres
MNVQGLKTRFNESIGAKNIFYLSFMMCNGKFDDSVEFRVEGRGTRYETLELSAVVRQGLGDCHGDDGVDLFGIEVDGTTREFDKEIYRFICKGLDWTLKKWGEGGDGFFNEILNGFLSPRFKAPYPPTPSDFVHLVKDNDDSLVLDEDEIVDETSSRNEDQFPLISSPKQSGSRISNSNSEDKAAEFPLPNEWFRFGIIPAGSTDAIVICTTGTRDPITSALHIVLGKRVHLDIAQVVRWKRTPKSEVEPHVRYAASFSG

SEQ ID NO: 97102 - protein, 292 aa, Glycine max
  Coding DNA Sequence Number=SeqID_5417
MSVVQKPISNPNVVSTLLANPSLSVVCEAGAPGFGGSPGNAAIVDEEQVVGVSVGGGVDLNEFNGGNEKRISGEVVEAGGKEVIVGAFAGGGFWPRSAPVEDDDGGECDIEGGTDELGVVVVVDNECAEKVVRRRREGREGVAIYLVGEGGKEEVECFRGGERELERLGDDGRGATRDEVVREPCSVEGVSGFGGSSTVDVFLPYKFTANDGKMKLKAMIHSDIHPHISKGKIKSKNDPKNIKNINKEDFWHQTQVHSSNYRKRVKRKSTPTAIKRESRQGEKTPPRRLKAL

SEQ ID NO: 97103 - protein, 64 aa, Glycine max
  Coding DNA Sequence Number=SeqID_5418
MLNPTQLQAKEEKVQAADDSLSEADPLSEWHPLSEASSSISGWETLEEDKSEMCLPSMQLARLV

SEQ ID NO: 97104 - protein, 70 aa, Glycine max
  Coding DNA Sequence Number=SeqID_5419
TKEENVQAADDSLSEANPLSEWHPLSEASNSLSGWETLEDDKSEMCSPSAQLARPTRSLSLLALSAPTLA

SEQ ID NO: 97105 - protein, 106 aa, Glycine max
  Coding DNA Sequence Number=SeqID_5420
MASNDSDLQMKIIYGDVGYILEDTYPNPLRSNPTYSVVKLLFTRIDQEVNIVNVQSLSKRVSGPIFLESSIQCPWRVGLHHSLPHEKYLTSNPEVLETLGFFPKHL

SEQ ID NO: 97106 - protein, 79 aa, Glycine max
  Coding DNA Sequence Number=SeqID_5421
  Pfam annotation: Domain name=zf-CCHC; Domain location=54-71; Score =22.1; E_value=0.00069; Accession=PF00098.14; Description=Zinc knuckle
MGLKNQGSHLVHYVSHQGNQGAEKKFMKKHDKGKGPLKINEDSLQIQQKVSKDNNCQFCGKYGHFQKDCQKRKSWLKRK

SEQ ID NO: 97107 - protein, 279 aa, Glycine max
  Coding DNA Sequence Number=SeqID_5422
  Homolog annotation: Hit_ID=Q2HTA0; Match level="QueryCoverage=25%, HitCoverage=10%, E-value=7e-12, Identity=52%"; Hit description=IMP dehydrogenase/GMP reductase, related
  Pfam annotation: Domain name=DUF1723; Domain location=41-90; Score =54.3; E_value=4.3e-13; Accession=PF08330.1; Description=Protein of unknown function (DUF1723)
MLHIAYGLERKVEKFGRPIPKIEGIVAATGLTPLIACSVVTGNPGVISAFVKRWHKETSSFHLPVGELTITLNDVASLLHLPITGAFHSFKPLHVDEAVIMLVELLEISGEEARAETCWIYEHFPSVHDNVTDDGYDETSPRAYRWLTTMAYMKGLTASSYWTRIDALTITDVRLDGVSGDYMEWFFLISHPFITPTQAGDQPRHPHVPQHEAYVEPNIPEDACEAMAERLERVLNLRMVTEGTELHEIMENRLRIAMGVTSDGNVYVRVRRRWHTDHS

SEQ ID NO: 97108 - protein, 142 aa, Glycine max
  Coding DNA Sequence Number=SeqID_5423
  Gene Ontology: Mol. function=protein binding; Cellular component =anaphase-promoting complex; Biological process=regulation of mitotic metaphase/anaphase transition
  Homolog annotation: Hit_ID=A7PUT4; Match level="QueryCoverage=38%, HitCoverage=28%, E-value=1e-20, Identity=85%"; Hit description =Chromosome chr4 scaffold_32, whole genome shotgun sequence
  Pfam annotation: Domain name=APC10; Domain location=58-142; Score= -73.2; E_value=0.0053; Accession=PF03256.7; Description=Anaphase -promoting complex, subunit 10 (APC10)
  Subcellular localization annotation: CTP_CleavageSite=52; ConfidenceScore=5.19e-01
MLKHVEISQLAHSKTLLHFFFSFSSHPKSARNRSVDTHIAPHSFQYCRKPLAGTHITSYRRKVEENPTLLLELWVEENPRLLLEQSWLIVLYVVFKLDESYTPSKVSILAGDGFHNLKEIKTVELVKPTGWVYLSLYGADPR

SEQ ID NO: 97109 - protein, 280 aa, Glycine max
  Coding DNA Sequence Number=SeqID_5424
  Gene Ontology: Mol. function=metal ion binding
  Homolog annotation: Hit_ID=A9PIZ1; Match level="QueryCoverage=75%, HitCoverage=58%, E-value=1e-84, Identity=74%"; Hit description =Putative uncharacterized protein
  Pfam annotation: Domain name=zf-C3HC4; Domain location=111-145; Score= 10.2; E_value=0.0063; Accession=PF00097.16; Description=Zinc finger, C3HC4 type (RING finger)
MYPVGKIDDSRIIGEQGRVCRIFKFICDAIFRFLLLPRFLFLMNMTPVCPFVKAARPDDNNASKKSGENSMKHQAESESKVKKEVNDSASTSPKCPFGYDSQSFKIGPLSCTVCQALLFDTSKCVPCSHVFCKACISRFKDCPLCGADIVKIEPDANLQGVVDRFIEGHARIKRSVSADKGEEAAESKQVIYEDVSLERGSFLVQQAMRAFRAQNLESAKSRLNFCAEDIRDQLEKVGNTSELCSQLGAVLDIICVKGLCLKKNEEILNNYNISVASLTD

SEQ ID NO: 97110 - protein, 139 aa, Glycine max
  Coding DNA Sequence Number=SeqID_5425
  Subcellular localization annotation: CTP_CleavageSite=34; ConfidenceScore=5.32e-01
ASSGILPEEPLLPETSGRTTSSGNFRKNLFRKVSGRRLVTSGSTLLPEKVLPELPEEPLTGLPEDSAVDLFRHFFRRTLVFSPLVFYPKVTTLRLFAEKKLGSWCREEDESLARGVTEDQQEWKKKRSSSGLPRRGARF

SEQ ID NO: 97111 - protein, 204 aa, Glycine max
  Coding DNA Sequence Number=SeqID_5426
MKKGVATCTQHYCWGTQQIVKWRNCPSSIILPEEYPQTTSGRTSSGMFPEEGSSGIFEDLVIPCSVFEVLSVAVLPISSEVRNDHVRKTFFRKLLRPIPEEGLPKVFSGSTSSGIGLSNFRKTFFRNMDEDQWRYDFAMSQEVHMDYDYDNQEECGVNEPHVDCSNAFNTSQVFATRDDVLQWARTVAHENGFVAVIMRSDTET

SEQ ID NO: 97112 - protein, 173 aa, Glycine max
  Coding DNA Sequence Number=SeqID_5427
MSDIEEIQEQMKADMEAMQEQMTTMMEAMISMRKMMEVNTTTVVAASTTTEVDPTHPSGLNQLSRLVPDMVGQWGKVLGSMGGPHFAQVQSKHPFPPYGLPPNYAPPNIVHVLYENIDHSAPIPLESQQPQFGHAHGSQPMGETHEVPRDHTLADFEPYPGYAIEGQTFGGIP

SEQ ID NO: 97113 - protein, 165 aa, Glycine max
  Coding DNA Sequence Number=SeqID_5428
  Homolog annotation: Hit_ID=Q2AA09; Match level="QueryCoverage=96%, HitCoverage=52%, E-value=2e-08, Identity=28%"; Hit description =Retrotransposon gag protein
MERSMIDAASGGALGDITPAEARNLIEKMASNSQQFSARNDAIVLRGVHEVTMNSSSSTENKKLEGKLDALVNLVTQIAMNQKSAPVARVCGLCSSADHHTDLCPSLQQSGVNEKPEAYAANIYNRPPRQQNQQQQNNYDLSCNRYNPGWTNHPNLRWASPPKQQ

SEQ ID NO: 97114 - protein, 204 aa, Glycine max
  Coding DNA Sequence Number=SeqID_5429
  Homolog annotation: Hit_ID=A5CA85; Match level="QueryCoverage=65%, HitCoverage=20%, E-value=9e-14, Identity=35%"; Hit description =Putative uncharacterized protein
MTRGNPGDLQPFDPEIDRTFHRLVRHSVHPGHFVHFEHFEYSVVGDSEYSDFEHSTTNFHTENMAQPPPCERTLREMAAPDFTYEGLCIQYLDEGVPYVLKTGLIHLLPKFHGLAGEDPHKHLKEFHIVCSTMKPPDVQEDHIFLKAFPHSLEGVAKDWLYYLAPRSIFSWDDLKSVNVCIHDFDDVKEESNKAASNDKHLLQE

SEQ ID NO: 97115 - protein, 74 aa, Glycine max
  Coding DNA Sequence Number=SeqID_5430
  Subcellular localization annotation: CTP_CleavageSite=56; ConfidenceScore=5.22e-01
MWSSAPFPEMSASSSRDYFSLTPLSKELRQVFTLVVRRHSSPTTHEILLCWAGTIKFDSVWKRHGYPILSLSRH

SEQ ID NO: 97116 - protein, 137 aa, Glycine max
  Coding DNA Sequence Number=SeqID_5431
  Subcellular localization annotation: CTP_CleavageSite=5; ConfidenceScore=5.33e-01
MAVATCHEFANGNCNLPFGLKKLTTPLPSATCKKSGKAGLRMELASLTGVSSSKLASATGGLLAPCMGLRPKVPPWAFVIARYPGTASRYRVLFFAISRYREVRACKLQGAQGGDFQFVGVHVEANAFGVLMMIMMI

SEQ ID NO: 97117 - protein, 190 aa, Glycine max
  Coding DNA Sequence Number=SeqID_5432
  Subcellular localization annotation: CTP_CleavageSite=70; ConfidenceScore=5.27e-01
MASTLSTPSSDATSIVAPVIGSQYELYARSMPPSVVGQIGLPNMTPFIPPSRRSIMTKEPQPEVTIADLMNMKKMVEELTIDFIERFIKAGSHCSVQFPEVECAAMATRNMHSRLKEKLVAQETRISLVNVDEDNVEALEKEVEIMVVEILQGKTYSCLALEPTKNKGVAGDENFEYDFDISKAYQFSTI

SEQ ID NO: 97118 - protein, 129 aa, Glycine max
  Coding DNA Sequence Number=SeqID_5433
MAESSKKKKVQLQPPPLQTNAATTLLASEKDLILLWALQSGCQIDWAHLVWYRIHKALRENASLPYPQPFAAIASFGYQKDMDDQRVRKQDLPPTVPDERTPSPPPQRDSSSSLLHDALTELWDLWAFL

SEQ ID NO: 97119 - protein, 150 aa, Glycine max
  Coding DNA Sequence Number=SeqID_5434
  Pfam annotation: Domain name=Transposase_23; Domain location=89-147; Score=-6.6; E_value=0.0063; Accession=PF03017.5; Description =TNP1ENSPM transposase
MDRMKKTRQMTSEATKEIANKIASQGSFVAHGRQDILTVAIERPEHPSCVYATGAGSQMQSQGLALPLEAEVGPSTARVSTKENCVNPSGPPRLIALERVYEGSTIIHNVLLGNDQVKVSVEEVQDADARVPVPTQEVELVGQTLNTFLA

SEQ ID NO: 97120 - protein, 52 aa, Glycine max
  Coding DNA Sequence Number=SeqID_5435
MGHEINRKSMYLDSEWDVEQGPTPESSSSKCKSSVAIRVEHRSVWSNSSPKY

SEQ ID NO: 97121 - protein, 91 aa, Glycine max
  Coding DNA Sequence Number=SeqID_5436
MAAELEQQTVELSSLVTRPANDKSSDSRLFDELAELDVVACNSMIMGLAKCGEAHGGIGAFPQNVVTKGLAKSIYNGESVRCLCSLRSTST

SEQ ID NO: 97122 - protein, 145 aa, Glycine max
  Coding DNA Sequence Number=SeqID_5437
  Subcellular localization annotation: CTP_CleavageSite=47; ConfidenceScore=5.52e-01
MATPPSSPPPPTGAASQLPSTLKRTRKATRLRSLATRPVGAERPLVHVDPVTGKGDGPHIKKLRTYLGIVAHDKVDVTYENWKQVPANQKDLIWEDIQLNLISLKWALSADKESVDDTVCEKYDISKEKWTQFCQTRRHMAETSM

SEQ ID NO: 97123 - protein, 802 aa, Glycine max
  Coding DNA Sequence Number=SeqID_5438
  Subcellular localization annotation: CTP_CleavageSite=3; ConfidenceScore=5.29e-01
MAFAMMQSGSSDDSSRSVKRGDIVWVRVHFPHKWRPALVLSSRDNLGVQVTFSFSENDAVSPSPTFFVESEVVPFEEALPSLISRRNLDAPPLHSALRLLGLRVLSGLRCHCITGRAQAQQQPAREFDTVGVLGFVLDAAVSPWVEPAHFAHAVRVVAQVHAFRSYCSVKHRKMYKQNKKAGDNVKLLPSSSLSQKVHKVTQESVALESKEKCLIVSKNRETNITIGDIKRLNSTVPLWEGNSARLFENKNLIISQNLVHSRAIDPLYMVRESLKSARQSFLGFKNISDQGIVDICFEDFSNMSRTHISVPSNFMIHLRNYIDKRKDNALGLCWRLPDKETIIYLNRRKRRRLDKSASCNDFPQISEVQESERCADISTHTTPSISDIKMLEPEGSIQKDHQASTYVCETSMNFTEEFHKVDSKRIQSCESLSNLVHHFHSDKCEVDGSEAKAKGMLGSDSSVYQERLHMCCNRDTTPLNSKRSAKYILKLTRPRISDIKMLEQEGSIQKHHQASTSICETSMNFIDEVQKADSKRSQTCEPVSNLVHPFHSDKCEVDANAAKVKGTLESDSSVYQERLQMSCNSVTTPLKSKRSARTEISSGDCLVEGKDCYEGVASHSIFNSNVRQLSKTHVPFSPKALLMKFPKNFNLPSKEQLVKKFSVFGSVDSYRTRVFCYAGSAQVSFLQEADAVAAFKYAKKKALFGKANVRFWLDPFEHKRRGFNPSSKQTGQPLKSCLKNSNSLSKENRKKHHRVRFTISAPLPPSTSNQTGPPLKSCLKNSNSLSKENRKKNHRVRFTIET

SEQ ID NO: 97124 - protein, 83 aa, Glycine max
  Coding DNA Sequence Number=SeqID_5439
  Gene Ontology: Mol. function=transporter activity; Cellular component= integral to membrane; Biological process=transport
  Homolog annotation: Hit_ID=A7QAK8; Match level="QueryCoverage=85%, HitCoverage=21%, E-value=6e-21, Identity=52%"; Hit description =Chromosome undetermined scaffold_71, whole genome shotgun sequence
MMLGRSLTSILWGMISDRYGRKPVIIIGIITVYAYATEIFREEEQALGLSTVVAAWGVGLVIGPALGGYLAQKKPWILYMDIK

SEQ ID NO: 97125 - protein, 575 aa, Glycine max
  Coding DNA Sequence Number=SeqID_5440
MGVEIEGKILPDAERDGDTQMTSDRGGMEFDQQGLDEGITGILPDGMQHGLPELKQATIEKLDSSEGLVNETLTLGKWFNAGKSDRHDIGNTGLAPVIRKYSKLVAEQILAPFMDSSGDSVQFANESTQILLIGGNGSVYNSLDLGLLGFNSFAGNDVPQVLQLSLGEQTFGAFEQGFAVDLDVVKEYSGELAQEWLKECIHHGLKSLSLENQEAWSRSSKSSSIVDIEKRSFTEVDVIDDLLRRWKVSRCLEDGSKFGKDSFNGGYRKMLNLWGRNVCRPRSNVNVKLHKLAQMGESHSKSDSYHMTKLPTIQKIAIADHFTQGGSVFCGKIEKFGHTRLDEVMRASDKDAALAVVGGAPFVFAVVTEALLPTKSHFVGSALNKRGLGSGEMGCNAYSSGERLEIKQLRRKSDGAIDESFELCQTFFHGLVMRKLEESTLGVVVKRRAVYVEQGDDDVFFVRSTLVIKKLGDLEDPSHRIVTVETGNVEFDVRSLWEMVRGSQSGYGVRMFVEQGIVVEGQAQDGLQTIRGRLAGGMDSMSTPRLGVISRLSATPMLSGIPGLVPPKSLGYSPA

SEQ ID NO: 97126 - protein, 106 aa, Glycine max
  Coding DNA Sequence Number=SeqID_5441
MEPPTKQSSNHHIILQVGIRITLTTPTFTAVNTHVVSMAAATNQPNFILEDCIDGEEEVPNTMAPILEMTTHVLSTVRHQIKMRADDIMQQLSKQLGDIVQTHGHE

SEQ ID NO: 97127 - protein, 66 aa, Glycine max
  Coding DNA Sequence Number=SeqID_5442
VAVIASFGYQKEHDGSWVKKGARPVDEEGHVGMRFNEMESRITKVEEDVSYIRTSIDLPPPPPPSS

SEQ ID NO: 97128 - protein, 323 aa, Glycine max
  Coding DNA Sequence Number=SeqID_5443
  Gene Ontology: Mol. function=protein kinase activity; Cellular component=basolateral plasma membrane; Biological process=protein amino acid phosphorylation
  Homolog annotation: Hit_ID=A7PM90; Match level="QueryCoverage=27%, HitCoverage=12%, E-value=2e-23, Identity=65%"; Hit description =Chromosome chr14 scaffold_21, whole genome shotgun sequence
MATSTAMSRPETFSSIHAAPSSLTTLVSLPASLIRVTANAHVIHLSEHLAGWHPRADIWSFGITALELAHGHAPFSKFPPMKVLLMTLQNAPPGLDYERDKKFSKPYYFQVLPPSVRMVKSVASNFLLEWLFQHEHEHRQWSAAISLGLIASCLHVTNHKERYHNITGFLEDVKWLQTVTKLPILVKGVLTAEDILPIGENLWLNITLLVQRNGGACHYIAMLGIMHLVFPPQAAMDALIFANIQIFNHAFKMMHGSVTYVVLNLEGDLTVRLPMLTVLKLHSCDGITTASMTAISHSNMLEDAAKLIIKAIEYMKFSGCGFS

SEQ ID NO: 97129 - protein, 361 aa, Glycine max
  Coding DNA Sequence Number=SeqID_5444
  Homolog annotation: Hit_ID=A7QKC8; Match level="QueryCoverage=86%, HitCoverage=100%, E-value=1e-84, Identity=53%"; Hit description =Chromosome chr2 scaffold_112, whole genome shotgun sequence
  Pfam annotation: Domain name=DUF1191; Domain location=71-349; Score =387.4; E_value=2.3e-113; Accession=PF06697.3; Description=Protein of unknown function (DUF1191)
MEGQRRLSDRGSMECNLGIYEYKEDRDETATVTGTAIQNFGYNLGSFCLMGSVFGLILMVFSWVSFTFPGSNAQEGVKSAHVLDLIIRDHTFKALDKNFRTAIPQSVSLPANLSGIGIDAVRFRCGSLRRYGAHLKEFHLGTGVTVHPCIERVMLIRQNMGYNWSSIYYANYDLSGYQLVSPIVGLLAYNADEDAKSSNPFQLGIVAGETPMTIDFTNATKMNQDGVKPLCASFEGDGRMTLAKAPNPSTPLVCVAKRHGHFGLVVEYSPPDQFRNKPLSRWKVAVGSTIGAALGAFLLGLLLVAMLVRVKKRSRIVEMERRAYEEEALQVSMVGHVRAPTAPGTRTTPVIEHEYIPHHPR

SEQ ID NO: 97130 - protein, 40 aa, Glycine max
  Coding DNA Sequence Number=SeqID_5445
MIPKIARMASGTACPAGGAGWPEWLANRASTAGGHGYTRG

SEQ ID NO: 97131 - protein, 133 aa, Glycine max
  Coding DNA Sequence Number=SeqID_5446
MQSQGLALPPEPEVGPSAARVAQRRVVLIPQGTTKTRGSITVHNIHLCHDQVKVGVEEVRDADASIPVLTQQVQLVGQTLNTFVTWPTHLVKRLSEQGAMGSDKPTDRPDHDVNDPLYLMTLTIPQLFLNPLQ

SEQ ID NO: 97132 - protein, 93 aa, Glycine max
  Coding DNA Sequence Number=SeqID_5447
  Subcellular localization annotation: CTP_CleavageSite=79; ConfidenceScore=5.11e-01
MRCAGLQSTKYCRLSQPTLLRASEARLTGASSKGGKCMESPPTFICGKRRKNRRKPVMKNIPNSGVVFMFKEGRQKRGSCSYVPSIEEEIRPT

SEQ ID NO: 97133 - protein, 377 aa, Glycine max
  Coding DNA Sequence Number=SeqID_5448
MGQFMRSWSSQEGRGQIMRVVVNHEGHSQSIITQGFIITSDHSHGGFTTTVLANTPHSSIKFWALERVVLVVKTSGLGKDMSEVTSMLKRGVLGWPVLRQPLKRKPFPKRNRGSKAVGDQRAADGTSYEFYSNTYHPMEDEDVVLEWYNTICNICILYDTRVINTYLAMSSPKSDLNKDVAYLIYAIIAGMSMNIGYIISKKIKEFVLSANTTNPTRKEYRLIGLHGSPYDTIRRPINQQFILDNSALASLDALMREMRATIAAKNHAIGMPLPKEVGMRLHRREVGIAAVETRLRQTLPQMRRSSKGDSLQPTTMPLHMAMDSLKGFTPSISIRLWIHSKGFTLHTTTGVGGATQEDVAQKSSGDNANSSLDKAES

SEQ ID NO: 97134 - protein, 98 aa, Glycine max
  Coding DNA Sequence Number=SeqID_5449
MEHPQRIFTWINSYYYNYTVEEEGCLYKNKSILVHARHQVGGGLQTGSPTVNEALPSDDGRSGSKERRHNHGKECKEQAHPHHNRHRVEDVRQLQKAE

SEQ ID NO: 97135 - protein, 195 aa, Glycine max
  Coding DNA Sequence Number=SeqID_5450
MDMFGWIIVQIKNLNPKVALHSMLLALRPGSEMRSERLDKSVIRDKEVERDRGTTSKDTSDNLRKNMKMRLPIKSKDIKINCINQPSPRSLPPITFTDRDFKGINPINQDDPMVVSIVIANFMVSKVLIDQWLSARKNPEEDELSGSLSAPLQVIKCTPSAHPLSERSALSQNPLMRAKRLRFVLSTRARTNPPI

SEQ ID NO: 97136 - protein, 44 aa, Glycine max
  Coding DNA Sequence Number=SeqID_5451
MSTTNDLETRTFVVVRGERTKEKKGKSKESKEYKDWDRGRQDYE

SEQ ID NO: 97137 - protein, 115 aa, Glycine max
  Coding DNA Sequence Number=SeqID_5452
  Subcellular localization annotation: CTP_CleavageSite=30; ConfidenceScore=5.49e-01
MYPLLFSVTTTQVDVPSTCTTKDVPSNVLRQSSQAVSPSKLCEGETKEFSGENFRKLFAKEEEEEEEEEEEEEEEEKVQRDSKVVKEYVEKLFVKVVSIVSAVSVLQMQIKVLLL

SEQ ID NO: 97138 - protein, 42 aa, Glycine max
  Coding DNA Sequence Number=SeqID_5453
MADSEICKQIYTPQQYHKEIRRKRPQYKPPNRQPSRKKNSTR

SEQ ID NO: 97139 - protein, 174 aa, Glycine max
  Coding DNA Sequence Number=SeqID_5454
  Gene Ontology: Mol. function=nucleic acid binding; Cellular component= nucleus; Biological process=regulation of transcription, DNA-dependent
  Homolog annotation: Hit_ID=A7PJ19; Match level="QueryCoverage=47%, HitCoverage=4%, E-value=2e-20, Identity=61%"; Hit description =Chromosome chr12 scaffold_18, whole genome shotgun sequence
MVGLMVFFRLGHYANIPFSHHKTYSCCDVKAEDAVDYEDIDEEYDGPETEAANEEDYLLPKKEFFSAEASVCLESKASVFDDENYDEDSEKEQDFVNDDCKVDNIPLAGEQKESFVDASKEESSLEHELHVDSPQTEELDADVQKLEEVIGELSPRCGKFMRGKIEGRKGVMRW

SEQ ID NO: 97140 - protein, 279 aa, Glycine max
  Coding DNA Sequence Number=SeqID_5455
  Homolog annotation: Hit_ID=A2Q454; Match level="QueryCoverage=57%, HitCoverage=89%, E-value=2e-28, Identity=38%"; Hit description =Retrotransposon gag protein
MEAEVSALESEVANLKVTLAEMRAQAAADQERLVCLLTQSKDTGGSEEMDKIIQDEDSSNSGSFDMQWLLQKLHGGALDEFRQPVKKNTCTKLKVNLAQFCMDGHTIHFFKALLDEDDQLTWEKLKDAGSVEEYIHDFKRLVAQVTWLLDEQYMGCFVHGLRDGIKGRVRSLKTLGPISRSHLLNLARAVEIELQETRPSWSGSRFSGSRWSGGGPFHPSHQCPDCHLRIMITEEDEGDDGEPYTTFPPAYFYTDRRNKGQEVEVLVAGGNMVYLEAQK

SEQ ID NO: 97141 - protein, 63 aa, Glycine max
  Coding DNA Sequence Number=SeqID_5456
MGMNEAAEDAHASEACQPIAERLERLLNLRIIIEGTETYDVMEDCLRIARGVTADDNVYVRLR

SEQ ID NO: 97142 - protein, 276 aa, Glycine max
  Coding DNA Sequence Number=SeqID_5457
MATNRRWKIWWLAATKSIWKLRNDMVFHNQTFVISKLVDNAIFLTWSWLKGRERDFNVPFQQWSSAMSIAFKTEQCLGLLVSEVGFPANQWLWLIGDSRIELQLVVAARSYLFILKARSFIERGVMLWCGWFYSTPWAYNLPPLMGMQQWTVRVFAGENSREILKDERFTVFLVFDFGNLWIGAPCTLAVYNIKESILYLALRLHGGGCRVVADNSEEFVDNGDWVFGVNIVEDNELDAVKVGDDRFHGNGNKEKGGVFGHQCNHDEGGCAKIMSS

SEQ ID NO: 97143 - protein, 84 aa, Glycine max
  Coding DNA Sequence Number=SeqID_5458
MAAVGVSSGVVSYGSYDPYALYDPWKQPIAAPPKKNQQEDEGAGAWSRMKKTNTQGGRAKAAYGRLLAFSLASSTFVVAATKSD

SEQ ID NO: 97144 - protein, 351 aa, Glycine max
  Coding DNA Sequence Number=SeqID_5459
MEDAPASPASPSRRREELEARLSQARSDVASSVELQPPPPLAIPKPSSEEGGQPEARVDPPRAFEAGEDEVVEVTPHVLPPTTTKRKRNEGAGGSAQHKKSTVPFSLRAWKQATSSQGQPSAPLPTQVVVASVTVSDSFVPHSLPIQTVPVPSSISSVAVLVNLPRPSPALPPSASAVLPSTMPFSSSRPSVSLDHENGQWHKETHSKITSLEAEHPKVANAIVALAKVIRSNYQLSSRVDDVYVKLMSTRLDGAEVFRHCKDLLKEKNDLASKVECAAELKKELNAIEAVEQHEKGFFKAVRQAEFFIEGLDLSLFDPFKDVKDGELLDEEEIVDGKEDIDDEEDDGDNV

SEQ ID NO: 97145 - protein, 201 aa, Glycine max
  Coding DNA Sequence Number=SeqID_5460
MEVDLPLGWKPLNLERYDGTTDLDEHLDWYGGLHPWSIDSFNTLVEQFGSQYATSRLHHLTSVALASLRQVDTSQIYGQFIDSLCKKPPSSMDKQHERAKGNIQMEEMSRFRNEVQQGPNREEREIKASSTKAWTSTSARAGRRTDTIQPHYGPLLGYAGESVETRGYVDLMTTFGQGKLSGSFIVRKMFNELGAIVSTPH

SEQ ID NO: 97146 - protein, 68 aa, Glycine max
  Coding DNA Sequence Number=SeqID_5461
MEMQQKIKEKRLKPYITIMAKIHGQKEEKPILIFTNKSGPNLGSWVQKFTLGFMRTIGPSLATLVQSS

SEQ ID NO: 97147 - protein, 208 aa, Glycine max
  Coding DNA Sequence Number=SeqID_5462
MDRARLVYDLVTKMDMDVRSFISGQISQMAQSNSSWLGFPVLITALCIARGVIPDSLTFESLNPAINLAYIRKNCWNPDDPTITFLGTRNARARGPSDASAPSSSAPSAPASTLAPPAPTPTPPTPSSTSAQSSDAMVPMLWPDQESILLLWGKAEVEVKETLEDTPVATPIEATKKGDDTADANYDTSLPAQDALSSPHDDPTPGQD

SEQ ID NO: 97148 - protein, 683 aa, Glycine max
  Coding DNA Sequence Number=SeqID_5463
MKFSHDIVCLLAVQAFEQGCWGHPVWFLLFFGHNFLNVYSGSLERPLDDSLEVTGLFGASQFGEQVFSGVALLGDFEDNTCPAWIRCPRRGSTSLGKAEQTIALATKRYKSRHTSALGWLRTGGVASELWEKPRQGCQSTIQLLDFLDIGRTAHLQYSCAFVGIGFSSSTWDHEAEELASIDPESAFFQVDAYVVFADFSESLFQNCHVLGYAMGFDEHVVDAELNISSDQLFKDLVHQSLASKKLSTWKPDAPLTILSMLGKGYASLGHVVLRSDINYASVLMVGEVPAELRRLPRSVVARIYIEYIIQACLVDGQGSDLRPFAQAHDLSTTTRCGDFCVALSCLLLIFLGSHDLSRQGGELHLQMQCGDDGSKLIERFPNFDEDLGHHEFGDYDGDNHEVLRLISLKSLSVKVIMGVVAGVFDGGVSIFLDLLLCLFFCRHRGVCGAPLGVLRVLLPLHDYSTFSQTGLGTQPYFVMYNLGMRGSEKGSFMGTSGLKASLRIIVRLAVRVGLGTSFSLIALLSNLLDLVSSLGHLFHLDVAFSSFAQLIHATRGYVDFHDAVDKGVLTSSSPFRTVYMGETRINLSVDCVSGLSELLLMVSLHLCNEVLSCWRVSVTVMVARGGLEPLKEVSCLRSEQVLTMGGKERVDAAKVLGVPIWMTQMTWVGDPKDVEELFLMVGS

SEQ ID NO: 97149 - protein, 288 aa, Glycine max
  Coding DNA Sequence Number=SeqID_5464
  Gene Ontology: Mol. function=zinc ion binding
  Homolog annotation: Hit_ID=A2Q4P8; Match level="QueryCoverage=52%, HitCoverage=82%, E-value=6e-21, Identity=36%"; Hit description=IMP dehydrogenase/GMP reductase, related
  Pfam annotation: Domain name=DUF1723; Domain location=126-175; Score =55.4; E_value=2e-13; Accession=PF08330.1; Description=Protein of unknown function (DUF1723)
MVRTRGLGCALGHVTGRGVGRGDRDDSDDAPQRRRPTASARRQRVPVTAVHNEPVVHAPDVEADIFPDDPMAPTDVEDTGADIPADTGAQAAEDEHEGFSGGPSDPSVLTRAGTGLSPLIACSVDTGDQGLLSSFVERWHRETSSFHLPVGELTITLDDISSLLHLPVVGDLHAFQPLHVDDAVCDIYERRCQAGHWTTAARAYLLHLLGCTLFANKSATNVYVVYLEALRDLSQTGRYAWGVAALCWIYEHFLSVVESTVDQDYDEDSSRVGLFYRCCLSKTPNYMR

SEQ ID NO: 97150 - protein, 268 aa, Glycine max
  Coding DNA Sequence Number=SeqID_5465
  Homolog annotation: Hit_ID=Q5XM22; Match level="QueryCoverage=30%, HitCoverage=62%, E-value=7e-13, Identity=43%"; Hit description =Resistance-like protein HAAS-2
MLQPYGINIGLKEHSNRVTPKAYTLKSPSGPLPPDSGCTLFANKSATHVHVVFLGAFRDLSQSGSYAWGDVALVHMYDNLNDACKSDNRQLAGYITLLQIYEHFSSIAKAFMDEDYDERHIRWGPVVVIHRPEKICVVLGQCAPDYLDWFYMISHPFMRSTQPGDPPKHPPVMQDETYVEPDMPQYSMAATAMEETPVHAPSDMEHPRHAEACQAIVERLERLLNLRIMTGGTETYNVMQDCLRIARGVTMDHNVYVRSRQRRCTDHA

SEQ ID NO: 97151 - protein, 97 aa, Glycine max
  Coding DNA Sequence Number=SeqID_5466
MGTDEDVERAQRVTEYLEYLCKWGCWALKIFRTQEYGISFDSWRGRRESGVYVQEKTFMFMCMDSDGTVVLMDPDTLDQIEVSKDLFNKDCLYLRGG

SEQ ID NO: 97152 - protein, 177 aa, Glycine max
  Coding DNA Sequence Number=SeqID_5467
MVGVPVIRIPLRSHPIDVPRAQTLFLEEDGLTSESNCYLALNVGILDMNLEIVHEALGRSRLVCLNDTDIVAVKVDAACDDSFNTITRGLTKHLRAISAAEVVPLSEGDIDGGDVDACGRWCEKVLVVLKGGGVVESCDNDGVEECGVVSSSEDEFVRERDRQRDSLVELNNFKSIP

SEQ ID NO: 97153 - protein, 98 aa, Glycine max
  Coding DNA Sequence Number=SeqID_5468
MVIFHHGDAAEDKGEEHLDNEGKLELLHMMSNVMSRNEIGLHNAQCKIKVNCRSEVAGGSQSRQCPDILPENTGVAVQCKIKVKCRSEAAGRCLEDVP

SEQ ID NO: 97154 - protein, 158 aa, Glycine max
  Coding DNA Sequence Number=SeqID_5469
  Homolog annotation: Hit_ID=A5AJ19; Match level="QueryCoverage=60%, HitCoverage=24%, E-value=1e-09, Identity=37%"; Hit description =Putative uncharacterized protein
MTKSKDKDPLEGLGGPMTRVRERKAKEALQQVLSILFECKPKFQGEKSKESPQGILTHLKPTMFNSRAIVVEESIHVKFNDGLTTDKKISYLEDNFAYMQIGSYVAPKKFVNYHPQGQIIGDQIEGVRTRSAFKDLASYAFVSEIEPKTIDEALIDDR

SEQ ID NO: 97155 - protein, 113 aa, Glycine max
  Coding DNA Sequence Number=SeqID_5470
VMEKELGTLEMVLEERRRRNDIFPKLLGLQGSKRTSEVALRKWIIDKDTLRCNGRRAWVTHRPHFATLEGLRDYAFLSWEMRGWYTMYLYVVIAPDCHPDDFCKTIKTWKDWW

SEQ ID NO: 97156 - protein, 34 aa, Glycine max
  Coding DNA Sequence Number=SeqID_5471
MGLGKVKSGMVKTSRKLRIEMIIFWHNCCFGLNG

SEQ ID NO: 97157 - protein, 70 aa, Glycine max
  Coding DNA Sequence Number=SeqID_5472
MLLTKNANLLTIICQIHKAQQVRIMVRTRGLGRALGQVTRRGVGRGDHDDPMMLHSVDDLLHPHEGSESL

SEQ ID NO: 97158 - protein, 235 aa, Glycine max
  Coding DNA Sequence Number=SeqID_5473
MKLPFYPELVKVFYSNFEIQEDSLIFKVYGIRMVIDQSLFFDLTQLSSDGVPFEGLLDDEWKFNFSVSDARRMVCTNQVDITGRLLAGSLAFECRIMNYLIMRILLPRSSNLAQVFEEDLIIMWVFLTGRQIDWAHLPFVKVKRSFSIGANVVSSFGYCKERDGSWVKKNAPIQAAEDRSPSPHSQRDDSSSLLHSILERFDGLQTYVDSRITKVEEDVTIIRDCLDLPPPPPSV

SEQ ID NO: 97159 - protein, 88 aa, Glycine max
  Coding DNA Sequence Number=SeqID_5474
MSQARAINFEANSDGESSDGSDDWLAAELHLHHRVALKVLHIVGQTLNTHWDPSPLCSMILQETTRLLITILTIQETTSLLITTDFLR

SEQ ID NO: 97160 - protein, 244 aa, Glycine max
  Coding DNA Sequence Number=SeqID_5475
MEVVSGISSMYLKYHHHEFMIKRDFTFQLMTMISKPLHLSSNNFETSRGKIVLFGSLEATTFNLLPMKAKLGTGAPVQSYSSSASTFTKFTNLSHASNFQIGNNTLTPFKICFQKESKAISILGHTTQSPYPCNIGLIGRNTNTRIQNIKWELTTQLQPRKTNPDLANISKTSIGDQYLETLTTRCMRKTNQKAGTYSTIPYVLYHLLGQIIKHAVRSERNRGTMLIRELISNETQVGLVNGTK

SEQ ID NO: 97161 - protein, 98 aa, Glycine max
  Coding DNA Sequence Number=SeqID_5476
MTSSQHLIYKAVIDYHEHVIDYQWYILCGTSRGYIYLGCYTEIKRGYISYGSVQVEDTSTWLFKENKRGYIPCGSLACKGFYKVERNLKNRWLLGDWM

SEQ ID NO: 97162 - protein, 46 aa, Glycine max
  Coding DNA Sequence Number=SeqID_5477
MMRLANVLSLSPIQIELNWAKLAHGQLSEPITLRCREQPPNIYDSL

SEQ ID NO: 97163 - protein, 159 aa, Glycine max
  Coding DNA Sequence Number=SeqID_5478
MDSIDVVVNIENIIGEEERDCGGWEEQIWGRRERRKIIKHYCQLTFEEGSRTTIVFDDRQVHRIAQVSSGGCEGRWATCWSSYWATDATNDVLYLTTFLCSMLSPGLLNPDISCMFSLILAKRHPQIPLVGLNLTRTALRHTYQQLGYRTLIPCENMIN

SEQ ID NO: 97164 - protein, 231 aa, Glycine max
  Coding DNA Sequence Number=SeqID_5479
  Pfam annotation: Domain name=Chromo; Domain location=12-64; Score =32.4; E_value=1.7e-06; Accession=PF00385.15; Description='chromo' (CHRromatin Organisation MOdi
MPDFILEATGPKEPTTILDRMTVKRRGQAVTKVLVQWKHQLPEDATWEFYYDLKRSPIHQQIEKGAVEVVLVREDGSEMQTIRMELGEGTGIRDQQLRKRNGLWKGQIGFFNSHYQPHCRSTPFHRDPLLKRHIPIPSSSLINSHHVDEEVPSDTVEELVFVGSSKLSLEVPPLPITHGDAQAVWLSLRPVSASEFSAKLLPLVTKHVAVPVVLPEVFHIDHPHYRHRHGH

SEQ ID NO: 97165 - protein, 216 aa, Glycine max
  Coding DNA Sequence Number=SeqID_5480
  Homolog annotation: Hit_ID=A5B5M2; Match level="QueryCoverage=28%, HitCoverage=4%, E-value=1e-20, Identity=74%"; Hit description =Putative uncharacterized protein
MAKTSSYGRGQFASSSKEKERKGISRNFMYYDTAKEIWDVVKETYSNIDNTFAIFEIKSLLHDLQQGEKLVTEFFNTLSRYWQQLIPTKCRNLPFGWRARRDLRKRVREFFTREEGDLVDLQLAWVSSNEQAGACPVNADDIDSLCETTNYDSLRKVKVDDIDSLYKTKDIDSLRKVKANDNDSLYNTKDSDSLWKVKEQMTLIVSARQQTMVVSE

SEQ ID NO: 97166 - protein, 77 aa, Glycine max
  Coding DNA Sequence Number=SeqID_5481
DIDSLCETTNYDSLRKVKVDDIDSLYKTKDIDSLRKVKANDNDSLYNTKDSDSLWKVKEQMTLIVSARQQTMVVSEK

SEQ ID NO: 97167 - protein, 56 aa, Glycine max
  Coding DNA Sequence Number=SeqID_5482
MKAKVHNGGLGLLPRVTPEGGSLLLFLAPYNYSNTLNWLLAVASSSELPFRARLTL

SEQ ID NO: 97168 - protein, 98 aa, Glycine max
  Coding DNA Sequence Number=SeqID_5483
MEASQCIPGKGFVLNAEGQPWKLLRKNLTTLAQTWSVLSYSNLDPTSHTSDLNMDRARKTRSTAAGVPFSFAPAADIPSSSTLDSKLQSLFEGQMLIM

SEQ ID NO: 97169 - protein, 137 aa, Glycine max
  Coding DNA Sequence Number=SeqID_5484
MTQSDIRVKRDSIRHPSKKILSLEFARSFIFNFELLDLQRDSIAHPSKKLLSFELAQSFNIQFRAISIYYGTQSDIRVKSYCRLIGSELQHSISTIRYITGLNQNPSKKLLLFELAQSFKIQFRASRYVTRVNQTSE

SEQ ID NO: 97170 - protein, 87 aa, Glycine max
  Coding DNA Sequence Number=SeqID_5485
MAAQLIHDRVEMECLEEAWETLEGNTRCRFRGTIRFTATSLVHPDEPARTLQRTVEWTAPWISFVYFLGWVYLGLTVSHHCGHLCSG

SEQ ID NO: 97171 - protein, 148 aa, Glycine max
  Coding DNA Sequence Number=SeqID_5486
  Gene Ontology: Mol. function=peptidase activity
  Homolog annotation: Hit_ID=A5C8K0; Match level="QueryCoverage=95%, HitCoverage=11%, E-value=3e-12, Identity=25%"; Hit description =Putative uncharacterized protein
MERGYHYWKTQMQIVIEAIDLNIWEAIEIRPYVPTVVAGNTTIEKPRENWSEEERRRVQYNFKAKNIITSWINTLTHEYELFRMKTNERRIFPNEDLINKVLRCLSRNWQPKEHEMELQRLNQHEENDKRKKGIALKASSSIQEESDS

SEQ ID NO: 97172 - protein, 39 aa, Glycine max
  Coding DNA Sequence Number=SeqID_5487
MAELRDSEGFAGNNGSKEEEEGFQKQRRRKVSGFRKQRR

SEQ ID NO: 97173 - protein, 231 aa, Glycine max
  Coding DNA Sequence Number=SeqID_5488
  Gene Ontology: Mol. function=branched-chain aliphatic amino acid transmembrane transporter activity; Cellular component=integral to membrane; Biological process=branched-chain aliphatic amino acid transport
  Homolog annotation: Hit_ID=A6T5C3; Match level="QueryCoverage=100%, HitCoverage=52%, E-value=1e-112, Identity=90%"; Hit description =Branched chain amino acid transport system II carrier protein
  Pfam annotation: Domain name=Branch_AA_trans; Domain location=6-231; Score=154.4; E_value=3e-43; Accession=PF05525.4; Description =Branched-chain amino acid transport protein
MTHQLKSRDIIALGFMTFALFVGAGNIIFPPMVGLQAGEHVWTAAIGFLITAVGLPVLTVVALAKVGGGVERLSSPIGKVAGILLAVVCYLAVGPLFATPRTATVSFEVGIAPLTGDGALPLLIYSVIYFALVILVSLYPGKLLDTVGNFLAPLKIIALVVLAVAAVIWPAGPISDAMEAYRTAPFSNGFVNGYLTMDTLGAMVFGIVIVNAARSRGVSEARLLTRYTVWA

SEQ ID NO: 97174 - protein, 207 aa, Glycine max
  Coding DNA Sequence Number=SeqID_5489
QGAPFEGTIVDDWKFDYSSHDARRMVCNDQVEMTAQASEEDLILMWAFLTGRQIDWAHLVRYRMHKALRANAPLPYPQLITLFLRHFQIPLDDEPFFQVKRSFAIGAGVVTSFGYRKDQNGQWLKKDALPPQDERTPSPPPQREDSALLNEVLTELRGLRSYVGERFDSLDTRFAVMDIRLTQVEDVSFIRTCFDPPPPPPSSSRLI

SEQ ID NO: 97175 - protein, 308 aa, Glycine max
  Coding DNA Sequence Number=SeqID_5490
MAKFDPDVVLELYANAWPTEEGVRDMRSWVRGQWIPFDADAIGQLLGYPLVLEEGQECEYGQRRNRSDGFDEEAIAQLLCIPGQDFAQTAAGRRVRIMRTNMTTLTQIWMTLLLSNILPSDHNSDLPLPKCQLVYAILTRMSIHVAQLIADAIYIFAGMAPTRHLWTRISPTGPGFPALITGLYQSFGVPVAPSKVIRPPITRAFIEKYCTQRQVQGDAPQAADAPPPHQAGPVGSFDTEQYLRHLMSLSLQSQGFTSFPCPTPDQFRAKAGEAPAEAPAEAPDEADEARDDEEMTDLLDFLGGSGAT

SEQ ID NO: 97176 - protein, 145 aa, Glycine max
  Coding DNA Sequence Number=SeqID_5491
MEACLAVGDLLQQMIDQGRLEVGDEGGEEQHICMQSAYEEGLREPKPFVIHFTRDATPQTPRHPSVVRPIPFPYKNSHAVPWRYAHPSERKEGATDISSLSAKVTNIMGLSGMTRSSRVFAPPDLPTQLANAKGKARMTEGQNVK

SEQ ID NO: 97177 - protein, 258 aa, Glycine max
  Coding DNA Sequence Number=SeqID_5492
  Homolog annotation: Hit_ID=A5AKA7; Match level="QueryCoverage=81%, HitCoverage=42%, E-value=8e-09, Identity=25%"; Hit description =Putative uncharacterized protein
MEEPSKKHKGSSSRSQGHSEAQDIPIPSSISSSSLFSSEEKCIRYTNLFSSRSIIDPKFIDMDLFSDESFECIQAFQNSNLIPFMSLKLPVYSELVKAFYSNLEIQESALDDDWKFDFSVHDARRLVCTNQADMTGRLLAGSLALESRILHYLIVCILLPRSSNLAQVYEEDLIVMWAFHTGRQIDWAMCKALRLNAPLPYPHLVTLFLQHFNIPLDYEPYVPIKRSFLIGAAVVASFGYCKERDGSWVKKGAQPNDD

SEQ ID NO: 97178 - protein, 71 aa, Glycine max
  Coding DNA Sequence Number=SeqID_5493
MEMEMITMIVDTLSVFYYEKMVGYMPSSFADLVFVSERIEVGLRRGNFDYPTVMNRKLGENGENKKEGGML

SEQ ID NO: 97179 - protein, 89 aa, Glycine max
  Coding DNA Sequence Number=SeqID_5494
MYILPTFENRPRRVQRNARNWNQRSGMQTEAEFQHPKVEPVQVIEVSSSEEDLEEDPEELPPEPVVDALDFPEDDEDPLPNVDSPEDVI

SEQ ID NO: 97180 - protein, 212 aa, Glycine max
  Coding DNA Sequence Number=SeqID_5495
  Homolog annotation: Hit_ID=Q6WAY6; Match level="QueryCoverage=85%, HitCoverage=38%, E-value=5e-10, Identity=25%"; Hit description =Putative uncharacterized protein
EGRIKILSSCEGCPNVPLMGTRGCINYNLVLAIRQLGYPMRGAPLDESITPFIARGFSDHNARDRELRGSSNGTIGGYHKWLRVRTQGLDWLPNLKTVRDDEVKASEESDEVQALKAELERARVVEEKFKSIAIKGSNSKLKLRRGERNHHGETEGNMWAVIDECKEKLNLAATHEQRLEDESQELPRLLAKAKAMADTYSAPKKIHGILSY

SEQ ID NO: 97181 - protein, 163 aa, Glycine max
  Coding DNA Sequence Number=SeqID_5496
MVSGYFMCLPHGLSAMYMTRLGLLALNGYESGVVDILIWSVCNIGWCIVGRQAIWWEGMLALDLYKIGVTRPSQCFAPLTYHIRDWTTCLIDARWVSRVHLSGSICSNDCSHVDLHNFSHTHHGFHHYGHLLFHGLHVGLHLLLHLLYFTHHSSFGIRSVRAP

SEQ ID NO: 97182 - protein, 135 aa, Glycine max
  Coding DNA Sequence Number=SeqID_5497
  Gene Ontology: Mol. function=ATPase activity, coupled to transmembrane movement of substances; Cellular component=integral to membrane; Biological process=transport
  Homolog annotation: Hit_ID=A7Q0Z8; Match level="QueryCoverage=91%, HitCoverage=60%, E-value=2e-44, Identity=49%"; Hit description =Chromosome chr7 scaffold_42, whole genome shotgun sequence
MKECSWLDMLARIRGLYLRAILRQDISFFDKETNTGEVVGRMSGDTLLIQEALGEKVGKFIQCVACFLGGLVIAFIKGWLLTLVLLSCIPPLVISGSMMSFAFEKLASRGQAAYSEAATVVERTIGSIRQVCQSS

SEQ ID NO: 97183 - protein, 120 aa, Glycine max
  Coding DNA Sequence Number=SeqID_5498
  Subcellular localization annotation: CTP_CleavageSite=68; ConfidenceScore=5.76e-01
MRRNSPASSSDTSFLPQPSFFSERPFTGIFSFGVGIILSFCSSSIFGFPLTFEVCVGRSGGENTLPLRVTSLSPVILVTLADNELMSGASSFLSLGGAYLHGTAFNYRGVSGRMGSYISW

SEQ ID NO: 97184 - protein, 130 aa, Glycine max
  Coding DNA Sequence Number=SeqID_5499
  Subcellular localization annotation: CTP_CleavageSite=35; ConfidenceScore=5.29e-01
AVHVSSTFEFGAMFHDCLSADPQGNPPFSPFFGAPGMSLSSAVHVSSIIKRGASGDWEICSSVVFRIEGVETRIVITERAGWTKSVSYLCFPLISDERCLAPFVAQYVKSRDVPKIKRKQAYAIRENSVM

SEQ ID NO: 97185 - protein, 66 aa, Glycine max
  Coding DNA Sequence Number=SeqID_5500
VGVKEVKDAEALVPVPTDEVTLVGQTVNTFLAWSTHLVKRLSEQAAVSPATKPPESPDEEVDDPCT

SEQ ID NO: 97186 - protein, 104 aa, Glycine max
  Coding DNA Sequence Number=SeqID_5501
MESNADTAAAAAIAFRALWDKGETHRGILLNFLTGPTRILESALMGTLNPTLCFPLGGQRPTHYLNPTSWECLKPTQCSQCFCPWEGHPRQRKERKNSISSKRD

SEQ ID NO: 97187 - protein, 51 aa, Glycine max
  Coding DNA Sequence Number=SeqID_5502
MWDGKAVFGSSEGNLIAKSLSTNTKCAGVAQITFAALNKFVEVGLNSPKSV

SEQ ID NO: 97188 - protein, 701 aa, Glycine max
  Coding DNA Sequence Number=SeqID_5503
  Homolog annotation: Hit_ID=A7UQU7; Match level="QueryCoverage=16%, HitCoverage=20%, E-value=3e-16, Identity=42%"; Hit description=IMP dehydrogenase/GMP reductase, putative
  Pfam annotation: Domain name=DUF1723; Domain location=643-692; Score =50.7; E_value=5e-12; Accession=PF08330.1; Description=Protein of unknown function (DUF1723)
MVRAFEILCPFFNIWPSVSVFLYFFQMKLAGKIDWVSLNSMSKKLFQFDSNIFCCFKDHFFKVLDSSVVVNGLPLMLNKDGEPRFYSTGRLIPPGHLGATIGLVGRVNHFVSSLASDLLTALDDGTMPPSIVTPTKRGQPTVEVGLAVVSTVEIAPSATSSVLAKRKWDDSAGLQAVGLTPSAVHPLVVQDVPLASTTVEALAVVIVYKVTLLVVEVSAPAALVGSAVAPSSTIAASLLSVGVVTTNAPVAPPPSSSAPMVPPSTALASLSTSSHPHVSLDHIYTFNDANSLWAMGSVGFQYATNFSKVFLQWSLAILEENGQRHQEMLSKVTFLEAEVAKWRANACTIWKVERPKVASATIAFDEAGRSNHQLSSKVGSVLGGDVVVEKDELAKKSMLEKFELWAAREREVSKKLKEELLIFKKEVVEQYEKGFNKHDEDNIAAEEEAGEKEQGTEFMIFGECTLSSSALSTAAGGVVLGPVLLLQCWRHGGGDLHLDFACSSSVGAAPSRSRPTTSTHRQWEAAPVAEDELVIAGDEPMVAADKPMVVVDKFVVDADAHGPCAEAATNEPEGFPGGSSDPSVLTEYVEHVAANIWTGEERPELKLSSHGRKVQKLGRPIPIIEGLVVGTGLSPLIACSVDTGDRGLISSFVESWHMETSSFHLPMGEVTITLDDVVSLLHLPIVGDFHTFQPLHVDEAG

SEQ ID NO: 97189 - protein, 370 aa, Glycine max
  Coding DNA Sequence Number=SeqID_5504
  Gene Ontology: Mol. function=rhodopsin-like receptor activity; Cellular component=integral to membrane; Biological process=G -protein coupled receptor protein signaling pathway
  Homolog annotation: Hit_ID=A7QRJ8; Match level="QueryCoverage=97%, HitCoverage=76%, E-value=1e-123, Identity=61%"; Hit description =Chromosome chr8 scaffold_150, whole genome shotgun sequence
  Pfam annotation: Domain name=LrgB; Domain location=199-366; Score= -59.1; E_value=1.3e-06; Accession=PF04172.7; Description=LrgB-like family
MIYSNFGVFGVIHLAVSLGLILAVDKFLKQAFVAAAIKFPSALFGMFCIFSVLIILDSTVPAAATAFVSFFVPAFMFIQRWLPLFYVPSLVVLPLAVKDIPAASGAKIGLILVGGWLATFCVAGYAAIAVRKAVKTELVEAEPMGKPAPFSLKCGHGLLVRLHGWLWVSIFLYTAAYTRGKLLFPMYGISDEKPLKKRVFLYTWLPPNVKKVFHPIICCALSADLTAFAFGYFSRSGLEPVLGMVTRHAAEIFTSVIISTLFSLYSTAFVGRLVQLEPSLTVSILPRCITVALALSIVSLFDGANSSLTAAVVVLTGLVGANFVQATLDKLSFRDPIARGIATASRLGTAALSAKEPEALPFCAIAYALN

SEQ ID NO: 97190 - protein, 194 aa, Glycine max
  Coding DNA Sequence Number=SeqID_5505
  Gene Ontology: Mol. function=aspartic-type endopeptidase activity; Biological process=RNA-dependent DNA replication
  Homolog annotation: Hit_ID=Q69F85; Match level="QueryCoverage=52%, HitCoverage=5%, E-value=1e-16, Identity=42%"; Hit description=Gag -pol polyprotein
MDKSLKKEKMRGGRRREGARHFVPQMSNRDEYRYSLATPKLHYGDGVTPRGGVKKAKWRRALYPHIARAHLRGITPPMHSQHSRSSKSLPQALSCWTDYSSTPFVDQIVEANIPLGWKSLNLERYDRTTNPNEHLDVFLTHANLYTNDDSILCRVFPTSLKWATLTWYVGLPPRSINSFDTLLERNMQPVSHII

SEQ ID NO: 97191 - protein, 80 aa, Glycine max
  Coding DNA Sequence Number=SeqID_5506
MDIKENVEVTLIFERPFMLTTKYVVDIKNGLGSSSSMESFASLSSMAAEWRRKKYDWRRHFKEKISQTQAHHHRKPWIRA

SEQ ID NO: 97192 - protein, 90 aa, Glycine max
  Coding DNA Sequence Number=SeqID_5507
METISKRFEQLDVCGKVHLKSNLREIAYPDMNSMCPPPEKVTMDKWMKITDMGYVIASRYNVIIVSLSRQQSMTFFLLEVSCHHILLCIV

SEQ ID NO: 97193 - protein, 71 aa, Glycine max
  Coding DNA Sequence Number=SeqID_5508
MWRVSTDYQEASFQTETPSSLVTFGEHYGDAQAKVEYVKRLREQVKAQIAKKNESYAKEANKNKKKVVLGP

SEQ ID NO: 97194 - protein, 147 aa, Glycine max
  Coding DNA Sequence Number=SeqID_5509
MKASLEEQTRQGSFVPHGREDILNTAIRQLDHGGRVRAAGSGVTITQYFGKAAHGSSCSSASISQVQLAEIIGSLQEQWKNDIQVLKHELKEQIILEMLQRGSPISAPIQPDIHVLGARVSTKGSNAETAVNPSPPNHVAPVKPTMG

SEQ ID NO: 97195 - protein, 37 aa, Glycine max
  Coding DNA Sequence Number=SeqID_5510
MMQTYPPRALDRRLQEDWAKDVREGTRVLMSLRGTIL

SEQ ID NO: 97196 - protein, 359 aa, Glycine max
  Coding DNA Sequence Number=SeqID_5511
  Gene Ontology: Mol. function=protein transporter activity; Cellular component=membrane; Biological process=protein secretion
  Homolog annotation: Hit_ID=Q603T0; Match level="QueryCoverage=86%, HitCoverage=84%, E-value=2e-54, Identity=37%"; Hit description =Putative heavy metal efflux system protein
  Pfam annotation: Domain name=HlyD; Domain location=58-342; Score= -6.5; E_value=0.011; Accession=PF00529.11; Description=HlyD family secretion protein
MLCLTLSTCLSLNTLAATLLPLSPAQLKQMQVQWGHLRAEQSGLSASYPAEVVLPPTQTRVVTAPQGGLITRLSVSMGDTVKQGQVIGQLSSPDLVVLQSGFLQSDTQARLHEQALKRDQELFKDGIISQRRMQETQSAYETSQALMHERKQTLKLAGMSDAQVQQLSQKRNMQNGVAIIAPISGQIMEQQQQVGARVDMSMPIYTISNPKPLWLMIQMPIAQAQQLSPGAMVRLPKQNLTAKVDTVLRQLNKNNQTTQVRASISEGAEQLSVGQVVDVALVEHTAQGSFSLPRAAVARQGEQAVIFVQQAKGVAVTPVKVVLEQDQQLTVQGSLNGNEMIAVQGVAALKGHWLGLGGE

SEQ ID NO: 97197 - protein, 93 aa, Glycine max
  Coding DNA Sequence Number=SeqID_5512
MLPALAASVCCQAANLLTVCAAAEAWIEALKASEKEILMETKIAQRELKESKLEQELEVYTKEKMLSRKVSSNEELDNWPRKRENTSSKNFIV

SEQ ID NO: 97198 - protein, 96 aa, Glycine max
  Coding DNA Sequence Number=SeqID_5513
  Pfam annotation: Domain name=zf-CCHC; Domain location=46-63; Score =12.2; E_value=0.022; Accession=PF00098.14; Description=Zinc knuckle
HSVHYASHQGNQGAGKKCVKKHDKSKGSLKINDTLMQIQKKASKRNNCHFCGKYGHFQAQSASLGSKRKGFLMIQTIISNEKFIFMGNRVKAPMEA

SEQ ID NO: 97199 - protein, 133 aa, Glycine max
  Coding DNA Sequence Number=SeqID_5514
MAKGSLDGTRGCINDNPVLAIRQLGYLMRGVPSDESITPFIARGFSDHNARVLQGVRKACDPTVRDDEIKASEESDEVQALKAELERAWVVEEKFKSIAIKESSRVKGMISEEVKGIITGQRHDLEGRAKGLL

SEQ ID NO: 97200 - protein, 118 aa, Glycine max
  Coding DNA Sequence Number=SeqID_5515
  Subcellular localization annotation: CTP_CleavageSite=41; ConfidenceScore=5.04e-01
MSDSGASHIDTLEIKHRKIARNSNGHKFSHRGPNQAHNISRRSKLSNGSSREIQMVITFQTDVHIQVDNISRRSKIIKGSSLEIQMVITYLTDVRFRWITYRDARKLSKEAHEKFKWS

SEQ ID NO: 97201 - protein, 59 aa, Glycine max
  Coding DNA Sequence Number=SeqID_5516
MVISLGYKGVPKLSDTPPSTSSPPHKELQGHPTRSMHPPMNIHNIRRMNMSTIKYKDHG

SEQ ID NO: 97202 - protein, 181 aa, Glycine max
  Coding DNA Sequence Number=SeqID_5517
  Gene Ontology: Mol. function=aspartic-type endopeptidase activity; Cellular component=viral capsid; Biological process=spread of virus within host, cell to cell
  Homolog annotation: Hit_ID=Q6XKE6; Match level="QueryCoverage=44%, HitCoverage=3%, E-value=3e-09, Identity=40%"; Hit description=Genome polyprotein [Contains: Movement protein (MP); Capsid protein (CP); Aspartic ...
  Homolog annotation: Hit description=protease (EC 3.4.23.-) (PR); Reverse transcriptase (EC 2.7.7.49) (RT)]
MMNPDILSQEYWKNEVAYLVAANGKFFRRLSNTWIKFKRELKPFSEITRLFSLAEAPLEVGEFKQKISSGCADSHEDFNHPYLLWKNKEYFVDLPIRLNEDINPTKATHQDDTFRSTSSHTRMPRSTKPRRTDDNSQGTQEDAQNPPALKIPGTGQRILQTDASDHYWRAIMIEQEGEKNY

SEQ ID NO: 97203 - protein, 141 aa, Glycine max
  Coding DNA Sequence Number=SeqID_5518
MEANAVAVAATRAVAKVNPMPPSDLNQMNHPTSGMVGKDLGSTSGPHYAQIQNKHAFPPYGLHPNYTPPNVAYTPKEDVNNSTPTLIESQQPQSDHAHVSQPMGETHGMPHHNLADFEPCLGYATEGNGKVGSSKGKAQGH

SEQ ID NO: 97204 - protein, 143 aa, Glycine max
  Coding DNA Sequence Number=SeqID_5519
MAPTRHPLDPDKSNRALGFPALITGLCQSFGVPVTPTKVIRPPITRAFIEKYCTQRQAQGDAAQAAGAPPPPHQAGPAGSFDMEQYLRHLVRQQAASHRAHAEVAWPRDWPEAQTGEAPPKAPDDGEEAHEDEEMADLLDFLG

SEQ ID NO: 97205 - protein, 204 aa, Glycine max
  Coding DNA Sequence Number=SeqID_5520
  Homolog annotation: Hit_ID=Q6WAY4; Match level="QueryCoverage=88%, HitCoverage=36%, E-value=2e-14, Identity=30%"; Hit description =Putative uncharacterized protein
MGSSQAPWLKKRFYQVKIKSLGVTSLKELGQLMGQLQRKAFHKAYCKIWDLTMAELTPTVEEFEEILGCPLGGRKPYLFSGFYPSLARISKIVKISAQELDQGKQVENEVVGVPRKCLEAKARTLASQDEWAPFMDVLALLIFGVVLFPNMDGLVDLAAIDAFLAFHDRKESPVVIILADLYDTFDRRCEKNSARIVCCTPALY

SEQ ID NO: 97206 - protein, 68 aa, Glycine max
  Coding DNA Sequence Number=SeqID_5521
MEAKAQKWWPRGENPGACPGISMALYGSAFAYSKPLKAASQRRFPLVKSWAWDDDLSIVILASTCVRP

SEQ ID NO: 97207 - protein, 179 aa, Glycine max
  Coding DNA Sequence Number=SeqID_5522
MSCLVIMIPTILCRSVSMPPTRHPLDPDKSNRALGFSALITGLCQSFGVPITPSKVIQPSITRAFIEKYCTPRQAQGDAPQAADALPPPHQADPAGSLGIERYLQHLVRQQVANHRGQGFAPFACPTLDQFRAEVAWPGDWPEAHAGEAPAGAPSDAEEARMDEEMTNLLDFLGGSGAT

SEQ ID NO: 97208 - protein, 289 aa, Glycine max
  Coding DNA Sequence Number=SeqID_5523
  Homolog annotation: Hit_ID=A5BY33; Match level="QueryCoverage=58%, HitCoverage=9%, E-value=1e-09, Identity=26%"; Hit description =Putative uncharacterized protein
MAESSKKRRVHPPPLRLRELIIPGATSASTAPIPPSLSSSTLFSSEEQQKRYSNLFSSRSTIDPKFIDMEFFSAESFDCIQAFQNLGLIPFMSLQLPVYPELVKAFYCNLEIQERTLISEVFGIKMVIDQSLFHNLTQLSSDGVPFEGTMNDDWKFDFSAHDARQLVCTNHADMTGRLLAGSLAFESRILHYLIVRILLPRSSNLAQVSEEDLVIMWAFHTGRQLDWAHLVRYRMHKALRLNAPFPYPHLVTLFLCHFQIPLDFEPYVPIKRSFLFGAAVIASWLPQRA

SEQ ID NO: 97209 - protein, 87 aa, Glycine max
  Coding DNA Sequence Number=SeqID_5524
  Homolog annotation: Hit_ID=A5B7X7; Match level="QueryCoverage=66%, HitCoverage=4%, E-value=7e-07, Identity=46%"; Hit description =Putative uncharacterized protein
KGWKLFDLETKEIFVSRDVEFVETKYPFSIDVITRKDVPPKNWSCKEIVDDMTDGIEETNHTGGIEESGDMTMDDRWGELDAGFDEQ

SEQ ID NO: 97210 - protein, 277 aa, Glycine max
  Coding DNA Sequence Number=SeqID_5525
  Homolog annotation: Hit_ID=A7Q0I0; Match level="QueryCoverage=66%, HitCoverage=84%, E-value=5e-12, Identity=26%"; Hit description =Chromosome chr7 scaffold_42, whole genome shotgun sequence
MESSNVKNKSSGKRKMSSEDTRSYFAWNLEMERVLADVLRDQRNLGNKGGGNWKAVAYNNVKNRFKLWRTWYGIVSVILSQSGFDWDSIKYMITVENEIAWSEYVKSHEEAKQFRFKVIPNWDDIVDLCAKDRAIGLGAENALDADDIMSKETNEEEAIHSVSFDLEGSSSATRKNIRPSKSGEKEGMIFSMKEVAESLKEFVEVTKKKMENKKKMEIKEAQEVVHEVVSELDNIPNFNGALRHRAIDWLTENPIKFAIIKALSLDEKEDYILSFMP

SEQ ID NO: 97211 - protein, 135 aa, Glycine max
  Coding DNA Sequence Number=SeqID_5526
KYFPDSKTAKGKATISSFHQFPDESLSEALERKIKLKTPEEAMELIENMASSDHAIFDASSIGACRPRIIFINGFLCFLEDESQRNGERKRERRRHIKEKMSLEAAHHHRRPWIRAWRKKEMNEGRERRARNFVL

SEQ ID NO: 97212 - protein, 25 aa, Glycine max
  Coding DNA Sequence Number=SeqID_5527
MDTRLRVIGDPMNRVQRGWGSQPTL

SEQ ID NO: 97213 - protein, 107 aa, Glycine max
  Coding DNA Sequence Number=SeqID_5528
  Gene Ontology: Mol. function=transferase activity, transferring hexosyl groups; Biological process=carbohydrate biosynthetic process
  Homolog annotation: Hit_ID=A7QB81; Match level="QueryCoverage=60%, HitCoverage=10%, E-value=3e-22, Identity=83%"; Hit description =Chromosome chr4 scaffold_73, whole genome shotgun sequence
MRGKETELVYNGNAPREAYATILHSAHVYVCGAIAVAQSIRKSGSTRDLVILVDETISSYHRSGLEAADLHSSAATILECKSQALFFDLKVHSQSFPNAKEDRGASH

SEQ ID NO: 97214 - protein, 66 aa, Glycine max
  Coding DNA Sequence Number=SeqID_5529
  Subcellular localization annotation: CTP_CleavageSite=43; ConfidenceScore=5.52e-01
MRNLEGNLSRRHALSASSARSASLLSPSRLSASLALSKNSLTRAMRVIEELPCYGRLNPQLGILAE

SEQ ID NO: 97215 - protein, 103 aa, Glycine max
  Coding DNA Sequence Number=SeqID_5530
  Gene Ontology: Mol. function=hydrolase activity, acting on ester bonds; Biological process=lipid metabolic process
  Homolog annotation: Hit_ID=Q08ET5; Match level="QueryCoverage=68%, HitCoverage=19%, E-value=2e-22, Identity=69%"; Hit description=GDSL -lipase protein
MVALDLTISMLALIVVVFSLGLWSGVQGAAQAPCYFVFGDSLVDNGNNNQLQSLGRADYLTYGIDFPGGPLGRFSNGKTTFDAIGWTWLRWTPGLRMSAENDL

SEQ ID NO: 97216 - protein, 113 aa, Glycine max
  Coding DNA Sequence Number=SeqID_5531
  Gene Ontology: Cellular component=nucleus; Biological process =ribosome biogenesis and assembly
  Homolog annotation: Hit_ID=A3CAN5; Match level="QueryCoverage=91%, HitCoverage=17%, E-value=2e-14, Identity=39%"; Hit description =Putative uncharacterized protein
MVSKIGYVLNFAEPETLLSATLIHVTIPVIARGLLKHESKVSVLHCRPIFSSEFINTDKNKMERFLHVGHFSVASIYAPILFPPLPMIILKRDGDNAAPAVAAVGSLKTFDNP

SEQ ID NO: 97217 - protein, 197 aa, Glycine max
  Coding DNA Sequence Number=SeqID_5532
  Homolog annotation: Hit_ID=Q6L477; Match level="QueryCoverage=60%, HitCoverage=19%, E-value=3e-08, Identity=30%"; Hit description =Putative uncharacterized protein OSJNBa0009L15.8
  Subcellular localization annotation: CTP_CleavageSite=53; ConfidenceScore=5.31e-01
MVTPRRSPPQSDDNTKPQPKKTRQSTRLRRLTLRTREKIPIVHSNWKNVPKTLKDMVWGEILAKFDIPEAEKAKKKVMSTVGTRWRKFKSSLTTKYVYDDTQGKQIENASVKYGMDKQTWDKFVASRKTPDWQDSLEEQTTQGSFVPYGRDDILNTAIVKPEHPSRVRAAGSGMTLTQFYGRATRTSSSSSATLMQQ

SEQ ID NO: 97218 - protein, 69 aa, Glycine max
  Coding DNA Sequence Number=SeqID_5533
MCWAEFSASALFSWFRLGGVDGDPVLRGTRIRAMWEYVSSVEGGQLGMVGSCLICESGRVDLRHRPIAT

SEQ ID NO: 97219 - protein, 145 aa, Glycine max
  Coding DNA Sequence Number=SeqID_5534
  Subcellular localization annotation: CTP_CleavageSite=47; ConfidenceScore=5.08e-01
MDDVAAQQHPAQRSQFRPPSAEVSAGLCQSFGVPVTPSKVIRLPITRAFIEKYCTPRQAQGGDPQAPDALPPPHQADPARSFDTERYLWHLVCQQAANHRAHVQTYDCLYELSLSLQSQGFTPFPCPTPDQFRAEVAWPGDWPEA

SEQ ID NO: 97220 - protein, 167 aa, Glycine max
  Coding DNA Sequence Number=SeqID_5535
  Gene Ontology: Mol. function=helicase activity; Cellular component =chromatin; Biological process=protein amino acid phosphorylation
  Homolog annotation: Hit_ID=Q6AUR0; Match level="QueryCoverage=99%, HitCoverage=22%, E-value=6e-34, Identity=43%"; Hit description =Putative uncharacterized protein OSJNBa0077L08.8
MMLGSCKGPTSFEDIRTVANIQYPTYREACFAMGFLQDDREYVEAIKEAKDWGTTNYLRKFLPINADEQKTIYHRIIQVVNNNEGGMFFLYEFGGIGKTFIWRTLASSLRAENQIVIIVASSGITSLLVPGGRTAHSRFKIPIPIFEDSTCNIHQGTELAELLNQTV

SEQ ID NO: 97221 - protein, 152 aa, Glycine max
  Coding DNA Sequence Number=SeqID_5536
MSWKRTHYFSMPTTKTMIMRGQDIYSSQDEATTSPSSSESEKAKGEESSEANYPLRRRTTISETFPLRQPPHFLFCKKALASIATPLGLEFIPQVKKLLDEGLVRKSLNPCALLVPKIGIIRHQVPKIGGMMNVLNGATLFCKITRTPNIFM

SEQ ID NO: 97222 - protein, 156 aa, Glycine max
  Coding DNA Sequence Number=SeqID_5537
  Homolog annotation: Hit_ID=Q6WAY4; Match level="QueryCoverage=85%, HitCoverage=24%, E-value=7e-12, Identity=34%"; Hit description =Putative uncharacterized protein
MGSSQTPSLKKRFYQVKVKSLGITSLRELGQLMGQLQRQVFRKAYGKIWDLAMAEVSTEAIASLAQYYDQPLRCFTFGDFQLSPMVEEFEEILGCPLGGRKPCLFSGFYPSLARISKIVQISAQELDHRKQVENGVVGIPRKCLEAKARILAGRGE

SEQ ID NO: 97223 - protein, 383 aa, Glycine max
  Coding DNA Sequence Number=SeqID_5538
  Gene Ontology: Mol. function=glucuronate isomerase activity; Biological process=glucuronate catabolic process
  Homolog annotation: Hit_ID=A7ZRX6; Match level="QueryCoverage=68%, HitCoverage=55%, E-value=1e-145, Identity=92%"; Hit description =Uronate isomerase
  Pfam annotation: Domain name=UxaC; Domain location=61-381; Score =504.9; E_value=9.2e-149; Accession=PF02614.5; Description =Glucuronate isomerase
MYDYLWGHSSLRAKPVMARPAAGFVPVRGMNLLAFIDLTHEKRFAYEHTLSDAPVMRKTIMTPFMTEDFLLDTEFARRLYHDYAKDQPIFDYHCHLPPQQVAENYRFKNLYDIWLKGDHYKWRAMRTNGVAERLCTGDATDREKFDAWAATVPHTIGNPLFHWTHLELRRPFGITGTLLSPATADEIWDRCNALLAQDNFSARGIMKQMNVKMVGTTDDPIDALEHHAAIAKDSAFDIKVLPSWRPDKAFNIEQATFKDYMAKLAEVSDTDIRRFADLQTALTKRLDHFAAHGCKVSDHALDVVLFAESNEAELDSILARRLSRSKRRCWCSSAQNMPVAAGYSSTISARCAITTSASLRCWARMWASTPSTTVRWLKRCLSC

SEQ ID NO: 97224 - protein, 203 aa, Glycine max
  Coding DNA Sequence Number=SeqID_5539
MMPDRKAVRHARSLVYRANGQRRFLMRKRAPGQQQGADDHQGNRGTGKAAQGERRDNHRRPASQSAEDQQNNGQQHQQDISWSSYFMKTGNKHPQQAAHPVKELEACAAQPGKASNGRQQGGAPADDSAQADARASSERSGYCPAICPGCSSPSSRDSRRRSVTEWFAEMPSPLWHTARRQAPVNCLRAGTQQAANRSRGTGS

SEQ ID NO: 97225 - protein, 147 aa, Glycine max
  Coding DNA Sequence Number=SeqID_5540
ETTSAAELYLSAIPGRYRGIAVDGEHHKRDVRERARWCPHPNPLPVEEGAKQKTVTRVTVLLLSPQLLLTNRGFHQTPGAPGAKATPRPADQHIRMTNRPDSHHATADQGPGTQAQEGVPATIKASRRINPVATAGRQIQPLLLDLA

SEQ ID NO: 97226 - protein, 67 aa, Glycine max
  Coding DNA Sequence Number=SeqID_5541
MSHTNDFVGYSFLGKNPKKFDIPSGCTIHELKDLIKQVAPHGISPYGIHESQMIMEMEGDMSRSEHD

SEQ ID NO: 97227 - protein, 245 aa, Glycine max
  Coding DNA Sequence Number=SeqID_5542
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLDRQWAFIDLCNIKHSENQLVRVVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 97228 - protein, 390 aa, Glycine max
  Coding DNA Sequence Number=SeqID_5543
  Gene Ontology: Mol. function=transferase activity, transferring nitrogenous groups; Cellular component=intracellular; Biological process=regulation of transcription, DNA-dependent
  Homolog annotation: Hit_ID=A6TCT7; Match level="QueryCoverage=93%, HitCoverage=86%, E-value=1e-171, Identity=80%"; Hit description =Putative bacterial regulatory protein, GntR
  Pfam annotation: Domain name=Aminotran_1_2; Domain location=97-390; Score=-51.9; E_value=0.00012; Accession=PF00155.12; Description =Aminotransferase class I and II
  Pfam annotation: Domain name=GntR; Domain location=9-72; Score=69.7; E_value=9.6e-18; Accession=PF00392.12; Description=Bacterial regulatory proteins, gntR fam
  Pfam module annotation: Pfam domain module=Aminotran_1_2::GntR; Domain location=97-390::9-72
MMEAKKVPHYQRIARQLKSAIENGELAPGSRLPASRVYAQELGVSRATIENAWGELVAQGWLERRGQAGTFVSERLSPRQVTAQRPTAGLGSSAPQPSQMGLPALDLFPRGVWARVMGRRLRTQSRFDLAPGDPCGEPVLRQAIVDYLRLSRSIECQPEQVVVSGNYAASMALILRTLAQPGLHMWMEDPGYPFIRPVVSAAGVNIDPVPIDQQGMDIDWAQAHFPQARFALLTPAHQSPLGVALSLERRRQVLQWAAQRDSWIIEDDYDSEFRYQGKPLPPLKSLDAPQRVLYAGSFSKSMFPALRVAWLVVPLPLAARFRRQAELSHCNVPTLWQQTLADFINEGHFWRHLKKMRASYALRRQWLALGAAGAGFSGSTAVRRDPTGDG

SEQ ID NO: 97229 - protein, 154 aa, Glycine max
  Coding DNA Sequence Number=SeqID_5544
  Subcellular localization annotation: CTP_CleavageSite=38; ConfidenceScore=5.31e-01
MNCVFFMCPPPSSLEPCRSDCLVQFSILNLFRSPMNCVFVHVSSSFEFGAMRSDCLVQFSILNLFRKPMNCVFIHESSTFEFGAMCSDCLVQFSILNLFRSPMNCVFVHESSTFEFGAMRSDCLVLNSPFLNLFSEPMNCVFIHESYLRVWSHA

SEQ ID NO: 97230 - protein, 115 aa, Glycine max
  Coding DNA Sequence Number=SeqID_5545
MRVHCYQVSRRPSMTTDSPPLLMFPWTRSYMQERKRNKRKPTKEEVMILHEIRRPNSLKTIPSGVANCPNLPIGGRATRDSRVHLPRKENERSRHQRYFEKNVGKTGKVWSTNFK

SEQ ID NO: 97231 - protein, 144 aa, Glycine max
  Coding DNA Sequence Number=SeqID_5546
IRWRSRPHRVPLSPMDVRMYWLLPLGDQNTLVVCMLLEPVSCPSFNRRCNHRDSHYRLSPRLVLQLLMSTQRRVVLIPQGMTKTRGSTTIHNIPLCHDQIKVGVEEVRDVDAPIPIPTEEVQLVGQTLNTFVAWPTHLVKRLSE

SEQ ID NO: 97232 - protein, 128 aa, Glycine max
  Coding DNA Sequence Number=SeqID_5547
MGETDEVQERIKANLEAMKEQMAIMMEAMMSMNKIMEVNAAAVAATSVVVEVDLTPTSGLNQINHVISDMVGQRGKELGSTGGPHFVQVQNKHSFPPYDLAPNHTPLNVAHTPNEDVDNSTPIPIESQ

SEQ ID NO: 97233 - protein, 82 aa, Glycine max
  Coding DNA Sequence Number=SeqID_5548
MDKVDIFVPHPLTNACLLIQLSPECESTSRAYFQSSSNPLEIFHSLCKTPSTKSEPHRDNPSLVFKNPLQQETHSLLIPFKK

SEQ ID NO: 97234 - protein, 153 aa, Glycine max
  Coding DNA Sequence Number=SeqID_5549
MDNEEGMQEQMKADLSALKDQMASISEVMLKLQKTIEDKATATASSTVREAEPVLQPALNPGLDRNTAVFSRRYSPQAYPYGLPPDFTPRATPEDLSQAPTFEGQLPPYEDYPGQDDGEGDTHLGPLLHLKDPSLHELPQPNIVRHIPASPTP

SEQ ID NO: 97235 - protein, 245 aa, Glycine max
  Coding DNA Sequence Number=SeqID_5550
  Subcellular localization annotation: CTP_CleavageSite=68; ConfidenceScore=5.25e-01
QRNFHTSGFLGFQNNQQYQQQRQWQNHPGNQFNTDQGGSSTSPQQQMPSLYDRTTKLEETLDQFMQVSMSNQKSTESAIKNLEVQVGQLAKQLAERSSNSFIANTEKNPKEECKAVMTRSRMATHVDERKVEKKMEEHKQQLAAEPTLKSVNNLVKLEEIVEESEGDEEVETPKTVQIEIFKFSNLGLPEHFGSGVAYGGTVFGEKNCFREENPSRGAFVTLLRRFCEQIREGFPSFFTVLRSSR

SEQ ID NO: 97236 - protein, 170 aa, Glycine max
  Coding DNA Sequence Number=SeqID_5551
  Gene Ontology: Mol. function=aspartic-type endopeptidase activity; Biological process=DNA integration
MIMRGQDIYSSQDEVTTSPSSSESEEGKVEESSEEIYPQEEVDLLMVRRLLGGQSCDLTQPHFSQKVIRLVSKLSLVITPYPKPYKLQWLNDQGEMIVNQQVKVPCYIGTYKDEITLTHLGTKFVLHPQTPSQVAKDQLTMKDKKGEEEKLEKQKKNKDCKALSSKAKEK

SEQ ID NO: 97237 - protein, 77 aa, Glycine max
  Coding DNA Sequence Number=SeqID_5552
MKLASTEISLVKVVWGRASGKDATWELEGQMRDAYPTLFDTATRGGALESTRDATIANGERLSDYIKVKDELLTPGD

SEQ ID NO: 97238 - protein, 501 aa, Glycine max
  Coding DNA Sequence Number=SeqID_5553
  Gene Ontology: Mol. function=serine carboxypeptidase activity; Cellular component=extracellular region; Biological process =proteolysis
  Homolog annotation: Hit_ID=Q6W6R6; Match level="QueryCoverage=83%, HitCoverage=95%, E-value=0.0, Identity=71%"; Hit description =Putative serine carboxypeptidase
  Pfam annotation: Domain name=Peptidase_S10; Domain location=137-490; Score=546.5; E_value=2.8e-161; Accession=PF00450.13; Description =Serine carboxypeptidase
MVAAVKMTIVLMVTIAVVIVVVVSKHKKTLLHCLSLFMVYKVIETYDTEKPSNQVVNKMKKKLSLYAFLLNLSLLVLLPYSKATQADKLQDLILSKSSQKPPVTLSWAEEDALKTHSSAYVASQEGQKEADKIVALPGQPYGVNFDQYSGYVTVDPEAGRALFYYFVESSYNPSTKPLVLWLNGGPGCSSLGYGAFEELGPFRINSDGKTLYRNKYAWNVVANVLFLESPAGVGFSYSNTISDYEHSGDKSTAKDAYVFLINWLERFPEYKTRDFYITGESYAGHYVPQLAYTILVNNKFSQQNINLKGIAIGNAWIDDVTSLKGIYDYIWTHALSSDQTHELIEKYCDFTSENVSAICANATRTAFEENGNIDPYNIYAPLCQDSSLKNGSTGSVSNTPISWLLNLDDVFFYSGDTDSVVPVTSSRYSINTLKLPIQVPWRPWYSGNEVGGYVVKYNGVTFVTVRGAGHLVPSWQPSRTLTLIFSFLHGSLPPTSPWKGF

SEQ ID NO: 97239 - protein, 47 aa, Glycine max
  Coding DNA Sequence Number=SeqID_5554
MTEARQKEGRSLPPSSPRRAHLAQVSKVASSRSNRLLEEETGRPKWA

SEQ ID NO: 97240 - protein, 148 aa, Glycine max
  Coding DNA Sequence Number=SeqID_5555
  Homolog annotation: Hit_ID=Q6UUU1; Match level="QueryCoverage=40%, HitCoverage=40%, E-value=8e-18, Identity=78%"; Hit description =Putative uncharacterized protein
GKPVVPAALMNRPTRGERRFAYWALAECILAYYVLTDEGGSEVLHVAGEKRLHRCVSRICDTGYIPLPRSLTRYARSFDCGERKWLTNGAEISWKMPGRYLTGNSLQAGLYARTPRSVRPLRLIRHAPVKAKLKGQVLVTALLQASYL

SEQ ID NO: 97241 - protein, 54 aa, Glycine max
  Coding DNA Sequence Number=SeqID_5556
MPHPIRALCPDILQHMIIGRPVRVMMFCENAPTIWDQHRLKGALNPVTVDKGSS

SEQ ID NO: 97242 - protein, 168 aa, Glycine max
  Coding DNA Sequence Number=SeqID_5557
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
MAKVSTTMTIEKSISGGIATRRSPRSQIDLYLRIRVRYLGRIRRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 97243 - protein, 83 aa, Glycine max
  Coding DNA Sequence Number=SeqID_5558
HFVSKRPFRGNTRSNESRRKSLKVYQSHTGQGLTFSPWVKVYGKLGFWLKACRTAGHSICQGLASGSGIKGMSHIISMIHMQQ

SEQ ID NO: 97244 - protein, 228 aa, Glycine max
  Coding DNA Sequence Number=SeqID_5559
  Gene Ontology: Mol. function=phosphoprotein phosphatase activity; Biological process=intracellular signaling cascade
  Homolog annotation: Hit_ID=A7PHV0; Match level="QueryCoverage=63%, HitCoverage=45%, E-value=3e-18, Identity=35%"; Hit description =Chromosome chr13 scaffold_17, whole genome shotgun sequence
MDPQIIGGVYLLTKATVKFPKVLQVLRDFEQCSMYAWGPAVLAYLYREMCSANDYKIKSIGGMCILIQMWAWEHCTTLAPKRTPPVIENKPLGRRWLRRGNQHIGNDDLIVFRRKLDIMKRHEFLWEPYTTTVMSMLPPICLVGSVAWRKTKMFVDPNNANTATLGEVVETLQYMVSPQGRNTWTVDDLVPYVEKITILSDEQERIIEPVAHGPASERRFPPQQFHML

SEQ ID NO: 97245 - protein, 125 aa, Glycine max
  Coding DNA Sequence Number=SeqID_5560
MAIQVLEATLVHEAQVARRLRLAGAGGQCLVHQHINGLATGCRERIDHFRVGARIGNRLVGELLEKRLGQQHHVDALADDHASRIVIGIGWIEAVAQRGEERLGLLQILHGQVDEDHLRLWCTHW

SEQ ID NO: 97246 - protein, 135 aa, Glycine max
  Coding DNA Sequence Number=SeqID_5561
MGEVEEVQDKMKADMEAMKEQMATMMEAMMSMKKIMEANAVTIAATSTVAKVNPMPPSCLNQMNHPTLDMVGKDLGSRDGPHDVQNQNKHAFPPYGLPPNYTPPNLAYTPNEDVNNSTLILVESRQPQTDHAHVS

SEQ ID NO: 97247 - protein, 21 aa, Glycine max
  Coding DNA Sequence Number=SeqID_5562
MELSTALPENNNCLTTTTLEA

SEQ ID NO: 97248 - protein, 123 aa, Glycine max
  Coding DNA Sequence Number=SeqID_5563
MHSEAEPLEHMKKKHTGHQSVSLKNKTGDSTVLKIGDSTKVVIKQDMKGGQHKYGFNNNKCEKPEKVRVVDDETGDKHELFEVLRIASRCVFFKVFMSFLHHSTCSCHSFIIQRLHVILSPTV

SEQ ID NO: 97249 - protein, 178 aa, Glycine max
  Coding DNA Sequence Number=SeqID_5564
  Homolog annotation: Hit_ID=Q0ZCD6; Match level="QueryCoverage=74%, HitCoverage=16%, E-value=7e-07, Identity=28%"; Hit description =Integrase
QYGVNEQPEAYAANIYNRPPQQQNQKQQNNCDLSSNRYNPGWRNHPNLRWTSPPQQQQLVPPFQNAAGPSKPYVPPPIHQQSQQRQQATEAPTQPSLEELQETRASIQSLTNQMRQMATQMNQAQSQNSDKLPSQTVQNPKYVSAITLRSDNQIQVPPPVAAPTPEPVKLHSTPEKRG

SEQ ID NO: 97250 - protein, 53 aa, Glycine max
  Coding DNA Sequence Number=SeqID_5565
GGVQIAISKFAMGPSRPLFEGKKVDGGSHPARLGELRSPGRAGRQPPPPFSYK

SEQ ID NO: 97251 - protein, 79 aa, Glycine max
  Coding DNA Sequence Number=SeqID_5566
MCTCAIFGSQDALSMHEMAPRKLASKRSRKDKAAEGTSSAPEYDSHRFRSAVHQQRFEPIKGWSISPGATRPAQGRRVY

SEQ ID NO: 97252 - protein, 68 aa, Glycine max
  Coding DNA Sequence Number=SeqID_5567
EALLTRQTSYRRSQRSGRGHLSCEPPDKFQEDSTVSEGWAAFLSRQLHVASLRSFIKRLPQEAFSWLL

SEQ ID NO: 97253 - protein, 188 aa, Glycine max
  Coding DNA Sequence Number=SeqID_5568
MQLPQKPLNKKPRGLARKSMAVINSMERCGAATESSSFEGKRETDHEHIAWSKRNLSQRLCETETNMLAMITKYQEELSLATTHEHRVADEYAQVYAEKEAIGRVIDSLHQEATMWMDRFALTVNGSQELPRLLAKAKAMADTYSAPEEIHGLLDYCQHMIDLMAHIIRNRKGTCIVTQILTSYKLFE

SEQ ID NO: 97254 - protein, 36 aa, Glycine max
  Coding DNA Sequence Number=SeqID_5569
MDDEELPSPVNSDVVHRDGCKWGWGHDRPIIAPSRR

SEQ ID NO: 97255 - protein, 144 aa, Glycine max
  Coding DNA Sequence Number=SeqID_5570
MPPTRHPLDPDKSNRALGFLALITSLCQSFGVPITPSKVIQPPITRAFVEKYCTPRQAQGDAHQAADAQPPPHQADPAGSLGMERYLQHLVRQQAANHRGQVQIHECPNRRLRLHDPETCPKPRQERSLQDPPVRQRRLVWMMK

SEQ ID NO: 97256 - protein, 71 aa, Glycine max
  Coding DNA Sequence Number=SeqID_5571
MGRIKRILRLCRFEFFDKGEGRHKRIQAVSPSFFWKREKKDTKRIQAKTRKLQKAFGTKKKKKKFKEIQGL

SEQ ID NO: 97257 - protein, 126 aa, Glycine max
  Coding DNA Sequence Number=SeqID_5572
  Gene Ontology: Mol. function=RNA-directed DNA polymerase activity
  Homolog annotation: Hit_ID=A2Q3D2; Match level="QueryCoverage=79%, HitCoverage=18%, E-value=2e-10, Identity=37%"; Hit description =Putative non-LTR retroelement reverse transcriptase, related
MTSRKQNHTIRQMGIHNDKGWEWKFSWRRLLFDNEIDTTINFLREVEGQSIQQQQTDIWEWLGDPSGNYSTRSAYNLICEEIAGGQKEDWSMELWKTNIPTKIAVFAWRLCRGRLPTKENLRKRHM

SEQ ID NO: 97258 - protein, 39 aa, Glycine max
  Coding DNA Sequence Number=SeqID_5573
MENWRTALGNDIRGAPDSKAIMKHSSKLEGGGHMNSARQ

SEQ ID NO: 97259 - protein, 124 aa, Glycine max
  Coding DNA Sequence Number=SeqID_5574
MNCVFVPGSSTHELGAMRSDCLVQFSILNPFWEPMNCVFVQASSTHEFGAMRSDCLVQFSILNPFLEPMNCVFVHASSIFEFGAMRSDCLVQLSIFNYFSETPRIAFSFMRPPPTSLEPCVVIA

SEQ ID NO: 97260 - protein, 87 aa, Glycine max
  Coding DNA Sequence Number=SeqID_5575
  Homolog annotation: Hit_ID=A8ARU6; Match level="QueryCoverage=48%, HitCoverage=53%, E-value=2e-15, Identity=83%"; Hit description =Putative uncharacterized protein
  Subcellular localization annotation: CTP_CleavageSite=32; ConfidenceScore=5.46e-01
MQFAPSWTVCTNPPFSPTAAPYPVTIVLSPTRKDMLKHHWQQPLPVTSVQRVGSSENLRKTALQGGFFVFRARDYAQTKTISRRSSY

SEQ ID NO: 97261 - protein, 231 aa, Glycine max
  Coding DNA Sequence Number=SeqID_5576
MAPKKHSTKRSRRDATGEGSSAAPEFDSHRFRSADHQQCFEAIRGWSFHRERREEIARRRWTSLVTPMAKFDPEIVLEFYANAWPTEEGMRDMHSWEGQQCEFSQRRNRADGFDEEAIAQLLCTPGQDFTRTAAGRRVRIMRTSMTTLTQTWMTLLLNNVLPSDHNSDLPLPKCQLVYAIVKVFHRSSSFFFVLQSSTVEMTNNQSETKAKINSQIKLLSSPKNHFKGSTP

SEQ ID NO: 97262 - protein, 136 aa, Glycine max
  Coding DNA Sequence Number=SeqID_5577
  Gene Ontology: Mol. function=protein heterodimerization activity; Cellular component=cytoplasm; Biological process=vitamin B6 biosynthetic process
  Homolog annotation: Hit_ID=A7NZH8; Match level="QueryCoverage=44%, HitCoverage=30%, E-value=7e-12, Identity=62%"; Hit description =Chromosome chr6 scaffold_3, whole genome shotgun sequence
VELSRPELVSKERGPETFCGIFICAPAILEAWPKVQVLADYPVPSSILLSFDSSIEDQTEVAVEVVQKLQPREASTMFIENKRGYISCGSVQVEGTSTWLFKENKEGYIPCGSLACKGFYKVERNLKNRWLLGDWM

SEQ ID NO: 97263 - protein, 48 aa, Glycine max
  Coding DNA Sequence Number=SeqID_5578
MFPVLNSALKELDDTPQPKSKAGARWIVVKYFNDVRPLKAKRLKALRI

SEQ ID NO: 97264 - protein, 128 aa, Glycine max
  Coding DNA Sequence Number=SeqID_5579
  Homolog annotation: Hit_ID=A5C922; Match level="QueryCoverage=66%, HitCoverage=31%, E-value=2e-10, Identity=38%"; Hit description =Putative uncharacterized protein
MHSEHSVAGDSEHSNFEHSATNFHTGNMAQSPPHERTLREMATPDFTYESLCIQYPDKDVPYVLKTGLIHLLPKFHGLAEGVAKDWLYYLAPRSITSWDDLKRVFLEKFFPTSRTTAIRKDPSRHQAT

SEQ ID NO: 97265 - protein, 98 aa, Glycine max
  Coding DNA Sequence Number=SeqID_5580
MKRDRAYSWHSRRWCCCQGRGSRLGEGMSLRLRLLVIVTVGGEDVKAKEVEVEGMDIEGGGKEREVEGGVGLEGKAEEVRVKGEEKGGMNGAENENGF

SEQ ID NO: 97266 - protein, 135 aa, Glycine max
  Coding DNA Sequence Number=SeqID_5581
  Homolog annotation: Hit_ID=Q6UUU1; Match level="QueryCoverage=63%, HitCoverage=55%, E-value=7e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSVPAFRFTGVIPLYA

SEQ ID NO: 97267 - protein, 32 aa, Glycine max
  Coding DNA Sequence Number=SeqID_5582
VWKTRKLQKAFGTKKKKKFKEIQGLYEISAQD

SEQ ID NO: 97268 - protein, 70 aa, Glycine max
  Coding DNA Sequence Number=SeqID_5583
MQRLTLSPAPFVVLTREVRVTLWLPAPFVNQGANEPIDAKRPTSSSAPFVIQGQRVRWFLLSSSGNIQAQ

SEQ ID NO: 97269 - protein, 128 aa, Glycine max
  Coding DNA Sequence Number=SeqID_5584
MLNIQNLICGYEKISSADSPSPHVRILAKKTSRLFLVSRVLELRRSEFLIGGYVGAGASLLSTAPLFVTMTQKLVARGDTLRLSAPRHSVTPSVIDERRPMWSSAPFPEVSAFSGGDFFKSHKLSRTT

SEQ ID NO: 97270 - protein, 53 aa, Glycine max
  Coding DNA Sequence Number=SeqID_5585
MTKARQKGGKRGRWLPPSSPKRAGLLPPEDTTFCWNILEGPSGADCYLHTLVY

SEQ ID NO: 97271 - protein, 350 aa, Glycine max
  Coding DNA Sequence Number=SeqID_5586
  Gene Ontology: Mol. function=motor activity; Cellular component=cell projection
  Homolog annotation: Hit_ID=UPI00016621D1; Match level="QueryCoverage =82%, HitCoverage=42%, E-value=3e-15, Identity=30%"; Hit description =UPI00016621D1 related cluster
MSSPSEDYTSLTSEDYMSSLSEDYKSSPLEDYMSSPSEDYRSSPLEDYTSSPSECYTPSPSEDYTSLPSYGCTQTFRGLDILALRGLRVLIFRGPHVLAIRGLHTLTFRGLNVITFRGLHVLTFRGRHVLPLRGPHVLTIRGLHALAFRGLHVLSFRALHLLPYKGLPILAFRGMDVLSIRGLLAVTFRGLYVLAFRGLHVITIRGQHVLTIRGFHALAFRGLPILTFRGLHVLLFRGLHVLVIRGLHALAFRGLHAHAFKGLHVLTFRGLHVLAFRGLHALPSTGGLHVLPCRGLHVLPNRGLHVLAFRGLHVLAFRGMDVLTLRGLHALTFRGLYILHFRGLHALAFR

SEQ ID NO: 97272 - protein, 369 aa, Glycine max
  Coding DNA Sequence Number=SeqID_5587
  Gene Ontology: Biological process=transposition, DNA-mediated
  Homolog annotation: Hit_ID=Q1J7G7; Match level="QueryCoverage=10%, HitCoverage=54%, E-value=1e-12, Identity=92%"; Hit description =Transposase
MVKVGTSYVPINVSFSPKVGPGLPGINRDTRIYLFCEVIFRHSLLIPSTYDGVFEVLQWLLFLSAVPPVQLLTGWCVPATTPPDISAGKLRNCWEGRSVRASSLLRQLAKGGCAAKAIKLGNARVFPVTTLNSISRSEEEPPVQRAHAVDAGLDAQPAAEEDAEERGEQRHGQAQQHAPEPGRGGLQPNPATGPDGSVRSRRGRGLGARRGRGGGIDRGRGAGVVVRHEGPPELSSAAGGGLVPSSPGANCFRAPIKGGEDHGGVLIRPQLEQGLQIPQLERSRGLAEGPRRVPQLLRGLELAVGADHLGAPLPLGLGLASHRPLHQLGDLHVLDLDDHHVHTPGHGLMGDRLVEVLVEIRAVGEQGVE

SEQ ID NO: 97273 - protein, 220 aa, Glycine max
  Coding DNA Sequence Number=SeqID_5588
MRWRPRSSRRPRCARSSARADLDTLLAHRADLNEDLYQSIAHQAVPWGVDVVVVEIKDVEIPELMQRAMARQAEAERERRAKTLLELGADQNSTVVFPLPMDIITPLMGALKQRTLMTDHDPRTSTPVDPPAPASTGAQAPAAPAADAPVRPGRRVRLEPTPSGFWRMLLGLAVALLAPFFGILFGSGLGVETGVDRMSPLYWGFFLGPADRIPAARGIH

SEQ ID NO: 97274 - protein, 54 aa, Glycine max
  Coding DNA Sequence Number=SeqID_5589
MSDSRASYIETLEIDYGSSRQIQTAITFDSNAKGPSGEGRRPKWRRTKPPSGEG

SEQ ID NO: 97275 - protein, 57 aa, Glycine max
  Coding DNA Sequence Number=SeqID_5590
MGVQIAPRPTWALQNIPPEAEALPKRFRNVFREEFRKGFDRSSTFFIRSSSFFDLQR

SEQ ID NO: 97276 - protein, 97 aa, Glycine max
  Coding DNA Sequence Number=SeqID_5591
MQSSPLWLSECYETLRIVHQDFLLTSGTSQNFTDCATMLSFDFRHVMELHGLPNDGCQVPRSGQMRVASQQTDGPRTKLGYDTFLPNASPKFGTNLP

SEQ ID NO: 97277 - protein, 98 aa, Glycine max
  Coding DNA Sequence Number=SeqID_5592
MDIDAENLMDCVMEKNNQNFRLSIDIVVMDGRGCTVITGKEECTDLSYPNFVRGLLLDDMQPLIGRFKILGTLCCTICKFRDTPEIKGKQGYTIREIP

SEQ ID NO: 97278 - protein, 135 aa, Glycine max
  Coding DNA Sequence Number=SeqID_5593
MVQKKDKELRGSSNGPIGCYHRWLKAYTQGVDWLPNLRTTKGVEVEAPKEDEEVQALRTELEKAQIVKEKFKSTNIRIRKENTELRDINIASTKALEQETKRARREEHGQNKFRGALWGINNELKLRREERDQSR

SEQ ID NO: 97279 - protein, 119 aa, Glycine max
  Coding DNA Sequence Number=SeqID_5594
MTPVNRKAGTGERTREPPGGNAGIFIVLSGFATTDLSVRFRDAFQGGGAMEKRLSVTALAIPLMKWIVAGCNRIPAARGISHFLACRHDASRSSGRGIRPGIVIRIHIFMLRPSVFSLT

SEQ ID NO: 97280 - protein, 168 aa, Glycine max
  Coding DNA Sequence Number=SeqID_5595
  Homolog annotation: Hit_ID=Q6UUU1; Match level="QueryCoverage=51%, HitCoverage=55%, E-value=9e-19, Identity=61%"; Hit description =Putative uncharacterized protein
VNFELGVIIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSCPAFRFTGVIAVCRVCLIPRLTLSS

SEQ ID NO: 97281 - protein, 126 aa, Glycine max
  Coding DNA Sequence Number=SeqID_5596
MSFLRRFLMDCHLQETENIKLISSPELHCLTGQLTKAILKRLNVRMHMPKLSANAKKNESYAKQANKKRKEVVLEPGDDPGHLRTNVFQEGGNDENPEIGQIQAKGPSGEGRRPKWRRIKPPSEEG

SEQ ID NO: 97282 - protein, 61 aa, Glycine max
  Coding DNA Sequence Number=SeqID_5597
MACLAKDGTSFVVQVEGTSTWVIVTENKRGYISYGSVLVEGTFTRLFKENKGGYIPCGSLL

SEQ ID NO: 97283 - protein, 54 aa, Glycine max
  Coding DNA Sequence Number=SeqID_5598
MGAATNVYSRKTVEETKKGSIDFKNKGSGVVYARGRVLPLLLRILKCNEEFKLT

SEQ ID NO: 97284 - protein, 121 aa, Glycine max
  Coding DNA Sequence Number=SeqID_5599
MAKSDDNVRSQVRILVKERKEEGVEVRCGGAVRQNQLVVCDYVKSQDGVSLDLDALNGIEKEEGVVAESSDGGDLVRCLPGLRPRHRGWHKGQERQLADGNRLRLQSLGVAELELERQARE

SEQ ID NO: 97285 - protein, 96 aa, Glycine max
  Coding DNA Sequence Number=SeqID_5600
MKRRRRKRGKTRPMHYQIAIIIDFYIVLRSLFFVRHPGNGDPLPVALEKICPVSYTKSKLRDDESRSFDDNKDDDKKLKSQEHFMITKMMTSRIKE

SEQ ID NO: 97286 - protein, 189 aa, Glycine max
  Coding DNA Sequence Number=SeqID_5601
  Gene Ontology: Mol. function=helicase activity; Biological process =viral genome replication
  Homolog annotation: Hit_ID=A2Q378; Match level="QueryCoverage=98%, HitCoverage=11%, E-value=3e-40, Identity=44%"; Hit description =Putative uncharacterized protein
YDRVTTVVLYDANGALENPITQNDEIKEYVDSRYISPCEATWRIFGFPIHARKPAIEGLHFHLPGQHNVLYEDDDDIDDILSNSSISDSKFLAWMNRNKYFSEGRNLTYSQFVSKFVYNQKARSWNLRKKGNTIGRLIWVPPTTGKLFYLRMMLTTCKGPTSFEDIRTVENVLYPTYREACFAMGFFAR

SEQ ID NO: 97287 - protein, 189 aa, Glycine max
  Coding DNA Sequence Number=SeqID_5602
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=30%, HitCoverage=46%, E-value=2e-24, Identity=94%"; Hit description =Putative uncharacterized protein
MKHFTDTLISANIGTKAGTGPPLEVDGIDKLDGGLRHVVDTVEVGGALSLLTTLRTATHATQGISNYASTQSCLESEETGLDFRGIRLEDRESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 97288 - protein, 322 aa, Glycine max
  Coding DNA Sequence Number=SeqID_5603
  Gene Ontology: Mol. function=glucose-1-phosphatase activity; Cellular component=periplasmic space
  Homolog annotation: Hit_ID=Q1W5Y8; Match level="QueryCoverage=62%, HitCoverage=51%, E-value=1e-105, Identity=91%"; Hit description =Glucose-1-phosphatase
  Pfam annotation: Domain name=Acid_phosphat_A; Domain location=130 -322; Score=-27.5; E_value=1.1e-05; Accession=PF00328.13; Description= Histidine acid phosphatase
  Subcellular localization annotation: CTP_CleavageSite=60; ConfidenceScore=5.05e-01
GEFGHNLLRGQFATVVGDKRQFSQGFALFAIDKDRQPAPSAGRVLSRSGHTPARRCRRRRAEAEGYLRQPAFLKLAKARNPAERVANNQQRPPVTDDIQRTGDGAGALFKTGTFHSTFSGGAQETPEGYQLEQVLIMSRHNLRAPLANNGSVLEQSTPKQWPEWEVPGGQLTTKGGVLEVYMGHYMREWLAQQGMIKTGECPPADAVYAYANSLQRTVATAQFFITGAFPGCDVPVHHQEKMGTMDPTFNPVITDNSPEFRDKALKAMEAERQKMQLAESYKLLEQMTNYAESPSCKEKKVCSLADAKDTFSADYEKEPGVS

SEQ ID NO: 97289 - protein, 271 aa, Glycine max
  Coding DNA Sequence Number=SeqID_5604
  Gene Ontology: Mol. function=receptor activity; Cellular component =plasma membrane; Biological process=amino acid transport
  Homolog annotation: Hit_ID=A8GD79; Match level="QueryCoverage=100%, HitCoverage=100%, E-value=1e-100, Identity=69%"; Hit description =Lipoprotein, YaeC family precursor
  Pfam annotation: Domain name=Lipoprotein_9; Domain location=33-271; Score=451.4; E_value=1.2e-132; Accession=PF03180.5; Description=NLPA lipoprotein
  Pfam annotation: Domain name=NMT1; Domain location=52-262; Score= -79.2; E_value=0.012; Accession=PF09084.2; Description=NMT1THI5 like
  Pfam module annotation: Pfam domain module=Lipoprotein_9::NMT1; Domain location=33-271::52-262
MAFSLKGLTHSLALVSALLLAGCGPKDQDPNHIKVGISAGIDQQVWAVVQKVAKQKYNLDVEVVTFNDFVLPNEALNNGDLDINAFQHKPYLDKQIQERGYKLVDVGTTFVYPIAAYSKKITAISQLPDGAQVAVPNDPTNLGRSLLLLEQQGLITLKEGVGLLPTALDIVNNPKKLKIVEIEAPQLTRALDDKQVTMAIINTTFSSQIGLSPTRNGLFIEDKNSPYVNIFASREDNKDSEKVKNLVKAYQTDEVANAAAELYKGDAVKGW

SEQ ID NO: 97290 - protein, 250 aa, Glycine max
  Coding DNA Sequence Number=SeqID_5605
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSISSFLELQRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPRRYLTG

SEQ ID NO: 97291 - protein, 236 aa, Glycine max
  Coding DNA Sequence Number=SeqID_5606
  Gene Ontology: Biological process=transposition, DNA-mediated
  Homolog annotation: Hit_ID=Q1J7G7; Match level="QueryCoverage=16%, HitCoverage=67%, E-value=2e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVTTLNSIVQHDPEDINLVSYPLVKPNSNLSYKETFEVNNTVQKKACNAELQDLGLITNGPTSKGEESVLSLKVYSRSSLSIPSTSRGGPVPAFVPFSEVGKPVVPAALMNRPTRGERRFAYWALAECILAYYVGTDEGVSEVLHVAGEKRLH

SEQ ID NO: 97292 - protein, 90 aa, Glycine max
  Coding DNA Sequence Number=SeqID_5607
NGADMEAMNEQMVAMMEAMMSVKKIMEANAVAIAATSVVAKVNPTSPSGINQMNHPTSNMGKAVGGIPLQNTWEGPSVSPTTTPLTFHSK

SEQ ID NO: 97293 - protein, 74 aa, Glycine max
  Coding DNA Sequence Number=SeqID_5608
MLYVNPYHQNDHLQRAEDPKVHLPVMPYAYGTGKDRPSQFDDQFERPTTESNPPQKPEQDLLNGEARYDTKYSA

SEQ ID NO: 97294 - protein, 48 aa, Glycine max
  Coding DNA Sequence Number=SeqID_5609
MDYENEQECGVNEPHVDCSDAFNTSKVYKLSVQKEKENHAREMMCKNK

SEQ ID NO: 97295 - protein, 252 aa, Glycine max
  Coding DNA Sequence Number=SeqID_5610
APSPNLQRTTRPRLGQHVLAIRVLHDLTFRGLHVLAIRGLHALTFRGLHVLAIRGLHTLAFRGLQRPRALTSEDYTAAHVLAIERSSFTFLAIRGHACPHLQRTTLSSSSEDYTSSPVEDYTVLAIREVVRPHLQMTTRPHHQRAARPQLQRNTLPRHRRAAFPHLPRTTLPRHQRIALPRRQRTSTPSFRGLHVLAIRGLQALTFKGLHVLVNQRAAHAWPLEDFTVLAIRGCTPSPSKGNTSSPSEGCTP

SEQ ID NO: 97296 - protein, 73 aa, Glycine max
  Coding DNA Sequence Number=SeqID_5611
MSLSLQSRGFTSFPCPTPDLFRAEVAWPRDWPEAWAGEAPAEAPAGASDKADEAREDEEMTDLLDFLGGSGAT

SEQ ID NO: 97297 - protein, 142 aa, Glycine max
  Coding DNA Sequence Number=SeqID_5612
  Pfam annotation: Domain name=G-patch; Domain location=1-42; Score =13.7; E_value=0.0042; Accession=PF01585.14; Description=G-patch domain
MVEWVMLKHGLEPGMGLGKDGLGNADIVDIRGNPYKYGLGYEPGMPGRRNVPSRLRADRAWPGRISQCFASAGMMSEEEVAAVGEEFPLDPPNFMQPCHPNSQVGNRRVISQSEVYTADSIYEGRFFGDPNNEGLTIDFDRD

SEQ ID NO: 97298 - protein, 108 aa, Glycine max
  Coding DNA Sequence Number=SeqID_5613
MPPSKDPTLLATAHHPPPNAVGRGRGTLRHNSNPHLGYNRVAYPYGLPPNYTLPVMQDDAGHVSSPILEGEPPRQPDEVHEDHQEYAQGDVEFYPAIPVEGPASNTLP

SEQ ID NO: 97299 - protein, 245 aa, Glycine max
  Coding DNA Sequence Number=SeqID_5614
MSEVEEVQEQMKANMEAMKEQMATMMEAMISMKKIMEANAVAVAATSTVAKVKPMPPSGLNQMNHPTSAMVGKDLGSAGGPHYMQSQNKHAFPPYGLPPNYTPPNVTYTPSENVNNSTPILIESRQPQTDHAHVSQPMGETHEMPQHNLADFKPCLGYATEGQAIDGIPLQNPLEGPQYHPQLHLLHSTTSKNPHAMAEMGNLDHLEERLRAIKGGEDYAFANLEESFLVPNIITPPKFKVLDFD

SEQ ID NO: 97300 - protein, 296 aa, Glycine max
  Coding DNA Sequence Number=SeqID_5615
  Homolog annotation: Hit_ID=Q6WAY6; Match level="QueryCoverage=14%, HitCoverage=7%, E-value=1e-07, Identity=59%"; Hit description =Putative uncharacterized protein
MACNLRLTDSRNLIPIVKQFVKFRDMSGVERKHYCAIRKVPWKQPSSPGRARWQPPPPASGGSNPTRLDELGGNLLPLFLIKRQKGVVLRVPDPPGYAFQLKSVKVFLRSSPFFIRSSFFNGMPAGRKEAVSVFWILPLHCKCRKSGQDLGIRVRPSEAKQEWGGRYTKAALGGKDGLVDLAMIDVFLAYHHNKESPVIAVLANAYDIFDLRCEKTSRPVCPLQGHRMCAKKGKANWEELLAGFPNIPLMGTRGCINYNPILAIRQLGYPMRGVPSKEIIAPFVAQGFSEGNAKRL

SEQ ID NO: 97301 - protein, 79 aa, Glycine max
  Coding DNA Sequence Number=SeqID_5616
MHLCDEGGLVGACAPSATMARLACISEFQLSARLFTQWMDSSGVLSGISPRSENIYSLSFFQILPRAQPQEWCAQRMAR

SEQ ID NO: 97302 - protein, 236 aa, Glycine max
  Coding DNA Sequence Number=SeqID_5617
  Homolog annotation: Hit_ID=A5B1P9; Match level="QueryCoverage=59%, HitCoverage=13%, E-value=1e-09, Identity=26%"; Hit description =Putative uncharacterized protein
MDMPRMAEEKAKDKKSIGLSLKSAIPTSDDSEEEDVEGSEAENLTLFKQQNGEKKSRSHNKKNTTYIAWEENASSTSSGSSDEEEANLCLMANEEVDSYVSAFDSESDENYDQLFDAFNEMHEEAQKLSIANNFLKGKLRDNLDALLAQQKCTFDKAGPSYTFDEKQKSFKNLFKFVKGSNTPFTTCRYCMHKGHSSMNCMIKKFGVRNGKYKWIPKGTKKPSNKCSILIVDVQGI

SEQ ID NO: 97303 - protein, 66 aa, Glycine max
  Coding DNA Sequence Number=SeqID_5618
MGGCAILLQSWAWYRMSFFAPRVPRPETTYPLAKRWSGGRLEYRVTPHGDLVRYRSRIDHMESHEV

SEQ ID NO: 97304 - protein, 289 aa, Glycine max
  Coding DNA Sequence Number=SeqID_5619
  Gene Ontology: Mol. function=transferase activity, transferring phosphorus-containing groups; Cellular component=integral to membrane; Biological process=two-component signal transduction system (phosphorelay)
  Homolog annotation: Hit_ID=A6TBH7; Match level="QueryCoverage=98%, HitCoverage=58%, E-value=1e-127, Identity=82%"; Hit description =Sensor protein
  Pfam annotation: Domain name=HAMP; Domain location=5-74; Score=72.8; E_value=1.2e-18; Accession=PF00672.16; Description=HAMP domain
  Pfam annotation: Domain name=HATPase_c; Domain location=187-287; Score=106.1; E_value=1e-28; Accession=PF02518.17; Description =Histidine kinase-, DNA gyrase B-, and HSP90-like ATPase
  Pfam annotation: Domain name=HisKA; Domain location=78-142; Score =54.4; E_value=3.9e-13; Accession=PF00512.16; Description=His Kinase A (phosphoacceptor) domain
  Pfam module annotation: Pfam domain module=HAMP::HATPase_c::HisKA; Domain location=5-74::187-287::78-142
QKRTSWLIVALATLLAALATFPLARGLLAPVKRLVEGTHKLAAGDFSTRVTVTGGDELGRLAQDFNQLASTLERNQQMRRDLMADISHELRTPLAVLRGELEAIQDGVRKFTPDSISSLQAEVGTLTKHGDDLHQLSMSDEGALAYQKESVDLIALLEVAAGAFRERFASRGLTIGVSLPDNAIVFGDRDRLMQLFNNLLENSLRYTDSGGRLQIDAKQNGRMLTLDFADSGPGVSDEQLARLCERFYRTEGSRNRASGGSGLGLAICMNIVAAHGGSLNAGHSPFWRG

SEQ ID NO: 97305 - protein, 105 aa, Glycine max
  Coding DNA Sequence Number=SeqID_5620
MYQYPFEGHDTDMSASEHSFGGVAETHPHFSWPTMTPSQQHDAPMTTPNAPISSAMECVDLRHEFSAEAEQQGRRQRARRNPNRQARRWDRPCGTSSRHHRHHND

SEQ ID NO: 97306 - protein, 44 aa, Glycine max
  Coding DNA Sequence Number=SeqID_5621
VMWDATVFGVFDENFPLYIKHEDLSEITHGGQCLSISVIQLWIL

SEQ ID NO: 97307 - protein, 93 aa, Glycine max
  Coding DNA Sequence Number=SeqID_5622
MGTKYLEVVKGGSHPNNGWSRTKLGYDEPHKGAWLAPGTKSIWCSIPLKGGSPGGISLGNISPNSCKSSWTFGGKVSNVGIVAVLRDVSLDRR

SEQ ID NO: 97308 - protein, 200 aa, Glycine max
  Coding DNA Sequence Number=SeqID_5623
  Homolog annotation: Hit_ID=UPI00006A2D9E; Match level="QueryCoverage =68%, HitCoverage=86%, E-value=9e-11, Identity=16%"; Hit description =UPI00006A2D9E related cluster
GGPLGTSTLTFRGLHILTFRGLHALAFRGLHVLAFKGLHVLAIKGLHGYMHALRGLCVLTFRGLHALAFRGLHALTFRGLHVLTFRGLHVLTIRGLHILAIRGLHALTFRGLHVLTFRGLHVLAFRGLHTLSFSGLHALAFNGSVLGPPPDLGGGPTGRAQLEEEAIVQPLCILGQDFTCAVTKRRVRIMCTNMATLTQI

SEQ ID NO: 97309 - protein, 288 aa, Glycine max
  Coding DNA Sequence Number=SeqID_5624
MNSPSEDYTSSPSEDNMSSPSSSEDYMSSPLEDYTSSPLEDYTSSPSVGYTPSPSKGCKPSPLEGYAFSLSFLGHPPDIGGRPTVQAQPEREAITQLLCIPGQDFTRAAAKKRVWIMCTNMTTITQICMTLLLSNILPCRCISWSVSSRHRDRDHKAPSGPGGVQRGPGVSSFGYGPLSVLQGARSPPARSRHCDIGIVTTRHPVDPEESNGALGSPALVTGLCQSYGVAVAPSKFIRPPINRAFIKKYCAPRQAQGETPQKPGEGRQRATDAPPPPLEFTSAHPQKG

SEQ ID NO: 97310 - protein, 122 aa, Glycine max
  Coding DNA Sequence Number=SeqID_5625
MVEREMITMMVDTLPVFYYEKLVGYMSSSFADLVFAGKRIKVGLKRGKFDYVSFTSANAKRIGTTGAKRKEGDTHAVSSTPAWVKPPQAPHGTHQYAQHHPSFSAHTGNASSSAPVQPKAPT

SEQ ID NO: 97311 - protein, 112 aa, Glycine max
  Coding DNA Sequence Number=SeqID_5626
  Subcellular localization annotation: CTP_CleavageSite=45; ConfidenceScore=5.41e-01
MRVHYNQASRRPSMTTNSPPLLMFPRTRWSHQLSQPTLRREGDVRLMGASSKKGKRAESPPTFIREKRQKNRKRRGLRTIRVKGSGVVFTHGECISTPHVRHKGRQPLSVQI

SEQ ID NO: 97312 - protein, 48 aa, Glycine max
  Coding DNA Sequence Number=SeqID_5627
TAEGTTTETTANGRNKQSKRKKKQSKRKKKQSKRKKKQRKRSKTQPED

SEQ ID NO: 97313 - protein, 71 aa, Glycine max
  Coding DNA Sequence Number=SeqID_5628
MGFEIYPEVHENPRAFFSRSSLILLKSSIQYPWGVGLHHLLSFSFHSSSPTFNLLSMASYGGELVLDSSSP

SEQ ID NO: 97314 - protein, 114 aa, Glycine max
  Coding DNA Sequence Number=SeqID_5629
MSASPDRDYFSLAHHKSKNYSDDMRRYPSGYPHKRFLLILTRETNVVFCTLCQSGASKPIDTQRLMSSSAFSVILTREVSVVFCTHCQSGANELVNTQRLTSSSAHSVILTREV

SEQ ID NO: 97315 - protein, 145 aa, Glycine max
  Coding DNA Sequence Number=SeqID_5630
MHYYVRMNQAGASVYSNRAHHILSTTLVLLMTLPDLYDDNSVMLLRWCPSGLTLNYPAASNPLLVGGDYSRPAGNKVGGQRIHSSNNYDATSGIGDRGGGGCDLNSCTVVGQASTIDIYIYYYMNRASGLAVTGKREAPAHTTLL

SEQ ID NO: 97316 - protein, 78 aa, Glycine max
  Coding DNA Sequence Number=SeqID_5631
MANFMILIIPSFLENICPQMSRIITGFKYHFLPFLVDLLGIAFILLCNLHLHLAMKLRGGDQLDVLCLLKVVVHEESP

SEQ ID NO: 97317 - protein, 208 aa, Glycine max
  Coding DNA Sequence Number=SeqID_5632
  Gene Ontology: Mol. function=motor activity; Cellular component=cell projection
  Homolog annotation: Hit_ID=UPI00016621D1; Match level="QueryCoverage =85%, HitCoverage=40%, E-value=7e-17, Identity=34%"; Hit description =UPI00016621D1 related cluster
MHAITFKGLYALAFRGLHVLTFRGLHALAFRGLHVVPFRGQHVLDFRGLHVLAFRGLHALSFKGLHVLAFRGLHVLAFRGLHALAFRGLHVLLFRGLHVLAFRGLDVLTFIGLHALTFRGLYVLPLRGLHILAIRGLYVLVFRGLHTLTFRGLHVLPFRGLRALAFRGLYVLTFRRLHVVPSKGDTPSPLEDYTPSPSWGYTSLPSED

SEQ ID NO: 97318 - protein, 213 aa, Glycine max
  Coding DNA Sequence Number=SeqID_5633
  Subcellular localization annotation: CTP_CleavageSite=68; ConfidenceScore=5.58e-01
MRRNSPASSSDTSFLPQPSFFSERPFIGISSSGAEITLSFCSSAILAFPLVFAGCVGRSGGANTRPLRVMPLSPVILVTLADNELMSVASSFLSLGGAYLHGTAWLFWYENGIGLTTEGYWGAWGAASLVKYTTKGLGFLRPSSSADCMHMCYSSPSSSSTSSRPWSIICCNRSRQGYTTLGKEAGRSFREISQPSGWRRGMARGLRTSLGSG

SEQ ID NO: 97319 - protein, 30 aa, Glycine max
  Coding DNA Sequence Number=SeqID_5634
MYQISCLACKEGVSKLPEPIDSEDGSMLEM

SEQ ID NO: 97320 - protein, 87 aa, Glycine max
  Coding DNA Sequence Number=SeqID_5635
  Gene Ontology: Mol. function=structural constituent of ribosome; Cellular component=chloroplast; Biological process=translation
  Homolog annotation: Hit_ID=Q32703; Match level="QueryCoverage=43%, HitCoverage=90%, E-value=7e-12, Identity=86%"; Hit description =Putative uncharacterized protein
MNSQYICFYLMPFFVHGSIFWCPRRRGTTPIHPELGGYSGEQISSGDDGVGPVAQRIRARGYEPRCRGFESLLAHNRPKKGRIFPLG

SEQ ID NO: 97321 - protein, 178 aa, Glycine max
  Coding DNA Sequence Number=SeqID_5636
MTWKYDLLIDVGNALACACCVCSWGALCTDLSGSLALAFGHVHTLDVVRTPFRHPKTIESYGTQTQIMVILHLLSSRGSEPNDMWRQIVVIRAPFRHSDTIESDGTQRQIMVILHLLSSRGETIKFDSTRRQILVIRTLLLSGQRVGWWAEIPYGHPHLSSTEGNEFSSIRMMLVVQC

SEQ ID NO: 97322 - protein, 126 aa, Glycine max
  Coding DNA Sequence Number=SeqID_5637
MKANKTRNELKVSDSKTYRLKNEERMKNSGKPSRICLWKRLGSITEAPRLGFSSRKQFFHPKQLKCIAKGEKGGGGCRPARPGLYRLCNNALFDFQNVADLYRLRNNACFDFRNVVRLYGLHIDRC

SEQ ID NO: 97323 - protein, 123 aa, Glycine max
  Coding DNA Sequence Number=SeqID_5638
MSQKFTDSTAMSVKPSEVINNGQLNANDIPHGTPLGSIDYTFDRIPLTDLKCLTKTFTPGYGVNRFLLSVPGPPPDIEGRPTVLAQPEREAIAQLLCIPGQDFTRAAVKRRVRIMRANMTTLT

SEQ ID NO: 97324 - protein, 55 aa, Glycine max
  Coding DNA Sequence Number=SeqID_5639
  Subcellular localization annotation: CTP_CleavageSite=47; ConfidenceScore=5.42e-01
VFGHGGELSYWRGVSSPPLASQAPFSFSRKLSSSSFRRKLPSLLLKEASYVLSYK

SEQ ID NO: 97325 - protein, 118 aa, Glycine max
  Coding DNA Sequence Number=SeqID_5640
MKADMEAMKEQMATMMEAMMSMKKKIEVNAAPIAAPSIVAENKRAFPPYGLPPNYTPHNVVHTPDENADNSEPISIEGQQPQSDHAHVSQPIGETYEVPHHNLDDFEPYLKYATEGQA

SEQ ID NO: 97326 - protein, 228 aa, Glycine max
  Coding DNA Sequence Number=SeqID_5641
  Homolog annotation: Hit_ID=A5ANP1; Match level="QueryCoverage=18%, HitCoverage=12%, E-value=2e-07, Identity=54%"; Hit description =Putative uncharacterized protein
SKEYGEIESISIEDLIAKQEKKKKIDVASKPIRLFLIFSKLDKDLMKLDTRSPDWLIPSRPSVESPLVIPINPNVNVRFYLGFRVLGLNITLYHPRRIVMSTISSASNALKSKELGLKGEVFDNTKEKIQDMKDMKEGFPTNKPPLFRGIKYDYWKERMIAHFESIHIDLWDVVENGPKREKSLALNSQKNKKASSSIEHVSRSSSKALKANDESEEDSDEDEIAFIS

SEQ ID NO: 97327 - protein, 556 aa, Glycine max
  Coding DNA Sequence Number=SeqID_5642
  Gene Ontology: Mol. function=protein binding; Cellular component =cytoplasm; Biological process=phosphate transport
  Homolog annotation: Hit_ID=Q4R0J3; Match level="QueryCoverage=40%, HitCoverage=91%, E-value=1e-114, Identity=92%"; Hit description =Phosphate regulon repressor protein
  Pfam annotation: Domain name=MFS_1; Domain location=271-540; Score= -7.8; E_value=0.034; Accession=PF07690.7; Description=Major Facilitator Superfamily
  Pfam annotation: Domain name=PhoU; Domain location=128-213; Score =111.6; E_value=2.4e-30; Accession=PF01895.10; Description=PhoU family
  Pfam annotation: Domain name=PhoU; Domain location=25-113; Score =116.1; E_value=1e-31; Accession=PF01895.10; Description=PhoU family
  Pfam annotation: Domain name=Sugar_tr; Domain location=266-553; Score= -172.1; E_value=0.029; Accession=PF00083.15; Description=Sugar (and other) transporter
  Pfam module annotation: Pfam domain module=MFS_1::PhoU::PhoU::Sugar _tr; Domain location=271-540::128-213::25-113::266-553
MDNLNLNKHISGQFNAELEHIRTQVMIMGGMVEQQLTDAITAMHNQDGELARRVIDGDQKVNMMEVEIDEACVRIIAKRQPTASDLRLVMAIIKTISELERIGDVAEKISRTALEKFGQQHLPLLVSLESLGHHTVQMLHDVLDAFARMDLNEAIKIYREDKKVDKEYEGIVRQLMTYMMEDPRTIPSVLTALFCARAIERIGDRCQNICEIIFYFVKGQDFRHAVRLISACSQPAALFILGAHFSARCCFMSSANNNKTAVTPAKAMVAAVSGYAMDGFDLLILGFMLPAISVSLALDASQAGSLVTWTLIGAVVGGIVFGHLSDRYGRIRILTVTILMFSLFTGLCAVAQGYWDLLAYRTLAGMGLGGEFGIGMALIAEAWPKEKPRRIAGGLYHAAAAERDWLARYVPGWPAAGAEFWLLRPDDMDAKLSLFQLWLQPDQIRPVDGRYGGGHDIRHLAVRRAGGPLCALEDFPAVPVWCRGDGGGLRPAARPDGDAVYRMCCLTSAAASAFRPAGDRHAGHAYFLHRCDYAAGADLPAGYCRYAVPAAKKPGQ

SEQ ID NO: 97328 - protein, 313 aa, Glycine max
  Coding DNA Sequence Number=SeqID_5643
  Gene Ontology: Mol. function=oxidoreductase activity; Cellular component=intracellular; Biological process=electron transport
  Homolog annotation: Hit_ID=Q11FQ5; Match level="QueryCoverage=29%, HitCoverage=57%, E-value=2e-20, Identity=51%"; Hit description =Flavin reductase-like, FMN-binding
  Pfam annotation: Domain name=Flavin_Reduct; Domain location=174-299; Score=44.9; E_value=2.9e-10; Accession=PF01613.9; Description=Flavin reductase like domain
HADMLPGIGDTEVRQIRIGKAEATAAAGDQRRQVTNTIDAQHQLGQQRACGKKAAAALIRQVPGAGHHILWNPHGIWGEGRVNHPTNKMTSHLSLRENGRIIIRAIVRIFSWVCIRLTLDSQIWTGKSCTMKCLNYSPICQSCASQTMHVGVVMSVTSLARQESISLDEFRHGMRRLTAGVSLVTTSSSGEKFGLIATSVSSLAAEPPSLLVCVNRSASSHDAILQAGYFAVNVLREQHDDLCAQFSSPTRRAERFQSAGKNGGVEHPQRAAGAYRGYCAAGRSDSADGLLQQRFSLAGLSHGAARASGGCAA

SEQ ID NO: 97329 - protein, 54 aa, Glycine max
  Coding DNA Sequence Number=SeqID_5644
MASKRCWCSALLKRWLSNSGAALVPAAAASFLDLFEESFLGAISCEDRQLEELP

SEQ ID NO: 97330 - protein, 104 aa, Glycine max
  Coding DNA Sequence Number=SeqID_5645
MAYERGGDFLEDARKILNREAFPPGGSLVRSPVPAFRFTGVIPLLWPRLSHSTPDTQFRVGSSLQAGLYARTPRFSPTAAPYPGNYRLESNPGKTCKSTTGSSH

SEQ ID NO: 97331 - protein, 91 aa, Glycine max
  Coding DNA Sequence Number=SeqID_5646
  Gene Ontology: Mol. function=structural constituent of ribosome; Cellular component=intracellular; Biological process=translation
  Homolog annotation: Hit_ID=Q32703; Match level="QueryCoverage=46%, HitCoverage=100%, E-value=1e-11, Identity=80%"; Hit description =Putative uncharacterized protein
MNSQYICFYLMPFFVHGSIFWCPRRRGTTPIHPELGGYSGEQISSGDDGVGPVAQRIRARGYEPRCRGFESLLAHNRPKKGRIFPSGGRKS

SEQ ID NO: 97332 - protein, 19 aa, Glycine max
  Coding DNA Sequence Number=SeqID_5647
MVQGKFVPNLGELLSRYGS

SEQ ID NO: 97333 - protein, 78 aa, Glycine max
  Coding DNA Sequence Number=SeqID_5648
  Subcellular localization annotation: CTP_CleavageSite=56; ConfidenceScore=5.09e-01
MVLVAAITAALTSIISCMLIMASIIVAIFSFKASMSALIYSCTSSISPITLALARVCSVFKERMQWAVQPMKSMDVCE

SEQ ID NO: 97334 - protein, 113 aa, Glycine max
  Coding DNA Sequence Number=SeqID_5649
  Homolog annotation: Hit_ID=A2Q1D6; Match level="QueryCoverage=78%, HitCoverage=14%, E-value=4e-12, Identity=41%"; Hit description =Ovarian tumour, otubain, related
MPEEVNMNEDNGEEPLIMRSDIDTRNRGRTLYVLIGCERSGKYRAYKKDLVRTVIGSRKYKCPFNLRVKPVLGGEGWMMKLICGNHNHALAKSLVGHSYVGRLTKDEKLLLVI

SEQ ID NO: 97335 - protein, 123 aa, Glycine max
  Coding DNA Sequence Number=SeqID_5650
TGAGWQPAGPRRTAATSQAYPAGSFDMERYLRHLVRQQAANHRAYVQTHDCLYQLSLSLQSQGFASFPCPTPDQFRAEVAWPGDWFEAQAGEAPAEALGDADEARMDEEMTDLLDFLGGSGAT

SEQ ID NO: 97336 - protein, 83 aa, Glycine max
  Coding DNA Sequence Number=SeqID_5651
  Subcellular localization annotation: CTP_CleavageSite=36; ConfidenceScore=5.70e-01
MASPPASPPPPPPPPSPPLAPFDASASLSAVKRTCKASRLPSLSTRPPGAERPVVHIDPAIGKVDVTYENWKEVPTAQNIIVY

SEQ ID NO: 97337 - protein, 69 aa, Glycine max
  Coding DNA Sequence Number=SeqID_5652
MGEEDKKSEENKVEEKKENELEKKEEEKKPEESKDDKESKEESAPLEIVPGTTFAMHGHFKHDFWHLLS

SEQ ID NO: 97338 - protein, 179 aa, Glycine max
  Coding DNA Sequence Number=SeqID_5653
  Homolog annotation: Hit_ID=UPI00016621D1; Match level="QueryCoverage =91%, HitCoverage=40%, E-value=6e-17, Identity=32%"; Hit description =UPI00016621D1 related cluster
VSYTSSPPEGCTPSPDLNFRGLHVLAFRGLHVLAFRGLDALVFRGLHAVTFRGLHVLTFRGLHVLAFRGLDTLAFRGLHALAFRGLHVLTLRELHILTFRGLRALTLRGLYILTFSRLHALSFRGLHILAFRGLHALTFRGLHVLTFRGLHVLTINGLHVLAINGLHAFAFIGLHILPF

SEQ ID NO: 97339 - protein, 150 aa, Glycine max
  Coding DNA Sequence Number=SeqID_5654
MTMIVDTLPVFYYGKRWATHLQSFEDLVFASERIDVGLKKGKFDHPTRTTEKTGANKEGEDEGETHAVTAIPVRPSFPPTQQYLYSANNKLSPYPPPSYPQRPSLNLPQSLSTALPMTNTTFSTNQKHQPRSEFCSEKACRIHPNSSVLC

SEQ ID NO: 97340 - protein, 151 aa, Glycine max
  Coding DNA Sequence Number=SeqID_5655
MAPTRHPLDPDKSNRALGFPTLITGLCQSFGVPVTPSKVIRLPITRAFIEKYCTQRQYLRHLVRQQAANHRAHVQTHDCLYQMSLSLQSQGFTSFSCPTPDQFRAEVTWPGDWPEAQAGEAPAEAPDEADEACEDEEMTDLLDFLGGSGAT

SEQ ID NO: 97341 - protein, 184 aa, Glycine max
  Coding DNA Sequence Number=SeqID_5656
  Gene Ontology: Mol. function=DNA binding; Biological process=DNA recombination
  Homolog annotation: Hit_ID=A8A826; Match level="QueryCoverage=95%, HitCoverage=29%, E-value=4e-62, Identity=68%"; Hit description=Site -specific recombinase, phage integrase family
MSQRYKLYRRTSGIYVVRISVPQRFRRYAGQCEIHTSTGTHDLHEAKQKSALLLAVWYQTLHEYELMDYQALSDSAPLLAGEGMISLSNFSQAIELPVAQLIQAVINRNLPVFWLATGQAGFYVETLSEAELDPLDGSYVLNYGEEQGIEGVAKGYLQLTAQPAHLRNIISDGYSEASVFSGIL

SEQ ID NO: 97342 - protein, 62 aa, Glycine max
  Coding DNA Sequence Number=SeqID_5657
  Homolog annotation: Hit_ID=A5BSW9; Match level="QueryCoverage=88%, HitCoverage=4%, E-value=2e-08, Identity=52%"; Hit description =Putative uncharacterized protein
MKPKRIKVIPEWPTPPSIKKIWGFHDLTNFYKRFVPYFSILVAPLIELVLIKKAQSFKKLRI

SEQ ID NO: 97343 - protein, 285 aa, Glycine max
  Coding DNA Sequence Number=SeqID_5658
  Gene Ontology: Mol. function=motor activity; Cellular component=cell projection
  Homolog annotation: Hit_ID=UPI00016621D1; Match level="QueryCoverage =98%, HitCoverage=40%, E-value=1e-16, Identity=32%"; Hit description =UPI00016621D1 related cluster
MGLHILAFVGIHALAFRGPHVLPFIGLHALTFRGLCVFTFRGLYPLAFRGLHVLPFRGQHVLGFGGLHVLTFRGLHVLGFRELHVLSIRGLHDLIFRGLHVLVLRGLHALTFVGLHALTFRGLHVLEFIGLHALSFRGLYVLQFRGLHLLTFRGLNVLGFRGLHIPTFRGLHVLPFRGLHLQRATRPRLQRTTRPRHKGPHALAFVGQHTLSFRGLHVLAFIGLHALAFRGLHVLPFRGLRVLTFRGLHVLTFRGLHVLSLRELDVLTFRGLHILTFKGLHALAF

SEQ ID NO: 97344 - protein, 74 aa, Glycine max
  Coding DNA Sequence Number=SeqID_5659
YILCGTSKGSIYLGLTGNKRGYISCGSVLVEGTSTRLFKENKGGYIPCGSLFVKGFLQGWKRNLKDHRSLEDWM

SEQ ID NO: 97345 - protein, 118 aa, Glycine max
  Coding DNA Sequence Number=SeqID_5660
MLLRGVYADLPRAPASWLVEIWVHGRLRRDKMVDEPRSRPITCEPVSSGPIDDPLRARTLPTRPQKRPQWRTGPKSPGRGAREGESPVVPDPVAPRGAVGESGCLGMQPQSAGNSVQG

SEQ ID NO: 97346 - protein, 242 aa, Glycine max
  Coding DNA Sequence Number=SeqID_5661
  Homolog annotation: Hit_ID=A7J0K4; Match level="QueryCoverage=51%, HitCoverage=41%, E-value=3e-08, Identity=31%"; Hit description =Putative polyphenol oxidase
  Subcellular localization annotation: CTP_CleavageSite=70; ConfidenceScore=5.31e-01
VGTLDVGFGVGALVGAGASARLARKVLGQKRQRRWALRGDSSYGDNSLTSRNTGSAFGTPLSPPEPTNCVQPTVPNLGSLIADPTTFALPFWNWDHPNGMKMPFMIYTDEYSYLYDHLREAIDLPWLHVSPDIHVKPENLAPRVGAKQALDLKALRFPLTLNSIERTTVNMPKVESRNEELMEELLLIDVEYDRSEDVRFDVYINDKATIVTDLLKELEVKDDDSTIAVTLVPKYGNKPVTV

SEQ ID NO: 97347 - protein, 293 aa, Glycine max
  Coding DNA Sequence Number=SeqID_5662
  Gene Ontology: Mol. function=hydrolase activity, hydrolyzing O -glycosyl compounds; Cellular component=extracellular region; Biological process=carbohydrate metabolic process
  Homolog annotation: Hit_ID=A5AJ61; Match level="QueryCoverage=56%, HitCoverage=22%, E-value=4e-37, Identity=49%"; Hit description =Putative uncharacterized protein
  Pfam annotation: Domain name=DUF593; Domain location=103-196; Score =139.4; E_value=1e-38; Accession=PF04576.6; Description=Protein of unknown function, DUF593
MGEVLQKIGTEETTSTNTHPVVCDSAPINPKEENSSNINMSSVTTKEREETGFIKEKPTTEEVDAEASSLNKVQIFRKSSSVESGLDSLDESNISEIQRESNDDRLRRRIEYYKKCNDSLQKEVEEERNASAVATNEAMSIITRLQEEKAALEMEALQYFRMMEKQAEYDNDELEKVNGLLTEKEKEIQDLEAELEFYRSNMTSSNGSLEDHLACKNNTPPLSWQARIRIAAETAAALAAASMIFKKVFQFADKYRGPYSNGLKPVVCPFYCSYSGYEDELLWGAAYLASQGY

SEQ ID NO: 97348 - protein, 175 aa, Glycine max
  Coding DNA Sequence Number=SeqID_5663
  Gene Ontology: Mol. function=oxidoreductase activity; Cellular component=chloroplast; Biological process=metabolic process
  Homolog annotation: Hit_ID=Q94KC2; Match level="QueryCoverage=50%, HitCoverage=19%, E-value=4e-21, Identity=49%"; Hit description =Polyphenol oxidase
MSLSNYFGTIYIDRRLTTTSKKHAPSMIQKFMWTTVYIAASPIPQELYYFEQGPHNNAHGWTAARDPIFFAHHSNVPGGYRRDFTDDDDWLESSFLFYDGNKNLVRVKVVKDCLDSRKLGYDYEYVDTQWLRTRTIPKYPVSLPLPVPLPQPLPFHSTYNCVERGRKGEGVSDGS

SEQ ID NO: 97349 - protein, 120 aa, Glycine max
  Coding DNA Sequence Number=SeqID_5664
MKCYKEFWPFLLCTKYALFQKKLGWRLDLVLVIIYNLTGHGFNLASPMDLILVVGKLVVRPQAKDVVLASFISVVIKAFNINIHAPKAGKIISWFPSLCSFQRLGQALAGGGFPFSPQGF

SEQ ID NO: 97350 - protein, 410 aa, Glycine max
  Coding DNA Sequence Number=SeqID_5665
  Homolog annotation: Hit_ID=Q84VH5; Match level="QueryCoverage=90%, HitCoverage=61%, E-value=1e-156, Identity=71%"; Hit description =Envelope-like protein
VPTSSTPNVSVPDVEKDVPTSSGPNAEVLSSPSKERSTEEDDQATKETPAPRAPEPAPGDLIDLEEVESDEEPIANRLAPGIAERLQSRKGKTPIKRSGRIKNMAQKKSTPITPATSRRSKVAIPSKKRKEISFSSSDSDDDVEPDVSTSKRAKKSGESGNMCINADLRLKENWKRRIDCKETMELIKAAGLLKTVTKLGDCYEGLVREFIVNIPSDISNRKSDDYQRVFVRGKCIRFSPAVINKYLGRPTEGMVDIDVSEHQIAKEITAKRVQHWPKKGKLSAGKLSVKYAILHRIGAANWVPTNHTSTVATESFAVKLPIAFPTVLCGIMLSQHPNMLNYTDSVMKRESPLSLHYKLFEGTHVPDIVSTSGKAAEEDKEAVEEEEEAAEEEEDAAEETESDDDSEATP

SEQ ID NO: 97351 - protein, 124 aa, Glycine max
  Coding DNA Sequence Number=SeqID_5666
MTKARQKGVRKFNFGNLPVEIEERTKNVEERLQIFAKSPTETSRKHYGSASAWIFFTETVFLTNFKEKEGEACHPACSGELGCFLQKAPPSGELPGRPKWAWLLFAPLCLLNTPPCLFLLILFP

SEQ ID NO: 97352 - protein, 80 aa, Glycine max
  Coding DNA Sequence Number=SeqID_5667
  Subcellular localization annotation: CTP_CleavageSite=32; ConfidenceScore=5.08e-01
MKPSSTQQWCPQKSKTSSSKNSRSRYLGSRICVEEKRDEYRRHCSSDENSVDDDNEGGIGAGGCSGGFVMSSSCCRSGGG

SEQ ID NO: 97353 - protein, 103 aa, Glycine max
  Coding DNA Sequence Number=SeqID_5668
  Subcellular localization annotation: CTP_CleavageSite=19; ConfidenceScore=5.30e-01
MATPPASPPPAPAPPPPSPAVALASPSTLKRTCKVDPVTGKADGPHKKKLRAYLGILARDKVDVTYETWKEVPTTQKDLIWEDIQAEFEIPKASDSRTKKKVL

SEQ ID NO: 97354 - protein, 214 aa, Glycine max
  Coding DNA Sequence Number=SeqID_5669
MGDQEETQEQMKADMSALKEQMASMMEAMLGMKQLMEKNAATAAAVSSAAEADPTLLATTHHPPSNIVGRGRDTLGHDGSPHLGYNRAAYPYGLPPNYSPPILQEDTGHIASPVHEKEPPQQPDEVHKDPQDYARRDVEFYPPIPEGPAPGTLPQPNLAASPIVLSMEGPPPATEERRKLDLLEERLRAVEGFGDYPFADMTDLCLVPDVVIPP

SEQ ID NO: 97355 - protein, 78 aa, Glycine max
  Coding DNA Sequence Number=SeqID_5670
RQAALMLNTEKNPKEECKAIMTRSRMTIHADEGRVEEKVEGYKQQSAAEPTLEPVSDLIELKEVVEDKDDQQERETPI

SEQ ID NO: 97356 - protein, 58 aa, Glycine max
  Coding DNA Sequence Number=SeqID_5671
MEKMRGMKRMRVEGGMRGTCDPEVYLEWEMKVEQVFACYNYDEEKRSNWPPWSLRDMP

SEQ ID NO: 97357 - protein, 50 aa, Glycine max
  Coding DNA Sequence Number=SeqID_5672
MEILVDGEFDANRLFDEAVFWTWTWLRHFEKNFSTHLNQWASNISQGFLM

SEQ ID NO: 97358 - protein, 139 aa, Glycine max
  Coding DNA Sequence Number=SeqID_5673
KLRLAEKTKKKLEEAAQSGSVDGVIDPPSPVRHHVKWKVARTKKTGEMTTEAAKEIAEKIDVLTAAIGRPEHPGRVRAAGAGVTIKQYFGPAPRTSRSSSSLPPEELQQLTQQIRDQLEESITEKVTRQLMASLSQMQS

SEQ ID NO: 97359 - protein, 199 aa, Glycine max
  Coding DNA Sequence Number=SeqID_5674
MSASDHAILRDRVHQPTKKSLLELPSQDTVLAQNKLFSKQLEILTETIGKLPTKLFTGQPSQSSVLQKKRRKLVTWEINKGKDTTNEDSQVSSKVPTISKDNKDHTLRTTNLEETLAQFMQVTMSNHKSTESALKNLEILVGQLTKKLAEKTSNSFGANTEKNPKEECKVVVTRNRKLVAAEDEDVVAIEASFMMLNQD

SEQ ID NO: 97360 - protein, 19 aa, Glycine max
  Coding DNA Sequence Number=SeqID_5675
MDQGISQSCGSACHRSLGT

SEQ ID NO: 97361 - protein, 134 aa, Glycine max
  Coding DNA Sequence Number=SeqID_5676
  Homolog annotation: Hit_ID=A8P6U5; Match level="QueryCoverage=18%, HitCoverage=40%, E-value=2e-07, Identity=96%"; Hit description =Putative uncharacterized protein
MKYECPRLSLLIITPIPKANTIGSESCAPEARPGPVKDRSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 97362 - protein, 93 aa, Glycine max
  Coding DNA Sequence Number=SeqID_5677
MFVVFNSALKGLNDTPRPRSKASARWIVVKCNRQKGSTECGYYVMHWMSTIILGSFKNNWETYLNDVRPLEAKRLKALRIQWAKYYLKVRNQT

SEQ ID NO: 97363 - protein, 604 aa, Glycine max
  Coding DNA Sequence Number=SeqID_5678
  Gene Ontology: Mol. function=glucan 1,4-alpha-glucosidase activity; Cellular component=integral to membrane; Biological process =polysaccharide metabolic process
  Homolog annotation: Hit_ID=A7MLR9; Match level="QueryCoverage=90%, HitCoverage=99%, E-value=0.0, Identity=66%"; Hit description =Putative uncharacterized protein
  Pfam annotation: Domain name=Glyco_hydro_15; Domain location=233-598; Score=130.9; E_value=3.7e-36; Accession=PF00723.12; Description =Glycosyl hydrolases family 15
MNNQTFQSPVRERGFARLGDYAAIGEGRSVALIAPDGAIDWWCAPNLDSAPLFDRLLDPEIGGFFKIEPDAPYRTERAYRADSNVLETRFFTDDGSVLLTESLNSTLAGRLPWSELARRVEGVDGEVTLRLTLRFGTVAETRSPWQDSTEQGDVYHVGDLLAMLRTSEDWQIEQRDDEQICATLCTAVDSRSLVALLVTEREPLAVPPLEAIDTRIETSHTAWCDWTRSLSYQGRFAEHVRRSALSLKFLWYSPTGAQAAAATTSLPEGIGGEKNYDYRYAWVRDACLIIKAFVFLGALEDCKAAFSWLSKTIIRHGTALRTCYTLEGNEVPAERFVPLRGYHHSQPVRVGNNARDQLQLSMYGDMLATAELFIRAGHVLDLATSRMLGALANHCADLWRQKDSGIWELPEQQHYTHSKMACWLALDRAVALAEARHIEPTWLKRWQRERDRISSWIEAHCWNEEKQAYVFYPDSNGRLDAALALVHPYGSRVNPARMQATYRAIEQELGHGSAMLYRYSGTEQEESTFIACSFWLVEAWAALGECTRAENAMQQILGKLCQRGNVETFNEMFDVRSDEWRGNMPQGLSHLALICAAQALTDHG

SEQ ID NO: 97364 - protein, 140 aa, Glycine max
  Coding DNA Sequence Number=SeqID_5679
MNLRGRQVEIADPLCPFYNNLDEDAAHLFFNCNKVLPLWWETVSWVKSVGAFPKEPKDHFMHHSRSNATRTRLFVSLEDDSNTLTAVPDITQITASDNNSNQEEIMIHIKIVYQTIYLPNKYSSICVYKCYDKCQNSSLS

SEQ ID NO: 97365 - protein, 170 aa, Glycine max
  Coding DNA Sequence Number=SeqID_5680
  Subcellular localization annotation: CTP_CleavageSite=94; ConfidenceScore=5.44e-01
YPHLQRTTCPRLQRTTRPRLQRTTRPRLQMTSRPHLRRTTRPRLERATRPRHQWAARPNLQRRTSRPRLHRATCPHLQRSTSSTFRGLHVLTFRVTTRPHLKRLHTLAFRGLHPLTSRLHVLAFRVLPPRLHAIAFRGLRVLTFSGLHIHALRGFKSSALKCLTETCAPG

SEQ ID NO: 97366 - protein, 69 aa, Glycine max
  Coding DNA Sequence Number=SeqID_5681
MNVSDEPAKRVFALSGTSVPTLSQAKRTLCAKLECYSVEVELSAPCCAKPILQKEMFFVSSSLVPACCA

SEQ ID NO: 97367 - protein, 158 aa, Glycine max
  Coding DNA Sequence Number=SeqID_5682
MDFLFKLDTHFFLENGGGEVCDPAAEEVGHQANQQVTDRQRAERQTKGGKAAGDTEVNKQLSWVDVREQAVHRMAAVGGGGVITRLVAGQRVPGAALSEAFNAMLADKVNQRVHDHQQADQQGQDPGHHAGEHLSAFLKQPDEPLGAGGEGLYHSSFL

SEQ ID NO: 97368 - protein, 490 aa, Glycine max
  Coding DNA Sequence Number=SeqID_5683
  Gene Ontology: Mol. function=magnesium ion binding; Cellular component=nucleus; Biological process=response to DNA damage stimulus
  Homolog annotation: Hit_ID=Q2HRV5; Match level="QueryCoverage=93%, HitCoverage=91%, E-value=1e-124, Identity=55%"; Hit description=DNA repair metallo-beta-lactamase
  Pfam annotation: Domain name=DRMBL; Domain location=370-434; Score =7.1; E_value=0.00037; Accession=PF07522.5; Description=DNA repair metallo-beta-lactamase
MTLSTAPSPPPALEEEPLPHDGDDYHGIVSLDDEGFPSQFPESGTASEKSSFAADFYRSGTDWSSLLLSLEDSKQSDLAQDSGKKMKQANLFQIWGFKRNDAIGSVESGPSKSGCCDDGGGSSERKIVKPENRCSIFPDTGKEFENAKSSRKRKGSCGENRGQCSLLMLFVMGVLKGAQHIFLLISIAITMVALARNGHMALYIALLSQEGSFKCVSRYIHPLEFNEEHVIDGVKVTLLEANHCPGAALIHFNLPNGQRYLHTGDFRACKLMQAYHLLVNQRVNVLYLDTTYCNPKYRFPSKEEVLNYVVKITKNHLKIHPRTLVVVGAYSIGKECVYLAISKALGVKIYANASRRRILQAFGWPDLSDKLCTNGNNTLLHVLPMSSLRVETLKDYLKTYKEQFTAILAFRPTGILPILMITFISESSCEKISNDLELIKPVSKGNITIYVLICIENALYWTMVDEGIVFLRSNNLLSDAEMHPQCETQF

SEQ ID NO: 97369 - protein, 541 aa, Glycine max
  Coding DNA Sequence Number=SeqID_5684
  Gene Ontology: Mol. function=ATP-dependent helicase activity; Cellular component=phycobilisome; Biological process=regulation of transcription, DNA-dependent
  Homolog annotation: Hit_ID=A7PA57; Match level="QueryCoverage=92%, HitCoverage=83%, E-value=0.0, Identity=73%"; Hit description =Chromosome chr14 scaffold_9, whole genome shotgun sequence
  Pfam annotation: Domain name=CarD_TRCF; Domain location=144-246; Score=67.5; E_value=4.4e-17; Accession=PF02559.7; Description=CarD -likeTRCF domain
  Pfam annotation: Domain name=DEAD; Domain location=274-440; Score =131.9; E_value=1.9e-36; Accession=PF00270.20; Description=DEADDEAH box helicase
  Pfam annotation: Domain name=ResIII; Domain location=270-434; Score= -6.4; E_value=0.00017; Accession=PF04851.6; Description=Type III restriction enzyme, res subunit
  Pfam module annotation: Pfam domain module=CarD_TRCF::DEAD::ResIII; Domain location=144-246::274-440::270-434
  Subcellular localization annotation: CTP_CleavageSite=58; ConfidenceScore=5.71e-01
MASSSSSLLPRSHIPTPLISKISSSPRTWSLFILTYPSHPKNNNNNNNNKRLFLSPTNAVYTQSPYTPSTPSKTELHNDPITVLNERIRRDLSKKEAFRTVMDSEEAGKYMKMVKVQQQRGLQKLKGDRESKDGVFSYKVDPYTLRSGDYVVHRKVGVGRFVGMRFDVAKNSSQPTEYVFIEYADGMAKLPVNKAAKMLYRYSLPNETKKPKALSKLSDTSAWEKRKVKGKVAIQKMVVDLMELYLHRLKQRRPLYPKSPAMAEFAALFPYEPTPDQKRAFIDVERDLTERETPMDRLICGDVGFGKTEVALRAISCVVSAKKQAMVLAPTIVLAKQHFDVISERFSVYPDIKVGLLSRFQTKAEKEENLDKIKNGSLDIIVGTHSLLGDRVTYNNLGLLVVDEEQRFGVKQKEKIASFKTSVDVLTLSATPIPRTLYLALTGFRDASLMSTPPPERVPIKTHLSSFSEDKVVSAIKYELDRGGQVFYVLPRIKGLDEVMTFLAESFPNVEIAIAHGKVVTHLHLFKGLVLACRTVKQISK

SEQ ID NO: 97370 - protein, 90 aa, Glycine max
  Coding DNA Sequence Number=SeqID_5685
MALLKWKSLPRDKAQIVLITLSLSPCSCRHRRHRFLEKDKKNLKHTKENRGDSKTKVMFSLNLEHKGASKKALACDNKEKVMFLANTCFD

SEQ ID NO: 97371 - protein, 152 aa, Glycine max
  Coding DNA Sequence Number=SeqID_5686
  Homolog annotation: Hit_ID=Q0KIL1; Match level="QueryCoverage=82%, HitCoverage=13%, E-value=2e-07, Identity=33%"; Hit description =Gag/pol polyprotein, 3'-partial, putative
  Pfam annotation: Domain name=G-patch; Domain location=51-95; Score =28.5; E_value=2.5e-05; Accession=PF01585.14; Description=G-patch domain
SGEEGILVSCPSSIPYVEAVEESLEMSFQALEVVSNAYVESPPVQPRSSRVTLMVARVMLGHGYEPGMGLGRNDNGVASLVEFRGNRRRFGLGYEPTRANMRMNALERRGRSMGQTQGLQVKAVPLCHINKSFVSAGWMCEGWIAMIHEETP

SEQ ID NO: 97372 - protein, 73 aa, Glycine max
  Coding DNA Sequence Number=SeqID_5687
  Homolog annotation: Hit_ID=A5AYU6; Match level="QueryCoverage=84%, HitCoverage=11%, E-value=1e-07, Identity=42%"; Hit description =Putative uncharacterized protein
NGKIERKTFNDKKTKKAYITWEDNNMDSSEDSENEVVNLSLMAKNYESDEKDSLKKSWYIDSGCSKHMTGDAS

SEQ ID NO: 97373 - protein, 154 aa, Glycine max
  Coding DNA Sequence Number=SeqID_5688
  Homolog annotation: Hit_ID=A5AZG1; Match level="QueryCoverage=35%, HitCoverage=16%, E-value=6e-08, Identity=48%"; Hit description =Putative uncharacterized protein
MTSTSGDATPPSPKTARLMAEMIKLGDQIRRMSYENEERMERMKKENEESLGRIQRSSKALSVRIDNIERRREDRSSNLLMENMRGIGREETIEGTEGMKVEQVFTCYNYNEEKKIKLASLEFEGYALVWWNQVKSGVERMRSPLINTLQGMKR

SEQ ID NO: 97374 - protein, 343 aa, Glycine max
  Coding DNA Sequence Number=SeqID_5689
MTKKSTETSRADVRPKKPTGVKIQEWKQEEKEEEERPLIRKRKLPSTSTKSAEQTETGNSQAQMPKKKKKVKQVEPEPSVAVEGGEPIKKKKKKIKPSKEQGDNQTVDVQPPSTDIDGTEVEATPSVAEMDNPVDQPDSSPAQPAVEVQQNVSVEEIPSRARTSPAPETDAVHVEEQGEGQGIGSISPYGSSQKSSSEENFSDEEAIQEAEAGGSDIYPASSTSKLSASIGIAEDTFIKMQDEDPAAALRLLLNTSQANTSSEKIPGASSSSDADITSSVRQDCLLLKLSMEYARADVLKSIEENPSAAFGHLNFLKKLHNPLTSDEILGKVIQIESIIDQFA

SEQ ID NO: 97375 - protein, 156 aa, Glycine max
  Coding DNA Sequence Number=SeqID_5690
MLQEKEESKKYKEAVNPHLHPLHKATTKWKRSAANITYFHSLIQLIQGNLFHGLPNEDHYTHLATYIEICNTEKQKGGYTPLKAIASRLGKNKALDHFYGLLRKTPTHGYNEPMQLNISTDGLRPQSKQLLDAFVGKNQDEGTRGGNEADREHGGQ

SEQ ID NO: 97376 - protein, 74 aa, Glycine max
  Coding DNA Sequence Number=SeqID_5691
MTIADSINTTLLKSDNAKVFVGLVEERSQTTDKSLAGTLMSSVTTMKFMVHGFLTIQTISPNKKLVFMKNRVKA

SEQ ID NO: 97377 - protein, 408 aa, Glycine max
  Coding DNA Sequence Number=SeqID_5692
  Gene Ontology: Mol. function=motor activity; Cellular component=cell projection
  Homolog annotation: Hit_ID=P15305; Match level="QueryCoverage=99%, HitCoverage=96%, E-value=2e-22, Identity=20%"; Hit description =Dynein heavy chain
GLYVLPFRELHALAFRGLYVLPFRGLHVLAFRGLDVLHFRGLRVFSFRGLHILHLRGLHVLLFRGLHILAIRVLHPLAFRGLHMLALRGLHIIDFRGLHILAFKGLHALAFIGLHALAFRGLHALAFRGLHALTFRGLHILAFRGLHILALRGLHALAFRGLHVLSFRGLHVLTLCTRTLTFRGLHVFAFRGLNVLTFRGLHALAFRGLHVLTFRGLHVLAFRGLHVLAFRGVHVLAFRGLYVLTFRGGLHVPTFRGLHVLAFRGLHALAFRGLHVHPFRGLHVLAFEGLHILTFRGLHALAFRGLYVLPFRELYALTFRGLYVLSFRGLHVLAFRGLDVLHIRGLHVFSFRGLHILHFRGLHVHLFRGLHVLAIRGLHPLAFRGLHMLALRGLHVIAFRGLHILAFR

SEQ ID NO: 97378 - protein, 35 aa, Glycine max
  Coding DNA Sequence Number=SeqID_5693
MKATGNQKWLEGARTASLRVLSFLNEGGGLLAQAT

SEQ ID NO: 97379 - protein, 75 aa, Glycine max
  Coding DNA Sequence Number=SeqID_5694
MVEKERFDHIEERMRAIEGGGDYAFADMAELCLVPNVVIPPKFKGSGSSSSALNDGEGNDNNDSKHITGVVLSKD

SEQ ID NO: 97380 - protein, 61 aa, Glycine max
  Coding DNA Sequence Number=SeqID_5695
MEEDLKKTLKFLDATNATNLVTSKQIVPQMRNGLRRVIRKEKEINLLTKDYESYENISQED

SEQ ID NO: 97381 - protein, 185 aa, Glycine max
  Coding DNA Sequence Number=SeqID_5696
MVSPQGRKTWTVDDLVPYVEKLMILSEEQERITEPVAHGLASERRFPPQQFHMLQSSVETRGFDRRREIVQAEDFSQQMQQRGHGIYYMPPTFSQYPLQMYQYPFEGHDTDMSASEHSFGGVVETHPHFSWSTMTSSHFLQRLSNKGGDSVQEEIQIIKPEGGIDHVAHPHAITDTIMTDFDVSI

SEQ ID NO: 97382 - protein, 167 aa, Glycine max
  Coding DNA Sequence Number=SeqID_5697
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=34%, HitCoverage=47%, E-value=5e-17, Identity=76%"; Hit description =Putative uncharacterized protein
GGGAYGKTALPRPSHFPVKYLPGIFQEISAPFSGRHRGGAHSTPYSESYYNSLAVVLQRRDWENPGVTQLNRLAAHPPFASWRNAKGHRSPSQTVAQPNGEWDAPVAAAIKRGGVVVTRQRRTPATLASADVRLVCFCRISGTPSPSVAEQEGTADRNQIATGAPRN

SEQ ID NO: 97383 - protein, 106 aa, Glycine max
  Coding DNA Sequence Number=SeqID_5698
  Subcellular localization annotation: CTP_CleavageSite=68; ConfidenceScore=5.65e-01
MEPLSCRSTSHFRQKLAQGFPHRRTSALASVAVTLRVTTTPAALNAPLQGASHSPFRLRNCWEGRSVRASSLLRQLAKGGCAARRLSWVTPGFSQSRRCKTTASEL

SEQ ID NO: 97384 - protein, 45 aa, Glycine max
  Coding DNA Sequence Number=SeqID_5699
MATYAAQCRGPDLACHGINETLGLIRILVVDLKRANKAALTLVNF

SEQ ID NO: 97385 - protein, 90 aa, Glycine max
  Coding DNA Sequence Number=SeqID_5700
MKPRGYIESDHVQDDVPYQVEEKSHVNEVIEVESISGLQDLRGGVEEVNSANLLTNEEESANLNGESNNIEQDNEGELEDDFEVYNSEED

SEQ ID NO: 97386 - protein, 235 aa, Glycine max
  Coding DNA Sequence Number=SeqID_5701
  Gene Ontology: Mol. function=cation transmembrane transporter activity; Cellular component=membrane; Biological process=cation transport
  Homolog annotation: Hit_ID=A1FWF0; Match level="QueryCoverage=31%, HitCoverage=11%, E-value=1e-31, Identity=93%"; Hit description =Cation diffusion facilitator family transporter
MGLVGAALVTVCAVGLVRDSGRIMLDAQMDAPVVAEVREVIEQGPWPARLADLHVWQVGRGKYAVSASVVTSDADPPWLILRDRGRICSRTHARLAVAFAAPSHARLSQAISRARARLYSQNFSIIRSRYISSGSALSTAPPMPIHGQRSPRTREATARPPPTSAAPSTPTPSPAAMPLPPAATAACAANVPAPQPTAIPSQLTMPHHGALPCAIRKPLCSCRISVRATPECCLH

SEQ ID NO: 97387 - protein, 93 aa, Glycine max
  Coding DNA Sequence Number=SeqID_5702
MESGDMRGYRMVIHTFRHLGANEPIDAQRLTSYSAPFVILTHGVRVFTLVVHRHASPTMHKILLCWAWGDQVRRRGEVSWLSHFIAFKTLKFC

SEQ ID NO: 97388 - protein, 56 aa, Glycine max
  Coding DNA Sequence Number=SeqID_5703
MNGTTLHLRVEVRKGHREGHGVGEEIRAGVAITNDVRVKEIRDDSHKVELTPPTIE

SEQ ID NO: 97389 - protein, 284 aa, Glycine max
  Coding DNA Sequence Number=SeqID_5704
  Homolog annotation: Hit_ID=Q2HRR4; Match level="QueryCoverage=33%, HitCoverage=32%, E-value=1e-07, Identity=38%"; Hit description =Ribonuclease H
METAKGTTTETTASNQNGRNKAEKKQAEKKAHLWVLPEVTNSSSGRSFSGKFPEKGFPENFRKKVFRKVSGKKLLPEEELLKGSFATSLFAGCPSNNAGNRNKFIFSNKKNHDSTIIHRIENEVVDIRQANSLVAALPIPNFNHYTIGSICWEAPSGDKLKLNCDAAVNLNGAAVCGGVHHCGSVIFVFAAFIRKCSITHAELWALDIGSKIVVSKGYSNFLVESDSQETINLIQEGCLSSHECAWLVNDILLTAAIHDIDSWKHIYMHSFKNLTGQSIELLSQ

SEQ ID NO: 97390 - protein, 102 aa, Glycine max
  Coding DNA Sequence Number=SeqID_5705
MVAAFPQQFQASYIEVSKISRDLQSLTTFGFQGEALSSLCALGNLTVEMSEPGTASQTGEFQVAEVTVVSSGGRLAFSDGRPKASYNCHWQVKGKLQLPLAI

SEQ ID NO: 97391 - protein, 376 aa, Glycine max
  Coding DNA Sequence Number=SeqID_5706
MDPICSWSFLSFDWPLAPPPKQPSQPPSFAEALCNTLDIPLSQLCKPCLKEQLLRTSEHSQRNCLRKNLRFELEACGWLEPKPRYLAYPMLGLTLRSSFGILEAPLQSLRFPLFALATIANITQGTANPLKAPRISPAKALKEETQEPGPSNQNQKQAPKLSARHMPTKACKDATQQNLENAYHISDAESDSNPGHIVPTPPLGASSPPTSRQGVQMSSSGKADIVDEEHDESGQEEEDENRGFIEAVVSLFPLPMIISRLGRMPVPLTTLIPLVLSMPSQMVVILIGTLKLTWIGPSITMIAWIVGTPYPVATLPENHCVENDLIATLILSLASSDNKCMLTNLPIKEEVRLVFAMNGYRASSLDGFGGSFFQAF

SEQ ID NO: 97392 - protein, 74 aa, Glycine max
  Coding DNA Sequence Number=SeqID_5707
MASPCDCNASKLHAMDLLAEDREVCQRENDLCSWIQVPQSYHVLIDESCFRSTVVKQEQRQDSLRDEENRDWQG

SEQ ID NO: 97393 - protein, 209 aa, Glycine max
  Coding DNA Sequence Number=SeqID_5708
  Homolog annotation: Hit_ID=A5B5G7; Match level="QueryCoverage=91%, HitCoverage=13%, E-value=2e-09, Identity=27%"; Hit description =Putative uncharacterized protein
MASRKRRAVPTPGEASNWDSSRFTSEIAWHKYQDNIQLRNILPERNVELGPGMFDEFLQELRRCRWDQVLTRLPEKRIDVALVKEFYSNLYDPEDHSPRFCRVRGQVVHFDADTINDFLDTPVILEDGEEYPAYTRYLSTHPDPNIIAATLCTLGGHFVLYTDGLPWKLLRKDMTTLAQTWSVLSYYDLAPTSHTSDVNLDRARLIYSL

SEQ ID NO: 97394 - protein, 126 aa, Glycine max
  Coding DNA Sequence Number=SeqID_5709
MAIEGLQLGLKERIGIIKTKNIEREGRAQAWIAEVGFGLSYSRLARSDCALSARCKLSLCFCWIARLVRSWGLARVTDSASSSSTPHLVPVFFARLALDVRLARVLGWACFRTPSFSSFLLPFCLM

SEQ ID NO: 97395 - protein, 76 aa, Glycine max
  Coding DNA Sequence Number=SeqID_5710
MCETINKLNAELLAKANKEKTLEEKMLQLMENHDHQSQEMQQQMQSIMPTPSPSTTIADGTEHHVNDAQIDHPHDM

SEQ ID NO: 97396 - protein, 519 aa, Glycine max
  Coding DNA Sequence Number=SeqID_5711
  Pfam annotation: Domain name=Transposase_23; Domain location=192-265; Score=-7.7; E_value=0.0083; Accession=PF03017.5; Description =TNP1ENSPM transposase
MAEKTKSRLNEGDDTQNADMVVDPPSPIARHEKWKKARTNKFGQMTSAAAQEIADKIGALVPHGREDILNTAIGRPEHLGCVRVSGHGVTITSYFGQRACASNSSSPAITAEKLVEIIQTIKQEVKKEVEDKNKDRMDKMKMELDAIKSELSQIHTQQSAPPRPFNPDIFDARVSTKESCVEAANNVVGNKRSTFDTCSMGLYIICGDNTQLVALGKVFGVGGTIHTVSYGDDVLRVCVNTVYNGEVILPLPTSEIQYVRDVVNSFIGWPRHLVKPLSDDSNLNVRKPVERSGDAKLASESDPLGEFMKILFYVYQNPVDVPREASQFGLPDIGAKFYITHADLAEIISAYQSLYGLLEPQSIQNAKDRRQQCQQYIETWVKESQRQLYLGAYLHQAHWQLFVLHPRENTVVRFCSLRKKLDINIKGTINSAMKTITSSFEGMSNQGAPRWVEPKSNVQSGGFECGYYVMHWMWCIVTAGLKDDWHKWFSDGSPLDVEAITIVRQKWATYFLTFRKSGC

SEQ ID NO: 97397 - protein, 216 aa, Glycine max
  Coding DNA Sequence Number=SeqID_5712
  Homolog annotation: Hit_ID=A5BU47; Match level="QueryCoverage=39%, HitCoverage=4%, E-value=4e-10, Identity=40%"; Hit description =Putative uncharacterized protein
MFYVEYPSDSRWSVVLQGKTIGIPPNIDASTLDVNDMPTFSTEKPVVNDENEEEEDVYANRIDHDEGMATPPRSLPPPDSPTETTKKKTRQTTRMRRLTTKSLDQPRPTIHINPSTGRGSGPHKEKFHNYLGVVAQEKIPIIHTTWKDVPETLKVLVWDDILAKFDIPEGLTAKKKVMSTVGTRWRQFKSSLTTRYVYAEKDDEQNKDPSAKYGID

SEQ ID NO: 97398 - protein, 66 aa, Glycine max
  Coding DNA Sequence Number=SeqID_5713
MVGYTPSSFEDLVFAGERIKVGLEKGISNHSALMNAKIGANEKDENEGEILAMTAIPTRSNFPSAQ

SEQ ID NO: 97399 - protein, 195 aa, Glycine max
  Coding DNA Sequence Number=SeqID_5714
  Gene Ontology: Mol. function=protein kinase C binding; Cellular component=cell projection
  Homolog annotation: Hit_ID=Q86AI8; Match level="QueryCoverage=59%, HitCoverage=28%, E-value=2e-10, Identity=32%"; Hit description =Similar to Homo sapiens (Human). Mucin 2
MPSPLEDYTSSPSEDYKSSPSEGCRPSPSEGYRPSLSEDCTPSPSEGYTSSPSNDYTPSPLEDYTSSPLEGRTSSPLEDYTPSPLEDYTSSPSEGYTSSLLEGSTSAPLENSRPVVSFYQFLVHPLDLGGGPTVRAQPEEEAGLQLRQGGYHTTIMHTGVRFRSDYCRDTSADHAYNHNSDVPLSKSQLVYAIMT

SEQ ID NO: 97400 - protein, 43 aa, Glycine max
  Coding DNA Sequence Number=SeqID_5715
MYSPSTPQAHPLVETKGEESKNRAKGEARATKTKPPRETRLKG

SEQ ID NO: 97401 - protein, 104 aa, Glycine max
  Coding DNA Sequence Number=SeqID_5716
  Subcellular localization annotation: CTP_CleavageSite=43; ConfidenceScore=5.01e-01
MNHCYLEESVKGGSGAPFTTKSTSWVLKIPLQLKASTLCDGPNASSGGSWWSPAVVGRGGDGSRVWGEKGLKSTFFMLLDVVSLQQKLEGDPMVKKSKIMVLLK

SEQ ID NO: 97402 - protein, 78 aa, Glycine max
  Coding DNA Sequence Number=SeqID_5717
  Homolog annotation: Hit_ID=A7Q3H9; Match level="QueryCoverage=75%, HitCoverage=7%, E-value=9e-09, Identity=55%"; Hit description =Chromosome chr13 scaffold_48, whole genome shotgun sequence
MKNRSLYDHLHVKDEGSRKRAILKYVKDEITQSLSLVDVVVPAILAQDLVKILDPKVAPPNVNEAFTVELVAYIAIHV

SEQ ID NO: 97403 - protein, 54 aa, Glycine max
  Coding DNA Sequence Number=SeqID_5718
MEEMGNKNVVVVKKSLPIAAYNGGVVKACRRGREFLEKMKIGMPTSHIKERIVS

SEQ ID NO: 97404 - protein, 110 aa, Glycine max
  Coding DNA Sequence Number=SeqID_5719
  Subcellular localization annotation: CTP_CleavageSite=47; ConfidenceScore=5.14e-01
MEGEEDSYHCKQPQTTKRNKKDTFLNKMMTKVMTKNSKVNQRMSSICSRRNQEQFKTQEERLKDTSKFKRKVEFKNQDSRIKLQESRFKIQELKRRLNQDKYEKDFSKTE

SEQ ID NO: 97405 - protein, 31 aa, Glycine max
  Coding DNA Sequence Number=SeqID_5720
MEQAGFVADLGVAFVDDWVFLADRMMGNEKG

SEQ ID NO: 97406 - protein, 167 aa, Glycine max
  Coding DNA Sequence Number=SeqID_5721
MKKTKGRNQNGQPKLVPTRRRLLRRRPLKNTNEEGARKKTLDQEEEVEEGEKAVAGALSVKKESRRAPESKQRTKREISSLSDSSVSCQAHRSIGAKPKSTYSRGGSNNKEPRVHLSKIRECLRVCEVPRREGGIPLPMNFSTGKCTVSLELDRAGLDNCIARDRLQ

SEQ ID NO: 97407 - protein, 105 aa, Glycine max
  Coding DNA Sequence Number=SeqID_5722
  Homolog annotation: Hit_ID=A5AWL4; Match level="QueryCoverage=69%, HitCoverage=10%, E-value=1e-07, Identity=39%"; Hit description =Putative uncharacterized protein
MSLPTLFGKLQEHEMELMRLNQHEENDKKKKGIALKASSSIHEESDKEDMNEQNNLEEDDDFSLFVKRFNKFMRNKGNRRRSKEKRRRFLLDQFQNAMNAINLAT

SEQ ID NO: 97408 - protein, 103 aa, Glycine max
  Coding DNA Sequence Number=SeqID_5723
  Gene Ontology: Mol. function=nucleotide binding; Biological process =defense response
  Homolog annotation: Hit_ID=Q6R271; Match level="QueryCoverage=79%, HitCoverage=8%, E-value=2e-17, Identity=55%"; Hit description =Disease resistance protein
MSTLTGVRHYAWGKLQLTGYTVMDFHGRKLDEMLLSIEALVDDAEQKKFRDPRVRGWHIAAKDVVFDTEDLLDEIDYELSKCQVESEFQTFTFKVTNVGSSGL

SEQ ID NO: 97409 - protein, 158 aa, Glycine max
  Coding DNA Sequence Number=SeqID_5724
  Gene Ontology: Mol. function=nucleotide binding; Cellular component =intrinsic to membrane; Biological process=defense response
  Homolog annotation: Hit_ID=Q6R269; Match level="QueryCoverage=86%, HitCoverage=17%, E-value=1e-38, Identity=46%"; Hit description =Disease resistance protein
  Pfam annotation: Domain name=NB-ARC; Domain location=1-158; Score= -105.3; E_value=0.0015; Accession=PF00931.13; Description=NB-ARC domain
MEEAKFDIKAWVCVSDDFDVLTVTRTILEAITTLKDDVPLNYGSKGSRILVTTCSEKVASTVQSCKVHQLKQLQEIYASKGLPLALKTIGSLLHSKSSILEWKNVSISKIWDLTKEDCEIIPALFLSYHHLPSHLKRKNDDLGTLLGRLPAVISPERN

SEQ ID NO: 97410 - protein, 150 aa, Glycine max
  Coding DNA Sequence Number=SeqID_5725
MAPKKLSAKRARKAAIGEGSSIAPPRHPVDLEKSNSALGFPALITSLCQFYGVLIAPTKLIQPPINRTFTEKYCMPRTLTLTRGLLPSSLEPLSHGLGIGPIFRRRQVLQMLKEFPKGTKVEPRTMETWQICLISSMEEVELPDRDLLNL

SEQ ID NO: 97411 - protein, 118 aa, Glycine max
  Coding DNA Sequence Number=SeqID_5726
MENSKHLATPMNTSCYLDKDESGQPVDPKQYREVVIIKKGEIVEAKLHGESKMIQRCRQKAQRSIKNNSRVQDKNQEEFKTQEESLETRIKILGSKISRIKIKIQDSRFKNEEKTQSR

SEQ ID NO: 97412 - protein, 190 aa, Glycine max
  Coding DNA Sequence Number=SeqID_5727
MHVCDTLKTRRCNAIEAGMRVEGESFKEHVKGEKMMKRRKMQNETTKIWRKRVVVNRRAEKEGTIRLDGSDLVAFHNMVVTFTCKLQTLQYLYRSVSRTWSTAGGRQQAFAEYSVKPRLKRTTQKQLSNKPSDIDASRALFIEITEILGADTVIPDQSPSGFLFPLETPHSEGGLNDQPACTEGVCGNAA

SEQ ID NO: 97413 - protein, 199 aa, Glycine max
  Coding DNA Sequence Number=SeqID_5728
  Homolog annotation: Hit_ID=A5AX25; Match level="QueryCoverage=33%, HitCoverage=11%, E-value=2e-09, Identity=41%"; Hit description =Putative uncharacterized protein
  Pfam annotation: Domain name=DUF659; Domain location=73-199; Score =11.1; E_value=3e-08; Accession=PF04937.6; Description=Protein of unknown function (DUF 659)
MVVEGQSKGYVCHKLPEGGDAGHGGGGGRHRRRVLLLLLRPGQHYVPSDVQGSGDAVPEGAAEEAAEPPPPPPSDQGGSSGGPVAAADKEVVELEKEMWERFYGSGFWRSPSQRENSSPQQRINATTVSAPNYLQFVDGSDFVKTGEKIFELFDATMEEVGEENVVQVVTDNGSNYVLAAHCIDLMLEDIGKLPLIRKT

SEQ ID NO: 97414 - protein, 81 aa, Glycine max
  Coding DNA Sequence Number=SeqID_5729
  Subcellular localization annotation: CTP_CleavageSite=19; ConfidenceScore=5.14e-01
MSDLKGADSGKNREKVMKSAKLASSALGTTLRRKKATMMLPMKGREILTEAWREIQVLFAFGALEVILRDHHTHKALRAPY

SEQ ID NO: 97415 - protein, 63 aa, Glycine max
  Coding DNA Sequence Number=SeqID_5730
MTQELLFFFFSSEGKDGHSHPGSMFMVSWYFWLRACRTTGHDICQGVGLVSSLGVKGCPTLFP

SEQ ID NO: 97416 - protein, 118 aa, Glycine max
  Coding DNA Sequence Number=SeqID_5731
MKMNANKTKNELKVSDSNTYWLKNEEQTKNDKERRKIFTDLLTETSRKRYGSTLTRFFFTEMEKGRCLLPRGFLRKISKRNPITKFTPFSYSTEKLRKPYGSFLDLIFIFFSLPFHQY

SEQ ID NO: 97417 - protein, 284 aa, Glycine max
  Coding DNA Sequence Number=SeqID_5732
  Subcellular localization annotation: CTP_CleavageSite=35; ConfidenceScore=5.30e-01
MIISRGGQYSVKSKTGINQGTRLMVIRSSSRDWLRMMHRVSSPGRAPPARERLKGEGKGEFFTQNVFLSSKKRMLTGSLGFPALGHHFSTFFDSILHFYSSPTRDGTEEALHKEVQEERPWGKLQRLHGVRQSPVLECRAPAALPGGDSMQALDTSSDSNGQGSVDFLRHRCPQLVPGSPTDLGGGPSVIAQLLCISGQDFARTAAGRRVWIMCTSMTTLTQIRMTLLLSNILPNDHNFYLPLPKCQMVYTILTRMTVHMAQMIAYAIYLFAGTAPTRHPLDPE

SEQ ID NO: 97418 - protein, 110 aa, Glycine max
  Coding DNA Sequence Number=SeqID_5733
MAPKKLSTKRSRRDTHGESSSASVEFDSHRERRIQLIEDEYSDFQEEIARRHWTPLVTPMAMFDPGIVLEFYRQCEFSQRRDQASGFDEEAIAQLLCILGQDFARTAAGR

SEQ ID NO: 97419 - protein, 150 aa, Glycine max
  Coding DNA Sequence Number=SeqID_5734
  Homolog annotation: Hit_ID=A7PG98; Match level="QueryCoverage=86%, HitCoverage=51%, E-value=2e-11, Identity=35%"; Hit description =Chromosome chr6 scaffold_15, whole genome shotgun sequence
MGEAVGGTAAVCCCFSFGLANIMYLAMYKVPAMLCQKALRRKRRSRRLLLLQTREEAAAVPSRPRCTCGCCDDIISAGRVYPLCSNDGGDVAVLRSRSSVEKDKEVVELEKEMWERFYGSGFWRSPSQRENSSPQQRINATTVSAPNYLQ

SEQ ID NO: 97420 - protein, 97 aa, Glycine max
  Coding DNA Sequence Number=SeqID_5735
  Gene Ontology: Mol. function=oxidoreductase activity; Biological process=negative regulation of transcription
  Homolog annotation: Hit_ID=A7PUZ6; Match level="QueryCoverage=73%, HitCoverage=24%, E-value=1e-16, Identity=61%"; Hit description =Chromosome chr4 scaffold_32, whole genome shotgun sequence
MEFVVLPLLETIDRYIYKPPDKLASFAITQFIHHGMLYVPIGYSFGMLYVPIGYSFGAGMFNLESTKGGTLYGAGVFAGDGTRQASEMELELAEYHG

SEQ ID NO: 97421 - protein, 68 aa, Glycine max
  Coding DNA Sequence Number=SeqID_5736
MTKSLNRASSIECRICNDFQDYFDDVKESRVKQIPKIQESSFKIQEQSRSRFKTQDSRFKRRLNQDKY

SEQ ID NO: 97422 - protein, 60 aa, Glycine max
  Coding DNA Sequence Number=SeqID_5737
MESNNMPDMNGVAKKTKGLGSSSSMDSFASWKMIGSGMEKEEREETPLQGEDESRRSSPP

SEQ ID NO: 97423 - protein, 60 aa, Glycine max
  Coding DNA Sequence Number=SeqID_5738
MFLSCLNHKKNWSVLGAAITVIGFYAVIWGKSQEQAKEECEVYDDSESYSPLSLFWRTRE

SEQ ID NO: 97424 - protein, 108 aa, Glycine max
  Coding DNA Sequence Number=SeqID_5739
  Gene Ontology: Mol. function=oxidoreductase activity; Cellular component=cytoplasm; Biological process=negative regulation of transcription
  Homolog annotation: Hit_ID=A7PUZ6; Match level="QueryCoverage=50%, HitCoverage=22%, E-value=4e-18, Identity=76%"; Hit description =Chromosome chr4 scaffold_32, whole genome shotgun sequence
MVFKIQDTNIDCTVHQSSISDDHSFGCFTVPSTKPHLHHARKEVFIALTPSFFGMLYVPIGYRFGAGMFNLESTKGGSPYGAGVFAGDGTRQASEMELELAEYHGKYI

SEQ ID NO: 97425 - protein, 241 aa, Glycine max
  Coding DNA Sequence Number=SeqID_5740
SALSQVTEQVSHILIHVGFLRFARGSCGSGSLLRGALPLLAEAEMLEGLMQLHLPAVVGPCCVSSFTCLAGAHNPHPPPRSGPGKVLPRDAQQLGDGLLVKAGGLVPSLAEFAPMVLLQDQWVAQELPKGIYAKGNPLTPYPRAHISNSLLLLILYELDAPLPMERLSLDGLKMLLVFGTSESVTVKLHRGAGAFPMGVPPGPLCGKLLRSHLLLGMNNNAKWNKKTLRNGDLRLEIKGIQ

SEQ ID NO: 97426 - protein, 58 aa, Glycine max
  Coding DNA Sequence Number=SeqID_5741
MRKLIKERMKNKVVNFMGLNKVVLGIKWMNGMNKVEDERKERITLSGRGQHTKVVKVL

SEQ ID NO: 97427 - protein, 158 aa, Glycine max
  Coding DNA Sequence Number=SeqID_5742
  Subcellular localization annotation: CTP_CleavageSite=3; ConfidenceScore=5.15e-01
MASGMYARPRLPKPKSNNSMVNPPKGLQNPRLFGKTFNQVEVILAPHNHQRISFVVQDDPSPDCMTRHSIRSSSYLLLITIKGETLQVKQPTPRLVGTTFNQGKVKHTPHNHQRRSSVGQTTYLKLVGKTFNQGQVKHTPHKHQGRSFAKQKEAPPDG

SEQ ID NO: 97428 - protein, 76 aa, Glycine max
  Coding DNA Sequence Number=SeqID_5743
MREKNGEGEEGNRTTEEPTKNNNREAWRSGRAEKEGGAERKGKGKSRRWRGYGGGWGRCRRRAAAATEEEEAEEEA

SEQ ID NO: 97429 - protein, 144 aa, Glycine max
  Coding DNA Sequence Number=SeqID_5744
  Gene Ontology: Mol. function=double-stranded RNA binding; Cellular component=intracellular
  Homolog annotation: Hit_ID=Q5YDB5; Match level="QueryCoverage=32%, HitCoverage=6%, E-value=1e-15, Identity=82%"; Hit description=C -terminal domain phosphatase-like 2
MLVVVFRVHTIFVFSTAVVSVSQKHFAREGYESFKVYDSDKHVSELNAEQEEEFLVLVVLLGIYDACLAMLNLRCLAIVFDLDETLIVANTMKSFEDRIEALKGWLFRGSHSSPTPSSPASTTLAFRVSGLEARSLTYQKIFIV

SEQ ID NO: 97430 - protein, 92 aa, Glycine max
  Coding DNA Sequence Number=SeqID_5745
MTKACQKGVRKKNEGGACHPARPGELGCFLQKVVPSGELPRRPKWARIVQQCFLLTSGILRNFTDCLTMGAKYLEVVKQGSHPNKRMVPGRN

SEQ ID NO: 97431 - protein, 48 aa, Glycine max
  Coding DNA Sequence Number=SeqID_5746
MTNKAKGKGKEVAGKGSADKRKGAFDDDKTGGVQKRNKRGVLRQVYMA

SEQ ID NO: 97432 - protein, 279 aa, Glycine max
  Coding DNA Sequence Number=SeqID_5747
  Gene Ontology: Mol. function=protein binding; Cellular component =membrane; Biological process=vesicle-mediated transport
  Homolog annotation: Hit_ID=Q8S8Z8; Match level="QueryCoverage=65%, HitCoverage=91%, E-value=2e-35, Identity=41%"; Hit description =Syringolide-induced protein B13-1-9
  Pfam annotation: Domain name=Hin1; Domain location=49-189; Score =115.1; E_value=2e-31; Accession=PF07320.4; Description=Harpin -induced protein 1 (Hin1)
MADTQPRPNDAVPSKERLGTRCCHCLCQTFWILLVLIITIVMLAILVLYIIITPRSFRFTLIDANLTQFDYTANNSTLYYDLVLNITAHNPNKRLKIYYDVVRAHALYRRVEFSAADVNMPWNGYLQDKKGTNFFGAVFSGQRVMGLNRDQIAEDKKDGMFPIDLKIHFTMRFRLDDFQLGHYYPRGTCELKVPLTSNNGNKVASFHPAMKPQWGTFDAASDVKEAVKALGDEGVDVDRELALGGEEHDVSGEQSRERDEKEAKEGGELGEQGGDGEAF

SEQ ID NO: 97433 - protein, 50 aa, Glycine max
  Coding DNA Sequence Number=SeqID_5748
  Homolog annotation: Hit_ID=A5AMK2; Match level="QueryCoverage=100%, HitCoverage=6%, E-value=2e-09, Identity=54%"; Hit description =Putative uncharacterized protein
MEMTLVRANIEEETEDTMAHFLSGLNPDIRDVVELREYMKLDDLLHKAVR

SEQ ID NO: 97434 - protein, 124 aa, Glycine max
  Coding DNA Sequence Number=SeqID_5749
  Homolog annotation: Hit_ID=A5BEV8; Match level="QueryCoverage=59%, HitCoverage=9%, E-value=2e-07, Identity=40%"; Hit description =Putative uncharacterized protein
MNNMITLQNTEIKASFETSTHVVEQVFKVTLYKKLLGMVSRYALNQIAAEFERVTYVGIDSSRCGCVMRTTQGLSEPEVSIIEEMEIISNQFEELDAYGKVTLKSKIQEIAYPDLNSMCVPPEK

SEQ ID NO: 97435 - protein, 213 aa, Glycine max
  Coding DNA Sequence Number=SeqID_5750
MVTTRGLGRALGRVIGRALGREVSGDADEAPQRRRPTTSAHRQWEAAPIDEDVERLDYAVDEIQEQPEGATTDDAVTHAEGFLGRPHDTSFFMDYVHHVAVTVWNEEEHSELKLSSHGRKVEKFGRPAPKIEDLVATIGLSPLIACSLDTNDRRLISAFAESIVNYRSSSISFAFAEDYHERKSRTCHWKSGKALLMSMYRKRLDKLTYDSLW

SEQ ID NO: 97436 - protein, 129 aa, Glycine max
  Coding DNA Sequence Number=SeqID_5751
MYGHTCHKIAQSGQFQEGVTNLHNHGKRPACLQNPPHHENVLHRGFTDHQTLGLGHRTSDREQRQFDHGRLNGGVVNVMLNLLTIIDNEKEDADWCGDDETNEKEDADWCGMMRRRESWFSLGIVTVTV

SEQ ID NO: 97437 - protein, 195 aa, Glycine max
  Coding DNA Sequence Number=SeqID_5752
MAFQFNRSHFPLPFSPLRNKDEREKKVKRSIVLPFFKRTLNDEAKRIRNSRKIIDDMALNGGHWQMVVILRKENLVVWFCSLHNRPDNYLKGIINSNINSLMFLIFNTSALKGLDDTPQPKSKTAARWIVVKCNRQKRITECGYYVMHWMSTIILGSFRNNWETYFNEVRPLEVERFKALRIQWAQYYLKVRNQT

SEQ ID NO: 97438 - protein, 300 aa, Glycine max
  Coding DNA Sequence Number=SeqID_5753
  Pfam annotation: Domain name=Transposase_23; Domain location=91-156; Score=-16.8; E_value=0.082; Accession=PF03017.5; Description =TNP1ENSPM transposase
MARTKKTGQMTSEATKEIDSSKAQASQGSFVARGRRDVLTAAIGRPEHPGHVRAAGASGLALSSKPKVSPSATRVSTKESCVDPSGNDPGMGDSEKCGLYVEENPPCLVALGRLYEGSTTIHNIPLGNDQFKVGVEEVRDADAHIPVPTQEDATMFGVFNDNFFLYIKPKDLSEIVHGGQCLSISVIQLWILHMTETSMRAGNADVYGFLEPQPIQRSRQLQFKSESYIKNWMQNSKRDVYLGAYLNDAHWQMIVILLKENVVIWFCSLHNRPDNYLKGIINSALKRFDDTPQGKSKVVA

SEQ ID NO: 97439 - protein, 47 aa, Glycine max
  Coding DNA Sequence Number=SeqID_5754
MDKEMNKMKAEVAKTKESELALARDRKKRKAADKEKKVVEDSTVESR

SEQ ID NO: 97440 - protein, 321 aa, Glycine max
  Coding DNA Sequence Number=SeqID_5755
MWCYEWKKSEALRVGRLNPDSVKNAMHLRVVERVVQNEFWMFASRSQRIDGDPVLRETRIWATWEYVSSVGGGQQGMVGLCAICGCGKLVVHHRPTATYGTWRYVAGVRRPWGRQASSWQSTDKRNKDHKARRLVWWLASCESCVIYGLWSLVIDYQGLENEVRKLGELLVIDYQGIVMAAQIIHDRVEMECLERAWETLEGNTRCRFRGTIRFTATSLVHPDEPARTLQRTVEWILPTPTPYRLVEPVQVIEVTSSEEDPEEDLEELPPEPAVDALDFLEGDEDPLPEVDSPEEVTSASEADSTEDSGPGEMAISGGSSS

SEQ ID NO: 97441 - protein, 93 aa, Glycine max
  Coding DNA Sequence Number=SeqID_5756
MLMRILKLAKYRLKAQVEKDEGPSGEGQSPRVENDEGPSSLLNQYQTYQGNPCGIYPDLSSFTGSGIIQISVACIKRSAPSQDHIIWYQSFGS

SEQ ID NO: 97442 - protein, 113 aa, Glycine max
  Coding DNA Sequence Number=SeqID_5757
MTRHRFQTPTVAVRALRVDSVAMRRPLGSMFIGWAEVTRASGTEDRGSRAAEAWTSQPRRWGEEGREAEGATMAAEVEMDRREERVEAHRSKRWAIEKMRLRDMAWPRTRSWV

SEQ ID NO: 97443 - protein, 360 aa, Glycine max
  Coding DNA Sequence Number=SeqID_5758
  Homolog annotation: Hit_ID=A5AUG1; Match level="QueryCoverage=70%, HitCoverage=41%, E-value=3e-13, Identity=26%"; Hit description =Putative uncharacterized protein
  Pfam annotation: Domain name=Transposase_23; Domain location=30-100; Score=-8.4; E_value=0.01; Accession=PF03017.5; Description=TNP1ENSPM transposase
MQSQGLALPPESCVSRNESCVNPSRNNPNTGDSNKCGLYIEENPPRLVVVGKVYEGLTTIHDIHFSHDQVKVGVEEVRDADAPIPIPTEEVELVGQALHTFLAWSTHLIKCLSEHGAVGPAKPANRPYHEVDDPLYLMTLTIPQLFLKPLQVMWDAIVFGVFNEDFPLYIKHEDLSEIAHGGQCLNISVIQFGDSDVYGFLEPRSIQRSGHSQFELESYMKNWMQNSKRDVYLGAYLNDAHWQMVILLPKENLVVWFCSLHNRLDNYLKGIINSALKGLDDTPQPKSKVGARWIVVKCNRQKGSIECGYYVMHWMSTIILGSFKNNWEMYFNDVRPLEAERLNALRIQWAKYYLKVRNQT

SEQ ID NO: 97444 - protein, 122 aa, Glycine max
  Coding DNA Sequence Number=SeqID_5759
MWRRLDNVPDLITNLSLNLRFHGLLPTTVLCGFGKSGGFLLRRKTHQKMSIGQGMISLEKIGLIALSHGWEREGTRCTRSQQVKWDGGEGELSGGWAGVLVVTLINERRMAWILNCCMEVEV

SEQ ID NO: 97445 - protein, 88 aa, Glycine max
  Coding DNA Sequence Number=SeqID_5760
MNLIIVIKKKEHALRRPYRTRARARVMGEVEEVQEHMKADTEALKEQMATMMEAMMSIKEIMEVNAAAIAATSTITEVDLTPHMASIK

SEQ ID NO: 97446 - protein, 499 aa, Glycine max
  Coding DNA Sequence Number=SeqID_5761
  Homolog annotation: Hit_ID=Q5HKR2; Match level="QueryCoverage=50%, HitCoverage=13%, E-value=7e-07, Identity=25%"; Hit description =Serine threonine rich antigen
MLVLTSRMLRNFMDYATMLVLTFGMLRNFMDYATMLVLRVLKGINKGSKDKTLISFELNLTRPSSSSYHRTCSPLADKGVVNHEVSPHATRPLSLTIETRLLRGLDRMTPTSPGKVQMTTLVSTCYRTLESDGRNETFSWSRSEDADISEKEDADISGKGADDNTLEFDGRNETFHSLGPKTLTSLGKSKYTDISGKGADDNTLTSPGKVQMTTLVSACYRTLKSNGRNETFSQSRPEDADISEKGADDNTLTSPGKVQMTTLVSASYQTLESDSRKDTFSRSRPKDGDISGKDTDISGKGADDDMMTLVSACYRALEFDGRNETFSRSRPEDADIFGKGADDDMATLVSACYRTLESDGRNETFSRSRPEDAYISGKGAGANNHKVSPRAIGLSGHRIAKSHDSKKCARITIWCLCVPSDSQVTIEELRHFCGLGRKTLTSPRRVQMTTLVFECQRARLPLADKRLTGHDSKKCARITIGCVYVPPDSQVTISKSVHG

SEQ ID NO: 97447 - protein, 55 aa, Glycine max
  Coding DNA Sequence Number=SeqID_5762
MEDFIVHTSFYRHSVTFPKIKAYRKMIVGQDLVEWQILVAIGEDLPLSQSHTFIR

SEQ ID NO: 97448 - protein, 128 aa, Glycine max
  Coding DNA Sequence Number=SeqID_5763
  Gene Ontology: Mol. function=nucleoside-triphosphatase activity; Cellular component=perinuclear region of cytoplasm; Biological process=proteolysis
  Homolog annotation: Hit_ID=Q1W2L1; Match level="QueryCoverage=86%, HitCoverage=39%, E-value=2e-37, Identity=50%"; Hit description =Suppressor of K+ transport growth defect-like protein
MHPYFPNSEDPRFPTALGVGHNDQKVLVLATTNTPYALDQVHLGDTPHNLAESDFEHLTRKTEGFSGLDISVCVKDVLFEPVRKTQDAMFFFRNPDDMWIPCGPKQQSAILPPPSLNMGFTKEFGEEG

SEQ ID NO: 97449 - protein, 97 aa, Glycine max
  Coding DNA Sequence Number=SeqID_5764
MTRGGNPGSLNHNIGFMTVFEGQLFYIGCAATTDVEWVGFYSSSKAETDVEWNGHEWKGLYIGLQSTDVEFEGFLHRLSPNRCRMRIFSTSFIIEPM

SEQ ID NO: 97450 - protein, 217 aa, Glycine max
  Coding DNA Sequence Number=SeqID_5765
  Homolog annotation: Hit_ID=A7UQU7; Match level="QueryCoverage=60%, HitCoverage=20%, E-value=1e-13, Identity=36%"; Hit description=IMP dehydrogenase/GMP reductase, putative
  Pfam annotation: Domain name=DUF1723; Domain location=144-193; Score =46.0; E_value=1.3e-10; Accession=PF08330.1; Description=Protein of unknown function (DUF1723)
MAETAIGKLLYFLRITGLGRALGQRVAVTVAHDELVIPTPNVQDDPMEAPAAVEDIVADIPVDTGAEAAEDEHEGFPGGPSDPSVLTQYADHVACSVWTGKERPELKLSSHGRKVHSLGRSVPAIEGLVAGTGLSPLIACSIDTGDRGILFAFVERWHRETSSFHLPMGELTITLDDVSSLLYLLVIGDLYAFEPLHMDDAVQMLVDLLMVSTESAR

SEQ ID NO: 97451 - protein, 82 aa, Glycine max
  Coding DNA Sequence Number=SeqID_5766
NNNVLVQTPTSLHESAENISGFTKGHHLEIPTMPIGSVKHAMTVSKLRNDAKGSSRCGVLTENNGALWWLMVAVDDGEKACH

SEQ ID NO: 97452 - protein, 72 aa, Glycine max
  Coding DNA Sequence Number=SeqID_5767
MREAIKCVSQALPEAQTVRRLHVTVNIKAILRTARTRDNLIGGGSRVANIPRDYYSSDIVVFEFAHLYRVDY

SEQ ID NO: 97453 - protein, 54 aa, Glycine max
  Coding DNA Sequence Number=SeqID_5768
MTGHLMMLLSESDRVYPLCGVLCHVLLSAPVLFFTDMMRLHMMSHMLEMERLSL

SEQ ID NO: 97454 - protein, 91 aa, Glycine max
  Coding DNA Sequence Number=SeqID_5769
MKCPLSPLAISDDVKNRKMKKKAKAVENNDDMERVEGLVCFHNNLLFEVLKHVDARMLAMSGGLANGVGELGTWRHLVDSPVELASCCPHD

SEQ ID NO: 97455 - protein, 30 aa, Glycine max
  Coding DNA Sequence Number=SeqID_5770
MATEEPIMLATSVMTSNNMILMNMVNQAIK

SEQ ID NO: 97456 - protein, 312 aa, Glycine max
  Coding DNA Sequence Number=SeqID_5771
  Gene Ontology: Mol. function=nucleic acid binding; Cellular component= spliceosome; Biological process=mRNA processing
  Homolog annotation: Hit_ID=A7NXC0; Match level="QueryCoverage=37%, HitCoverage=21%, E-value=3e-51, Identity=82%"; Hit description =Chromosome chr5 scaffold_2, whole genome shotgun sequence
MNLIPKVNFFSTIKKFPACWVLPWPMLLLISAAMLRNLADKLYEKHKNAALDNLLIDHKPTIGSQIKTREIVALKKIRMDNERERVKLCRAPAEVNWPGVSKTPWYNQFKPTRPMKRRLREVFRHVKSINETLILQSPGSDADIIILNPNSGFEITAKSHHSKLDTNVYEGRRGKQSSINVSKNFMREDPLLDANPSEKFYGGDNQYRMSGQALEFKQLNTHAWEAFEKGQDIHMQAAPSQAELLYKNFKIIKEKLKSQTKNAIVEKYGNAASQEELPKELLLGQTERQVEYDRAGRIIEGLVNDLECTNAR

SEQ ID NO: 97457 - protein, 272 aa, Glycine max
  Coding DNA Sequence Number=SeqID_5772
  Subcellular localization annotation: CTP_CleavageSite=30; ConfidenceScore=5.33e-01
MIRGRTSVGSSVRIKCSLRKKLQQDLPRVRGRQGFSAGSRGRSCRTFFRWITRKILQKLLSQESAEEPSTLLPREFQKPLSYAWKKVQPPAINVVYPKVPTAIYTIHAIETDTNNSFFSKFQIQNEMRARRKKLNEGEEEEQARMEIAGCTRKKQVQKQAILLGAPSNSPKTICMLLKVYCILKVLHEDKYRALWVFFYVSSSVSFIVVHFLSFVVVFASVVRGSGSVKMDKDQWTYDNTMPQEVDMDYENEQECGVNQPHVDCSDVYNTLE

SEQ ID NO: 97458 - protein, 135 aa, Glycine max
  Coding DNA Sequence Number=SeqID_5773
MPSQGLVLPPELKVGPSATRVSTKGSCVDPSGQDLSTRESDKCGLYVDDNPFRLVALGRVYEGSTNIHNIPLGNDQVKVNVEEGFNDIQGSKSKTTAKWIVVECNKQRGSTECGYYVMHWMSMIVLGGFKDNWEM

SEQ ID NO: 97459 - protein, 122 aa, Glycine max
  Coding DNA Sequence Number=SeqID_5774
PYLPTTTGAPATVVETSNNNDGVHTTDVDILPNNVGGEPATDVDRKQNNDGSCEPDVEMDRNNDGGEPATDVDRKQNNDGSCEPDVEMDQNILGSFPANLPLLDGKNFEKLVTRSSLVSKRC

SEQ ID NO: 97460 - protein, 128 aa, Glycine max
  Coding DNA Sequence Number=SeqID_5775
  Subcellular localization annotation: CTP_CleavageSite=70; ConfidenceScore=5.61e-01
MNLWDLNAAQLLTLLLPSQPPPPPPSLTAPSPPPSSTSNSKSTPSMTSSSSHRAAHSTTPVTTSPTSFPPASSKSFTWTPTSFSLTTSPNSPPPPRDNNNTTLIAPEYYNANFSAYFTPSFCYARGGR

SEQ ID NO: 97461 - protein, 420 aa, Glycine max
  Coding DNA Sequence Number=SeqID_5776
  Gene Ontology: Mol. function=ubiquitin-protein ligase activity; Cellular component=ubiquitin ligase complex; Biological process =protein ubiquitination
  Homolog annotation: Hit_ID=A7QHS6; Match level="QueryCoverage=99%, HitCoverage=100%, E-value=1e-133, Identity=60%"; Hit description =Chromosome chr8 scaffold_99, whole genome shotgun sequence
  Pfam annotation: Domain name=U-box; Domain location=5-81; Score=86.1; E_value=1.2e-22; Accession=PF04564.6; Description=U-box domain
MDEIDVPPFFVCPISLELMKDPVTVSTGITYDRHSIEKWLFAAVPKNNTCPVTKQPLLPDLTPNHTLRRLIQAWCTVNASHGVQRIPTPKPPVDKTLIEKLLRDASASDSPSLQLRSLRTLKSIASESQSNKRCIESAKDAVSFLASFITTTVTVTTTTVLLDDVELEIKTSIAHEALSLLHSIQLSESGLKALMNHPEFINSLTKIMQSGIYESRAYAVFLLNSLSEVADPALLVNLKIDLFTELVQVLKDQVSEKASKATLRALIQVCPWGRNRVKAVEAGAVPVLVELLLECKERKPIEMMLVLLEILCQSADGRAGLLAHAAGVAIVAKKILRVSTMANDRAAKILLSVCRFSATHGVVQEMLQLGVVAKMCLVLQVDSGNKAKEKAREILKLHARAWRNSPCIPHNLLASFPMSS

SEQ ID NO: 97462 - protein, 783 aa, Glycine max
  Coding DNA Sequence Number=SeqID_5777
  Homolog annotation: Hit_ID=A5C3Q5; Match level="QueryCoverage=87%, HitCoverage=58%, E-value=1e-157, Identity=56%"; Hit description =Putative uncharacterized protein
  Pfam annotation: Domain name=Extensin_2; Domain location=296-603; Score=-140.9; E_value=0.089; Accession=PF04554.4; Description =Extensin-like region
MKLEDVVLHQNEVLVFSKTHQLLENSVEKIDDHLYVGGLGDKFLWECPETLPDRLTQTNLAAKRKLPSMDGPVRRARGESFQADMSSQNVFSRGVAQSAVSSGPTRRDAFRQRKPNTSRPPSMHVDDYVARERNVEGVTNVISVPRAGSTGGRPPSIHVDEFMARQRERQNPSATVVGEAVGHLKNASPVKPTDTEKLNKSKQLKTDLDDDLQGIDIVFDGEGSDPDDKLPFPQLDDNLQQPAPAIVEQSSPHSIVEETESDVVDSSQFSQMGTPLGSNIDENAQSEFSSKMSGSRPDMSLTRESSVSSDRKSAEHLDDSKNVQARPSGRYDSVASNTSFPMSLYNNPSASMQSPADSRMVSQNYLLKTSPQHGGIASGSQGLYDQRFMPNQPPLPPMPPPPTVLPVISHASDSVPGHSSPYVNSPAGTQRPVAFQVQLDYSSPFNNGSTAASSVPVPDSKYSRTSVSSPGGPNRIAPPLPPTPPPFASSQYNLPIVKASASQPSMYNQTSIGATELSQASIASSGARLSSYPNPSMMSVGFSRPASMPLTMFGNSLNQQQTENQPSMLQSVSVPPSSFQSMHSVSQLQPPQLPRPPKPPQLLRPTVQALQQLEQGMGLQSNVQVHQLQMLQQSQVPSMQTNYQTQQQQVEYTQQPGNCQSQQQQDAAMSLHEYFKSPEAIQSLLSDRDKLCQLLEQHPKLMQMLQVVLLGIYFTDLLKDWANCSRIMMTKILMANIMVGEWLLMRSLSGDVYIEVTGGSGPTVNYWYSSWTGLGWLKLELSE

SEQ ID NO: 97463 - protein, 779 aa, Glycine max
  Coding DNA Sequence Number=SeqID_5778
  Homolog annotation: Hit_ID=A7Q2I9; Match level="QueryCoverage=77%, HitCoverage=71%, E-value=0.0, Identity=59%"; Hit description =Chromosome chr1 scaffold_46, whole genome shotgun sequence
MGRPEPCVLFAQNFVHTHLDEYVDEVMFSEPIVITACEFLEQTASSAAQAVTLVGATSPPSFAIEVFVHCEGETRFRRLCQPFLYSHSSSNVLEVEAVVTSHLVVRGSYRSLSLVIYGNTAEDLGQFNIDIDDNALTDLVDSTEGKLEDLPPALRSTNFTIDDSRSSLRVLSIPVPATDISVEVNLFLQLMLKILEFSELGDAGHKIVDPVVSAITSYISSDICESIGGRYQMQKRSENLEELHSVVNEGRKELLEVYKVLHKKFRSGSSECSPDANYLEMDAEMLDSKTLVDMFNQYFHFQRHSSCIGDHCLSQSEHALLILSMAYLLCSGRESGFQFVSSGGMEQLAVFFSKDWQNSTTIMLLLLGVVERATRYSVGCEAFLGWWPREDENIPSSISEGYSHLLKLILSKPRHDVASLATYLLHRLRFYEIASRYESAVLSVLGNIGTVGRVTDVTLNMLSSAEILLRKLLKLINSRGPIEDPSPIACASRSLITGQTDGLLSYKTTSSLISSSSCCFSDCDIDSHLLGLLKERGFLSLSTALLSSSILRVESGHDPELSSTLIRALRGGHRGNKEDCIPLRYASIFISKGFFCSPPEIGMIIEIHLKMVNAVDSLLSLNPQSEEFLWVVWELSMLSRSDCGRQALLALGNFPELNLAGVIRRRPPPSPPPSAATAAVCRRRRHFPAAISPAKPGLGSPWEARASRPTRVSNGAATRRHRPARPPARAVHAPPSRRRNRAAPPPFSWSASPESVPALSFQFRHLERYSPILSTFLLP

SEQ ID NO: 97464 - protein, 625 aa, Glycine max
  Coding DNA Sequence Number=SeqID_5779
  Pfam annotation: Domain name=RRM_1; Domain location=85-155; Score =31.8; E_value=2.6e-06; Accession=PF00076.13; Description=RNA recognition motif. (a.k.a. RRM, RB
MRERERENERQRERVKECERNTERDTIRDREWITVRNRKRERQRGWQHPTEGLRQHYGGQRQRRTGQQRNHYQVNWHDRPDVMTFYFTRFPEDTSEKELWYHFKQMGDVREIFIPKHRNKEGRRYGFVRYKGVSNASYMERKLDNMIVGGFKLHLNIPKYGRGKEEKELTAAKQRGHKEGDNPRCNVAVEQNTKRSYAEVVISHAENKERRSGTSSLTTTHGRTHSSITLEISEETKKRYADTWVGRLKRQQVFERVEDELSTDQLRKIVAEVGDLVKVDDNFEDMQRLDRARVLVRTPWTPTVEHIVIAHIDGDAHKISIVEENCNAGIVCARHHQSVWGSSEEILSDSDDTGTLQSWPIDNSPPSTTFVMHGDNTFWQSLVKSNGQTGTCSPLGITRSRKKRGLCKAISHSGAEKGKEINLEECNPTLLVVEYEELESQLAGAEGQFTQKGEDIPQRFLANTGENQKGEPDALDQGLVGENFQKHSNGPLEEFLNKSRDITVYSRKKGCSKKWAQDRGKQINPKTLDFAEKPSNHKHNAASCGSDEVLESPKQHNFHQSPSPSSILNINDMEVKDDAYRNLAKELGVSFADDKSNGAKLMTDMDNTENPPKSAAVLGNEDNAS

SEQ ID NO: 97465 - protein, 266 aa, Glycine max
  Coding DNA Sequence Number=SeqID_5780
  Gene Ontology: Mol. function=methyltransferase activity; Biological process=metabolic process
  Homolog annotation: Hit_ID=A7PJF6; Match level="QueryCoverage=99%, HitCoverage=71%, E-value=1e-106, Identity=68%"; Hit description =Chromosome chr12 scaffold_18, whole genome shotgun sequence
  Pfam annotation: Domain name=Methyltransf_11; Domain location=98-200; Score=95.9; E_value=1.3e-25; Accession=PF08241.3; Description =Methyltransferase domain
  Pfam annotation: Domain name=Methyltransf_12; Domain location=98-198; Score=78.1; E_value=2.8e-20; Accession=PF08242.3; Description =Methyltransferase domain
  Pfam annotation: Domain name=Ubie_methyltran; Domain location=67-264; Score=-118.5; E_value=0.00088; Accession=PF01209.9; Description =ubiECOQ5 methyltransferase family
  Pfam module annotation: Pfam domain module=Methyltransf _11::Methyltransf_12::Ubie_methyltran; Domain location=98-200::98 -198::67-264
MAKEILESEVYRELDNIQNQSLVYPDYYLNPFHAYDEGNLTWLAAAEAEAATMSIARRAVPDASSTQEAIKILRGNWLRAIEQHHIQYSESFVINDILDIGCSIGISTRYLADKYPTAKVTGLDLSPYFLAVAQHKEKSAPPRKFPIRWIHANGEDTGLPSKSFNLVSIAFVFHECPTRVIVNIVREAFRLLRPGGTLALIDSSMKSKVVQELSPVLFTLYKCTEPFIDEFYLTDMDETLREAGFVNITSILTSPRHATITATAPQ

SEQ ID NO: 97466 - protein, 488 aa, Glycine max
  Coding DNA Sequence Number=SeqID_5781
  Gene Ontology: Mol. function=ketol-acid reductoisomerase activity; Cellular component=chloroplast; Biological process=branched chain family amino acid biosynthetic process
  Homolog annotation: Hit_ID=O82043; Match level="QueryCoverage=86%, HitCoverage=85%, E-value=1e-179, Identity=67%"; Hit description =Ketol-acid reductoisomerase, chloroplast precursor
  Pfam annotation: Domain name=IlvC; Domain location=229-488; Score =306.6; E_value=4.7e-89; Accession=PF01450.10; Description =Acetohydroxy acid isomeroreductase, catalytic domain
  Pfam annotation: Domain name=IlvN; Domain location=75-238; Score= -49.1; E_value=5.9e-05; Accession=PF07991.3; Description=Acetohydroxy acid isomeroreductase, catalyti
  Pfam module annotation: Pfam domain module=IlvC::IlvN; Domain location=229-488::75-238
  Subcellular localization annotation: CTP_CleavageSite=57; ConfidenceScore=5.89e-01
MSSTASSTASICATSRTTFSSKHVARSCFVAVPNRAFSKLNFRFKPVAMATLGARMVAAAPSVTPPASLDFESSVFKKEKINLSGHDEGPAQAQNLRDSLADAKSDIVVKIGLRKGSLLINEARAAGFSEENGTLGDIWVSEENGTLGDIWETISGSDLVLLLISDAAQSMGLDFPKHFSVIAVCPKGMGPSVRRLYVQGKEINGAGINSSFAVHQDVDGGLLMLLWHGILLGAVHGIVESLFRRYTEHGMSEDLAYNNTVESITGTISKIISTKGMLAVYNALSEDEKREFEKAYSASYYPCMDIMYECYEDIAAGSEIRSVVLAGRCFYEKEGLPAFPMGKIDQTRMWKVGEHVRSTRPAGDLGPLYPFTAGVYVALMIAQIEILRKKGHSYSEIINESVIESVDSLNPFMHARGVSFMVDNCSTTARLGSRKWAPRFDYILTQQALVAVDNGAPINQDLISNFLSDQVHGAIEVCAQLRPTVDIS

SEQ ID NO: 97467 - protein, 65 aa, Glycine max
  Coding DNA Sequence Number=SeqID_5782
MVIVATYPSAGGQREGSRVRLPKRKMREVATNIYSRKTSVKSERRGLRTLSVKGLGVVFVHGEGN

SEQ ID NO: 97468 - protein, 101 aa, Glycine max
  Coding DNA Sequence Number=SeqID_5783
MIMRGQEIYSSQDEATTSPSSYESEKEKGEESSKEIYPQEEGQPLMVKEDCKESDQGVPMNPKRIKVLRKKSPEFQEPQDLRSNPFQGGGNDAILYRKGLG

SEQ ID NO: 97469 - protein, 130 aa, Glycine max
  Coding DNA Sequence Number=SeqID_5784
MPTSSRRLGSSSPEFHFLHPVAVILLPRTMFVIITGVNHTIQNCKGEFIIKRTNTNSKQSQLARNIGKQDEHTQHSLFNTHIQQIFIIHIQQLLIIHPWTQSRLHKMMHAPDSNTQMQCGTYQQQPNLRK

SEQ ID NO: 97470 - protein, 166 aa, Glycine max
  Coding DNA Sequence Number=SeqID_5785
MAEEPRRVTLEDYSSSTVPQFLTSIAQPEVQAQTITYPPSLIQLIQNNLFHGVPADAIRLSLLSFSLSGEAKRWLHYFKGNSLKSWDEVVEKFLKNLPASSSLHFKNNPREIWLKGVNTHVVLSRNHDERAKRASALSLFIATVKILEFQMNALSGPCRAKRVHPC

SEQ ID NO: 97471 - protein, 85 aa, Glycine max
  Coding DNA Sequence Number=SeqID_5786
MLCVIDYMVMGTSFVVQVEGTSTWVVVTENKRGYISCGSVQVEDTSTWLFKENKGRYIPCGSLFVKDFTRLKRNLKNRWLLGDWM

SEQ ID NO: 97472 - protein, 71 aa, Glycine max
  Coding DNA Sequence Number=SeqID_5787
MENWRTALGNNFAGLQTRRWRMHEQLLAMIIRGLRIKGRMENWRTALGNNSRGSRLEGGGHMNSAWQSIHG

SEQ ID NO: 97473 - protein, 224 aa, Glycine max
  Coding DNA Sequence Number=SeqID_5788
  Gene Ontology: Mol. function=transporter activity; Cellular component= integral to membrane; Biological process=response to stress
  Homolog annotation: Hit_ID=P30704; Match level="QueryCoverage=100%, HitCoverage=64%, E-value=1e-119, Identity=93%"; Hit description =Outer membrane pore protein E precursor
  Pfam annotation: Domain name=Porin_1; Domain location=17-224; Score =218.8; E_value=1.2e-62; Accession=PF00267.12; Description=Gram -negative porin
MGFVASSASQAAEVYNKDGNKLDVYGKVKAMHYFSDYDSKDGDQTYVRFGIKGETQINDQLTGYGRWESEFSGNKTESDSSQKTRLAFAGVKLKEFGSFDYGRNLGALYDVEAWTDMFPEFGGDSSAQTDNFMTKRASGLATYRNTDFFGLVDGLNMTLQYQGKNEGREAKKQNGDGFGTSLSYDFGGSDFAVSAAYTSSDRTNDQNLLARGQGSKAEAWATGL

SEQ ID NO: 97474 - protein, 251 aa, Glycine max
  Coding DNA Sequence Number=SeqID_5789
  Gene Ontology: Biological process=transposition, DNA-mediated
  Homolog annotation: Hit_ID=Q6UUU1; Match level="QueryCoverage=23%, HitCoverage=40%, E-value=9e-18, Identity=76%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTLKSKPRHFRNVSVSNYTKILDRSSTAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWFTNGAEISWKMPGRYLTG

SEQ ID NO: 97475 - protein, 79 aa, Glycine max
  Coding DNA Sequence Number=SeqID_5790
MTRSRMEIQTDEGRAEEKVEGYKQQSATEPALEPVSDFIELEEVVEDEDDQQERETPIKESEIGIKMKEEQENEKEKEE

SEQ ID NO: 97476 - protein, 171 aa, Glycine max
  Coding DNA Sequence Number=SeqID_5791
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
  Subcellular localization annotation: CTP_CleavageSite=65; ConfidenceScore=5.55e-01
KPVYTPLAPQYANRLSPRVGRFINAAGTTGFPTGKRAVSATQLIVRPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 97477 - protein, 149 aa, Glycine max
  Coding DNA Sequence Number=SeqID_5792
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=58%, HitCoverage=73%, E-value=3e-24, Identity=66%"; Hit description=LacZ protein
MDVSAKQGRCELPAPLRKPHQWVLESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 97478 - protein, 249 aa, Glycine max
  Coding DNA Sequence Number=SeqID_5793
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=ATP synthesis coupled proton transport
  Homolog annotation: Hit_ID=P92549; Match level="QueryCoverage=56%, HitCoverage=27%, E-value=2e-71, Identity=100%"; Hit description=ATP synthase subunit alpha, mitochondrial
  Pfam annotation: Domain name=ATP-synt_ab; Domain location=1-92; Score= 18.7; E_value=2.6e-09; Accession=PF00006.16; Description=ATP synthase alphabeta family, nucleotide-binding domain
  Pfam annotation: Domain name=ATP-synt_ab_C; Domain location=104-176; Score=21.7; E_value=0.00036; Accession=PF00306.18; Description=ATP synthase alphabeta chain, C terminal domain
  Pfam module annotation: Pfam domain module=ATP-synt_ab::ATP-synt_ab _C; Domain location=1-92::104-176
MSLLLRRPPGREAFPGDVFYLHSRLLERAAKRSDQTGAGSLTALPVIETQAGDVSAYIPTNVISITDGQICLETELFYRGIRPAINVGLSVSRVGSAAQLKAMKQVCGSLKLELAQYREVAAFAQFGSDLDAATQALLNRVKYSFSSFFDIDTLLAFFTPAFCMDDVGASSQSSLPTVNPTPDPAAPAEPQAPDPDLSLPLLDDNARRAELNERGGFLHFGDLSDQQKDKVLNAQVKIERAIEKALLSD

SEQ ID NO: 97479 - protein, 147 aa, Glycine max
  Coding DNA Sequence Number=SeqID_5794
  Gene Ontology: Mol. function=helicase activity; Cellular component =chromatin; Biological process=protein amino acid phosphorylation
  Homolog annotation: Hit_ID=Q2R0Z1; Match level="QueryCoverage=95%, HitCoverage=6%, E-value=3e-38, Identity=55%"; Hit description=AT hook motif-containing protein, putative
MQVVKKDEGGMFFLHAYRGTGKTYIWRTLASSLRVNNHIVIMVASSGITSLLLLGGRTAHSKFKIPVPIFEDSTCNMLQGTQLAELLNQTKLIIWDEAPMAHKFCFEALDQSLKDIIKETKNPNQIFGGKVIVYGGDFQQILPVIPR

SEQ ID NO: 97480 - protein, 77 aa, Glycine max
  Coding DNA Sequence Number=SeqID_5795
  Subcellular localization annotation: CTP_CleavageSite=28; ConfidenceScore=5.20e-01
MLVATPRVFLSWNTHPASLASPSRRRVGCDNLSSSVLVHPPILTHLHVYFLVALKRCRSDDESRKGTNTADPTVDFE

SEQ ID NO: 97481 - protein, 54 aa, Glycine max
  Coding DNA Sequence Number=SeqID_5796
MEVGSWKWKLEVGNESYWKLKVENAGWKLEGEVVVIIKKGENVNHEDFDDVKKN

SEQ ID NO: 97482 - protein, 178 aa, Glycine max
  Coding DNA Sequence Number=SeqID_5797
MASFSQLQSQRQSQGLAVPPEPLVVLIPQEMILRRVSTKGSCVDPSGKDPETGDSDRCGLYIEVDPARLVSVDEIKDADAAVPVPTDEVSLSGAGTSHLPCLADTFGQVFITPAVSPPKPPPKPDPEVDDPLYLMTLTIPELFLRPYQVRWDATVFGVVNPDFPLYIKHEDLSEIAHG

SEQ ID NO: 97483 - protein, 73 aa, Glycine max
  Coding DNA Sequence Number=SeqID_5798
MKQPARPAKLGSNLLSHFFYKWTWGAEGVATCPSRASEGEAHGCAFQRRKGARSCHQGLFVGNVGKTEGNRSK

SEQ ID NO: 97484 - protein, 110 aa, Glycine max
  Coding DNA Sequence Number=SeqID_5799
LHVLALRGLHVLTIRGLHALTSRGLHVLALRGLHVLTLGTSYPHRQRATRPHLERTTHPRQQRGLHALTSRGLHLLALRGLHALTFRGLRVLIFSVLDIHTLKEFKVLCP

SEQ ID NO: 97485 - protein, 73 aa, Glycine max
  Coding DNA Sequence Number=SeqID_5800
  Subcellular localization annotation: CTP_CleavageSite=35; ConfidenceScore=5.65e-01
FSSIFRSALDSRSLFRPPSSHSLQFRLKKGFLSVKARLAPSSCLARVSEIWLSVILALSAEETIFSLNELMTR

SEQ ID NO: 97486 - protein, 79 aa, Glycine max
  Coding DNA Sequence Number=SeqID_5801
MRMLETEESPPNNVCTLTKESKFRVGIECTLFGEYVDKLSASLLLEKVNGLICFGSVGYVVLGSDLIYLDNMRLKETMV

SEQ ID NO: 97487 - protein, 105 aa, Glycine max
  Coding DNA Sequence Number=SeqID_5802
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=93%, HitCoverage=75%, E-value=3e-25, Identity=66%"; Hit description=LacZ protein
  Subcellular localization annotation: CTP_CleavageSite=32; ConfidenceScore=5.05e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSAH

SEQ ID NO: 97488 - protein, 127 aa, Glycine max
  Coding DNA Sequence Number=SeqID_5803
MTRGNPSDLQPFDPEIDRTFHRLVRHHFIPFDHSEHSITGESVHSVIGDFEHPDLEHYNFEHSDSEHSDFAHSENMAQPPPRERTLREMAAPDFTYESLCIQYPDEDVPYVLKTGLIHLLPKFHGLA

SEQ ID NO: 97489 - protein, 35 aa, Glycine max
  Coding DNA Sequence Number=SeqID_5804
MHSLKNSLSVPAVLSEAESLSPAFEELSAYPCGRP

SEQ ID NO: 97490 - protein, 43 aa, Glycine max
  Coding DNA Sequence Number=SeqID_5805
MGSPPAPLSPPPLPPPPRCICFAVCMSGHAKPHVYDRCPLEPP

SEQ ID NO: 97491 - protein, 91 aa, Glycine max
  Coding DNA Sequence Number=SeqID_5806
MPLWWEFYSWVKEPRVLHCKPMDNFLQHSPMSGLQNTNRRRVYLLWLTVVPLALTLKLLQEHNKGKGNFTKEKKHKVVTMLELNMRYPSHV

SEQ ID NO: 97492 - protein, 368 aa, Glycine max
  Coding DNA Sequence Number=SeqID_5807
  Homolog annotation: Hit_ID=Q9AVH2; Match level="QueryCoverage=48%, HitCoverage=75%, E-value=5e-64, Identity=61%"; Hit description =Putative senescence-associated protein
MADAKFAGLLGLGKPLVEILPPGQLRGFCPLLAWLGSAVLGYGPVLSFGLVGPLLPPVISFVARILPTLACAPLAKSVPRWQNEREPTNGSLFWPNIVEEERDTGLIGEGRIKATRAESQWIVAARPLCHLQYPVAYLSRLQRILPAARWELRFKASRRANPPHEGHQRHVPLGARGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADIGSKKRGSAPLPIHGI

SEQ ID NO: 97493 - protein, 74 aa, Glycine max
  Coding DNA Sequence Number=SeqID_5808
MTKARPKGIRKGKEGEACHPTLAGELGCILPKAPPSGGTSWKAQNFTDCATMLSFDFWHVTELHGLPNDGCQVP

SEQ ID NO: 97494 - protein, 92 aa, Glycine max
  Coding DNA Sequence Number=SeqID_5809
KKEGVETRIVITERAGWTKSVSYLCFPLISDERFFLQKAVASRGSNLARLGELSSPGRAGGSAFLALLILSKLLRKIISVKKIQAEALPLQQ

SEQ ID NO: 97495 - protein, 37 aa, Glycine max
  Coding DNA Sequence Number=SeqID_5810
MGVFLADRVERQSHHGFLPPSYSLHLPLSSYSSKQDN

SEQ ID NO: 97496 - protein, 56 aa, Glycine max
  Coding DNA Sequence Number=SeqID_5811
MALALDFCIRNTRMCTYAIFDSQSALSMHVCKFSKGNACDVGNGPEEACLKEVQEG

SEQ ID NO: 97497 - protein, 73 aa, Glycine max
  Coding DNA Sequence Number=SeqID_5812
MGTQHCTFDRPLSPFAKRKPRAKRIFCHALSGESLALSAQPLHVRLIWSTMLAKVELSLFQFDLNSVKRWPAR

SEQ ID NO: 97498 - protein, 55 aa, Glycine max
  Coding DNA Sequence Number=SeqID_5813
GMQPSEGEDVKSSEGEDRVARACIPLKVRTCSPLKERVLVPKGPPDAILSHKGIG

SEQ ID NO: 97499 - protein, 193 aa, Glycine max
  Coding DNA Sequence Number=SeqID_5814
MEGLVDLAAIDAFLAFHHGKESLVVAILAMHDTFDQRCEKSGARIVCCTPALYVWLVSHLFLQEGRLVYPLQGRKNQDSIFMRRISKCSLNGNKGKDRELRRSSNGIIGGYHKWLRVRTQGLDWLPNLKTVRDDEVKASEESDEVQALKAELERARVVKEKFKAAIVSSSSEEVKGIITGQRHDLEGRAKGLP

SEQ ID NO: 97500 - protein, 53 aa, Glycine max
  Coding DNA Sequence Number=SeqID_5815
MDSGRFQVSVPGIAFVDNWAVGKEKEWQSQHGLLLHPHPLHLPQFSHSSKQDD

SEQ ID NO: 97501 - protein, 53 aa, Glycine max
  Coding DNA Sequence Number=SeqID_5816
MTIALSGPIGLGVHPSLSVASHAKREINSLSESFVSCQTQRNIGAKPKSTYSR

SEQ ID NO: 97502 - protein, 45 aa, Glycine max
  Coding DNA Sequence Number=SeqID_5817
MEYLLVGDEQKRKTESKNAKKDDPRAANSSIPWGKINPVPPPLLD

SEQ ID NO: 97503 - protein, 171 aa, Glycine max
  Coding DNA Sequence Number=SeqID_5818
  Homolog annotation: Hit_ID=Q6UUU1; Match level="QueryCoverage=35%, HitCoverage=40%, E-value=1e-18, Identity=78%"; Hit description =Putative uncharacterized protein
MMFATKLLKWYLEHGLAVSNITFAVRYERKDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 97504 - protein, 44 aa, Glycine max
  Coding DNA Sequence Number=SeqID_5819
MDTSVPYIGAMKGTMHKPQANLGTDHKFSPNRFPATRRIISNWA

SEQ ID NO: 97505 - protein, 67 aa, Glycine max
  Coding DNA Sequence Number=SeqID_5820
  Gene Ontology: Mol. function=protein kinase C binding; Cellular component=cell projection
  Homolog annotation: Hit_ID=UPI0000F2ADE5; Match level="QueryCoverage =77%, HitCoverage=10%, E-value=9e-09, Identity=52%"; Hit description =PREDICTED: similar to PDZ-LIM protein cypher3s isoform 1
MGALRLINYFAMIGLPSPSEGYTPSPSEGCTPSPSEGYMPSPSEGYTPSPLEDYTSSPSKGCMPSPS

SEQ ID NO: 97506 - protein, 170 aa, Glycine max
  Coding DNA Sequence Number=SeqID_5821
MTTLVSTCQSDLRSLNDEVRITVRCLCMLQDSRVAVTKGGVVDKSRAFAPTYPQFVMRNSDLHMRGEKAIDAQDFWLTIKGREPLQVVGKDGHSHPGSRFTVSWDFGLRLVEQLDMIYVSSGFGQRFGDKGDAPHYFHDTHATMTIRKFYAKLVMHVPMRTLKHHVFMVM

SEQ ID NO: 97507 - protein, 109 aa, Glycine max
  Coding DNA Sequence Number=SeqID_5822
MGLKSRTHMSNQFNLKICTNSKTKGENLFVIIKNGEIVEAKLHGESKNNSRVQDKNQEEFKTQEERLESRIKIQGSRSQESRSRFKTQDSRIKRRLNQDKYEKFFTKIE

SEQ ID NO: 97508 - protein, 116 aa, Glycine max
  Coding DNA Sequence Number=SeqID_5823
MTLKNLVLEDARTQCSDRIRGYIYLGLTENKRGYISCGSVLVEGTSTRLFKENKGGYIPCGSLLVKGFLQGWKRNLKDRRSLGDENHETGQIQAKGPSGEGRRPKWRRTKPPSGEG

SEQ ID NO: 97509 - protein, 77 aa, Glycine max
  Coding DNA Sequence Number=SeqID_5824
MDRSTAVRKEKQMGNNKLDLKERKNKKSKLDVQIEDPWEVGGVACLSMNNWDKKDVVHNEAKIEESQAKSTKTDIDS

SEQ ID NO: 97510 - protein, 135 aa, Glycine max
  Coding DNA Sequence Number=SeqID_5825
TTRPRLQRTARPHLERTTRPRLERTTCPHHPRAARPHLQRTTRPRLERTTCPHHQRAARPHLQRTISPRLERATRPHLGTTRPRLRGLHALNSRGLHVLALRGLHVLTLGLHALTLGTSYPHRQRTTRPRLERTT

SEQ ID NO: 97511 - protein, 78 aa, Glycine max
  Coding DNA Sequence Number=SeqID_5826
MVIDYQKQRPFNILSPFLSPVIDYPRMVIDYHRLISRYHPRYIAGQPPHKPSSFVDFVLLLVDCQELASLGTSQVLTD

SEQ ID NO: 97512 - protein, 127 aa, Glycine max
  Coding DNA Sequence Number=SeqID_5827
GSRPQRHPVDPEKSNRALGFPALVTGLCQSYRVPVPPARSRHHDIGIAPTKAPSGPGEVQQGLEFYGVPVTFSKGIRPPTNRAFIKKYCVPRQAQGETQQQPGDGRQRAIDAPPSPLEFTSAHPQKG

SEQ ID NO: 97513 - protein, 116 aa, Glycine max
  Coding DNA Sequence Number=SeqID_5828
HFPSVAECIVDPDYDEVSPRACRWIAMKKTGASTSPGVLVDFMLFRLAPLGARCCQTLTRKGQCAPDYIDWFLVISHPFVAVAQPLDPPRDAPATHHAAFVEPHRPQVLEPAQTCS

SEQ ID NO: 97514 - protein, 137 aa, Glycine max
  Coding DNA Sequence Number=SeqID_5829
MASRKLASKRSRKDKAAEGTSSAPEYDSHRFRSAEHQQRFEAIKGWSFLRERRVQIRDDEYTNFQEEIVCRRWASLVTPMAKFDPDIVLEFYANAWPTEEGVRDMRSWVRGQWIPFDADAISQLLGYPLVLEEGQEC

SEQ ID NO: 97515 - protein, 77 aa, Glycine max
  Coding DNA Sequence Number=SeqID_5830
MEHTSTWLFKENMRCDILALIPHDVAPCGASRPWIFFINGVLCFLKIIAEEWRMKKDDWIRHFKEKMSQEEAHNHRK

SEQ ID NO: 97516 - protein, 264 aa, Glycine max
  Coding DNA Sequence Number=SeqID_5831
  Homolog annotation: Hit_ID=A6N073; Match level="QueryCoverage=13%, HitCoverage=89%, E-value=5e-08, Identity=82%"; Hit description =Putative uncharacterized protein
NWRCGMNRKLGYGAQLRANLDPTKGVGRLRQQDGGHGSRNPLRRRGGRCKTQGASPGGAVVGADLGGSSKYSNENFEGRRGERFHGIGLKFLNRDVAADGNVRESGDVGGGPGKSYLFCLTACPPWKTAQPEVGSSGWKSTARRVGVRQGKSAKWIRNLGKRIGSEGWARGSQSRTRRLSVDCSSCFRGESGSSRAGRGTDWERALRGLFPGASNSQLRTVLWNVKVKKFNQARVNGGSNYDSLKRNHSQGNGLGGISGERRPC

SEQ ID NO: 97517 - protein, 65 aa, Glycine max
  Coding DNA Sequence Number=SeqID_5832
MQEKASRILELFLKDSLGENEFVLIFSFNTNLVIIGVPMNPKRIKVIPDGSAHSTKYKKNVLGVP

SEQ ID NO: 97518 - protein, 180 aa, Glycine max
  Coding DNA Sequence Number=SeqID_5833
MVLISSAPVAYLVSISCPSCSATEIRGGIRSQFGTQAYQPEASALATNHHLTRLALTLRRFHSRRNLSCHSLHSRLNRQLLGRAIGAGLSRITPAGERGMCCKAIKLGNARVFPVTTCVAGEKTTVPENCNTTHYRANWSSTAVAAALELVVIPRAAGIRSIAVSCPIRIFEGNDHLTGK

SEQ ID NO: 97519 - protein, 206 aa, Glycine max
  Coding DNA Sequence Number=SeqID_5834
  Homolog annotation: Hit_ID=Q2QQ86; Match level="QueryCoverage=14%, HitCoverage=14%, E-value=1e-07, Identity=96%"; Hit description =Putative uncharacterized protein
SAQQSAFAVGVLSDLYAFHRSTGNSLCPYHALRPIIPDNACILCLTAAAGTELADAYSPDTVIASSPGKEVHDPPSVADHPLGPATDHRLGKLLPHQLANQTRAPPRADSSFCSSAYGVLAAVSSCCSPPKAFILSQDRTLHEIPSCITYSFLVVDKADSEFSSIPRHNLYPGASYSTGVRSQKYSPPTPRARTDNFHHVKVTLYR

SEQ ID NO: 97520 - protein, 66 aa, Glycine max
  Coding DNA Sequence Number=SeqID_5835
MRDHGSIGLFLGNDEQVTDTQDFGWQSKGEDHFMMQSYPARALGRRLQLDWARDPREGPRVLMSLR

SEQ ID NO: 97521 - protein, 232 aa, Glycine max
  Coding DNA Sequence Number=SeqID_5836
  Subcellular localization annotation: CTP_CleavageSite=29; ConfidenceScore=5.10e-01
GLHVLALRGLHALTLGTSYPHRQRTTRPRLERTTRPHHQRAARPHLQRTISPCLERATRPHLGTTRPYLQRTTCPRLWGLHALTLRDNCASTTREGAITQDYYALPGGKISFVPLDRTHKTPSGPGKVQQGPGVPSSGYGPLSVLHGARTPPSKVMLSRHRDRARKTSSGLEEVQQGLGVVKALITGLYQFKGVPVAPSRVIRPPTDRAFIKKYCVPRQAQGETPQQHWDGR

SEQ ID NO: 97522 - protein, 92 aa, Glycine max
  Coding DNA Sequence Number=SeqID_5837
MVAITPTKVHQPPFLREYDSNATCACHGEAPGHSIEHCRGLKRKVQGFSTFTGIGCKPLVYLLKRPVTIQSEITRLVRWWGCRKTTSKVQNK

SEQ ID NO: 97523 - protein, 121 aa, Glycine max
  Coding DNA Sequence Number=SeqID_5838
MDREMITMIVDTLPAFYYEKMVGYMSSSFSNLVFAGERIEVGLRIGKFVYPTLMNRKPRANGENKKEGGTHVVTAVPTWPNFPPAQQYQPFSLPTTLSSTKATPKLVTKLACYTSDTKHHP

SEQ ID NO: 97524 - protein, 413 aa, Glycine max
  Coding DNA Sequence Number=SeqID_5839
  Homolog annotation: Hit_ID=A7UQU7; Match level="QueryCoverage=28%, HitCoverage=19%, E-value=2e-11, Identity=37%"; Hit description=IMP dehydrogenase/GMP reductase, putative
MVRTRGLGRAFGRVIGKALGREDHHDSDDAPQRRRPTTSARRQRGAVSVAEDDPVVAADEPMVDADTGANVHPPGVDASANEPEGFPGGPRDPSVLTEYADHVVVSVWNEEERSELKLSFHGRKVQKLGRPAPQIKGLVATTGLSHLIACSVDTAIGDLYPRLWRGGIGKLAISIFSWGRSPERQTWPRQHIVMDHTYAYLGYEIYIRADVRLDIRQLQLGAAAVVHMYDHLNDACICTNRQLAGYITLLQCWIYEHFSSVAECIANPDYDEVSPRTCRWIATKATVKSISTATYRQHLDRLRILDVYWMPYGENRATPTREEIDNRWMHYSDHLVPVGEICLVPGQCAPEYMDWFFVISYPFMTATQPSNPPQDPPATHDASFVELHIPQVPESAATSTHARSDVDEPRHAM

SEQ ID NO: 97525 - protein, 57 aa, Glycine max
  Coding DNA Sequence Number=SeqID_5840
MVWKIGLLILQLEVSKDFTEQIHSRVYTNVEQIDDDIGTNAIEEGEEWTVKCIRYDR

SEQ ID NO: 97526 - protein, 121 aa, Glycine max
  Coding DNA Sequence Number=SeqID_5841
MLMCNDQYSCVGSIKLLCIIGRTPDGILNLLQATITSTLDALLYYNGRWNMSCQHDFVGYPFTGKNTKRFDIPSGCTIDGMKDVIKQVAPQGIPSYGHSEYSDKIIKFEIIELKTDDDVLK

SEQ ID NO: 97527 - protein, 46 aa, Glycine max
  Coding DNA Sequence Number=SeqID_5842
MSSKSSKIQRFKNQVSRIKIQDSRFKIQDSSFKNQDSRIIKIKIQD

SEQ ID NO: 97528 - protein, 66 aa, Glycine max
  Coding DNA Sequence Number=SeqID_5843
MHLLKDCYTKNKKGYISCGSVKVEGTSTWLFKENKGGYISCGSLACKGFYKVERNLKNRRLLGDWM

SEQ ID NO: 97529 - protein, 136 aa, Glycine max
  Coding DNA Sequence Number=SeqID_5844
MKGLAWAENVSALIGKSVPHISEKCKNPGDDKKLKGQSKNEFKIFKIESRTLQDSKGKLISRIKNQDSRDQDFKNQDSRDQDSRLKIQESREGLIKISMKRFSQKLSSTWIFLKTCLPKSFYSLVIDYQIVVIDYQ

SEQ ID NO: 97530 - protein, 75 aa, Glycine max
  Coding DNA Sequence Number=SeqID_5845
MAIGIMRHDNIIVYFMAFGISRPHVQTKAMCKTVLHAKQRIKLNVLMMPKDYMNHMLLKDLFKTKIFKMNDQDSL

SEQ ID NO: 97531 - protein, 93 aa, Glycine max
  Coding DNA Sequence Number=SeqID_5846
  Homolog annotation: Hit_ID=A5B612; Match level="QueryCoverage=97%, HitCoverage=31%, E-value=1e-10, Identity=34%"; Hit description =Putative uncharacterized protein
MQIFIEGIDLNIWEAIELGPHISTIVDVSTSTTTQKPRDQWTEEDRRKIQYDLKAKNIITSALGIDEYFRVSNCTNAKDMWDTLQLTHEGTTD

SEQ ID NO: 97532 - protein, 41 aa, Glycine max
  Coding DNA Sequence Number=SeqID_5847
MGEANLMTAEWRRKKDDWRCHFKEKMSQEEARHRRKPWIRA

SEQ ID NO: 97533 - protein, 110 aa, Glycine max
  Coding DNA Sequence Number=SeqID_5848
LGRIDGDPVLRETRIWATWEYVSSDGEWYLEICRGGQDLWDVRRAPGSQPIKEQRPQSKEACVVAGQLKLRWPLVIDYQGSVIDYQALKQDQEVKRASGCVIDYIEEQGT

SEQ ID NO: 97534 - protein, 106 aa, Glycine max
  Coding DNA Sequence Number=SeqID_5849
LASGLAPDHAEFAGYGPAVASYEPGGEDDILEALEPTPPEPFIFETDPVAPTPQVTPEPSTAVLDMSSPQPESSALVLDLPLSQDSPSSTPALNLNEYAMDATQDH

SEQ ID NO: 97535 - protein, 101 aa, Glycine max
  Coding DNA Sequence Number=SeqID_5850
VDSRGSPTSFGYRKDRNGQWLKKDALPPQDERTPSPPPPPEDSALMNEVLSELRGLRSYVGDRFDSLDTHFAGMDIRLTQLEEDVGYIRQSFDLPPPPPPS

SEQ ID NO: 97536 - protein, 98 aa, Glycine max
  Coding DNA Sequence Number=SeqID_5851
EPARTLQQPVEWILPTPTPYRLVESVQVIEVSSSKEDPEEDPEELPPEPAEDALDLPKDDEDPLLDVDFPEDIMSASEADSTEESGPGGTANSEDSSS

SEQ ID NO: 97537 - protein, 211 aa, Glycine max
  Coding DNA Sequence Number=SeqID_5852
ELATQLAQASKVASSRSKSLLEEESGRPKLTTTIWLLSREGSRSAYGIGIGVNFVGFLSGKFLLGLVFVLGTYTWSGLCREWMLWVMLGWSLWLIEHSQSDGRRAGGRFDIGRVIILVRGILVHGVVRGLLGAWPCGCYGRSIGVLWKSSCSRTQDSCSLLHMFCNYILSGAMSELYWYFLIKAAIRSFQEWIQEDSRLVYQVIVAPAKLS

SEQ ID NO: 97538 - protein, 74 aa, Glycine max
  Coding DNA Sequence Number=SeqID_5853
MWGLRVRLPWEENVRSRHQRLFEENVGKTGKVWSTNFKCERFRSCFYTRGSFCIFYLFVVDKGVSLGPTYPQLR

SEQ ID NO: 97539 - protein, 105 aa, Glycine max
  Coding DNA Sequence Number=SeqID_5854
MESLDSPFRKNYVGLISSSMEVSFGFSDVFHKEKVGGDSAHFPPLEDAPVSLASLARKRVVATVGDSTGDYFSPTGLSKKGPYTRVHGNLRSGGESMVMLGLRLA

SEQ ID NO: 97540 - protein, 82 aa, Glycine max
  Coding DNA Sequence Number=SeqID_5855
  Gene Ontology: Mol. function=RNA-directed DNA polymerase activity; Biological process=RNA-dependent DNA replication
  Homolog annotation: Hit_ID=Q1AKH8; Match level="QueryCoverage=64%, HitCoverage=21%, E-value=2e-20, Identity=62%"; Hit description =Reverse transcriptase family member
DDGEIEGDVNHRIQAGWMKWRKAFGECWAVKSQHENKVGVAEMRMLRWMCEKTGRLCSEESRPDGEKTNNSRQRKTPKDYKR

SEQ ID NO: 97541 - protein, 116 aa, Glycine max
  Coding DNA Sequence Number=SeqID_5856
  Subcellular localization annotation: CTP_CleavageSite=57; ConfidenceScore=5.42e-01
MSLSLNSQVTALERCIGGNSVPCRLSNVALRSAFINPLSRKVTSSTSPNKLGFTKLLVSHAESLLLLLLCRSIAIAVHLISPCLQVAIVVHFMVVSFGNATMEDVQLFELQEQGGT

SEQ ID NO: 97542 - protein, 120 aa, Glycine max
  Coding DNA Sequence Number=SeqID_5857
AKHFSTECLGTPPWYLQVALGSYLFGEGGKFLVALELPAGRVVFGVGTWGASLWVGALGCTGAELEAFPTAWPSPSFLFAPVALMEACLWGFYGGWIFELQWGPLMVIFHHGDEAEDKGK

SEQ ID NO: 97543 - protein, 129 aa, Glycine max
  Coding DNA Sequence Number=SeqID_5858
LEGTPLEKAPVPPQSLIVTVSGVPSTSSTSRPSGDGRDISQALDTSSDSHGQWIPFDADALSQFLGDLLILEEDQLCEFSQRRSQADSFDEEAIAQLLCILGEAGADHAHQHDYFDPDIDDTAAQQCLA

SEQ ID NO: 97544 - protein, 188 aa, Glycine max
  Coding DNA Sequence Number=SeqID_5859
MAHGPASEHRFPPQEFHMLQSSVETRGFGRQREVVEAEEFSQQMEQCGHGMYYTPLTFSQYPSQMYQYPFEGHDTNMSASEHSFGGVVETHPHFSWPTMTPSQQHDAPMATPNAPLALQWNVPGAIPDMGDLLGVDLCHDFSAEVEQVEAGRHHGRRNLDRQARRWDRPCDTSSCHHDTIMNDFHVSV

SEQ ID NO: 97545 - protein, 106 aa, Glycine max
  Coding DNA Sequence Number=SeqID_5860
MREDPIKNSHFRHDPLTKEKAKDHGKEISHAPIRNTRIKDLMQDYWQGEGAKNKPNNQSNLAQDEGSDSEVVMLMETTSNESSNDTSWYLDFGCSTHMTRRKGMVH

SEQ ID NO: 97546 - protein, 152 aa, Glycine max
  Coding DNA Sequence Number=SeqID_5861
MRQFGYTQTIPAPPVGSWVSYDDIHDRWMHYSEHMVAAGEVCAMPGQCASDYMDWFFRILHPFMTPGQTSDPLPDRHGPQPPVVPPEPRAPSTSTMDEPRHAVEICSDIAERLERHLSLGVVTPGSSSHDVIQECIKMARSVTQDQLVYVRS

SEQ ID NO: 97547 - protein, 99 aa, Glycine max
  Coding DNA Sequence Number=SeqID_5862
MEDESSETTTPEPLVRRKKVDQTQEAAATSEKSLETTSEPLELVADTTSLQQTADPSTPEDQTTPILSLNTSLTATLVLHLTDEEDVQTQDTQDQPQEF

SEQ ID NO: 97548 - protein, 83 aa, Glycine max
  Coding DNA Sequence Number=SeqID_5863
MDAKVATESKRVGKKETNTDEDMFKSKGKDPLEGLGGPMTRARARKAKEALQQVLSTLFEYKPKFQAEKSKVVSCIMAQMEED

SEQ ID NO: 97549 - protein, 23 aa, Glycine max
  Coding DNA Sequence Number=SeqID_5864
MPLRHFTEHLVGACDAILSRKGI

SEQ ID NO: 97550 - protein, 132 aa, Glycine max
  Coding DNA Sequence Number=SeqID_5865
MKTLKTTVDGKTDQAAPQWIEVKSHVQSGGYEYGYYVMNWMCNIVSGGLKNDWAMRFGDGKPLDKETITTIQNKWAAYFVKVNKFEVQQLHSYKRGNIKENMNLEISRVGPCGLNNLKRDRLRMQKKQQQSI

SEQ ID NO: 97551 - protein, 231 aa, Glycine max
  Coding DNA Sequence Number=SeqID_5866
MIIEEGESLSAYSRFTQLRPNPQELEARLCIPGRGFKLNSDGLPLKILRKNLTTLAQTWSVLSFSNLAPTSHTSDITLDRAKLIYGIIQKMDMNLGYLISTINLAYVKKNCWNLDDPSITFRGPRKTRGKRSEAPSSYALPIYAPSTSTLASLTPALASAPTPSGPSTSLHKGQIIIMQSLQSSGLQPIMSMDEFISQVAWPGVQPSPLGGSEAFATQEPVPEEDEPIPPE

SEQ ID NO: 97552 - protein, 349 aa, Glycine max
  Coding DNA Sequence Number=SeqID_5867
  Gene Ontology: Mol. function=solute:hydrogen antiporter activity; Cellular component=integral to membrane; Biological process =regulation of pH
  Homolog annotation: Hit_ID=A7R309; Match level="QueryCoverage=45%, HitCoverage=83%, E-value=7e-23, Identity=39%"; Hit description =Chromosome undetermined scaffold_470, whole genome shotgun sequence
MDPPRKKKKGRYDVAELKTLGNQLLLTFVSPPHHVLESLLSHHSFFLPLLPKLPSSSASAAATTALSVVGDQSEFIYLSWLRSKFYEFLKSLFNVLASPQGDETLKELVLDTLMQFVKVANGGAFHPSQYHKLLHSIVYSTSPPTFLVDLLASKYLKHIDVRLNLCSKLLVFKEIDLPDKDYAKLLLKSLASIYQYSRELYEAPCLFIFYQGFVMVACVHFILDAYTCLYLEIERTKLKSMVDQFAELGVRNKKLNQFIAKSPQLLLRKPKDFLQVETVAQFGVIFLLFALGLELSTRKLRVVQAVAILGGLLQIFLSMSLCGITASGRDVVRGLTLAYAKRLFPDSNP

SEQ ID NO: 97553 - protein, 107 aa, Glycine max
  Coding DNA Sequence Number=SeqID_5868
  Subcellular localization annotation: CTP_CleavageSite=29; ConfidenceScore=5.21e-01
MSPPPLGPLNHSLTQLKLSGRLPLPALCKCTTHPSSRFFLTLSGWLAKPIGWLSEKMLLIPHDAAPCGACRPLIFFINGEKDDWRCHFKEKMSLEEAHHHRKPWIRA

SEQ ID NO: 97554 - protein, 70 aa, Glycine max
  Coding DNA Sequence Number=SeqID_5869
  Subcellular localization annotation: CTP_CleavageSite=28; ConfidenceScore=5.42e-01
MDSSGALSGMNPRSVNMHSSSFFQILPRAQPSNGALSGWLTKPADWLSEPMEISTSQTCLINLKLRGTDY

SEQ ID NO: 97555 - protein, 37 aa, Glycine max
  Coding DNA Sequence Number=SeqID_5870
PIPEEGLPEALLPELAFVTSGRPSSGSGHSGPSSFCA

SEQ ID NO: 97556 - protein, 49 aa, Glycine max
  Coding DNA Sequence Number=SeqID_5871
MVIFHHGDAAEDKGEELGDDASMEEKKEGEKERGGSTKLKEEKGREVEL

SEQ ID NO: 97557 - protein, 89 aa, Glycine max
  Coding DNA Sequence Number=SeqID_5872
MEKSEKKNFSEKKMKKAYITWDDNDMESSEDSENEEINLCLMAKSYESDEHVSSRKEWYIDSGCSKYMTGDASKFTHISPKKSRACNIW

SEQ ID NO: 97558 - protein, 63 aa, Glycine max
  Coding DNA Sequence Number=SeqID_5873
  Subcellular localization annotation: CTP_CleavageSite=55; ConfidenceScore=5.37e-01
MNALPSTVHVSSTNESGALRIHCLGLFANSPFSNVIRRLMNSLPSVVHVSSVIKRGASEKEEG

SEQ ID NO: 97559 - protein, 46 aa, Glycine max
  Coding DNA Sequence Number=SeqID_5874
FDLNNLIFVEPNDDAQSEEDLDDDGDGDESDDIHGDDPIRGLNMLL

SEQ ID NO: 97560 - protein, 34 aa, Glycine max
  Coding DNA Sequence Number=SeqID_5875
MVQPKKIYMNKKVKWWLDRNIEMAITEATGLQMR

SEQ ID NO: 97561 - protein, 51 aa, Glycine max
  Coding DNA Sequence Number=SeqID_5876
MLDVLEMAPRKLASKRSRKDKAAEGTSSAPEYDSHRFRSAEHQQRFEATKG

SEQ ID NO: 97562 - protein, 130 aa, Glycine max
  Coding DNA Sequence Number=SeqID_5877
MERSMIDAASGGALGDMTPTEARNLIEKMASNSQKFSARSDVIVIRGVHEVATNSSSSGETKKLEGKLDALVNVVTQLTMNKKSAPAARLYGLCSSANHHTDLCTSVQQSEAIEQPEAYAANIYNRPPQP

SEQ ID NO: 97563 - protein, 60 aa, Glycine max
  Coding DNA Sequence Number=SeqID_5878
YILCGTNRGYIYLDLTKNKRRYISCGSVLVEGTSTRFKENKGGLKEIPRTAGCLGIGGRH

SEQ ID NO: 97564 - protein, 28 aa, Glycine max
  Coding DNA Sequence Number=SeqID_5879
MASGNRLPRVCNRLQGLRNGNRLQGLEM

SEQ ID NO: 97565 - protein, 118 aa, Glycine max
  Coding DNA Sequence Number=SeqID_5880
  Subcellular localization annotation: CTP_CleavageSite=57; ConfidenceScore=5.31e-01
EELATQLAQASKVPSSRSNSLLEEGFGSPKTPSVSKRPIKGCISSNNNPRTKGIGMRVATYPSAGGHGVATYPSAGGQRETRGMRVPRKEYARSRHQRLFEENVGKTGKDAIYEFLSE

SEQ ID NO: 97566 - protein, 108 aa, Glycine max
  Coding DNA Sequence Number=SeqID_5881
NDPETGDSDRCGLYIEADLARMVDMGRVYEGSTIVHNTPLLPGQVKVVVSPAKPPPKPDPEVDDPLYLMTLTIPELLLRPYQVPLQWTLADGGHPAQGTPSCLVLFIG

SEQ ID NO: 97567 - protein, 191 aa, Glycine max
  Coding DNA Sequence Number=SeqID_5882
MLESFKQQQEMSVLELYIEKDVAGGSMFHSANSLTSCGNYVSNDYTQPPTNMSNLNLDEDDDHDDDDYLVSNSYVEESLDEDDSVDDISDTDNEVPEMIPPVRIVHPAEGVQGIQNPFWNDALHYNNINWSHPDEEDICGLEMPSTFNAGQELYVGMEFDSKDAVKNAVKQYVMRVHQSFKVVESKWDKYV

SEQ ID NO: 97568 - protein, 262 aa, Glycine max
  Coding DNA Sequence Number=SeqID_5883
  Pfam annotation: Domain name=Transposase_23; Domain location=122-187; Score=-9.3; E_value=0.012; Accession=PF03017.5; Description=TNP1ENSPM transposase
IRLRSRTTQGSFVPHGQHPGRIRAAGAGVTIKQYFGSAPRTSHSASSLPPDELQQLTQQIRDKLEESITEKVTRQVMASFSQLQSQMQSQAPPEPLVGPGPSSPRVSTKGSCVDPSGNDPETGDSDRCGLYIEADPARLVVVGRVYEGSTLVHNTPLLPGQVKVSVDEVKDADAPVPVPTAEVAVSLPKPPSKPDPEVDDPLYLMILTIPELFLRPYQVRWDATVFGVVIPDFPLYIKHEDLSEIAHGGQCLSISVLQLWIL

SEQ ID NO: 97569 - protein, 58 aa, Glycine max
  Coding DNA Sequence Number=SeqID_5884
MGPKSTLRLMRTLGHSQRDRRLAVDGSLSAALITLAQLSGPNQPERQGLSAKRQRLSA

SEQ ID NO: 97570 - protein, 70 aa, Glycine max
  Coding DNA Sequence Number=SeqID_5885
NIQEIMSNIIRIEKFNGKNNFNLWRIKMRALLKEQHVWAPVASASVKKEVASESKEKAVVSKTEELAEQE

SEQ ID NO: 97571 - protein, 83 aa, Glycine max
  Coding DNA Sequence Number=SeqID_5886
  Subcellular localization annotation: CTP_CleavageSite=66; ConfidenceScore=5.88e-01
MKDCRITSSGDVSSTSRTSQSLTNSSQALRMTSSSSFGLCRSSHNKFSQTLWNLDLSLSRTLQICRSFKKRPNSPPKSDFRLK

SEQ ID NO: 97572 - protein, 77 aa, Glycine max
  Coding DNA Sequence Number=SeqID_5887
MASSSSSSSSIHIKSGPIEGDVLWLQPKHVSEHVWNGEADIKLHIRRAVPINQGQEEIPEEIIPLLRQSGFYWIMKM

SEQ ID NO: 97573 - protein, 73 aa, Glycine max
  Coding DNA Sequence Number=SeqID_5888
MLSETKTSRTLQTSSQRSQRSDRGQVSVQPETKFREDPTINEGWEVFLLRQLHVASLRSFIKRLPREASSWLL

SEQ ID NO: 97574 - protein, 74 aa, Glycine max
  Coding DNA Sequence Number=SeqID_5889
  Homolog annotation: Hit_ID=A5B939; Match level="QueryCoverage=79%, HitCoverage=37%, E-value=1e-15, Identity=69%"; Hit description =Putative uncharacterized protein
MRDEPEAGYGAQLRVLDPTSLPTLETAQPEVGSSGWKSTARRVVSGAPPAAIENPEDRVPPTPGRTHNRIRSPR

SEQ ID NO: 97575 - protein, 65 aa, Glycine max
  Coding DNA Sequence Number=SeqID_5890
  Homolog annotation: Hit_ID=A7NZC1; Match level="QueryCoverage=47%, HitCoverage=3%, E-value=3e-08, Identity=80%"; Hit description =Chromosome chr6 scaffold_3, whole genome shotgun sequence
MVTDEGEKTCPLCVEEMNLTDQQLKLCICGYERVFCSVLEGLKKCQCLEQHLVSFNTLPNDTCSV

SEQ ID NO: 97576 - protein, 463 aa, Glycine max
  Coding DNA Sequence Number=SeqID_5891
  Gene Ontology: Mol. function=microtubule motor activity; Cellular component=microtubule associated complex; Biological process =microtubule-based movement
  Homolog annotation: Hit_ID=A7P9D5; Match level="QueryCoverage=98%, HitCoverage=22%, E-value=4e-62, Identity=38%"; Hit description =Chromosome chr3 scaffold_8, whole genome shotgun sequence
MELMGKQEHEIMTLKNQLASKEFRDNLLSNNPEFENKSPLQVKLRRMHDCLEKAKQLNMSYQSDHAFQISNEEERDEIRRQAEAETVEVIVCMQEELAQLQHQKKMLTTIDDNRSLKEELGQKDIELTSLAEEWELLTSEIEEVLLDGCEAIVDASEELGNIRNSFPQKRIRIFEQVGMIVRKISENELLIDELRRCLEDARNKRSDMECMLKSLRSAALVITKSCKKDCAENEKEILLLTSQLSEKTSTLVKSGNDTKDLKSRKVGKNVLERDATIRLLRKEIECALESLKEVQYEMARLHEEKKEMSVSEKKSRQSIECLTNHILFLQEAMYHFEEKSKVKIDVLSHKLRGLEKPLKEANSHWYQRKESLELEVGEAKIIQAQKAQEASFILAKFEEAQDTMRETDIMINGLVIANESMKIDIERLKDREMTLLNEKGTLVSNIESLQTTETVNEKESSGH

SEQ ID NO: 97577 - protein, 185 aa, Glycine max
  Coding DNA Sequence Number=SeqID_5892
  Gene Ontology: Mol. function=oxidoreductase activity
  Homolog annotation: Hit_ID=A7P7I9; Match level="QueryCoverage=78%, HitCoverage=51%, E-value=2e-52, Identity=62%"; Hit description =Chromosome chr9 scaffold_7, whole genome shotgun sequence
MLALLIFCSKDEEAFKECLVEIINKDEEAFKEAIFAALQELFDLPLQTKILNVSKKPYHGYVGQYPMVPLFESMGIDDANVYENVESMTNIMWPHGNPSFRHMILESLGVEKYLDEHMNSTNYLLEVMKYKGPQTSDTKVGLTTHSDKNIVTILYQNEVEGLEFGMGPVIKQFLNSLSNRNMIEA

SEQ ID NO: 97578 - protein, 53 aa, Glycine max
  Coding DNA Sequence Number=SeqID_5893
  Homolog annotation: Hit_ID=A5B7I7; Match level="QueryCoverage=64%, HitCoverage=3%, E-value=2e-09, Identity=85%"; Hit description =Putative uncharacterized protein
MKDLGDASFVLGIKIHRDRSQGIIGLSQRSYIEKCQANSYYFIHYGGIICGML

SEQ ID NO: 97579 - protein, 146 aa, Glycine max
  Coding DNA Sequence Number=SeqID_5894
MAFRLTEQQKVYTDNHSGIYARQRDSKVSMTDLVSAEDDVNLRVSTGLSAAIDEGSQKTTFVSACYQAFRLTDSKKFIRITTRGAEDDRESKVSMTDLVSAEDDVNLHVSTGLSAAIEEGFSSYRMQKVYTDNHSGISGRQRDSKV

SEQ ID NO: 97580 - protein, 169 aa, Glycine max
  Coding DNA Sequence Number=SeqID_5895
MHKALRLNAPLPYPHLVTLWVQHFNIPLDSEPYVSIKRSFLIGTSVIASFSYQKEHDGSWVKKGTRHVGEEGHDGEDSSLLSKILDRFDGLQTFVEVVIIKKGEIVEAKLHDESRMITKDDDKGDDKKLKGQLKNEFKIFKIESRTLQDSRGKLISRIKRSRFQESRFK

SEQ ID NO: 97581 - protein, 300 aa, Glycine max
  Coding DNA Sequence Number=SeqID_5896
  Gene Ontology: Cellular component=integral to membrane; Biological process=transport
  Homolog annotation: Hit_ID=A6TFU4; Match level="QueryCoverage=100%, HitCoverage=100%, E-value=1e-111, Identity=71%"; Hit description =Putative membrane protein, transport
  Pfam annotation: Domain name=DUF6; Domain location=16-145; Score =67.2; E_value=5.6e-17; Accession=PF00892.11; Description=Integral membrane protein DUF6
  Pfam annotation: Domain name=DUF6; Domain location=167-291; Score =88.0; E_value=3e-23; Accession=PF00892.11; Description=Integral membrane protein DUF6
  Pfam annotation: Domain name=TPT; Domain location=7-145; Score=-34.9; E_value=0.064; Accession=PF03151.7; Description=Triose-phosphate Transporter family
  Pfam annotation: Domain name=UAA; Domain location=10-297; Score= -166.3; E_value=0.043; Accession=PF08449.2; Description=UAA transporter family
  Pfam module annotation: Pfam domain module=DUF6::DUF6::TPT::UAA; Domain location=16-145::167-291::7-145::10-297
MGSSKRGMLNVLIAAVLWGSSGVCAQYIMQQSQMSSPYLTMIRLLFAGLILLMLAFVHGDKIFRVMQNRKDALSLLFFSLVGALTVQYTFLMTIEKSNAATATVLQFLSPTIIVAWFALARKARPSPFVLLAIGTSLAGTFLLVTHGNPTSLSISPAALFWGIASAFAAAFYTTYPSTLIARYGTLPIVGWSMLIGGAMLLPFYGSQSANFVVNGRLLLAFFYLVVIGTSLTFSLYLNGAQKIGGAKAGILSCAEPLSSALLSLLLLGITFTLPDWLGTLLILSSVILIAVDSRRRVRAA

SEQ ID NO: 97582 - protein, 325 aa, Glycine max
  Coding DNA Sequence Number=SeqID_5897
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-35, Identity=28%"; Hit description= UPI00006A17C9 related cluster
  Subcellular localization annotation: CTP_CleavageSite=36; ConfidenceScore=5.46e-01
ATTCSTLKARTCSPLKARTCSPLKARACNPLKARTCSPQKSSEGDGVLPSERRVRACRPLKARACIPLKARTFSPLKARSCYPLKARTCKRTCSPLKARVCSPPKARTCSPLKARACSPLKATTCTPQMTRVCSPLKLRACTPLKARACSPLKARTCKRTCSPLKATACSTLKARTCSPLKVRTSSPLKARAFSPLKARTSSPLMASRCKISCSPLKARACSPLNVRTCSPLKLRTCSPLKVRTSSPLKARACSALKVRMCSPLKARACSPVKARAYSPLKARAYCPQKASMSSPMKARESNPMKARGVQPSEGEDVQSSDGEHV

SEQ ID NO: 97583 - protein, 109 aa, Glycine max
  Coding DNA Sequence Number=SeqID_5898
ERRKRDGSRHRLITKRAKTDEIVFYLFFPLISDKRYLAPFIAQYVKFRDMPEIKRKHCYTIREIPMFLQKAVASGESNLARLGELGGKLLPYFPINKERSEGERGSTLL

SEQ ID NO: 97584 - protein, 88 aa, Glycine max
  Coding DNA Sequence Number=SeqID_5899
MSSTPPTAPVDEEVGDHIEDMLRDLGQEGFRKAHSPYYESLDTDSTTPLYMGCTNCPTCGASRYKVKFDVLMQAHTKIVHQKCVGICQ

SEQ ID NO: 97585 - protein, 45 aa, Glycine max
  Coding DNA Sequence Number=SeqID_5900
MDKSLKVGEDEWRERERKGTKFCASKEPTNPRSSTRFSTKCAKVS

SEQ ID NO: 97586 - protein, 137 aa, Glycine max
  Coding DNA Sequence Number=SeqID_5901
MTSRDKIWSFCTLVSSKGGGPDDTRRYLTVHPFVIQRRRIGHHILWDLLDDMQRPKFGHSAPLCHPEAMNTRRYLTVMPPATCHPEERKYPSGYPPTWALQNIPPEGCCFWREQPGSPGRAELAWASWAATTSPILL

SEQ ID NO: 97587 - protein, 301 aa, Glycine max
  Coding DNA Sequence Number=SeqID_5902
EEEPAQSGSVDGVIDPPSPVRRHVKWKMVRTKKTEEMTTEATKEIAEKIDSFEEQATQGSFVPHGHQDVLTVAIGRPEHPGRVHAAGAGVTIKQYFGSAPRMSRSSSSLPPEELQQLTQQIRDQLEESITERVTRQVMASFSQIQSQMQSQGLAPSGNDPEIGDSDRCGLYIEADPARLVAMGRVYEGSTVVHNTPLCLPSKGNSHLPFLADTSDQVFITAACLKLGHLTFFHEQPIVSPAKPPQKPDPKVDDPLYLMTFTIPELFLRPYQVTWDATVFGVFNPYFPLYIKHEDLFEIAHG

SEQ ID NO: 97588 - protein, 64 aa, Glycine max
  Coding DNA Sequence Number=SeqID_5903
MKVKSWKWKLEVGNESYWKLEVGNESYWKLKVENAGWKLEGEVVVIIKKGENVNHEDFDDVKKN

SEQ ID NO: 97589 - protein, 84 aa, Glycine max
  Coding DNA Sequence Number=SeqID_5904
MQLSFKGGSAVSATGESGGATASSDDASEMTIREGDGGTTSSSGEEGGCTIGYCGLAGSELTCIGVGSSGAASLGLTNGSWASG

SEQ ID NO: 97590 - protein, 84 aa, Glycine max
  Coding DNA Sequence Number=SeqID_5905
MSWNFTYCATKGAKYLEAVKQRLHAIKQWSPDEIRAINSWGSRLDGGGCMNDNQFMGLRIRFEGGGCMNDNQFMGLRIRFEGGG

SEQ ID NO: 97591 - protein, 52 aa, Glycine max
  Coding DNA Sequence Number=SeqID_5906
MLQPCGIGTGLKEHSNWVTPKTYTLKSSLGPLPPDSDTAHELYNTHDLTLVF

SEQ ID NO: 97592 - protein, 28 aa, Glycine max
  Coding DNA Sequence Number=SeqID_5907
MGYLLVGVSRSTKNESKMQPKGLLAQVS

SEQ ID NO: 97593 - protein, 125 aa, Glycine max
  Coding DNA Sequence Number=SeqID_5908
RQAQGDAPQAADAPPPHQAGPAGSFDTEHYLRHLVRQQTANHRAHIQTHDCLYQLSLSLQSQGFTFFPCPTPDQFRAEVAWPGDWPEAQAGEAPVEAQAEAPDEKILDRSSTFIVRSSFSSVFNG

SEQ ID NO: 97594 - protein, 95 aa, Glycine max
  Coding DNA Sequence Number=SeqID_5909
MNSRIKIQGSSFKNQDQDSRIKLQESRSRFKIQNSRIKRRLNQDKGYIYLGLTENKRGYISCGSVLVEGTSTRFKENKGGYIPCGSLLVKGFLQG

SEQ ID NO: 97595 - protein, 95 aa, Glycine max
  Coding DNA Sequence Number=SeqID_5910
MTAIGVRALTRDEENGWKWNQGEEEKYVVKEMYLQPHAGNISNEEESSCQLWKLKVPSNIKEESGKPKQYLMRQDIGLGVGAEQRNYGTYEDKGG

SEQ ID NO: 97596 - protein, 2126 aa, Glycine max
  Coding DNA Sequence Number=SeqID_5911
  Gene Ontology: Mol. function=protein binding; Cellular component =cytoplasm; Biological process=defense response
  Homolog annotation: Hit_ID=A5BH36; Match level="QueryCoverage=81%, HitCoverage=94%, E-value=0.0, Identity=28%"; Hit description =Putative uncharacterized protein
  Pfam annotation: Domain name=AAA; Domain location=181-393; Score= -29.6; E_value=0.0079; Accession=PF00004.20; Description=ATPase family associated with various cellular activities (AAA)
  Pfam annotation: Domain name=LRR_1; Domain location=1036-1064; Score =3.7; E_value=64; Accession=PF00560.24; Description=Leucine Rich Repeat
  Pfam annotation: Domain name=LRR_1; Domain location=1150-1177; Score =2.4; E_value=1.1e+02; Accession=PF00560.24; Description=Leucine Rich Repeat
  Pfam annotation: Domain name=LRR_1; Domain location=1373-1396; Score =6.5; E_value=19; Accession=PF00560.24; Description=Leucine Rich Repeat
  Pfam annotation: Domain name=LRR_1; Domain location=1397-1421; Score =2.6; E_value=1e+02; Accession=PF00560.24; Description=Leucine Rich Repeat
  Pfam annotation: Domain name=LRR_1; Domain location=1575-1600; Score =3.9; E_value=57; Accession=PF00560.24; Description=Leucine Rich Repeat
  Pfam annotation: Domain name=LRR_1; Domain location=1602-1623; Score =1.6; E_value=1.5e+02; Accession=PF00560.24; Description=Leucine Rich Repeat
  Pfam annotation: Domain name=LRR_1; Domain location=1813-1834; Score =3.1; E_value=84; Accession=PF00560.24; Description=Leucine Rich Repeat
  Pfam annotation: Domain name=LRR_1; Domain location=575-596; Score =7.4; E_value=13; Accession=PF00560.24; Description=Leucine Rich Repeat
  Pfam annotation: Domain name=LRR_1; Domain location=598-619; Score =0.7; E_value=2.3e+02; Accession=PF00560.24; Description=Leucine Rich Repeat
  Pfam annotation: Domain name=LRR_1; Domain location=621-642; Score =12.7; E_value=1.3; Accession=PF00560.24; Description=Leucine Rich Repeat
  Pfam annotation: Domain name=LRR_1; Domain location=644-667; Score =14.2; E_value=0.48; Accession=PF00560.24; Description=Leucine Rich Repeat
  Pfam annotation: Domain name=LRR_1; Domain location=806-827; Score =3.1; E_value=80; Accession=PF00560.24; Description=Leucine Rich Repeat
  Pfam annotation: Domain name=LRR_1; Domain location=872-893; Score =0.1; E_value=2.9e+02; Accession=PF00560.24; Description=Leucine Rich Repeat
  Pfam annotation: Domain name=LRR_1; Domain location=898-919; Score =4.6; E_value=43; Accession=PF00560.24; Description=Leucine Rich Repeat
  Pfam annotation: Domain name=LRR_1; Domain location=922-942; Score =0.2; E_value=2.7e+02; Accession=PF00560.24; Description=Leucine Rich Repeat
  Pfam annotation: Domain name=LRR_1; Domain location=981-1009; Score =1.2; E_value=1.9e+02; Accession=PF00560.24; Description=Leucine Rich Repeat
  Pfam annotation: Domain name=NACHT; Domain location=180-359; Score= -23.8; E_value=0.0043; Accession=PF05729.3; Description=NACHT domain
  Pfam annotation: Domain name=NB-ARC; Domain location=142-461; Score =68.4; E_value=2.4e-17; Accession=PF00931.13; Description=NB-ARC domain
  Pfam module annotation: Pfam domain module=AAA::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::NACHT::NB-ARC; Domain location=181 -393::1036-1064::...
  Pfam module annotation: Domain location=1150-1177::1373-1396::1397 -1421::1575-1600::1602-1623::1813-1834::575-596::598-619::621 -642::644-667::806-827::872-893::898-919::922-942::981-1009::180 -359::142-461
DRMESVLSPIVERTFNFAVDPIIRQLAYILRCRQNVDELLTSFESLELEKESIDRRCDQAQNNLQNIEAKVKEWSRKVDEFKTELEKFRNDEGHTKTGLSNVLFLFPYFWNRHRLGRQAKKMAEIVKNLIDESAKFNDVSYTDNLTFNDFTLSNPGYMGFASRHSTVEKIIAKLEDSSVRMIGLHGSGGMGKTTLIKAIAKKAMEKKLFNVVAVSEITANPNPQKIQEDIAYRLGLRLEGEGENARAHRLMTRLKQEKENTLIILDDLWDRLDLNKLGIPLDGDVDDNDLNTKTSNAKQGPKEVTKEKSLGDYKGCKILLTSRDKNVLTDKMEVKSTFCVEELDDDDALRLFRKEARIQGEMSKWKQEIVKKYCAGLPMAIVTVGRALRDKSDSEWEKLKNQDLVGIQNSMEISVKMSYDRLENEELKSIFFLCAQMGHQSLIMDLVKYCFGLGILEGVYSLGEARGRISTSIQKLKNSGLVLDGSSSIHFNMHDLVRDAALSIAQNEQNVFTLRNGKLNDWPELKRCTSVSICNSDIIDELPNVMNCPQLKFFQIDNDDPSLKIPESFFKRMKKLRVLILTGFHLSSLPSSIKCLSDLRLLCLERCTLDHNLSIIGKLKKLRILSFSGSQIENLPAELKDLDKLQLLDISNCSVVKRIPPNLISRLTSLEELYVRKCFKEVSEEGERNQSQISFISELKHLHQLQVVDLSIPCAQVFPKELFFDNLSDYKIEIGNFKTLSAGDFRMPNKYEKFKSLALELKDDTDNIHSQKGIKLLFKRVENLLLGELNGVQDVINELNLDGFPHLKHLSIINNPSIKYIINSKDLFYPQDVFPKLESLCLYELRKIEMIYFSSGTEMICFSPFTDCSFTKLKTIKVEKCDQLKNLFSFCMVKLLASLETIGVSNCGSLEEIIKIPDNSDKIEFLKLLSLSLESLSSFTSFYTTVEGSSTNRDQIQITVIENEHSEMAPPLFGELVEIPNLENLNLISMNKIQKIWSDQPPLRKLKGLFVSKCKMMEKIFSTEGNSAGKVCVFPKLEEIHLDYMDKLTDIWQAEVSADSFSSLTSVYIKSCDKLDKIFPSHMEGWFASLNSLKVYSCESVKVIFEIKDSQQADASGGIDTNLQVFDVRGLLKLEQVWSRDPGGILNFRKLQSIEMYDCKSLRNVFPASVAKDVPKLEYMSVRWCDGIVEIVACEDGSETNTEQLVFPELTDMCLYDLSSIQHFYRGRHPIECPKLKKLEVRECNKKLKTFGTGERSNEEDEAVMSAEKIFPNLEFLDIDFDEAQKWLLSNTVKHRMHRLKELRLSQVNDGERLCQILYRMPNLEKLQLWEAEHLLKESSESRLGTVLQLKELVLWESEIMDIGFEREPVLQRLEVLSLYECHRLRNLAPPSVSLAYLTNLEVRDCVRLRNLMASSTAKSLVQLKSMKISRCDELEEIVSDEGNEEEEQIVFGKLITIVLEGLEKLKSFCSYKKCEFKFPSLEVLIVRECPMMERFTEGGARAAKLQNIVTAYEEGKEEAKWQWEGDLNATIQNVWEDQLLESASTVSSLSLLGDSPLQVIWLDSRRIPKSCFSNLNSLAVEGCQFLTDVVIPFYLLPFLTNLEELQVRKCGSVKSIFDVKTTTGLGAAAFPRPLPFSLKKLTLERLPKLENVWNEDPHGILTMQLLQHVIVEKCKCLTSVFPASVAKDLEILVVKDCEELMEIVAEDNADPREDNLELTFPCPCVRSLKLQGLPKFKYFYYCSLQCDMFQTPNEDEMPTSNLKCLSLGEKGLEMIKRGEFQRNFIHKLQVLTLCFHNGSDVFPYEILQLAPNIEKLVVYNASFKEINVDYTGLLLQLKDLCLESLPELVSIGLGTIYSVFLQSDIFGSRKMPLPAIFVHILHSKKFGSTQKNGDKMLNCLKLERIGKLRRFYRGSLLSFPSLEELSVIKCEWMETLCPGTLKADKLVQVQLEESSDAIKLENDLNSTMREAFRKKGNHLNELKVLALFFHIESDVFVQRVPNIEKLEVLGGFFREIFCFDSLNVDEAGLLSQLKVICSDSLPELVSIGSENSGIVPFLRNLETLQLQESAIFVHILNSKKFGSTQNNGDKLVIKKAEKVLQREFKFPVLGGIHSMALREDGKFVC

SEQ ID NO: 97597 - protein, 160 aa, Glycine max
  Coding DNA Sequence Number=SeqID_5912
MWAFHKVRQIDWAHLVRYRMHKALRLNPPLPYPHLVTLFLQHFNIPLDSEPYVPIKRSFLIGAAVIASFGYQKEHDGSWVKKGARPIDEEGHGGEDSSLLQKILDRFDGLQTFVGERFDTLELQVDMGFNEMESRITKVEEDVSYIHTSFDLPPPPPPSS

SEQ ID NO: 97598 - protein, 96 aa, Glycine max
  Coding DNA Sequence Number=SeqID_5913
MDKDQLMYEEVDINVENEEDADVKIEHVDCFDAFNTSQLFASRDEVLQWAQSLAHDIGFVVVIMRSNTNTGVLGRALFLLIACDRSGKYRPKTHNL

SEQ ID NO: 97599 - protein, 48 aa, Glycine max
  Coding DNA Sequence Number=SeqID_5914
MADSGQQMRRRHLQSPLTHLQRLERCLRPVADQQATKFKAKGKMNPEP

SEQ ID NO: 97600 - protein, 61 aa, Glycine max
  Coding DNA Sequence Number=SeqID_5915
MEEDHKKTLKFLDVTNATNLATSKQIVLQMKNGLRKVIRKEKEINLLTKDYESDEKISQEG

SEQ ID NO: 97601 - protein, 89 aa, Glycine max
  Coding DNA Sequence Number=SeqID_5916
MSYRMSRHHASEHADYMCPYEQIKQPLSTTFSPNHYPCNLYLRATLRYENPAHSLSTTLPCLQINQRHTRDFSLNKRDQPYTLEINSTH

SEQ ID NO: 97602 - protein, 176 aa, Glycine max
  Coding DNA Sequence Number=SeqID_5917
  Gene Ontology: Mol. function=RNA-directed DNA polymerase activity; Biological process=regulation of transcription, DNA-dependent
  Homolog annotation: Hit_ID=A7QL19; Match level="QueryCoverage=99%, HitCoverage=35%, E-value=3e-40, Identity=42%"; Hit description =Chromosome undetermined scaffold_116, whole genome shotgun sequence
MVATTYQTSHECPEETIIDILVEGFSRQLKVKTNLNGKVITNDDNKKIPDAVNTLIFTIAQHFIGDRSLWKDRSAELLSNLKCRTLADFRWYRDTFLTRVYTREDSQQPFWKEKFLAGLPRSLGDKVRDKIRSQSANGDIPYESLSYGQLISYVQKVALKICQDDKIQRQLAKEKA

SEQ ID NO: 97603 - protein, 88 aa, Glycine max
  Coding DNA Sequence Number=SeqID_5918
  Subcellular localization annotation: CTP_CleavageSite=79; ConfidenceScore=5.37e-01
MDKAVSIICPLDLMMKYVQFQLSLAHHWAKRASTTKRSFSVLRATEESGRASISRPRAKREISALSVAAVFSQAERMTSAKLKSTYSY

SEQ ID NO: 97604 - protein, 98 aa, Glycine max
  Coding DNA Sequence Number=SeqID_5919
  Subcellular localization annotation: CTP_CleavageSite=64; ConfidenceScore=5.58e-01
MFAHSIKRLPSLGTDVWGTNTFPMRKYNSRTFHLKVRRSRLFRFFRRFPQINVGGDSARIPFVEHASRESRVALPSKGRLRHNEKEKLSAERQVIELE

SEQ ID NO: 97605 - protein, 60 aa, Glycine max
  Coding DNA Sequence Number=SeqID_5920
IYGVPVAPSKAIRPPTNRAFIKKYCAPRQVQGETPQQPGDGRQRATDTPPPPLEFTSAHP

SEQ ID NO: 97606 - protein, 82 aa, Glycine max
  Coding DNA Sequence Number=SeqID_5921
MPFELAQRFKIQFRASRYITGLNHTSEKKLLSFELAHRTQSDHPSKKLSSLELVRASTVNFERLDILRDSIRHPSKKILSFE

SEQ ID NO: 97607 - protein, 254 aa, Glycine max
  Coding DNA Sequence Number=SeqID_5922
MTTVTQMWMTMLLSNVLPSDHNSDLPLSQCRLVYAILTWMSVHVAQLIVDTIYLFAGMPPTRHPLDPDKSNRALGFLALIMGLCQSFGVPVTPSKVIRPPITRAFIEKYCTPRQAQGDAPQATDAPPPPHQADPAGSLGMERYLQHLVRHQAANHRGQVQIHECLYQLSLSQQGQGFIPFACPTPDQFRAEVAWPGDWLEAQAGEAPAEALDDVEEVRMDEEMTDFSVSWKGAEPHDHGIPRFIAYFVIVDNVC

SEQ ID NO: 97608 - protein, 104 aa, Glycine max
  Coding DNA Sequence Number=SeqID_5923
MKGNENEDAKAAGVSNLVVVVNVVNGNVVEALMRLLVPPMRVQFGDGDFEPEHGDIVVIVMYVVSSFQQSRVKTKQTVTSWRNECDSSSTTTAIKTWSGVATFS

SEQ ID NO: 97609 - protein, 75 aa, Glycine max
  Coding DNA Sequence Number=SeqID_5924
MDPKYKDQNKKTTYSTIYKEEWTKPWPMGSKIYPKVHENRKAFFINSSPILLEPLAHGSGNWSFPREDCIIGDHG

SEQ ID NO: 97610 - protein, 228 aa, Glycine max
  Coding DNA Sequence Number=SeqID_5925
MAPRKLASKRSRKDKAAEGTSSAPEYDSHRFRSAEHQQRFEAIKGWSFLQERRVQLRDDEYTDFQEDIVRRRWASLVTPMAKFDLDIVLEFYANAWPTEEGVRDMRSWVRGQWIPFDADAISQFLGYPLMLEEGQECEYGQRRNWSDGFDEEAIAHLLCIPGQDFARTAVGRRVRIMRTNMTTLTQIWMTLLLSNIQPSDHNSDLPLPKCQLVYAILTRMSIHVGGIL

SEQ ID NO: 97611 - protein, 177 aa, Glycine max
  Coding DNA Sequence Number=SeqID_5926
  Homolog annotation: Hit_ID=Q2HW90; Match level="QueryCoverage=37%, HitCoverage=13%, E-value=2e-07, Identity=41%"; Hit description =Putative uncharacterized protein
MGWSEYREIFGVLFPNVDGLVDLEAIDVFLAYHNHKESPVVAMLADLYDTFDRRCEESNARIVCCTPALYVWILSSCEGCPMRGVPSDESITPFIARGFSDHNARDRELRGSSNGIIGGYHKWLRVRTQGLDWLPNLKTVRDNEVKASEESDDVQALKAKLERARVVEEKFKSIAIK

SEQ ID NO: 97612 - protein, 77 aa, Glycine max
  Coding DNA Sequence Number=SeqID_5927
KAVASGGSNPARLGELGGNHLPYFAINRGGSEEGRGSAPEALLSLSNLLGKIVSECRKGFNRSTFFIRSSSFFDLQR

SEQ ID NO: 97613 - protein, 86 aa, Glycine max
  Coding DNA Sequence Number=SeqID_5928
MKHKLKNKGGEWKFMSFDDNKDDDKKLKSQDHFMITKMMTFKNEFKIESRTLQGKRFKIQRFKNNQDQDSRLKDSRIKRRLNHDKY

SEQ ID NO: 97614 - protein, 114 aa, Glycine max
  Coding DNA Sequence Number=SeqID_5929
MRGYRMVTHNIRQPGGNEPVDMQRLTSSSAPFAIQGQRVRWLVEIPYGHPHLSSTEGNEFDDIRMMLVLLSSSGNIQARRHARFFSAGQGQSSAMAKGSVVVVQLFRFQDTEVC

SEQ ID NO: 97615 - protein, 163 aa, Glycine max
  Coding DNA Sequence Number=SeqID_5930
MAPTRHPLDPDKSNRALGFPALITGLCQLFGVPVAPTKVIRPPITRAFIEKYCTQRQAQGQAGAFDMEQYLRHLVRQQAANHRAHVRTHDCLYQMSLSMQSQGFASFSCPTPDQFRAEVAWPGDWPEAQAGEAPPGAPGDGEEAHEDEEMADLLDFLGGSGDT

SEQ ID NO: 97616 - protein, 194 aa, Glycine max
  Coding DNA Sequence Number=SeqID_5931
MEYTGAATTANHLTKAFPSSEWMNCVPVSGICRQHIGDTRRAVSRLGHRQDRRLHLQHVAQAGIEGNAAHQHAFAAPAAAGAVMGAAQARAGNAHAARGRRSVRDSRWPVPLHPGTARNAPPAAARRHGCVPMRPGWRANRGPRSSPRHRNAAGYDGSSADPASHRGSARPGRCAPRPARHAAQPHRHRTDPRP

SEQ ID NO: 97617 - protein, 279 aa, Glycine max
  Coding DNA Sequence Number=SeqID_5932
  Gene Ontology: Mol. function=oxidoreductase activity, acting on the CH-CH group of donors; Cellular component=mitochondrial matrix; Biological process=electron transport
  Homolog annotation: Hit_ID=A1FSE4; Match level="QueryCoverage=100%, HitCoverage=73%, E-value=1e-136, Identity=88%"; Hit description =Butyryl-CoA dehydrogenase
  Pfam annotation: Domain name=Acyl-CoA_dh_M; Domain location=112-164; Score=85.5; E_value=1.7e-22; Accession=PF02770.10; Description=Acyl -CoA dehydrogenase, middle domain
  Pfam annotation: Domain name=Acyl-CoA_dh_N; Domain location=1-108; Score=115.9; E_value=1.2e-31; Accession=PF02771.7; Description=Acyl -CoA dehydrogenase, N-terminal domain
  Pfam module annotation: Pfam domain module=Acyl-CoA_dh_M::Acyl-CoA_dh_ N; Domain location=112-164::1-108
MLQDVARRIAQEKIAPSAEHHDRTGEFPLDNIRLLGENGLMGIEVPTEYGGAGMDPVAYVLAMVEVAAADAAHSTIMSVNNSLFCNGILTHGTEAQKQTYVRAIAEGEAIGAFALTEPQSGSDATAMRCRAVKQADGTFIINGKKSWITSGPVAKYIVLFAMSEPDKGARGITAFLIDTDKAGFGRGKTEPKLGIRASATCEIEFNDYVAQAEDVLGQEGEGFKIAMSVLDAGRIGIASQAIGIARAAYEATLEYVKERKAFGAAIGTFQMTQAKIADM

SEQ ID NO: 97618 - protein, 17 aa, Glycine max
  Coding DNA Sequence Number=SeqID_5933
EKLGANFKSFISKKVTL

SEQ ID NO: 97619 - protein, 81 aa, Glycine max
  Coding DNA Sequence Number=SeqID_5934
PVAPSKIIRPPTNRAFIKKYCGPRQVQGKTPQQPGDGRQRATNALPSPLEFTAAHPQKVRDRQAIKHPAQDVKEALLGGNL

SEQ ID NO: 97620 - protein, 27 aa, Glycine max
  Coding DNA Sequence Number=SeqID_5935
MAIKDQCDSLQIQKKEIWTLPEGLPKE

SEQ ID NO: 97621 - protein, 37 aa, Glycine max
  Coding DNA Sequence Number=SeqID_5936
MTTGDPPKQKTSQANEKKKEDENITQGDPPQEKRREV

SEQ ID NO: 97622 - protein, 123 aa, Glycine max
  Coding DNA Sequence Number=SeqID_5937
MGAKYLEAVKQRVHAIKQWSPDEIREPIGKITKKPYFPLTGGFLLDNGGCMNDNQFMGLRIRWWRMHEQRKEINSWGSGLDGGGCTNNARQSIRGAPDSMEHHILEKQYAYAKILFLVTKNEG

SEQ ID NO: 97623 - protein, 132 aa, Glycine max
  Coding DNA Sequence Number=SeqID_5938
MTRGNPSDLQPFDPEIDRTFHRLVRHHFIPFDHSEHSITGESVHSVIGDFEHPDLEHYNFEHSDSEHSDSKHSDFAHSENMTQPPPRERTLREMAAPDFTYESLCIQYPDEDVPYVLKTGLIHLLPKFHGLA

SEQ ID NO: 97624 - protein, 184 aa, Glycine max
  Coding DNA Sequence Number=SeqID_5939
  Homolog annotation: Hit_ID=A5AZG1; Match level="QueryCoverage=46%, HitCoverage=27%, E-value=2e-09, Identity=38%"; Hit description =Putative uncharacterized protein
  Pfam annotation: Domain name=zf-CCHC; Domain location=86-103; Score =11.4; E_value=0.029; Accession=PF00098.14; Description=Zinc knuckle
PQEANINLPYFHGKDNVEAYLDGEIRVEQQLKRKSTSKFYGSHSYPNKEQSLGILGAAPCKPKDDKWKTIEKQPPKASMQEKTSYIKCFKCLGKGHITSQYPTKKTMIMRGQDIYSSQDEATTSPSSSETSKARLTGALSKGGKMRGVATNEGISISHVDKSGALAPTYPPSKRKSDLRSSFLR

SEQ ID NO: 97625 - protein, 82 aa, Glycine max
  Coding DNA Sequence Number=SeqID_5940
MVIDYQIVMAAQLIHDRVEMECLEGAWETLEGNRRCRFWGTIRFTATSLVHPDEPARTLQRTVEWTAFFGFVFQHCGHLCSG

SEQ ID NO: 97626 - protein, 51 aa, Glycine max
  Coding DNA Sequence Number=SeqID_5941
MVWRLQSPLLLLHSAAIDLQEANDSIDEEDPRLTCSTWSYIKWLGASSTKC

SEQ ID NO: 97627 - protein, 66 aa, Glycine max
  Coding DNA Sequence Number=SeqID_5942
MGEKLASGGIFWKAQVGLSFTNCATMLPFDFRHITELHELPNDGCQVPRSGQTRVASQQRMVPGRN

SEQ ID NO: 97628 - protein, 121 aa, Glycine max
  Coding DNA Sequence Number=SeqID_5943
MSLFSCCRTKRTLPAKHMTSRKRKDTVSRPREAYDTTRFISEGTWERYAQNVHSQNILPERNVILYVTEYDKFHQELERKSWHKALTRRGALEAPEEGPHHSSTDLESALILQPRPYLSYI

SEQ ID NO: 97629 - protein, 129 aa, Glycine max
  Coding DNA Sequence Number=SeqID_5944
ETKKLEGKLDALVNLVTQLALNKKSALVARLCGLCSSSDHHTDLCPSVQQSEAIEQPEAYATNIYNRPPQPQRQNKPQQNNYDLSSNRPYVPPPIQQQQQQQPQKQQIVKAPPQPSLEELGRQMTMQNM

SEQ ID NO: 97630 - protein, 102 aa, Glycine max
  Coding DNA Sequence Number=SeqID_5945
MGKLDHLEERLRAIERGKEYAFANLEELFLVPNIITPPKFKVSDFDKYKGTTCPKNHLRIIGTILIWLRIGCNYRAYARGGTDLSKNTPKGGETWQLMWHLQ

SEQ ID NO: 97631 - protein, 58 aa, Glycine max
  Coding DNA Sequence Number=SeqID_5946
MEKMNVHIITRGTPKGLGSSSSMDSFASWKMNGSGMEKEEREETPFQGEDESRRSSPP

SEQ ID NO: 97632 - protein, 141 aa, Glycine max
  Coding DNA Sequence Number=SeqID_5947
  Homolog annotation: Hit_ID=A2Q6B3; Match level="QueryCoverage=70%, HitCoverage=46%, E-value=2e-08, Identity=26%"; Hit description =Putative uncharacterized protein
MDEHQQNWKKMANIMMKINKESNEMFNIVHVIDQPYGEVSMSFVIRWKDELEPTWHLLHSSGNMHSVTYNQDLVSPALLAGWTELREFYGLTGNHQVTLIHYGQSVFLLTIFKSNSEPKAFPKWHFLYHQVPNSITFKVTH

SEQ ID NO: 97633 - protein, 59 aa, Glycine max
  Coding DNA Sequence Number=SeqID_5948
MNFKKCQNALGVGYHCTKSRMMTSVVVTTLKEGPPSEGVMVSSDHSKVQDNQEITLMFI

SEQ ID NO: 97634 - protein, 254 aa, Glycine max
  Coding DNA Sequence Number=SeqID_5949
  Homolog annotation: Hit_ID=Q6WAY6; Match level="QueryCoverage=92%, HitCoverage=54%, E-value=1e-21, Identity=27%"; Hit description =Putative uncharacterized protein
MGSSQKPSLKKRFYQVKIKSLEVTSLGELGQLMGQLQRQAFRKAYGKIWDLARVEVSMEPIASLSQYYDQPLRCFTFEDFQLVPTVKEFEEILGCPLGGRKPYLFSGFYPLHDKSCQGQRPWQIKANGLSFIDILALLIFGVALFPNMEGLVDLAAIDAFLAFHHGKESPVVAILAMYDTFDRGCPSIRYKEGRIRILSSCEGCPNVPLMGTRGCINYNPVLAIRQLGYLMRGVPSDESITPFIARGFSDHNAR

SEQ ID NO: 97635 - protein, 93 aa, Glycine max
  Coding DNA Sequence Number=SeqID_5950
MARNVLAPCPYFRDLYGRELKGLLTIIPKVVISLLMVSRVPSGVANCRNLPFGGRATGDSQVCLPRKEYARSRHRRLLEGNVGKTGKDVVYEL

SEQ ID NO: 97636 - protein, 69 aa, Glycine max
  Coding DNA Sequence Number=SeqID_5951
MMAHQEPFNRSGILQLGLQFAPFELLGLGSSSSMDSFASWKMNGSGMEKEETEETPLQGEDESRRSSPP

SEQ ID NO: 97637 - protein, 62 aa, Glycine max
  Coding DNA Sequence Number=SeqID_5952
AINSWGFELDGGGCMNSARQSIHGAPDLMMEDARTALGNQFMGLRIRFDGGGCMNDNQFMGL

SEQ ID NO: 97638 - protein, 161 aa, Glycine max
  Coding DNA Sequence Number=SeqID_5953
  Homolog annotation: Hit_ID=P03851; Match level="QueryCoverage=52%, HitCoverage=100%, E-value=4e-44, Identity=98%"; Hit description =Uncharacterized 9.4 kDa protein
VDSRGSLKAVIPRYPQNQGITQERTCEQKASKRPGTVAKPDRTIKIPGVSPWKLPRALSCSDPAAYRIPVVRSKLGCVHEPPVQPDRCALSGNYRLESNPVRHDLSPLAAATGNRISRARYVGGATEFLKWWPNYGYTRRTVFGICALLKPVTFGKRVGSS

SEQ ID NO: 97639 - protein, 120 aa, Glycine max
  Coding DNA Sequence Number=SeqID_5954
YATYQAADTPPPPHQADPAGSFGTKRYLQHLVRQQAANHRGQVQIHECLYQLSLSQQSQGFTPFACPTPDQFRAEVAWLGDWPEAQVGEAPAEAPGDAEEARMDEEMTDLLDFLGGSGAT

SEQ ID NO: 97640 - protein, 201 aa, Glycine max
  Coding DNA Sequence Number=SeqID_5955
MSVHVAQLIADAIYLFAGMPPTRHPLDPDKSNRALSFPALITGLCQSLGVLVTPSKVIRPPITRTFIEKYCTTRQAQGGDPQAPNAPPPPPQADPAGSFDTERYLRHLVRQQAANHRAHVQTHDSLYQLSLSLQSQGFASFPCPTLDQITAEVEWPGDWPEAQAGEATTEAPAEAPGEADEARMDKEMTDLLDFLGGSGAT

SEQ ID NO: 97641 - protein, 142 aa, Glycine max
  Coding DNA Sequence Number=SeqID_5956
AFRLTDSKNNVYTDNHSGISARQRDSNVSMTDLVSAEDDTAKKNVYTDNHSSIFARQRDSNVSMTILLVAIDEGCRRRRQSLRAIRLFVLQTAKKNVYTDNHSGISARQRDSNVSMTDLVSAEDDAFRLTDTKKNVYTDNTR

SEQ ID NO: 97642 - protein, 255 aa, Glycine max
  Coding DNA Sequence Number=SeqID_5957
  Homolog annotation: Hit_ID=Q2HW90; Match level="QueryCoverage=59%, HitCoverage=30%, E-value=8e-12, Identity=28%"; Hit description =Putative uncharacterized protein
MVEEFEEILGCPLGGRKPYLFLGFYPSLARISKIVQISAQELDHRKKFENGVAGVPRKCLEAKARILAGRGEWAPFIDILVLLIFGGVLFPNVDGLVDLAAIDAFLAFHDRKESPLVAILVDLYDTFNRRCEKSKTRIVCCTPALYVWLVSHLFLQEGETCLPVRKPPFMHREERGKLGPTLSKQRRSVCQLVPPVERRKNRSPNFVQRISKCSLDGDKGLHQLQFYSCYKTTWLPHERGTTRGRARTYYCMRFQ

SEQ ID NO: 97643 - protein, 185 aa, Glycine max
  Coding DNA Sequence Number=SeqID_5958
MVSYTPSSFTDLVFVCKRIEVGLKRGKFDHPALTNKKPWANREDEKEEGTHAMTVVPTWPNFPPAQQCHYSANISPSHYPPPNHPQRPSLNQPQSRPATHPMPNTTLNTNQNTNQEGNFPAKKPIEFTPISVSYANLLPYLLDNSMVAITHPRFLNLHFFEDMTRMQHVLTMEKFRGIPLSIIGP

SEQ ID NO: 97644 - protein, 246 aa, Glycine max
  Coding DNA Sequence Number=SeqID_5959
  Homolog annotation: Hit_ID=UPI00016621D1; Match level="QueryCoverage =95%, HitCoverage=43%, E-value=1e-17, Identity=32%"; Hit description =UPI00016621D1 related cluster
MPISPYGGLHVLAIRGLHVLTFEGIHALTFRGLHVLTFRGLHALAIRGPHVLTFVGLHAFTFRGPHVLTFRGLHTLAIRGPHILTFRGLHALAIRGLHVLTFRGLHALTFSGPHVLTFKGLHALAIRGPHVLTFVGLHALTFRGPHVLTFRGLHALAIRGPHVLTFRGPHALAIRGLHVLTFRGLHALAIRGTACPHLQRTTRPRHQRTSVLAFVGLHALTFRGLHVLTFRGCYTPSPSEDTTSSL

SEQ ID NO: 97645 - protein, 260 aa, Glycine max
  Coding DNA Sequence Number=SeqID_5960
  Gene Ontology: Mol. function=transcription regulator activity; Cellular component=nucleus; Biological process=negative regulation of gene expression, epigenetic
  Homolog annotation: Hit_ID=A7R0D8; Match level="QueryCoverage=53%, HitCoverage=13%, E-value=7e-55, Identity=75%"; Hit description =Chromosome chr6 scaffold_305, whole genome shotgun sequence
  Pfam annotation: Domain name=Hira; Domain location=1-184; Score=43.8; E_value=5.9e-10; Accession=PF07569.2; Description=TUP1-like enhancer of split
MPIMMMGSATTFIDCDECWKLLLVTRNKSLYLWDLFNKTCLLHDSLASLIASSPNSSTKDADTIKVLYAKLSKSGSPLVVYATCHAFLFDMSLKCWLRVANDYFPASSFASSWCMRLIQSGELAALQVDVRKYLARKPGDGCMSLLKKRHFGIRLHVVQKRTPQGSKQILACGILGKLTAITQLVHHGMILIPIGYTFNADMFEMEKVKGGSPYGARTYTGDGSRQPSELELQQVSTKGSTLPATQRSSSKLHNVALPSY

SEQ ID NO: 97646 - protein, 97 aa, Glycine max
  Coding DNA Sequence Number=SeqID_5961
  Subcellular localization annotation: CTP_CleavageSite=30; ConfidenceScore=5.17e-01
MYPLLFSVTTTQVDVPSTCTTKDVPSNVLRQSSQAVSPLKLCEGETKDISGGKGRIKRILRLYRFEFFEKGEGRHKRIQAVSPLFFWKREKRDTGIL

SEQ ID NO: 97647 - protein, 2563 aa, Glycine max
  Coding DNA Sequence Number=SeqID_5962
  Gene Ontology: Mol. function=DNA-directed RNA polymerase activity; Cellular component=cytoplasm; Biological process=keratinization
  Homolog annotation: Hit_ID=Q9SB74; Match level="QueryCoverage=95%, HitCoverage=85%, E-value=0.0, Identity=33%"; Hit description =Putative uncharacterized protein F28M20.240
  Pfam annotation: Domain name=Filament; Domain location=1497-1751; Score=-186.5; E_value=0.033; Accession=PF00038.12; Description =Intermediate filament protein
  Pfam annotation: Domain name=M; Domain location=1289-1309; Score=0.7; E_value=1.1e+02; Accession=PF02370.7; Description=M protein repeat
  Pfam annotation: Domain name=M; Domain location=134-154; Score=6.2; E_ value=20; Accession=PF02370.7; Description=M protein repeat
  Pfam annotation: Domain name=M; Domain location=1405-1425; Score=0.9; E_value=99; Accession=PF02370.7; Description=M protein repeat
  Pfam annotation: Domain name=M; Domain location=1571-1591; Score=1.1; E_value=95; Accession=PF02370.7; Description=M protein repeat
  Pfam annotation: Domain name=M; Domain location=1806-1826; Score=0.8; E_value=1e+02; Accession=PF02370.7; Description=M protein repeat
  Pfam annotation: Domain name=M; Domain location=2092-2112; Score=1.6; E_value=81; Accession=PF02370.7; Description=M protein repeat
  Pfam annotation: Domain name=M; Domain location=2342-2362; Score=4.8; E_value=30; Accession=PF02370.7; Description=M protein repeat
  Pfam annotation: Domain name=M; Domain location=288-308; Score=1.9; E_ value=74; Accession=PF02370.7; Description=M protein repeat
  Pfam annotation: Domain name=M; Domain location=344-364; Score=1.0; E_ value=97; Accession=PF02370.7; Description=M protein repeat
  Pfam annotation: Domain name=M; Domain location=582-602; Score=2.0; E_ value=72; Accession=PF02370.7; Description=M protein repeat
  Pfam annotation: Domain name=M; Domain location=981-1001; Score=2.4; E_value=64; Accession=PF02370.7; Description=M protein repeat
  Pfam annotation: Domain name=Osmo_CC; Domain location=1268-1316; Score=0.7; E_value=13; Accession=PF08946.1; Description=Osmosensory transporter coiled coil
  Pfam annotation: Domain name=Osmo_CC; Domain location=627-676; Score =16.1; E_value=0.03; Accession=PF08946.1; Description=Osmosensory transporter coiled coil
  Pfam annotation: Domain name=Pox_A_type_inc; Domain location=1067 -1086; Score=1.6; E_value=50; Accession=PF04508.3; Description=Viral A-type inclusion protein repeat
  Pfam annotation: Domain name=Pox_A_type_inc; Domain location=1268 -1290; Score=8.2; E_value=5.4; Accession=PF04508.3; Description=Viral A-type inclusion protein repeat
  Pfam annotation: Domain name=Pox_A_type_inc; Domain location=1553 -1575; Score=4.7; E_value=18; Accession=PF04508.3; Description=Viral A-type inclusion protein repeat
  Pfam annotation: Domain name=Pox_A_type_inc; Domain location=1673 -1695; Score=4.6; E_value=18; Accession=PF04508.3; Description=Viral A-type inclusion protein repeat
  Pfam annotation: Domain name=Pox_A_type_inc; Domain location=1957 -1978; Score=2.7; E_value=34; Accession=PF04508.3; Description=Viral A-type inclusion protein repeat
  Pfam annotation: Domain name=Pox_A_type_inc; Domain location=344-366; Score=1.4; E_value=52; Accession=PF04508.3; Description=Viral A-type inclusion protein repeat
  Pfam annotation: Domain name=Pox_A_type_inc; Domain location=753-775; Score=1.1; E_value=58; Accession=PF04508.3; Description=Viral A-type inclusion protein repeat
  Pfam module annotation: Pfam domain module=Filament::M::M::M::M::M::M: :M::M::M::M::M::Osmo_CC::Osmo_CC::Pox_A_type_inc::Pox_A_type_inc::Pox_ A_type_inc::Pox_A_type_inc::Pox_A_type_inc::Pox_A_type_inc::Pox_A _type_inc; ...
  Pfam module annotation: Pfam domain module=Domain location=1497 -1751::1289-1309::134-154::1405-1425::1571-1591::1806-1826::2092 -2112::2342-2362::288-308::344-364::582-602::981-1001::1268-1316::627- 676::1067-1086::...
  Pfam module annotation: =1268-1290::1553-1575::1673-1695::1957 -1978::344-366::753-775
MQEADGLDMKKSYQSTDPVIDGQKELSLSEVGESDQSLSGIALEKIRVEEASHEAEQLRKSIELLSSQFLLEARGAVSDLDPLASSSVLSDNDISEAFQSLKEELFLANLMKNIFNTQLAEQLESDDQRHQLVDEISQLHASHNKVNDKNQQLTEELANCHVELHDISSKNVEVQNQFNAAMAEVEALSVRVIELQNSFDVSHKDSLELSRELADCRGLISSLQVEKKGMNETLNLMIAEKNKLVEEKEFHLCESKNLATELADFKSLMEGVRVENSNLIDRISLVTEERNKIEAEIEHLKHEIDRLSLDLVENKDLVASLEAENSNLNRNLALSADKIKNLEDENQRHSSEIIALNEQLSTEKAERMRFEGDLKEATVHLEQISKENVFLNDTLDKQKAKIEEIGKEHSQPLSQPRDLGNQAHVARTQSKGLEIAIANDSLHMDQEPDEGALGGPHVNILEHEVFDDSHGFVSLKACSDEVEKVLVKLEKAIDVLHSQSVSSSRAGEKVSSPVVSKLIQAFESKVQEDEHETESRDSSDVLSSSNSFIMLTKEQIGDLKKLLSKWKLNVQIAGTLFNGERDDRKTGDAKYSDLKDQFEQLKQHCSDLEASNIELAVQYETAKQLLGDIQEKKCLLEEFYDALKQEDTHLKAKNNELYEKLGYCQSKISELHTEMNDVKQISNDMASTVGSQLENLQKEVTERAMLLEQGWNMTIAQIVELVGKLKESVGETLCTTVSSDAYGNLDICHQLEVSVNAAAEMIFDLQKKLEATYSEHEIMCTSYKEMNSKCDDLLGRNELAVSLLHKMYSDLRKLVFSNGGTMDEDKIDLQSEVLPDLLNYNSYQPILKHIGNILTEKLELESVTKEIKSELMHRETELEELKMKCLGLDSVSKLIEDVVGVLNVDISKIDINKSPLSCLDSLVSSLVQKTRDTEIQYHTTKEGYGSKEMELAELKEKMHFLDTLRLENENEILVLKESLHQAEEALTVAHSELHKKANELEHSEQRVSSIREKLSIAVAKGKGLVVQRDGLKQSLAETSSELERCLQELQLKDTRLHEVETKVKTYAEAGERVEALESELSYIRNSSNALRESFLLKDSMLQRIEEILEDLDLPEQFHSRDIIEKIDWLASSVSANSLPINDWEQKEAMGGGSYSDAGYVVTDSWKDDSQLRPDSDDFRKKFEELQSKYYGLAEQNEMLEQSLMERNSLVQRWEELVNRVEMPSHLQSMETEDKIECIGSALTEANHHIDSMQLKIEKYDSYCGLLNADLEESQRTVSALQEDLSALTSEREHLSEKMESLVYEYEKLSLQTREAELENGKLHDEITSLKDKLEHKTAIEEQIFTIEGKIRKLRDLVGDALSESETENMVSGSANIDSLEELLEKLVEKLNMERKPSAQTREAELENEKLHTEISSLKDKLEQKAAIEEQIFTIDGKIRKLQDLVGDALSVPETENLVSCSANIDSLEELLRKLIENHAKLSLMKPAYGVVGDGLHSQKEDATLLEERSMDVHDKEAADIDIYKRDLEESSNELMHVKEERNRSLEKQISLSGEVEALTKRIEELQGLLNQEEQKSASFREELASEVETLTKRNEELQGLLNQEEQKSASVREKLSGEVETLTKRIDELLGLLNQEEQKSASFREKLNVAVRKGKSLVQQRDSLKQTIKDMTVEMEHLKSEINNRENTLGEQEQKLRQLSTYPDRLEALESESLLLKKHLEETEHHLQDQEYSLKLILNKLGEIEVGGEGHISDPVKKLELVGKLFSDLHSAVASLEQESRKSKRASELLLAELNEVQERNDSFQEELAKVTAELVDLRRERDSAEAAKLEAVAHLEEGKKSHFSDIMELKSSMNQVCKSFGEVQNLLCNAFFMDLESYRKVEAGLESCMKGNNDKNVVDSSITKEHDGILHCSSANKKSSVSADPWSDFDRIDHYDDNTIVEISRLFGHQLQELMVEVSSLRERINMHSSLAQETDKTLSKLIASIQREMTSQKEACETMKKEVSERDGELAVLRGNVAYLYEACINSVIVLENGKAELVGRKVESSDLGINLEIPSFDDGISEECIKTLTDRLLLSAKGFASLKTEFLDANQKEMKATITNLQRELQEKDVQRDRICSELVKQIKDAEAAANSYSQDLQAFSLQEHNIKKEVEAIEAERKILEQRVNELQDRQETAAELEEKMRSQTGLLAAKDQEIEALMHALDEEETQMEELTNKIVDLETVVQQKNQEIENLGSSRGKVMKKLSITVSKFDELHHLSASLLSEVEKLQSQLLERDTEISFLRQEVTRCTNDALLASQMSNQSSDEIFEFLMWVDTIVSHDGVHDIHPDMKSNSKVHECKEILHKKLTSLLSELENLREVAESKDAMLQIERSKVEELNCKTETLETSLHEKELQLNLLEGVEETGKGAGTSSEIVEVEPAMNDWSSSGAFVTPQVRSLRKGNSDHVAIAVDVDPGSTSRIEDEEDDKVHGFKSLTTSRIVPRFTRPLTDLIDGLWTQLSCTVSSFCLVLVAVRDSYKYNEFKDAAARKSYRQSIEEKMRKQIAQYFEEQHKHHSSWCF

SEQ ID NO: 97648 - protein, 87 aa, Glycine max
  Coding DNA Sequence Number=SeqID_5963
MDEYFRVSNCKSAKEMWDTLRLTHEGTTDEHEIELLRLHQNEENDKKKKGIALKASSSIQEESDQDNDADDDDDLSLFVKRFNKFLK

SEQ ID NO: 97649 - protein, 182 aa, Glycine max
  Coding DNA Sequence Number=SeqID_5964
MAPRKLPAKRSRKDKAAEGTSAAPEYDSHRFRSAKHQQRFEAIKGWSFHRERHVLLRDDEYTDFQEEIARRRWTSLVTPMAKFDPDIVLKFYANAWPTQEGVRDMRSWVRGQWIPFDADALSQFLGYPLVLEKGQECEYGQRRNRADGFDEEAIAQLLCNTGTGFCPNRCRETSANHAHQTD

SEQ ID NO: 97650 - protein, 316 aa, Glycine max
  Coding DNA Sequence Number=SeqID_5965
  Homolog annotation: Hit_ID=Q6WAY6; Match level="QueryCoverage=97%, HitCoverage=58%, E-value=2e-26, Identity=29%"; Hit description =Putative uncharacterized protein
MGSSQKPSLKKRFYQVKIKSLEVTSLRELGQLMGQLQRQAFRKAYGKIWDLARVEFSMEPIASLSQYYDQPLRCFTFEDFQLVPTVKEFEEILGCPLGGRKPYLFSGFYPSTTRVSQGSENLSTRVGPCKAKQKWSSRSTKGSVWRKGQRPWQNQGEWASFIDILALLIFGGVLFPNMEGLVDLAAIDAFLAFHQGKESPVVAILAMYDTFDRGCEKSGARIVCCALALYVWLVSHLFLQEGRKNQDSIFIRRMSKCSLDGTRGCINYNPVLAIRQLGYPMRGVPSDESITPFIARGFSDHNARVLQGVRKAWDAA

SEQ ID NO: 97651 - protein, 65 aa, Glycine max
  Coding DNA Sequence Number=SeqID_5966
MLQQEEESLSSKKEETSSAEEEEEDPFYQNEDDCFAIKVPVETTCLVTNSQIVPIKTTGLRFLAI

SEQ ID NO: 97652 - protein, 83 aa, Glycine max
  Coding DNA Sequence Number=SeqID_5967
MTQQWHLHHHLHHISTLSLAPSILMYYGCNLSMFQNMFGMGKKKGNYISDALSPRIKGKNKFQSKFFLFFNNLVSGGLSKWDT

SEQ ID NO: 97653 - protein, 248 aa, Glycine max
  Coding DNA Sequence Number=SeqID_5968
MDRARLVYGLVTHMDMNIDTLISGQISSVAQSNSSRLRFPALITTLCRARGITSDSLTYESLSPAINLAYIKKNCWNMDYLIVNFRGARKARARPVDVPSSSTPPAPSTSATPTLAPLDPSAQDSQRFESMLQSLYQGKQFVEKVAWPENQPFLVREGGSPSAQAGGTQVRQEAATPERSTQISPDPPTPMHEMPADPSTPLLEIPEDPASLVLGLTTTPLATLVLHFTDEEGTQDQDNQQDDQSQEF

SEQ ID NO: 97654 - protein, 96 aa, Glycine max
  Coding DNA Sequence Number=SeqID_5969
MNPKRIKVIPKWPTPPTPLTELVRNHVPSWEDAQEMGVEGRSPEYEEPRDLRSNPFQGGQMMQSYPPRVLDRRLQEAWARATTEGPRVLMNLRVDF

SEQ ID NO: 97655 - protein, 73 aa, Glycine max
  Coding DNA Sequence Number=SeqID_5970
VDVEEVRNVDARIPISTQEVQLVGQTLNTFLAWATHLDKQKTEGPAKLVDRLDPDVDPLYLMTLTISQLFLKL

SEQ ID NO: 97656 - protein, 269 aa, Glycine max
  Coding DNA Sequence Number=SeqID_5971
  Homolog annotation: Hit_ID=Q2HW90; Match level="QueryCoverage=65%, HitCoverage=35%, E-value=3e-19, Identity=32%"; Hit description =Putative uncharacterized protein
LGPIIVEVSTEAIASLAQYYDQPLRCFTFVDFQLTPTVKEFEEILGCPLGGRKPYLFSGFYPSLARISKIVKISTQELDRGKQVENGVVGVPRKCLEAKARVLASQDEWAPFMDILTLLIFGVVLFPNVDGLVDRAAIDAFLSFYDHKESLVIAILADLYDTFDQRCEKNNARIVCYTLALYRVHKAWEMSQRKDKELKGSSNGPIGGYHRWLKAYAQDLDWLPSLRTTKGMEVETPEEDEEDTKGERRTERRQYSHHQGLGARDQEGP

SEQ ID NO: 97657 - protein, 44 aa, Glycine max
  Coding DNA Sequence Number=SeqID_5972
GCMSSATTNFVDLQMKSIMASWRTALRYNFAELQTRWWRMHEQR

SEQ ID NO: 97658 - protein, 403 aa, Glycine max
  Coding DNA Sequence Number=SeqID_5973
  Gene Ontology: Mol. function=cation transmembrane transporter activity; Cellular component=integral to membrane; Biological process=cation transport
  Homolog annotation: Hit_ID=Q1H0T7; Match level="QueryCoverage=99%, HitCoverage=38%, E-value=1e-138, Identity=63%"; Hit description =Acriflavin resistance protein
  Pfam annotation: Domain name=SecD_SecF; Domain location=184-377; Score=-102.0; E_value=0.066; Accession=PF02355.7; Description =Protein export membrane protein
  Subcellular localization annotation: CTP_CleavageSite=20; ConfidenceScore=5.01e-01
MVGNRLPPGIVPNITPLTSSASTVMGLGVTSNKLSLMELRTLVDWHLTPHLMTIPGIADINVYGGEVRQFQIKLDPRKLMLYQLNVQDVETAASRATGVRGAGYIQNDNQRIILNTQGQTTTPQQLANITLVRKLGRTIRIRDVAEVSEGAAPSISAAAINGQPAVYLSVQGQLGANVYALTKQLELKLAEIKPSLEKQKVTLHEGLFRPANFIEIAIQSLRSDILIGSVLVILVLFIFLFNVRTAIISATAIPLSLLTAIVVLYQSGVGLNIMVLGGLAIALGEVVDDAIIDTENIFRRLRENRLLSVPLPVTKVVFQASMEVRSSVVYATIIVALVFLPLLTLSGVAGKLFAPLGYAYISAILASLVVALTLTPALCYVLLARAPLKDEDSPLLKWLKKRY

SEQ ID NO: 97659 - protein, 139 aa, Glycine max
  Coding DNA Sequence Number=SeqID_5974
MHTEAGFRPDRCREAGADHAHQHDHLDPDVDDIAAQQCMPPTRHPLDPDKSNRALGFLALITGLCQSFGVPVTPSKVIRPPITRAFIEKYCTPRQTHGDAPQDAGAPPPPHQADPTGSLGMEHYLQHLVRQQAANHRGQ

SEQ ID NO: 97660 - protein, 102 aa, Glycine max
  Coding DNA Sequence Number=SeqID_5975
MHQPHVKIYVSFITNGERQKRNDASSIGACRPRIFFINGFLCFLEDEWQRNGERKRERRRHFNEKMSLEEAHHHRRPWIRALRKKEMNEGRGREEHEILCSK

SEQ ID NO: 97661 - protein, 234 aa, Glycine max
  Coding DNA Sequence Number=SeqID_5976
LCQSLEFPVAPTKAQGDAPQAAGAPPPPHQAGQAGAFDMEQYLRHLVRQQAANHRAHTSSGQRSHGPEIGPRPKQERRHQKLPAMARRPTRTRRWPICLTSWEGVELHDWEILEGNERCGFRGTIRLTATSLVHPEEPAHTLQQPVEWILPTPTPYRLDEPVQVIELSSSEEDLEEDLEELPPEPAMDALDLPEDDEDPLPDVDSPEDVMSASEADSTEESGPGGTANSDDSSS

SEQ ID NO: 97662 - protein, 70 aa, Glycine max
  Coding DNA Sequence Number=SeqID_5977
MGEVEEVQERIKADMKAMKEKVATMMEAIMSMKEIMEHAFTPYGLPPNYTPPNVAYTPSEDVNNSLSHTH

SEQ ID NO: 97663 - protein, 364 aa, Glycine max
  Coding DNA Sequence Number=SeqID_5978
  Gene Ontology: Mol. function=molecular_function; Cellular component =membrane; Biological process=auxin mediated signaling pathway
  Homolog annotation: Hit_ID=Q2HV22; Match level="QueryCoverage=96%, HitCoverage=99%, E-value=1e-111, Identity=56%"; Hit description =Putative uncharacterized protein
  Pfam annotation: Domain name=DUF6; Domain location=178-307; Score =40.0; E_value=8.3e-09; Accession=PF00892.11; Description=Integral membrane protein DUF6
  Pfam annotation: Domain name=DUF6; Domain location=22-134; Score=9.9; E_value=0.019; Accession=PF00892.11; Description=Integral membrane protein DUF6
  Pfam annotation: Domain name=TPT; Domain location=169-307; Score= -23.1; E_value=0.013; Accession=PF03151.7; Description=Triose -phosphate Transporter family
  Pfam module annotation: Pfam domain module=DUF6::DUF6::TPT; Domain location=178-307::22-134::169-307
MNDVRKLVQDLKPVFLMVSVQIAYSSVNVLYKLAINDGMSIRVVTAYRLMFAVVFTSSLALIFESASLFHNLFLEALDLVSATFATAVYNLVPAVTFILAILCGMEKLNVRTAAGKAKVMGTIIGIGGSMLLTFFKGQEINVKSFGTNLLQKNEQVVALHTDSGKKFLGVLCGFGSCFSFALWLIIQSKMSKEYPSHHSSTALMSLMAAIQATAFALYVEKDWSQWKLGSSIRILTVAYTAIVASGLVVIVIAWCVRMRGPMFVSVFNPLMLVLVAVADSLMFGENLYVGSVMGAMLIVGGLYMVLWGKSKEMKKANLSVSSEINQEHEATEVVVMSTTINDDNCDRVNNTDANCKSNIVAKVS

SEQ ID NO: 97664 - protein, 260 aa, Glycine max
  Coding DNA Sequence Number=SeqID_5979
  Gene Ontology: Mol. function=DNA binding; Cellular component =chromatin; Biological process=regulation of transcription, DNA -dependent
  Homolog annotation: Hit_ID=O80383; Match level="QueryCoverage=57%, HitCoverage=54%, E-value=2e-40, Identity=40%"; Hit description=98b
  Pfam annotation: Domain name=HMG_box; Domain location=160-220; Score =29.3; E_value=1.4e-05; Accession=PF00505.10; Description=HMG (high mobility group) box
MDKRYWFIPAYSKEDIRRMAILQGLEYPSTPDFNAQDVSDDAMCFAFAPVASGSIFGNLAQMNQLVGYDFLRKTVSFKSTAQCFLCIDGLVQIKKANPEAEFKEISTMVIAKEKRETESMRLLEDEQKQRTAMELLEQYMQFKQEAEKDGKKNKEGSIETKAPHVSYFLFTNDRGAALAAENKNFLEVPKITSEEWKNMTEEQKRPYEEEQYALEMEAYKQKKDEEAGHFMKEEEDHMKLQKQEALQLLKKKEKTENIIK

SEQ ID NO: 97665 - protein, 276 aa, Glycine max
  Coding DNA Sequence Number=SeqID_5980
  Gene Ontology: Mol. function=protein serine/threonine kinase activity; Cellular component=cytoplasm; Biological process=protein amino acid phosphorylation
  Homolog annotation: Hit_ID=A5AQY4; Match level="QueryCoverage=51%, HitCoverage=10%, E-value=3e-19, Identity=43%"; Hit description =Putative uncharacterized protein
MDNVKAVKDILRSYEMVSGMRINFGNSQFGAIGQSDEWCCLAADYLNCALLHFPFYYLGLPIGINPRRKVHVAAMVTESTSRNDTTSGNRHANDENLVAVAGDSESDVVEGESVTLTHGGAVSKSALCVLSDLGNLRGRHSLIDIRDEGYDSIRRTVSMDHSFQRGSGLSITDVLHVNQEHKGCSNGAGPSKNSRGEISKSSYRRRVLHCVLSPIAMKRSFSSGRQGFHEFVTEVLMLSLLHDSNLVKLIGYCTDGDQRLLVYEYMPMGSLEDHLF

SEQ ID NO: 97666 - protein, 232 aa, Glycine max
  Coding DNA Sequence Number=SeqID_5981
METQIEEIQSTRSLRIPKISSVARDSDIIENLQYTSLKDIKSCNFGLPTICGVVDYQKRKLLYDFLGKAKEQGCFLFNMEGFRSCKPIQGLSCPNLPVSESHVGEYSEEMILIKDILPENTGIAKSIEAAGSTMSDTMSRTSCPKILELLKALKLQDPRCRIRCPGHLARKYWTYKSVISLTDYCAIFQKNDRSHPAQEVAAQIRSLLYKHEGCTSSVPSPGLKSYFVSFGT

SEQ ID NO: 97667 - protein, 69 aa, Glycine max
  Coding DNA Sequence Number=SeqID_5982
MGSSLAMRCSSQFDVCIYGSCEGGVKGDEGWFCWSKEIGLLRSMLLYGNCCGDGSCSCGHKGCGDDGCG

SEQ ID NO: 97668 - protein, 180 aa, Glycine max
  Coding DNA Sequence Number=SeqID_5983
  Gene Ontology: Mol. function=metal ion binding; Cellular component =intracellular; Biological process=protein modification process
  Homolog annotation: Hit_ID=A7P1J6; Match level="QueryCoverage=83%, HitCoverage=30%, E-value=4e-48, Identity=59%"; Hit description =Chromosome chr19 scaffold_4, whole genome shotgun sequence
  Pfam annotation: Domain name=RCC1; Domain location=33-82; Score=17.2; E_value=0.01; Accession=PF00415.9; Description=Regulator of chromosome condensation (RCC1)
  Pfam annotation: Domain name=RCC1; Domain location=85-137; Score=6.8; E_value=0.13; Accession=PF00415.9; Description=Regulator of chromosome condensation (RCC1)
  Pfam module annotation: Pfam domain module=RCC1::RCC1; Domain location=33-82::85-137
MGQYTPLDQVLIFVLAMVTNMMSCSHILYKNSEGKVYTWGKGYCGALGHGDEIDNTTPKLLTSLKNQLVVQVCVRKRKTFVLVNSGSMYGFGSMGFGSLGFLDRRVSDKVLKPRILDTLRAHHVSQISTGLYHTMVITSRGHIFGFGDNERAQLGHDTLTSCLEPTQIFIKHTYEDVENT

SEQ ID NO: 97669 - protein, 583 aa, Glycine max
  Coding DNA Sequence Number=SeqID_5984
  Gene Ontology: Mol. function=oxidoreductase activity; Cellular component=anchored to membrane; Biological process=electron transport
  Homolog annotation: Hit_ID=Q9AYM8; Match level="QueryCoverage=87%, HitCoverage=98%, E-value=0.0, Identity=67%"; Hit description=CPRD2 protein
  Pfam annotation: Domain name=BBE; Domain location=503-561; Score =115.5; E_value=1.6e-31; Accession=PF08031.3; Description=Berberine and berberine like
  Pfam annotation: Domain name=FAD_binding_4; Domain location=129-268; Score=74.4; E_value=3.7e-19; Accession=PF01565.14; Description=FAD binding domain
  Pfam module annotation: Pfam domain module=BBE::FAD_binding_4; Domain location=503-561::129-268
MGWGQTNLFDPCKKRGGLAQSTANADLCRRALRGMDRPVYPPLPTYPMPSTKIMPLSSYSTVVAIALLFSFTSSAHTQENFVQCLNNYPHNINATSISKVLYNQTNSSYSSILDFSIKNLRFSNVSSKPLVIVTPLVVSHIQATIICSQRHGMQIRTRSGGHDYEALSYVAKAPFVVIDLINLGEIKVEMENNTAWVPAGASIGELYYRISEKSTTLGFPAGVCPTVGTGGHFSGGGYGFLMHKFGLAADNVIDAHIVDVNGNLLDREAMGEDLFWAIRGGGGASFGVIVAWKVKLVPVPSTVTVFYVPRTLEQNATEIIHKWQLVANKLDNGLMIRVNLERVNSSQNGKPTVVATFESMYLGGVDQLIPLMQKSFPELGLVREDCTEMSWIDSVVYMSQFTNGKSDYVRDPIPDVGLKGLWPLFYEDEAQGAVIQFTPYGGKMYEISESEIPFPHRSGNIFHIHYLVRWREEGEEAKQKYINWIRRAYKYMEPFVSKSPRAAYLNYRDLDIGVNNNNGNTSYSQASIWGLKYFKNNFNRLARVKSMVDPLNFFRNEQSIPPLKSKGLNMQVENLGAVNVFIK

SEQ ID NO: 97670 - protein, 90 aa, Glycine max
  Coding DNA Sequence Number=SeqID_5985
  Gene Ontology: Mol. function=transferase activity, transferring glycosyl groups; Biological process=metabolic process
  Homolog annotation: Hit_ID=Q8S996; Match level="QueryCoverage=43%, HitCoverage=6%, E-value=3e-09, Identity=71%"; Hit description =Glucosyltransferase-13
MSLIIYKTAAYLCGWNLILESVQEGVPLIPCSLFADHDPMSLIIFKTAAYLCDWNLILESVQEGVPLIPWSLFAEQKMNAVMLVDGLKVG

SEQ ID NO: 97671 - protein, 432 aa, Glycine max
  Coding DNA Sequence Number=SeqID_5986
  Gene Ontology: Mol. function=protein dimerization activity; Cellular component=nucleus; Biological process=regulation of transcription, DNA-dependent
  Homolog annotation: Hit_ID=A7Q9T7; Match level="QueryCoverage=49%, HitCoverage=96%, E-value=1e-72, Identity=59%"; Hit description =Chromosome chr8 scaffold_68, whole genome shotgun sequence
  Pfam annotation: Domain name=Utp11; Domain location=207-412; Score =175.5; E_value=1.4e-49; Accession=PF03998.4; Description=Utp11 protein
  Pfam annotation: Domain name=bZIP_1; Domain location=139-196; Score =49.7; E_value=1.1e-11; Accession=PF00170.12; Description=bZIP transcription factor
  Pfam annotation: Domain name=bZIP_2; Domain location=139-195; Score =41.2; E_value=3.6e-09; Accession=PF07716.6; Description=Basic region leucine zipper
  Pfam module annotation: Pfam domain module=Utp11::bZIP_1::bZIP_2; Domain location=207-412::139-196::139-195
  Subcellular localization annotation: CTP_CleavageSite=18; ConfidenceScore=5.24e-01
MASSKLVSTNPDLPRDPSSSSSSSSSISPLSSLLSDLHPMDDLLKSITPNSVDDFWKGIAAASTDNAGGVTLEDFLTKAIPVTEEDVRGAPPPPPSFLPFPAEGSSSSVEPFANNGVGSAPSNSVQKGKRRAVEEPVDKATLQKLRRMIKNRESAARSRERKQAYTSELEYLVHQLEQENARLLKEERIAVDEHHPNMSSLRNAIPRRAHKERSQPSSRKKFGLLEKHKDYVQRAKAFHKKEGTLRVPFYSFLFLQLLIPSTVNNFLQKLREKAANRNEDEFYFKMVRTKTVDGVHKPESEANKYTQQELMLMKTQDMGYILQKIQSERNKIERLTASLHSIDKQPVNKHVLFAEERKTAQSYQELEARRSRLNQLEKIYMDMAMQKELQKKGRKRKLGEDEIVCPTSKPLKNLHVLDEAPTLLAAASNVLH

SEQ ID NO: 97672 - protein, 316 aa, Glycine max
  Coding DNA Sequence Number=SeqID_5987
  Gene Ontology: Mol. function=sequence-specific DNA binding; Cellular component=nucleus; Biological process=regulation of transcription, DNA-dependent
  Homolog annotation: Hit_ID=Q6IEP9; Match level="QueryCoverage=75%, HitCoverage=43%, E-value=1e-40, Identity=39%"; Hit description=WRKY transcription factor 32
  Pfam annotation: Domain name=WRKY; Domain location=279-316; Score =45.1; E_value=2.5e-10; Accession=PF03106.6; Description=WRKY DNA -binding domain
MEAYRLINIIGEDKGRDSPKAQPWPQILIMGRSREKPTKMEIDLSLKIDTDDEHKEEEDERVKEDEEQEMAQIQDNNKEEIPEATAGEIEDDASVIETSLQDNTKTKELSVLQMEMESMKEENKVLRKVVEQTMKDYYDLQMKFSAIQENNKRKDHEISLSLQDIATTSGEGPSRILEIFNKQMQSAPSPPHPDHDDDSLSESELGLSLRLQPSTSHHKESDVGNNKEDKNDQQLASYASVQNKLQRTNCLPGITTHAASPPNRKARVSVRARCEAATMNDGCQWRKYGQKIAKGNPCPRAYYRCTVAPGCPVRKQ

SEQ ID NO: 97673 - protein, 308 aa, Glycine max
  Coding DNA Sequence Number=SeqID_5988
  Gene Ontology: Mol. function=zinc ion binding; Cellular component =intracellular
  Homolog annotation: Hit_ID=Q2Z1Y7; Match level="QueryCoverage=77%, HitCoverage=66%, E-value=8e-97, Identity=71%"; Hit description=Pm27 protein
  Pfam annotation: Domain name=DUF1644; Domain location=48-211; Score =363.6; E_value=3.2e-106; Accession=PF07800.3; Description=Protein of unknown function (DUF1644)
MAKGSRGRHRIASRQFRVTPYPLASCKRDICEDLCQNKCSKALEKKEWEDVTCSVCMEYPHNAVLLLCSSHDKGCRPYMCGTSFRHSNCLDQYKKAYTKAISPNRQPMQGTPGLLQDSNMHLEKSESTELACPLCRGQVKGWTVVEPVRDYLNAKKRGCMQDDCSFVGNYKELKKHVRAEHPSARPRMVDPADEQKWRWLEWEREREDVISTVTSAMPGAVVFGDYVIEGHHNDFDTDEEEGAGNAERNGRFQMGLEAMNFFLLYNEDTDGGVSLVSRLHRHGGGRVLLGRSGRRRRCREARARIGDS

SEQ ID NO: 97674 - protein, 163 aa, Glycine max
  Coding DNA Sequence Number=SeqID_5989
MKRNRRALAKNNSLWCKVLKSKYEELNRLGVGVSNKGSVWWKDISKCLRIQVKRCVVLEKWVDGCKGGGSGNSNGGGTSLNGKKNAERFHATHYPKNALMKSGYGNMTTVQYNMLNLRMHFCDKDMIMMTNHFFHCLWMMNIPSIIATFRWKVLLDNIQTKDN

SEQ ID NO: 97675 - protein, 169 aa, Glycine max
  Coding DNA Sequence Number=SeqID_5990
MGYLAGDTSVSDIEFTKLGEFGDGGGYCANDVGGVGDEKKFEVGKVAYGGGNRVGFGEVNFGEVEVVDAIYLKDVFLRPEQHRHITHQHVLRQVHKIKDELRQCLQNPPSEAVVRESYQLEGLREGAEGVRDGGRDAVAIEGDSVEVGDQREPKREVSGEVVIEEDNGF

SEQ ID NO: 97676 - protein, 497 aa, Glycine max
  Coding DNA Sequence Number=SeqID_5991
  Gene Ontology: Mol. function=protein kinase activity; Cellular component=plasma membrane; Biological process=protein amino acid phosphorylation
  Homolog annotation: Hit_ID=A7Q4W1; Match level="QueryCoverage=92%, HitCoverage=94%, E-value=1e-156, Identity=56%"; Hit description =Chromosome chr10 scaffold_50, whole genome shotgun sequence
  Pfam annotation: Domain name=LRR_1; Domain location=119-142; Score =4.4; E_value=46; Accession=PF00560.24; Description=Leucine Rich Repeat
  Pfam annotation: Domain name=LRR_1; Domain location=143-166; Score =13.7; E_value=0.68; Accession=PF00560.24; Description=Leucine Rich Repeat
  Pfam annotation: Domain name=LRR_1; Domain location=168-192; Score =9.0; E_value=6.5; Accession=PF00560.24; Description=Leucine Rich Repeat
  Pfam annotation: Domain name=Pkinase; Domain location=235-471; Score=- 95.5; E_value=0.0069; Accession=PF00069.16; Description=Protein kinase domain
  Pfam annotation: Domain name=Pkinase_Tyr; Domain location=248-471; Score=-160.2; E_value=0.013; Accession=PF07714.8; Description =Protein tyrosine kinase
  Pfam module annotation: Pfam domain module=LRR_1::LRR_1::LRR _1::Pkinase::Pkinase_Tyr; Domain location=119-142::143-166::168 -192::235-471::248-471
MVTISSTWYLFLPIILSLCPITLCASVLEDLKNLHQPPDFNSTIFSNCLKNPSLRYCSSSPMLDLDEIFKFTIVASHLCNESKNPNCVESFPKVDLRNRPNIAPLYLSFDFFWKYCPLSIMSIDLSNNSMKGDFPTDVLYCTQIQSLDLSINAFSGDIPIQSFSPLTNLTFLNLSYNCFSESKLSDSQFFKRFNSSSFLHSGALLDQKRPDFLPSKLQRSRRFTPAILKAATNDFSNKYLVGKSDVVHIYKGILRDGTEVKIEMYWDDIPRDSYRKFVEECKVLSKLHHKNLVRFLGWCRSRKFRAIITEWTREENVEMWLSGSGPPWNHRLKVLMGVVACMRYLQEEWPEVDYELNTSSILLSDNVEPLISRFKVGDQNSNRRKIHGFGVFLLEMILSRKVQEEFDGGDAGFIRFMRTLNLADLKQMIDERMKVTETIFHQVKQALSLGLMCIDQSNSDKPSLAMIFNTIARAYKASHALPSANHRFKRHMPVQTK

SEQ ID NO: 97677 - protein, 200 aa, Glycine max
  Coding DNA Sequence Number=SeqID_5992
  Gene Ontology: Mol. function=DNA-directed DNA polymerase activity; Cellular component=nucleus; Biological process=DNA replication
  Homolog annotation: Hit_ID=A7PAZ6; Match level="QueryCoverage=28%, HitCoverage=48%, E-value=2e-18, Identity=75%"; Hit description =Chromosome chr16 scaffold_10, whole genome shotgun sequence
  Pfam annotation: Domain name=DNA_pol_delta_4; Domain location=2-112; Score=35.4; E_value=1.8e-08; Accession=PF04081.4; Description=DNA polymerase delta, subunit 4
MASVSGNIKGFYRQKKTTATKKSSKKSPIPAAAQSPALISHGGKPDLEDEYKESEVALRQFDLNMAYGPCLGMTRLARWERAQRLGLNPPQEIDRLLKSGKGWAKASVSDFRVVHCGDEFYQGWAKAKFSFKPMASPATRNSINWSPPISGHLKCNLDAGFAHGTNITEMGCCVRNHVVALVASYMNSRSPCMDVKEGET

SEQ ID NO: 97678 - protein, 565 aa, Glycine max
  Coding DNA Sequence Number=SeqID_5993
  Gene Ontology: Mol. function=transporter activity; Cellular component= integral to membrane; Biological process=transport
  Homolog annotation: Hit_ID=A5B003; Match level="QueryCoverage=92%, HitCoverage=73%, E-value=2e-86, Identity=38%"; Hit description =Putative uncharacterized protein
  Pfam annotation: Domain name=Ank; Domain location=115-150; Score =30.9; E_value=4.6e-06; Accession=PF00023.21; Description=Ankyrin repeat
  Pfam annotation: Domain name=Ank; Domain location=164-196; Score =17.4; E_value=0.054; Accession=PF00023.21; Description=Ankyrin repeat
  Pfam annotation: Domain name=Ank; Domain location=198-230; Score =10.3; E_value=1.1; Accession=PF00023.21; Description=Ankyrin repeat
  Pfam annotation: Domain name=Ank; Domain location=231-266; Score =12.9; E_value=0.44; Accession=PF00023.21; Description=Ankyrin repeat
  Pfam annotation: Domain name=Ank; Domain location=267-299; Score =10.3; E_value=1.1; Accession=PF00023.21; Description=Ankyrin repeat
  Pfam annotation: Domain name=Ank; Domain location=301-333; Score =21.4; E_value=0.0034; Accession=PF00023.21; Description=Ankyrin repeat
  Pfam annotation: Domain name=Ank; Domain location=335-367; Score=8.2; E_value=2.1; Accession=PF00023.21; Description=Ankyrin repeat
  Pfam annotation: Domain name=Ank; Domain location=371-403; Score=1.5; E_value=20; Accession=PF00023.21; Description=Ankyrin repeat
  Pfam module annotation: Pfam domain module=Ank::Ank::Ank::Ank::Ank::An k::Ank::Ank; Domain location=115-150::164-196::198-230::231-266::267 -299::301-333::335-367::371-403
METETIANQAEATDLDENMSAPPSPSLHDIGGGSNKNITCRIDGALYFAAVEGNFQEFINIHNLENLLTPNKNTILHIHLTSTTSKSGKTTPASAQFVTQILVKCGRLVLLPNAKGETLLHVAARYGHSNIAKLLLEHAKAKISPDIENGVGADQKFIRATNDELDTALHEAVRYDHIEVVKTLLEMDPDYSYYANNAKETPLYLASERQNLQVVREILKKVKSPSYDGPNNQTALHAAVINQDIAMARDLLKNEHVRVAVKLADKKGWVPLHYAVKTRNAVLTKLLLKEDENTAYMQDNEGRTALHIAADSDSRRIVKMIIKYYPDCSEIVDNKGWNALHYAVNGGKQNTIRRIMRNLYLSNLYNEKDVDGNTPLHYLPNSNLVACHKLVGHPRVDKLAVNKKDQTVLDVAYVKTEDPDPESDKRTREGQIVLLEMAGAKRSLRLDQKSKNGLNGLVFPKEAKQTHLLVATLITTVSFAAGITLPGGTIQDGELKGTPLLGHKTSFKAFMASNTIAMVLASTAAFINLFTPLTKTKWKDYYFSKAALIFTLTALVTMIVAFATG

SEQ ID NO: 97679 - protein, 536 aa, Glycine max
  Coding DNA Sequence Number=SeqID_5994
  Gene Ontology: Mol. function=oxidoreductase activity; Cellular component=anchored to membrane; Biological process=electron transport
  Homolog annotation: Hit_ID=Q9AYM8; Match level="QueryCoverage=100%, HitCoverage=100%, E-value=0.0, Identity=71%"; Hit description=CPRD2 protein
  Pfam annotation: Domain name=BBE; Domain location=473-531; Score =102.3; E_value=1.5e-27; Accession=PF08031.3; Description=Berberine and berberine like
  Pfam annotation: Domain name=FAD_binding_4; Domain location=76-215; Score=89.7; E_value=9.5e-24; Accession=PF01565.14; Description=FAD binding domain
  Pfam module annotation: Pfam domain module=BBE::FAD_binding_4; Domain location=473-531::76-215
  Subcellular localization annotation: CTP_CleavageSite=84; ConfidenceScore=5.00e-01
MMHLSLYFTVVAIALLFSFTSSSADTHENFVQCLYNYPNSGTSISKVVYTQTNSSYTSTLDSSIQISRFLNASSKPLVIVTPLVISHVQVTIICSQHHGMQIRTRSGGHDYEGLSYIAKDPFVVLDLKNLREIKVDVEKSNAWVQAGSTIGELYYSISQKSKTLGFPAGVCPTVGTGGHFSGGGYGFLMRKYGLAADNVIDAHIVDVKGNLLDRKAMGEDLFWAIRGGGGASFGVIVAWKIKLVPVPSKVTVFRIARTLEQNATEIIRKWQLVANKFDQRLIIRVAMTRVNSSQRGKLTIQARFESMFLGRVDQLIPLMQKRFPELGLVKEDCTEMSWINSILFMKAGLVGSASNETLEVLLNRTQAVFLTFKGKSDYVRKPISVVGLRGLWRLFYEDEARDASVEFAPYGGRMDEISESEIPFPHRSGNMFHIHYAVYWQEEGDEAAQRYINWLRRLYKYMEPYVSKSPRAAYLNYRDLDIGVNNNYDYTSYRQASIWGLKYFNNNFKRLAKVKVKVDPQNFFRNEQSIPLLESE

SEQ ID NO: 97680 - protein, 538 aa, Glycine max
  Coding DNA Sequence Number=SeqID_5995
  Gene Ontology: Mol. function=oxidoreductase activity; Cellular component=anchored to membrane; Biological process=electron transport
  Homolog annotation: Hit_ID=Q9AYM8; Match level="QueryCoverage=98%, HitCoverage=99%, E-value=0.0, Identity=69%"; Hit description=CPRD2 protein
  Pfam annotation: Domain name=BBE; Domain location=471-529; Score =113.4; E_value=6.6e-31; Accession=PF08031.3; Description=Berberine and berberine like
  Pfam annotation: Domain name=FAD_binding_4; Domain location=78-217; Score=101.8; E_value=2.1e-27; Accession=PF01565.14; Description=FAD binding domain
  Pfam module annotation: Pfam domain module=BBE::FAD_binding_4; Domain location=471-529::78-217
  Subcellular localization annotation: CTP_CleavageSite=51; ConfidenceScore=5.13e-01
MMRLSSYFVVAIALLFSFTPSSSANTHENFVQCLYNYPHNNNVTSISNVVYTQANSSYSSILDFSIQNLRFSNASSKPLVIVTPLTVSHIQATIICSQRYGMQIRTRSGGHDYEGLSYVAKDPFVVLDLINLRKIEVDAENSTAWVLAGATIGELYYSISQKSKTLGFPAGVCPPVGTGGHFSGGGYGFLMRKFGLAADNVIDAHIVDVKGNLLDREAMGEDLFWAIRGGGGASFGVIVAWKIKLVSVPSTVTVFRVPRTLEQNATEIVHKWQLVANKLDEDLTIRINFGRATSENGNLTVQAQFESMYLGGVDQLIPLMQESFPELGLVREDCIETSWIGSILYMAGFTNGESTDVLLNRTQANGVSFNKGKSDYVRDPIPDVGLEGLWPFFFEDEGQSSFVQFTPYGSRMDEISESEIPFPHRAGNIFHIQYGVSWQEEGDEEAQRHINWIRRMYSYMETYVSKSPRAAYLNYRDLDIGVNNNKGYTSYSQASVWGLKYFKNNFNRLARVKTNVDPLNFFRNEQSIPSLVSKGRKL

SEQ ID NO: 97681 - protein, 779 aa, Glycine max
  Coding DNA Sequence Number=SeqID_5996
  Gene Ontology: Mol. function=catalytic activity; Cellular component =nucleus; Biological process=metabolic process
  Homolog annotation: Hit_ID=A7P8S8; Match level="QueryCoverage=77%, HitCoverage=96%, E-value=0.0, Identity=72%"; Hit description =Chromosome chr3 scaffold_8, whole genome shotgun sequence
  Pfam annotation: Domain name=PPR; Domain location=211-245; Score =14.1; E_value=0.17; Accession=PF01535.11; Description=PPR repeat
  Pfam annotation: Domain name=PPR; Domain location=277-311; Score =31.8; E_value=2.5e-06; Accession=PF01535.11; Description=PPR repeat
  Pfam annotation: Domain name=PPR; Domain location=375-409; Score =36.3; E_value=1.1e-07; Accession=PF01535.11; Description=PPR repeat
  Pfam annotation: Domain name=PPR; Domain location=474-508; Score =41.6; E_value=2.9e-09; Accession=PF01535.11; Description=PPR repeat
  Pfam annotation: Domain name=PPR; Domain location=545-579; Score =12.8; E_value=0.24; Accession=PF01535.11; Description=PPR repeat
  Pfam annotation: Domain name=PPR; Domain location=611-645; Score=4.3; E_value=2.4; Accession=PF01535.11; Description=PPR repeat
  Pfam module annotation: Pfam domain module=PPR::PPR::PPR::PPR::PPR::PP R; Domain location=211-245::277-311::375-409::474-508::545-579::611 -645
MGEDLFWAIRGGGGASFGVIVSWKIMLVPVLQYVADKIHDGLFIRVILSPLTRKWGLRLMFCFKGMLQKENFLKKKSDDVQYMEDDDETRKACFHFNPYGGKMGEISEFETPFPHRAGNIYEIQYSVSWNEEGEDVANQYLDVDIGVDGPGNATYAQASVWGRNVNSSLVSPHYVPPETESLLNHCYRRDLPSAMHVLDSMERRGVWADSITYSELIKCCLAHGAVREGKRVHRHIFSNGYHPKTFLTNILINMYVKFNLLEEAQVLFDKMPERNVVSWTTMISAYSNAQLNDRAMRLLAFMFRDGVMPNMFTFSSVLRACERLYDLKQLHSWIMKVGLESDVFVRSALIDVYSKMGELLEALKVFREMMTGDSVVWNSIIAAFAQHSDGDEALHLYKSMRRVGFPADQSTLTSVLRACTSLSLLELGRQAHVHVLKFDQDLILNNALLDMYCKCGSLEDAKFIFNRMAKKDVISWSTMIAGLAQNGFSMEALNLFESMKVQGPKPNHITILGVLFACSHAGLVNEGWYYFRSMNNLYGIDPGREHYGCMLDLLGRAEKLDDMVKLIHEMNCEPDVVTWRTLLDACRARQNVDLATYAAKEILKLDPQDTGAYVLLSNIYAISKRWNDVAEVRRTMKKRGIRKEPGCSWIEVNKQIHAFILGDKSHPQIDEINRQLNQFICRLAGAGYVPDTNFVLQDLEGEQREDSLRYHSEKLAIVFGIMSFPKEKTIRIWKNLKICGDCHKFAKLIAELEQRHIVIRDPIRYHHFQDGVCSCGDYW

SEQ ID NO: 97682 - protein, 115 aa, Glycine max
  Coding DNA Sequence Number=SeqID_5997
MVEEPQIENSDMKDGNDQFECLTTYNAFVKYYSEQLKNAIEILRQENLDAFLWVKLRLSKHVVERVKKRLSFELQNVTVWLSSAVGLSTYPPLSAASARLAQRRIWQSINIKVAR

SEQ ID NO: 97683 - protein, 108 aa, Glycine max
  Coding DNA Sequence Number=SeqID_5998
  Gene Ontology: Mol. function=ATP-dependent DNA helicase activity; Cellular component=nucleus; Biological process=double-strand break repair via nonhomologous end joining
  Homolog annotation: Hit_ID=Q8S563; Match level="QueryCoverage=95%, HitCoverage=15%, E-value=1e-44, Identity=87%"; Hit description=KAP-2
MARNKEALLLLLDVGPSMHPALSEIEKVCSMLVHKKLIYSKYDEVGIVLFGTEDTNNELTTEVGGYQHVVVLKNIKVVDGDIVEALQQLPRGTTDGDCIHEVLGFILC

SEQ ID NO: 97684 - protein, 153 aa, Glycine max
  Coding DNA Sequence Number=SeqID_5999
  Homolog annotation: Hit_ID=A2Q323; Match level="QueryCoverage=69%, HitCoverage=22%, E-value=2e-13, Identity=37%"; Hit description=IMP dehydrogenase/GMP reductase, related
  Pfam annotation: Domain name=DUF1723; Domain location=69-118; Score =58.7; E_value=2e-14; Accession=PF08330.1; Description=Protein of unknown function (DUF1723)
MQIMVRTRGLGRALGRTIGKALKRRDERPELKLSSHGRKMTKFGRPAPEIKGLVVASGLSPLIACSLDTGDRGLMSAFVEHWHKETNNFHLPIGEVTITLDDVASLLHLPVVGAFHSFELLHVDDAVDMLVELLEVSAVEARAETIQCHDSYV

SEQ ID NO: 97685 - protein, 231 aa, Glycine max
  Coding DNA Sequence Number=SeqID_6000
  Pfam annotation: Domain name=DUF1723; Domain location=1-40; Score =18.4; E_value=0.0035; Accession=PF08330.1; Description=Protein of unknown function (DUF1723)
MERWHKETSSFHLPIREVTITLDDVVLLLHLPIIGAFHSFEQLHVDDVVDMLVELLEVIIVESGSYAWGAVALVHMYDNLNEALKSKTRQLHFPSIGSALVVEDYDKRRPRACQWTSGKALPVSTYRRRLDRLTPNGPLTVIHRPERVFSDYITPVGQICVVPSQCSPDYMDGFYMISHPFMSPTQPRDPPRVSPVQEYDTFVEPDVHQQPVEAATPDEVDADVHHLGHAV

SEQ ID NO: 97686 - protein, 142 aa, Glycine max
  Coding DNA Sequence Number=SeqID_6001
MGRFSKKFTQGDSFGRKTHAWCKQTANGTGGFAVGEGLATTSGDMHMQPEELTIRSGDMHSKGNRQFDWRVPTTRRWMWNSASLALLSSSSSYYSSSSYYFNTLRFFLFSFWTVFVPLAIRWFLLLRAIMWFLLLLLRDFSI

SEQ ID NO: 97687 - protein, 42 aa, Glycine max
  Coding DNA Sequence Number=SeqID_6002
MSEEVDMNVENERDAGVKVEHVDCSDAFNTSQLFASHDQVLH

SEQ ID NO: 97688 - protein, 401 aa, Glycine max
  Coding DNA Sequence Number=SeqID_6003
  Homolog annotation: Hit_ID=A5BK17; Match level="QueryCoverage=45%, HitCoverage=14%, E-value=1e-17, Identity=28%"; Hit description =Putative uncharacterized protein
  Subcellular localization annotation: CTP_CleavageSite=46; ConfidenceScore=5.56e-01
MASTNSSATPANDSGPTPANNSGATPLDAVPMNQDVSSSFPMKFFASNHRKQIKPVIAALGLNYFVVTPQIPPQYLSDEDHDLHRINPLFLIKQKQDQFLLVWLQPMLSSSMLPRVLGSRHSYQVCDKIYAYFHHQMRTKARQLRPELRQTTLDNCSVFDFLSQIKHMDAILEGLPRDFDSIITLIESRLPHITIEEAEGYILVQELHLRKYTRLESSSFGGRNGRGRGGFNCIRGRGGGRSGRSSVQCQYQAANGGNDSNYGNNNHNNWSHNQNQKQNWGQNQNQNNNWNNSSNSNWSSQKSQNQNHNSQNSITRPPQAMVANFDSNASSSWFPDFGASFHVTNNSEHLANFSFFWVQTRSSLVMDKDSNKSFFKEMLNLMTSTSFPIFSFDLICLLQLA

SEQ ID NO: 97689 - protein, 108 aa, Glycine max
  Coding DNA Sequence Number=SeqID_6004
MGSFSESGWEWSFSWRRNLFDNEMGRASEFIDQTAAISPSASLKDSWVWGADPKGIFSTNSAYLHVKVDHLDEDQCLGFQHLWNIKIPPRALVFAWRLLWDRLPTKDI

SEQ ID NO: 97690 - protein, 380 aa, Glycine max
  Coding DNA Sequence Number=SeqID_6005
  Pfam annotation: Domain name=Chromo; Domain location=288-338; Score =20.4; E_value=0.0016; Accession=PF00385.15; Description='chromo' (CHRromatin Organisation MOdi
MAVWKCLTVIVMLPSMLGNAVMTIFVRLTVFLPIVSRMLLLEPRILVAKPAPRGGWPTLILKQSNLKQTELVFRLCGLLTTRIPSNRRSPMTAAATCIAIPQDPRKLMKQIECVARVRMLTTMIIERCGASIGTTPTRPLPCRTCNRQPLMIWCVVILKKLSYLKVQPVGSEPSNLGTSSFRRCVEPVTVGVCPAEEDDGVYDADNFAMSQELPRLTPWTICSVREKQCLRCFVGIATSTSDFGLKHHLLEAHQEVLWAFSNLGPNGQDPPHDSTDLPPVAVDNDPVVTPLAIITPKLIPSKRGPTRMVLVQWKDLPLEEASWEEWSSFKALHHLEEKVLFEGEGNVTNREEGLQEVREQQREERPKRKTKAPTYMEDYV

SEQ ID NO: 97691 - protein, 86 aa, Glycine max
  Coding DNA Sequence Number=SeqID_6006
RSTAGDLIPIDLEINTTCRRRNSERIRIFLQDLEAVETPEEEPRSFKASSSFPIAGHSHIEPVEDPIVAEEPRRVTLEDYSSSTMP

SEQ ID NO: 97692 - protein, 31 aa, Glycine max
  Coding DNA Sequence Number=SeqID_6007
MPKEKLEEYQGITRDAAITIERHVSPLRGKG

SEQ ID NO: 97693 - protein, 364 aa, Glycine max
  Coding DNA Sequence Number=SeqID_6008
MVGGSDYGSNSGGDDSDRGGIVTATMVAQRQCGSSGGSDAGDGGGNSNGGGNENSGRAAKARYDSNDGGGGMVEAIVVVVQTRTTGCGGGGMVTVEVAVRWRWQCGAVAEKEVQDTLTVSSIAKSVNKETIDLDMPVSTTNASNAGAAENLEEQEDTQSHSESSPLKQMSLPEPMLEENTVEVDSNLDHFMNYETKQHPPTAKEELPYINPVVAFVSIPIVKTNEPIIYQSIIPNYKCRKSLRRDSPIDVDPFAFIDVLSSNSMPSEASESSHNRPFTHFDKVVASQHTTDIAEIESSIELDRNKLIQAKEGFEKAKENLMLIEGLIEKTERYEAELVKKEDLLANLNPIQDEPHSTRFNLAEL

SEQ ID NO: 97694 - protein, 140 aa, Glycine max
  Coding DNA Sequence Number=SeqID_6009
  Homolog annotation: Hit_ID=Q69F85; Match level="QueryCoverage=32%, HitCoverage=2%, E-value=6e-08, Identity=53%"; Hit description=Gag -pol polyprotein
MEADIPLGWKPLNLERYDGTTDPDEHLDAFLTQANLYTNDDAILCRVFPAKGYIQMEEMSRFRNEVRQAEQKRGKRKGNTKANLHRKNKRHKLDKCQPFPRGPRYKHYTPLTTNRTTILEEAFNLDVPIRLPQTKPPGQG

SEQ ID NO: 97695 - protein, 70 aa, Glycine max
  Coding DNA Sequence Number=SeqID_6010
MTWRNSPGNSSSAGEKLPNYDQSGDTIQRFNHEPFNSVTSYCESKVKPKKIPEWESLAPTGKVPQGYNQP

SEQ ID NO: 97696 - protein, 96 aa, Glycine max
  Coding DNA Sequence Number=SeqID_6011
MEEELIKCLRHNKDAFAYKAQDMSGIHPNFIEHKLFTESGCKAGSLEKEFGDDKRKTIKQRIKLNVLMMPKVHMRLKALFKIKKLKIFKMDDQDSL

SEQ ID NO: 97697 - protein, 153 aa, Glycine max
  Coding DNA Sequence Number=SeqID_6012
MAHTKTTGQKKAPPQEAKVKLVEPDQEFSDAISHEFYVIAFLSKARMQFLSSTTLFATFASCMTHTPSTPIWRYLLPGRVLFLSTMNGYTIPTITKKWQMCFCALAASFEVEMREMWADIADNNHAIGMVMDSLRGFSLHTSIGAANLYHCPS

SEQ ID NO: 97698 - protein, 85 aa, Glycine max
  Coding DNA Sequence Number=SeqID_6013
MALGYFLSSILVKLVNSATKNITARCDNTQKGTASLGRDGANNTQRGGQGGATMYGSFCGGHGGERDIQANTRRQLIVEFSETGI

SEQ ID NO: 97699 - protein, 86 aa, Glycine max
  Coding DNA Sequence Number=SeqID_6014
MYIFLSNYCKLHFGRRAAQGSRVRLPRAEGARSRHQHLFEENVGKTGTCGLRTLIVKGSGVVFTHGEGCFPCSYIFLNCDEEIRPT

SEQ ID NO: 97700 - protein, 290 aa, Glycine max
  Coding DNA Sequence Number=SeqID_6015
  Gene Ontology: Mol. function=oxidoreductase activity, acting on the CH-OH group of donors, NAD or NADP as acceptor; Cellular component =glycerol-3-phosphate dehydrogenase complex; Biological process =glycerol-3-phosphate catabolic process
  Homolog annotation: Hit_ID=P52425; Match level="QueryCoverage=97%, HitCoverage=84%, E-value=1e-136, Identity=78%"; Hit description =Glycerol-3-phosphate dehydrogenase [NAD+]
  Pfam annotation: Domain name=NAD_Gly3P_dh_C; Domain location=132-283; Score=282.9; E_value=6.4e-82; Accession=PF07479.5; Description=NAD -dependent glycerol-3-phosphate deh
  Pfam annotation: Domain name=NAD_Gly3P_dh_N; Domain location=2-115; Score=84.1; E_value=4.6e-22; Accession=PF01210.14; Description=NAD -dependent glycerol-3-phosphate de
  Pfam module annotation: Pfam domain module=NAD_Gly3P_dh_C::NAD_Gly3P _dh_N; Domain location=132-283::2-115
MNPDEVRMWVYEETLRSGEQLTDVINRTNENVKYLPGIKLGKNVVADPDLESAVKDSNMLVFVTPHQFMEGICKRLVGKIREDSEAISLVKGMEIAVEKFSEATVGYRLNREVAERWVQLFYTHYFIVTAVQDVEGVELCGTLKNVVAIAAGFVDGLEMGNNTKAAIMRLGLREMKAFSKLLFPSVKDSTFFESCGVADLITTCLGGRNRKVAEAYARNGGKRSFDEVEAEMLQGQKLQGVSTASEVYEVLSHRGWLELFPLFSTVHEISTGLLPPSAIVEYSEKLPKSF

SEQ ID NO: 97701 - protein, 45 aa, Glycine max
  Coding DNA Sequence Number=SeqID_6016
MAEQPGVHRGHNATMSRERQLGRRSKVVGLVVKESRTCRDKMTTK

SEQ ID NO: 97702 - protein, 143 aa, Glycine max
  Coding DNA Sequence Number=SeqID_6017
  Gene Ontology: Mol. function=hydrolase activity, acting on ester bonds; Biological process=lipid metabolic process
  Homolog annotation: Hit_ID=A2YY91; Match level="QueryCoverage=41%, HitCoverage=14%, E-value=6e-19, Identity=72%"; Hit description =Putative uncharacterized protein
MDMEASLWHLRLSHISEKGLNCLAKKDMLPRLKNANLEKCSHCMVVNTPTPHPKVQFNMATLSSFASLAILSLVLVIGVIISRAEAKPRAFFVFGDSLVDNGNNNYMATTTCVDAPPYGIDYPPSHRPTGCFSNGYNIPNLIS

SEQ ID NO: 97703 - protein, 98 aa, Glycine max
  Coding DNA Sequence Number=SeqID_6018
MLAEKLLHKSDYDIDSEILSYPNFVRGPSVVGMRPSFDHFEGKMFSPPDNSRSLEISEKNCFREENSSQGVSVGDFAKIFNRSSTFFVRSSSFFSLQP

SEQ ID NO: 97704 - protein, 161 aa, Glycine max
  Coding DNA Sequence Number=SeqID_6019
  Gene Ontology: Mol. function=nucleoside-triphosphatase activity; Cellular component=integral to membrane; Biological process=protein catabolic process
  Homolog annotation: Hit_ID=A5AIR5; Match level="QueryCoverage=71%, HitCoverage=16%, E-value=4e-13, Identity=41%"; Hit description =Putative uncharacterized protein
MSNWNHRGCSSETEITTGAAMDLQQIKQIARHMVTKFGVLEIGPWALTDPAVEGHHVDLKLVAHSHAPPGIRTIPPSPKWLSTSHGCIEAHLIDNSELVGFIITKIDEYWQLKQVYRGNALAALISSIKQLPNNLKPLKLQMKALSLLRSIFPLYLEEIEQ

SEQ ID NO: 97705 - protein, 114 aa, Glycine max
  Coding DNA Sequence Number=SeqID_6020
  Gene Ontology: Mol. function=ubiquitin protein ligase binding; Cellular component=cullin-RING ubiquitin ligase complex; Biological process=ubiquitin-dependent protein catabolic process
  Homolog annotation: Hit_ID=A7NW32; Match level="QueryCoverage=97%, HitCoverage=14%, E-value=2e-47, Identity=83%"; Hit description =Chromosome chr5 scaffold_2, whole genome shotgun sequence
MVYKELNGKVRDVVISLIDQEQEGEHIDRALLKNVLDIFVEIGMGQMDHYENDFEATMLKDTSFYYSRKALNWILEDSCLDYMLKAEECLKWEKDKVAHYLHSSSKPKLLEVFY

SEQ ID NO: 97706 - protein, 24 aa, Glycine max
  Coding DNA Sequence Number=SeqID_6021
MASNRKSSSWARGGGEGSRKRVKW

SEQ ID NO: 97707 - protein, 354 aa, Glycine max
  Coding DNA Sequence Number=SeqID_6022
  Gene Ontology: Mol. function=hydrolase activity, acting on ester bonds; Cellular component=nucleus; Biological process=lipid metabolic process
  Homolog annotation: Hit_ID=A7PZ35; Match level="QueryCoverage=90%, HitCoverage=93%, E-value=1e-142, Identity=73%"; Hit description =Chromosome chr4 scaffold_39, whole genome shotgun sequence
  Pfam annotation: Domain name=Lipase_GDSL; Domain location=34-329; Score=169.3; E_value=1e-47; Accession=PF00657.13; Description=GDSL -like LipaseAcylhydrolase
  Subcellular localization annotation: CTP_CleavageSite=55; ConfidenceScore=5.09e-01
MAILSSFAPLTILSIVLLVVGVIVTGAKARPRAFFVFGDSLVDSGNNNYLATTARADAPPYGIDYPPSQRLGAESTLPYLSPELRGDKLLVGANFASAGIGILNDTGIQFVNVIRMYRQLEYFKEYQNRVSALIGASEATNLVKQALVLITVGGNDFVNNYFLVPNSARSRQYPLPQYVKYLISEYQKILQRLYDLGARRVLVTGTGPLGCVPSELAQRGRNGQCAPELQQAAALFNPQLEQMLLQLNRKIGSDVFIAANTGKAHNDFVTNPRQFGFVTSQVACCGQGPYNGLGLCTALSNLCSNRETYAFWDAFHPSEKANRLIVEEIMSGSKAYMNPMNLSTILALDANTGR

SEQ ID NO: 97708 - protein, 125 aa, Glycine max
  Coding DNA Sequence Number=SeqID_6023
  Homolog annotation: Hit_ID=Q2HTK5; Match level="QueryCoverage=56%, HitCoverage=28%, E-value=3e-09, Identity=42%"; Hit description=H+ -transporting two-sector ATPase, alpha/beta subunit, central region
MLWKVDSSSVYSTKSAYRLLLTTNSQLPEANIYKTIWNLNIPPRAVIFSWRLLKDRLPTRYNLLRRNVSISDQLSQQLILPNSVMILEMGRIIKDGVDGGLHYEAQYGSIGISWYSKATGLIQPK

SEQ ID NO: 97709 - protein, 76 aa, Glycine max
  Coding DNA Sequence Number=SeqID_6024
  Homolog annotation: Hit_ID=A7NX21; Match level="QueryCoverage=59%, HitCoverage=17%, E-value=9e-07, Identity=53%"; Hit description =Chromosome chr5 scaffold_2, whole genome shotgun sequence
MFVYMHVQDKVVTENELFEKMKVEAEKCLTQTERIANERLEFESEIYAKHGSACVKKAQWSLHLTQWSLQTSEAIN

SEQ ID NO: 97710 - protein, 149 aa, Glycine max
  Coding DNA Sequence Number=SeqID_6025
  Gene Ontology: Mol. function=carbon-nitrogen ligase activity, with glutamine as amido-N-donor; Cellular component=chloroplast
  Homolog annotation: Hit_ID=A7QIF4; Match level="QueryCoverage=65%, HitCoverage=16%, E-value=9e-38, Identity=72%"; Hit description =Chromosome chr12 scaffold_103, whole genome shotgun sequence
MGLLQLLHMCPNSKSHPRIDLVCTCHYIAALKTGCLTLHNYICKHGCVRIPASFCGIFGFRPSHGAVSTIGVLPNAQSLDTIGWFARDPSILHRVGHVLLQLNSVETKRSRHFIFADDLFQLSKIPTQNTIYVIGKAIENMSGCKFLDL

SEQ ID NO: 97711 - protein, 200 aa, Glycine max
  Coding DNA Sequence Number=SeqID_6026
  Gene Ontology: Mol. function=catalytic activity; Cellular component =plasma membrane; Biological process=protein amino acid dephosphorylation
  Homolog annotation: Hit_ID=A7NUY4; Match level="QueryCoverage=74%, HitCoverage=52%, E-value=3e-65, Identity=82%"; Hit description =Chromosome chr18 scaffold_1, whole genome shotgun sequence
  Pfam annotation: Domain name=PP2C; Domain location=23-199; Score= -6.3; E_value=1.5e-05; Accession=PF00481.12; Description=Protein phosphatase 2C
MVVGGRSSCNSGKGKSSQSSVKYGYSLVKGKANHPMEDYHVAKFVQFKGRELGLFAIYDGHLGDSVPAYLQKHLFSNILKDEDFWNDPFMSISNAYETTDQAILSHSPDLGRGGSTAVTAILINNQKLWVANVGDSRAVVSRGGVAGQMTTDHEPNTERGSIETRGGFVSNMPGSSINPVALDVTMLIYLFILWDFIHIV

SEQ ID NO: 97712 - protein, 950 aa, Glycine max
  Coding DNA Sequence Number=SeqID_6027
  Gene Ontology: Mol. function=calcium ion binding; Cellular component =nucleus; Biological process=regulation of transcription, DNA -dependent
  Homolog annotation: Hit_ID=Q6NPP4; Match level="QueryCoverage=91%, HitCoverage=84%, E-value=0.0, Identity=45%"; Hit description =Calmodulin-binding transcription activator 2
  Pfam annotation: Domain name=Ank; Domain location=636-668; Score=1.3; E_value=21; Accession=PF00023.21; Description=Ankyrin repeat
  Pfam annotation: Domain name=Ank; Domain location=669-701; Score =31.3; E_value=3.5e-06; Accession=PF00023.21; Description=Ankyrin repeat
  Pfam annotation: Domain name=CG-1; Domain location=15-110; Score =134.0; E_value=4.3e-37; Accession=PF03859.7; Description=CG-1 domain
  Pfam annotation: Domain name=IQ; Domain location=845-865; Score=23.4; E_value=0.00085; Accession=PF00612.18; Description=IQ calmodulin -binding motif
  Pfam annotation: Domain name=TIG; Domain location=435-521; Score =13.2; E_value=0.046; Accession=PF01833.15; Description=IPTTIG domain
  Pfam module annotation: Pfam domain module=Ank::Ank::CG-1::IQ::TIG; Domain location=636-668::669-701::15-110::845-865::435-521
MPSSIIYQSADLQQLQLEAQHRWLRPAEICEILRNYQMFQITSEPPNGPPSMVSAYATDRFINATYVGSVDVLHCYYAHGEENENFQRRSYWMLEPDMMHIVFVHYLDVKVNKTNVGGKTYSDEVTSDSQKSSSLSSGFPRNYGSVPSGSTDSMSPTSTLTSLCEDADSGDHGQLPVSGAEYIPHVLGDKSRASDTTYIEGQRAQGIASWDNTMEQSAGEYADPSLVSSTTIPSSAVGNILEENHTVPGKLLGRKNALTEEERGSQPVQSNWQIPFEDNTGELPNWGFTQSLGLEFGSDYGASLLGDVTNNAGPEIVPELFTFNGELKEQSVHQNFSKLYTHGQSQPTLKSNSEYEVPGEASINYALTMRRGLLDGEESLKKVDSFSRWMTKEFAGVDDLHMQSSPGISWSTDECGDVIDDTSLNLSLSQDQLFSINDFSPKWAYAESEIEVLIVGTFLKSQPVVAKCNWSCMFGEVEVPAEVLADGILCCQAPPHKIGRVPFYVTCSNRFACSEVREFEYREGFDRNIQFADCFNNSTEMVLHLRLVGLLSLNSVRTSNQVFEGDMDKRSLIFKLISLKEEEEYSSKEETTAEMDISKHKLKELMFHKQVKEKLYSWLLHKVTETGKGPLVLDEEGQGVLHLIAALGYDWAINPIITAGVNINFRDVNGWTALHWAAFCGRERTVAVLVSMGAAAGAWTDPCPEFPSGRSPADLASSKGHKGISGFLAESLLTGHLESLTMDENKDGRKETSGTKVVQTASERTATPVLYGDIPDAICLKDSLNAVRNATQAADRIYQVFRMQSFQRKQFAQYEDDEFGLSDQQALSLLASKTCKSGQGEGLANAAAIQIQKKFRGWTKRKEFLIIRQRIVKIQSQRTSPGAAVKLCLGDLLVMGSNPETVSLHMQVSPDNIALEGSIDENLGFKYFAISVCPLYNLHARRDHVGCQYW

SEQ ID NO: 97713 - protein, 176 aa, Glycine max
  Coding DNA Sequence Number=SeqID_6028
MVSPQGRNTWTVDDLVPYLDKLAIISEEQERITEPVSHGPASEREFPAQEFHILQSSVETRGIGRRRELVEAEQYSQQMMERGHHTDTSASEHSFDGVAETQPHFSWPTMTHSQQHDAPMATPNALFAPQWNVPGAIPDMGDLLGVDLRQEFSAEAEQAEAGRQRGRRNPDRQARR

SEQ ID NO: 97714 - protein, 332 aa, Glycine max
  Coding DNA Sequence Number=SeqID_6029
MSSTTENVTVVVHYDAYVTECAIGIEFKGEKNVLVSMKRGMTFNALKTKIQQKMDLNQGQTITIVILSIPRNFKLLVQYEQQPFSTTNVETTIPSPQIHQTQYTDYHTQSYREGPSSYTPIPYMPTNDYYIPHFEPTEFDAHISSYTQLLSGSSNYSVTAPQLLNLNEPSHPNAQPTSKIHVAQSQSNEMSHDYHVENGLSEEVFGDFSDHEDKNLVDNDDNNINDNDDNDIQFLFQPTTTENVYRPYPNYADVGDNQGSLLNQSQTYQGNPCGVYPNLSSFIGSGVYPDLSSFTGSGVIQISLQEDNPHNTVWLDQIPREQWTLTWDDGKR

SEQ ID NO: 97715 - protein, 252 aa, Glycine max
  Coding DNA Sequence Number=SeqID_6030
  Homolog annotation: Hit_ID=A5B0E0; Match level="QueryCoverage=84%, HitCoverage=30%, E-value=6e-11, Identity=23%"; Hit description =Putative uncharacterized protein
APKLVVDKLVRLQRRFLWGGRLDQNKIAWIRWETVTSSKENGGLDIKDITNFNVALLDRPGLESVWWRDLKKALIHSPQGQIINSDMRWKQQKFIQQMESHKDNGWEWNFIWRRPCFDNEIDSTGVFLNEIQDMAIQYHGPDVWEWTADPTGQYTANSAYKVLMEGAVAVTQEDCFVKLWSIKVVDTSCPFCRDGEENAGHLFFQCRKIQPIWWEAMSWINLKGAAPLTPKMNFNHHMGLQADGVRSNRWQC

SEQ ID NO: 97716 - protein, 288 aa, Glycine max
  Coding DNA Sequence Number=SeqID_6031
  Gene Ontology: Mol. function=nucleic acid binding; Cellular component= nuclear speck; Biological process=regulation of alternative nuclear mRNA splicing, via spliceosome
  Homolog annotation: Hit_ID=O82021; Match level="QueryCoverage=35%, HitCoverage=35%, E-value=6e-51, Identity=98%"; Hit description =Putative arginine/serine-rich splicing factor
  Pfam annotation: Domain name=RRM_1; Domain location=18-89; Score =92.7; E_value=1.1e-24; Accession=PF00076.13; Description=RNA recognition motif. (a.k.a. RRM, RB
MSHFGRSGPPDISDTYSLLVLNITFRTTADDLFPLFDKYGKVVDIFIPKDRRTGESRGFAFVRYKYADEAQKAVERLDGRMVDGREITVQFAKYGPNAERISSVVVWGENGMPGEGRYYYMLVTKEGLLKHPQDQGDQGAVAQGKGIVMITETEIIGEEVAAEVMIGMNVTGIVGETKIIVAEVGAVVPVLITRVVVEDAMMMSVIVEAGADQLIAAPLHDAVLVLEGVPPLRGALPLKGVLPLGRVHGVKVLQIVAVRNVPLPLAVSHHAVALMLHEVLPLEIQTGM

SEQ ID NO: 97717 - protein, 805 aa, Glycine max
  Coding DNA Sequence Number=SeqID_6032
  Gene Ontology: Mol. function=potassium ion transmembrane transporter activity; Cellular component=integral to membrane; Biological process=potassium ion transport
  Homolog annotation: Hit_ID=A7QII3; Match level="QueryCoverage=91%, HitCoverage=94%, E-value=0.0, Identity=67%"; Hit description =Chromosome chr12 scaffold_103, whole genome shotgun sequence
  Pfam annotation: Domain name=K_trans; Domain location=97-781; Score =813.0; E_value=1.8e-241; Accession=PF02705.7; Description=K+ potassium transporter
MANPKTKSHHSLGGEDDPDSTESRWVFQEDEDPSEIEDFDAADLRHQSMFDSDDEDNAEQRLVRTGPRIDSFDVEALEVPGAHRNDYEDVSVGKGILLAFQTLGVVFGDVGTSPLYTFSVMFRKAPIKGNEDILGALSLVLYTLILIPLVKYVLVVLWANDDGEGGTFALYSLICRNAKVSLLPNQLRSDARISSFRLKVPSPELERSLKIKERLETSVTLKKILLLFVLAGISMVMANGVVTPAMSVLSSLNGLKVGVDAIKQDEVVMISVACLVILFSVQKYGTSKVGLAVGPALFIWFCSLAGIGSEAMFADLCYFSVQSVQLTFVFLVLPCLLLGYLGQAAYLMENHADAGNAFYSSVPSGAFWPTFLIANIAALIASRAMTTATFSCIKQSAALGCFPRLKIIHTSRKFMGQIYIPVINWFLLAVSLVLVCSISSIDEIGNAYGIAELGVMMMTTILVTLVMLLIWQIHIIVVLSFAVVFLGLELTFFSSVLWSVTDGSWIILVFAVIMFFIMFVWNYGSKLKYETEVKQKLSMDLMRELGCNLGTIRAPGIGLLYNELVKGIPGIFGHFLTTLPAVHSMIIFVSIKYVPVPMVPQSERYGYKDVRKENHQTFEQLLMESLEKFIRREAQERSLESEGDDDTDSEDEYSGSRVLIAPNGSVYSLGVPLLADFNDTTIPIPNFEASTSEEANPESPKPPVLDAEQSLERELSFIRKAKESGVVYLLGHGDIRARKDSWCLLEAFLLDPGENLNLKSNELVITPMELSPMRAPAIDGVSTVPFMGNNTPAAIGIPTCIKIEV

SEQ ID NO: 97718 - protein, 619 aa, Glycine max
  Coding DNA Sequence Number=SeqID_6033
  Homolog annotation: Hit_ID=A5ADE7; Match level="QueryCoverage=78%, HitCoverage=62%, E-value=2e-68, Identity=36%"; Hit description =Putative uncharacterized protein
GRENLLNLNQKERTEKANKPEDLLSPCDSDSCREHKKLTSDNTRMSDHCLKSSKVDSSSSELCADDTILGDKCVVEDDSVSQYSINHISQTDNELSFLDNDGWLNIGNFEDVDRMMLSCDLTFGMESLNNEEEFCWLRSSNGTEGSDDALKSAFKFSSAEASLLKSISDYNIDTNENMEGLPINDGNNKASPIDKKLRSRMNANHDDVPSSLSTFHESAMKSGNRDDLMAKLKMEGNLLKTSAGKRKNGYLGHGDFDLPYAQVEQYANLKQSFGASSSGVTSQDSIHKHRPDMDSNSLGHIQIQTDLMDPGYCHTSNYTSLLPTLSGSRSGHDGHPSPSFKESSFAPNMESSNAHKLDAVALKTKNERENLYFCHDAQLISPRFKSGNMGNPEPFKSPGSAQKVGHQFENENEGHSEVGEISIRFSQEIDSSNVQESSSMSSALDEASLETTSFCQLQQIMDQLDIRTKLCIRDSLYRLAKSAEQRHNDTNASGQIGDDVEACKAVMIQDSNRYHSIDFWFKFVFLLGLDYTMQCWCGMILSRLVYNHAALSLPPPFKAWKIEPPKLATAKNFISTLDLNPNNSTGSIEVKELGLNECVVEEWNMGDDVKSLKVDRAQY

SEQ ID NO: 97719 - protein, 180 aa, Glycine max
  Coding DNA Sequence Number=SeqID_6034
  Gene Ontology: Mol. function=protein binding; Cellular component =endoplasmic reticulum; Biological process=vesicle-mediated transport
  Homolog annotation: Hit_ID=A7NV05; Match level="QueryCoverage=95%, HitCoverage=39%, E-value=7e-58, Identity=65%"; Hit description =Chromosome chr18 scaffold_1, whole genome shotgun sequence
MDKVFNKLRNLDAYPKVNEDFYNRTLAGGVVTVVSAAVMLFLFFSELNSVWTNFSIIPYRRRKSEGLYLYTVTESKLLVDTSRGDTLHINFDVTFPAVRCSILSLDAMDISGEQHLDIRHNIVKKRIDANGNVIEERKDGIGAPKIERPLQKHGGRLGHDEKYCGSCFGAEEVPLTIYYT

SEQ ID NO: 97720 - protein, 404 aa, Glycine max
  Coding DNA Sequence Number=SeqID_6035
  Gene Ontology: Cellular component=intracellular
  Homolog annotation: Hit_ID=A7Q6Z6; Match level="QueryCoverage=86%, HitCoverage=89%, E-value=8e-96, Identity=55%"; Hit description =Chromosome chr12 scaffold_57, whole genome shotgun sequence
MKEQSVKGDLGESASVVCVGERKKKKQMEFQRSDSSSSPPTPNNADPKKNTCSDPMHSWWESVSKARSRIHALAAILPSSSSDSLSSLADSDRPALSLLSSPAAYSAVSSSLSGSHFDPLCHWLYDTFLSSDPHLRLVVLSFVPLLAGLYLSRIHSPEPPSLAGFEAVLLALYAAETKSRNGKPLVVTIPDLSHPSIYHAPLRKPQTLTLITPPSVGLISPPLEPQLGVKSTKRASIVGVALHSFFSQISHMPAWSKLHFCQFAAAWAGGASHCPCRNELDRDGEIVGEINDFANTFEIRDDTEGKGERIPLPWEILQPSLRILGHCLLGPLNSQDVKDAASFAVRCLYARASHDLVPQAILATRSLIQLDVRTREAAKTNAATNSNANTPTKAKKPEILLVSK

SEQ ID NO: 97721 - protein, 136 aa, Glycine max
  Coding DNA Sequence Number=SeqID_6036
MGLSDAPDFNLKAIYESNRRQGVQKSQGREKRLVTSHMIKGVRIKNPRSKGAGLRNKGYRITRLSHSGNSMIIHDTRYSSSNQSSHHHGHPCMTQAAVVRSFHFVEPKKRRQQQRRKRHRAAVGQDEGGAVEIGSS

SEQ ID NO: 97722 - protein, 306 aa, Glycine max
  Coding DNA Sequence Number=SeqID_6037
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=A5JTQ3; Match level="QueryCoverage=87%, HitCoverage=34%, E-value=1e-135, Identity=84%"; Hit description=Beta- xylosidase/alpha-L-arabinosidase
  Pfam annotation: Domain name=Glyco_hydro_3; Domain location=76-297; Score=139.5; E_value=9.3e-39; Accession=PF00933.12; Description =Glycosyl hydrolase family 3 N terminal domain
MANKVLVLLCVLVTTLLSCCDVSVVRGQTFACDVGKSPAVAGYGFCDKSLGVEARVKDLVGRLTLQEKIGNLVNSAGDVSRLGIPRYEWWSEALHGVSNVGLGTRFSNVVPGATSFPMPILTAASFNTSLFEVIGRVVSTEAGAMYNVGLAGLTYWSPNINIFRDPRWGRGLETPGEDPVLTSKYAAGYVKGLQQTDGGDPNKLKVAACCKHYTAYDVDKWKGIQRYTFNAVLTKQDLEDTFQPPFKSCVIDGNVASVMCSYNKVNGKPTCADPDLLKGVVRGEWKLNGYCHTSFLTRFYFFFLVF

SEQ ID NO: 97723 - protein, 158 aa, Glycine max
  Coding DNA Sequence Number=SeqID_6038
  Gene Ontology: Mol. function=nucleic acid binding
  Homolog annotation: Hit_ID=A7Q413; Match level="QueryCoverage=39%, HitCoverage=21%, E-value=1e-23, Identity=76%"; Hit description =Chromosome chr13 scaffold_48, whole genome shotgun sequence
  Pfam annotation: Domain name=zf-CCHC; Domain location=113-130; Score =17.4; E_value=0.0035; Accession=PF00098.14; Description=Zinc knuckle
MAILLQLRLRLMVSEVFSKPGGLCWEVGLGGIDGNSCRVLTLAILSVMLLRVFYGNGNDHKLVFSSSLRGDISYSSSIQVMMALLFLDTISAEFEGPCGSQEYLGRGPPTGPGRCFNCGIDDHWARDSKAGHRKNKSYQFGGRGHIEKNCKNSPKKLR

SEQ ID NO: 97724 - protein, 72 aa, Glycine max
  Coding DNA Sequence Number=SeqID_6039
METVPISEATPKRQVATFGWLDPIVCNRGVLVGCSELALKLKLSLTVVVSDKMLVAWRGSLFGLAYAKNLLN

SEQ ID NO: 97725 - protein, 217 aa, Glycine max
  Coding DNA Sequence Number=SeqID_6040
  Subcellular localization annotation: CTP_CleavageSite=46; ConfidenceScore=5.12e-01
MKLNKRDVVSRSGSKKIPPKNGRKNLRMMESENPSFFSSSIVGTSSAELVEGGSDWVGEGPRGVPEVAERVGDGVELAIVEDSGAGVELLEVERLIIEELLGFRVGGDEDLEAAVEEEAVDNVGADAASDGVGGFQEEEGDVLGVQVGGGGESGEARADDDDSGGFGEWWGLEREGEGDCSHWSLDKGFDSGGRGSSIGFGGDGDAMFLRGLECNHS

SEQ ID NO: 97726 - protein, 241 aa, Glycine max
  Coding DNA Sequence Number=SeqID_6041
  Homolog annotation: Hit_ID=A2Q1D6; Match level="QueryCoverage=45%, HitCoverage=17%, E-value=1e-13, Identity=40%"; Hit description =Ovarian tumour, otubain, related
  Pfam annotation: Domain name=AFT; Domain location=125-221; Score= -36.3; E_value=0.0063; Accession=PF08731.2; Description=Transcription factor AFT
  Pfam annotation: Domain name=FAR1; Domain location=139-223; Score= -16.2; E_value=0.0034; Accession=PF03101.6; Description=FAR1 family
  Pfam module annotation: Pfam domain module=AFT::FAR1; Domain location= 125-221::139-223
  Subcellular localization annotation: CTP_CleavageSite=44; ConfidenceScore=5.46e-01
MQKLPLPPFFLKNVIFFSEKLLTSIFRKFCFSFSLFRAALPLVRGGNSVERSGEGEGSGVELCGGRWRQTRYADGGLFVADMDEDEWMYEIMSERGDMDYENAESCSANEPHVDCSDAFKTSQVFECREDVLRWARSVAHENGFVTVILRPDTNTGSRGRSTFVLIGCKRSGEYKCRKKEFIIRDIGTRKCGCPFKLRCKPVVGGEGWMVKLISGVHNHELAKVTTDKWMDITDMGHVIAS

SEQ ID NO: 97727 - protein, 187 aa, Glycine max
  Coding DNA Sequence Number=SeqID_6042
  Gene Ontology: Mol. function=structural constituent of ribosome; Cellular component=ribonucleoprotein complex; Biological process =translation
  Homolog annotation: Hit_ID=A7P2V5; Match level="QueryCoverage=55%, HitCoverage=68%, E-value=6e-56, Identity=98%"; Hit description =Chromosome chr1 scaffold_5, whole genome shotgun sequence
  Pfam annotation: Domain name=Ribosomal_L44; Domain location=101-177; Score=167.4; E_value=3.7e-47; Accession=PF00935.10; Description =Ribosomal protein L44
MGGGHMSLQNEFVGYSFTGKNSKNFDIPTGCTMDELKDLIKQVAPRGILPYVDPEVADQVDPETLCFHLGSALWFAQPISAAMVNVPKTKKTYCKSKECRKHTLHKVTQYKKGKDSIAAQGKRRYDRKQSGYGGQTKPVFHKKAKTTKKIVLRLQCQGCKHVSQHAIKRCKHFEIGGDKKGKGTSLF

SEQ ID NO: 97728 - protein, 107 aa, Glycine max
  Coding DNA Sequence Number=SeqID_6043
MGCRLLNELEVIILTPYLSMKFPSEDGKIITIRVSLRIAKEKKVAKPKVKLVACTSLNSNLGEVKLYLRKAKPRVVPTEEVKPFQLSKESSQCTKLGCRLVEKSKNP

SEQ ID NO: 97729 - protein, 299 aa, Glycine max
  Coding DNA Sequence Number=SeqID_6044
  Gene Ontology: Mol. function=phosphoprotein phosphatase activity
  Homolog annotation: Hit_ID=A7QCK2; Match level="QueryCoverage=31%, HitCoverage=35%, E-value=4e-14, Identity=38%"; Hit description =Chromosome chr12 scaffold_78, whole genome shotgun sequence
MSNVSPVGYSSTTTKRTTCLQFVWVPYSGHMEMNLSQVCFIGSVLWTCIIPFICFQKVEWHQSDRVMRQFGMQQPIPGLVMQPSNIHDLTLKGKEGRDWMRLMQPALNEWNSLYEKRVEQTPSLSKGEIAETLHFMVSPAGRRRSVKTRGLARCRKTVDAATYSLPPMPERQHGMYYTPPALTQEPSQMPPMYSYPHDFQPGYSLAGIFGSSPPTGTPSFTLNGELSTPNVPLVGPWNVPGDISDMDDLLGVDLRHDFSVEADQVDERANRRRRNPDRAARNWDRPCGTLSRHHRHSDD

SEQ ID NO: 97730 - protein, 124 aa, Glycine max
  Coding DNA Sequence Number=SeqID_6045
  Gene Ontology: Mol. function=pyridoxal phosphate binding; Biological process=carboxylic acid metabolic process
  Homolog annotation: Hit_ID=A2X5T7; Match level="QueryCoverage=35%, HitCoverage=9%, E-value=8e-18, Identity=93%"; Hit description =Putative uncharacterized protein
MPGSKNFIHEANWQRECLRPQIRGVPHALWHADNTVGARQRSLRDATIMGSRNGHAPIFLWYGLNMKGYRGFQKEVQKCLRNAHYFKGRLCLRGLMMRGLCTSGSLHAKATLRNLDDFLNELVV

SEQ ID NO: 97731 - protein, 286 aa, Glycine max
  Coding DNA Sequence Number=SeqID_6046
  Gene Ontology: Mol. function=nucleic acid binding; Cellular component= ribonucleoprotein complex; Biological process=multicellular organismal development
  Homolog annotation: Hit_ID=Q531A8; Match level="QueryCoverage=52%, HitCoverage=15%, E-value=2e-47, Identity=68%"; Hit description=FCA gamma
  Pfam annotation: Domain name=RRM_1; Domain location=147-203; Score =10.2; E_value=0.017; Accession=PF00076.13; Description=RNA recognition motif. (a.k.a. RRM, RB
MSFSFASPAGGGNGDAGTDDGCGSGSESGDANLKLVGDVGQELFRLSPDVIILDVSESGLRHALDGPDSMGFDSLISIENERSLMERESPRGVLYCCCFIKYATSEEADQAIRALHNQHTLPGGVGPIQVRYADGERERLGVVEYKLFVGSLNKQATVKEVEEIFSKYGRVEDVYLMRDEKKQSRAGNWVGDGGEIMGARGWFPCFSFIIVLEESMNWLGVVLLNTHKDMALAAINALNGIYTMKISTSVVLITDVECYIGYYNGRCRMMTFYIGFQDNRYRNLAF

SEQ ID NO: 97732 - protein, 84 aa, Glycine max
  Coding DNA Sequence Number=SeqID_6047
MNVEERLKIFAKIGEELATQLAQASSARPCEQGCFLQKQPPSGGRNWKAQLSKKLRKLTDCTKTPPFDFRHITEFHGSCKLASF

SEQ ID NO: 97733 - protein, 111 aa, Glycine max
  Coding DNA Sequence Number=SeqID_6048
FYSSSLKTCKPNKAQDYSLLGWGRSSLMAWGSVVVVPLYRFQDTEIRKEGQLSYPNFVWGPLFGGMQPSLDRLEPRCFRNASVSDFVKILHCSSSFFVRSSSFFGLQPVSS

SEQ ID NO: 97734 - protein, 113 aa, Glycine max
  Coding DNA Sequence Number=SeqID_6049
MEHFLKQVAWLEAQLPLVRPDEAAPAEPTTTRVKPKPADPQSLVVNPPFSPKLEVVLPSPPLIIISDSLSRETIAPPDSPAREAVDLPDSPIGKAIDLSYSSSREAVALSDSP

SEQ ID NO: 97735 - protein, 178 aa, Glycine max
  Coding DNA Sequence Number=SeqID_6050
MEADMEAMKEQMATMMEAMMSVKKIMEANAVAIAATSVVAKVNLMSPSDINQMNHPTLDMVGKDLGSTGGPHDVQIQNEHAFPPYGLPLNYKPPNMAYAPNKNTHEIPHHNLADFEPWLGYAIEGQAVGGIPLENTSEGPQYHPQLHLLHSTTSKNPRAMAEMEELDHLEERLRTIEG

SEQ ID NO: 97736 - protein, 132 aa, Glycine max
  Coding DNA Sequence Number=SeqID_6051
MAAQLIHDRAVMECLEGVWETLEGNERCRFRGTIQLTATSLHPVEWILPTPTPYRLVEPFQVIEVSSSEEDLEEDLEELPPEPAMDAPDLPEDDEDQLPEVDSPEDIMSASEADSTEESGLGGTVNTDDSSS

SEQ ID NO: 97737 - protein, 154 aa, Glycine max
  Coding DNA Sequence Number=SeqID_6052
  Gene Ontology: Mol. function=helicase activity; Biological process =viral genome replication
  Homolog annotation: Hit_ID=Q2R1R7; Match level="QueryCoverage=99%, HitCoverage=12%, E-value=4e-26, Identity=33%"; Hit description=AT hook motif-containing protein, putative
MFQPHTILDADGFPVYHKRNNGHTIEKNGVIIDNSYIYLPNRYICPCESTWRIFGFPIHGRKPAVERLHFHLPGQHSVLYEDHDDIDDVLSKPSISDSKFISWMNTNQNSVEGRNLTYAEFVSKFLYNKKKRCWHLRKKGYTIGRLLWVPPITG

SEQ ID NO: 97738 - protein, 173 aa, Glycine max
  Coding DNA Sequence Number=SeqID_6053
MAPRKLASKRSRKDKAVEGTSSAPEYDSHRFRSAEHQQRFEAIKGWSFLRERRVQLRDDEYADFQEEIVHRRWASLVTPMAKFDPDIFLEFYANAWPTEEGVRDMRSWVRGQWIPFDADAISQFLGYPLVLEEGQECEYGQRRNRSDGFDEEAISQLLYMDDVAAQQHPAQRS

SEQ ID NO: 97739 - protein, 99 aa, Glycine max
  Coding DNA Sequence Number=SeqID_6054
  Gene Ontology: Mol. function=structural constituent of ribosome; Cellular component=intracellular; Biological process=translation
  Homolog annotation: Hit_ID=Q32703; Match level="QueryCoverage=38%, HitCoverage=90%, E-value=3e-11, Identity=84%"; Hit description =Putative uncharacterized protein
ISSGDDGVGPVAQRIRARGYEPRCRGFESLLAHNRPKKGRIFPSGGRKIMIGLADPKLWNFQLTADRSTTELLRNNGKFELIEFNSRSQPMTNMSSKFP

SEQ ID NO: 97740 - protein, 135 aa, Glycine max
  Coding DNA Sequence Number=SeqID_6055
VPGDMSRGSGDLGDVRRAPGSQPIKEQSPQRKEACVAAGQLWILSGIWKFASSNRLPRIVMAAQLIHDRVVMECLEGVWETLEGNERCRFRVTIQLTATSLVHPEVPARTLQQPVEWILPTPTPYRLVEPVQVIE

SEQ ID NO: 97741 - protein, 124 aa, Glycine max
  Coding DNA Sequence Number=SeqID_6056
MAAQLIHDRVVMECLEGVWETLEGNERCRFRGTIRLTATSLVHPEEPALEPVQVIEVSSSEEDLEEDLEELPPEPAMDALDLPEDDEDPLPDVDSPEDIMSASEADSTEESGPGGTANSDDSSS

SEQ ID NO: 97742 - protein, 76 aa, Glycine max
  Coding DNA Sequence Number=SeqID_6057
MEAEWRRKMERRCHFKEKMSLEEAHHHKRPLIRAWRKKEMNEGRGREEHEILCSRRALKSEPTNPRSSPRFSTKCA

SEQ ID NO: 97743 - protein, 136 aa, Glycine max
  Coding DNA Sequence Number=SeqID_6058
  Homolog annotation: Hit_ID=A6FJQ2; Match level="QueryCoverage=27%, HitCoverage=84%, E-value=3e-11, Identity=92%"; Hit description=50S ribosomal protein L5
  Subcellular localization annotation: CTP_CleavageSite=43; ConfidenceScore=5.74e-01
MLCKKAVSSFGPPIVVRSKLAAVLSLMVMAALHNSLTVMPSVRCFSVTGVSRGPFVSRVSVMTVKTSDTCSSGDGHSLSMRKEKIPHQAPFAIQAAQLLGRAIGAGLFAITPAGERGMCCKAIKLGNARVFPVTTL

SEQ ID NO: 97744 - protein, 90 aa, Glycine max
  Coding DNA Sequence Number=SeqID_6059
  Subcellular localization annotation: CTP_CleavageSite=43; ConfidenceScore=5.24e-01
TWFASRRPTTGGRCKPMSVSTSSSSICRARVLLLLRPTLDQFRAEVAWPRDWPEAQAREAPAKAPDDAEEARMDEEMTNLLGFLGGSGAT

SEQ ID NO: 97745 - protein, 117 aa, Glycine max
  Coding DNA Sequence Number=SeqID_6060
VDGDPVLRGTRIRAMWGYVSSVEGGQLGMVGSLVLGDMSRGSGDLGDVRRAPGSQPLKEQRPQSKEACVVAGQLWILSDIWNMASGNRLPREVEMAFGNRLPRGVIDYQAILRFSMF

SEQ ID NO: 97746 - protein, 107 aa, Glycine max
  Coding DNA Sequence Number=SeqID_6061
MACTHIPVEAKILENPDESLETSNNSFQNCPMCGIASSLHQLDFAPYASGSYSAQWNVPGLLHDMHMLRSSRILGKMEVEETLQGLWLPLHYQVDMGASQHRTPELG

SEQ ID NO: 97747 - protein, 76 aa, Glycine max
  Coding DNA Sequence Number=SeqID_6062
MAAKWRRKRERRRHFKEKMSLEEAHHHKRPWIRAWRKKEMNEGRGREEHEILCSKRALKSEPTNRRSSPRFSTKCA

SEQ ID NO: 97748 - protein, 174 aa, Glycine max
  Coding DNA Sequence Number=SeqID_6063
MPLVVRKSRHYRTKGKVSSGCKTLLKDFHDLEEKHKGREVLKELPPEIVKLYEEIKTLKDKLGKIVGGHGALNKIIKVQRNPKDKYGHGFKGKKIVHGEEVIVCYFCGKVGHETHKGKDLAKKGNPSRGPSYAYQHLHANREKEPKKIWVPKSKIIPIADLLDSRKETSVVVPG

SEQ ID NO: 97749 - protein, 440 aa, Glycine max
  Coding DNA Sequence Number=SeqID_6064
  Gene Ontology: Cellular component=integral to membrane; Biological process=transport
  Homolog annotation: Hit_ID=A7PR50; Match level="QueryCoverage=99%, HitCoverage=98%, E-value=1e-169, Identity=67%"; Hit description =Chromosome chr14 scaffold_26, whole genome shotgun sequence
  Pfam annotation: Domain name=Mem_trans; Domain location=15-430; Score= 439.3; E_value=5.3e-129; Accession=PF03547.9; Description=Membrane transport protein
MNENTVRSAGADLTAAIVPLLKLLCLTVIGLLLANPTMQFIPKATFKLLSKLVFALFLPCLIFTELGESITLENFVDWWFIPVNVLVSTALGCLLGFLVVIICHPPPELTRFTIIMTGFGNTGNLLLAVVGSVCHTKDNPFGKNCNTRGVAYVSLSQWVSVILVYTLVYHMMEPPIEYYEIVEEEAEIEEERTLNDISRPLLVEAEWPDIEQKETEHSKTPFIARIFKSISGVSSSNIPELESGGTSPKSIRCLAEPRVVRRIRIVAEQTPIQHILQPPTIASLLAIIIGTVPQLKAVFFGYDAPLSFITDSLEILAGAMVPSVMLILGGMLAEGPSDSKLGLKTTIGITVARLLVLPVLGIGIVALSDKLNFLVENDAMFRFVLLLQYTTPSAILLGAIASLRGYAVSEASALLFWQHVFALFSFSLYIVIYFRIVMYV

SEQ ID NO: 97750 - protein, 179 aa, Glycine max
  Coding DNA Sequence Number=SeqID_6065
MAPTRHPLDPDKSNRALGFPALITGLCQSFGVPVAPTKVIRPPITRAFIEKYCTQRQAQGDAPQAAGAPPPPHQAGPAGSFDMEQYLRHLGRQQSANHRAHVQTHDCLYQLSLTMQSQGFASFSCPTPDQFRAEVAWPGDWPEAQAGEAPPEAPGDGEEAHEDEEMADLLDFLGGSGAT

SEQ ID NO: 97751 - protein, 139 aa, Glycine max
  Coding DNA Sequence Number=SeqID_6066
ALRANAPLPYPQLITLFLRHFQIPLDDEPFVQVKRSFAIGAGAVTSFGYRKDQNGQWLKKDALPPQDERTPSPPPQREDSTLLNEVLTELRGLRSYVGERFDSLDTRFAGMDIRLTQVEEDVSFIRTCFDPPPPPPSSS

SEQ ID NO: 97752 - protein, 54 aa, Glycine max
  Coding DNA Sequence Number=SeqID_6067
MSERTIIIKKGEIVEAMPSKVILMMPKNQGLSKVSSKDSRIKFQVSRFKNQEKT

SEQ ID NO: 97753 - protein, 118 aa, Glycine max
  Coding DNA Sequence Number=SeqID_6068
KGCRQPHWSLRVNGLACLLLTKGADNHKVFLHATEPLSHDIKGADNHKVSPHATGPSSHDSKGDTFLRSRSEDADISGKVQMTTLVLACQRPEDADISEKDADDHIGPCVSTGSLASS

SEQ ID NO: 97754 - protein, 318 aa, Glycine max
  Coding DNA Sequence Number=SeqID_6069
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=A7M8Y9; Match level="QueryCoverage=100%, HitCoverage=74%, E-value=1e-134, Identity=70%"; Hit description=ATP synthase subunit alpha
  Pfam annotation: Domain name=ATP-synt_ab; Domain location=104-303; Score=261.2; E_value=2.2e-75; Accession=PF00006.16; Description=ATP synthase alphabeta family, nucleotide-binding domain
  Pfam annotation: Domain name=ATP-synt_ab_N; Domain location=25-93; Score=77.3; E_value=5.2e-20; Accession=PF02874.14; Description=ATP synthase alphabeta family, beta-barrel domain
  Pfam annotation: Domain name=HAS-barrel; Domain location=25-91; Score= 35.9; E_value=1.4e-07; Accession=PF09378.1; Description=HAS barrel domain
  Pfam module annotation: Pfam domain module=ATP-synt_ab::ATP-synt_ab _N::HAS-barrel; Domain location=104-303::25-93::25-91
MVTIRADEISKIIRERIEQYNTEVKIVNTGTVLQVGDGIARIYGLDEVMAGELVEFEEGTIGIALNLESKNVGVVLMGDGLMIQEGSSVKATGRIAQIPVSEAYLGRVINALAKPIDGRGEISASESRLIESPAPAIGQKASSVAQVVNTLQERGAMEYTIVVAETADSPATLQYLAPYTGAALAEYFMYRERHTLIIYDDLSKQAQAYRQMSLLLRRPPGREAYPGDVFYLHSRLLERAAKLSSQLGEGSMTALPIVETQSGDVSAYIPTNVISITDGQIFLSADLFNAGIRPAINVGISVSRVGSAAQIKAMKQVA

SEQ ID NO: 97755 - protein, 77 aa, Glycine max
  Coding DNA Sequence Number=SeqID_6070
MTTNSRGNNRPKCNTHRPNFNNSYFENEEDLHREIARDLGVSYADKNTCKDKMKYDVINSSIFPQSAAVMGTEQNDP

SEQ ID NO: 97756 - protein, 48 aa, Glycine max
  Coding DNA Sequence Number=SeqID_6071
MADTYSAPEEIHGLLDYWKNTITKRVPRHPYCTRSKSRTMGDQEETQE

SEQ ID NO: 97757 - protein, 73 aa, Glycine max
  Coding DNA Sequence Number=SeqID_6072
MDQRMWVGDLVRLHFKTCDASEKLWYRATRIVFKGSPLVVLIYHGDDELKNCSVLQQFPSPLSPVPSQCSFNF

SEQ ID NO: 97758 - protein, 35 aa, Glycine max
  Coding DNA Sequence Number=SeqID_6073
MSKRLQEDRARIAEECPRVLMNLRIDFIAHGPRAP

SEQ ID NO: 97759 - protein, 74 aa, Glycine max
  Coding DNA Sequence Number=SeqID_6074
MLLPSALHVSSTFEFGAMFHDCLSADPQGNPPFSTSFSESHECHCLALFMCPPLSSMKPLKRKKEGVETRVVMD

SEQ ID NO: 97760 - protein, 111 aa, Glycine max
  Coding DNA Sequence Number=SeqID_6075
  Subcellular localization annotation: CTP_CleavageSite=71; ConfidenceScore=5.37e-01
MYLAAIADSQPQPSPLAGQPFSVLQQQQGMHSQLGMSSSGSQGLHMLQSEATNVGGNATIGTGGGFPDFVRIGNGKQDIGISGEGRGGNSSGHSGDDGETLNYLKVVGDGN

SEQ ID NO: 97761 - protein, 211 aa, Glycine max
  Coding DNA Sequence Number=SeqID_6076
KGSRLRSLATRQVGAERPLVHVDPATGKADGPHSKKFITYLGIVARDKFKSDLTSKWALATEKDSVNDTDVRKKAQAIQKQNTAPRVMSRGGYEYLEKKLMDEKRKKKLEEATQSGSTDTVIDPPSPIKRHLKWKLARTKKTGDMTSEAAKEIPDKIGSFVTHGRHDILIAVIGRPEHPSHVRAIGAGITIKQYFGSTSRTSSIAPEYLQQ

SEQ ID NO: 97762 - protein, 84 aa, Glycine max
  Coding DNA Sequence Number=SeqID_6077
MKAQVEKDEGPEAETLSRLLIVAEDLSSFTGSGVYPDLSSFTGSGVYPDLSSFTGSGVYPDLSSFTGSGVIQTFVACIKRSAPT

SEQ ID NO: 97763 - protein, 190 aa, Glycine max
  Coding DNA Sequence Number=SeqID_6078
MTLLLYNILSSDRNANLPLRKDRAHKTPSGPGEVQQGPGVSSSGYGPLSVLQGAYFPQQGIAPARHPMDPEKSNRVLGFPALITGLCQSYRVPVTPARSSGRDTTAAWGWPTSGNRHTAATSGAPQLIYKGWSVAYDPWPTSRRPSPKPKDILLEKTGIAKSIEAAGSTMSDTMSRTSCPRILELLYNAR

SEQ ID NO: 97764 - protein, 127 aa, Glycine max
  Coding DNA Sequence Number=SeqID_6079
MNSWGSGLNCGECMNVNQFIGLRIRLDDGGCTNSARISIRRAPNSMVEDACMAIVATYPLAGGRRETRGMRVPRKEYARSRHQRLFEENVGKTGKDAIYEFLVKGSGVVFTHGEGCFPLLLRIPQLR

SEQ ID NO: 97765 - protein, 80 aa, Glycine max
  Coding DNA Sequence Number=SeqID_6080
MKHNSKLFGWRMHERKRNSWGYEKKARMEDALEGPHLSMMKHSSNLFGSRMHERKPIHGAQKKARMEDCTRGSSLVNHGA

SEQ ID NO: 97766 - protein, 442 aa, Glycine max
  Coding DNA Sequence Number=SeqID_6081
  Homolog annotation: Hit_ID=A5C995; Match level="QueryCoverage=44%, HitCoverage=13%, E-value=6e-10, Identity=27%"; Hit description =Putative uncharacterized protein
MADNNRTLKERTTPDVVYQAWCIQYPKTKVSYELNFGLTHLMPRFQGLAGEDPHKHMKEFHVMCSTMQPGQPFRPQQQQYNPYSNTYNPGWRDHPNLRYGPGVDKANGHQQHFVSVECECCQQKPIDSDWTGNVSAITLKSDRELPKPIDVGAKIDDVSAITLKSDKELPKPTDAGAKINDVSDVTLKSDREPPKPTDVGAKIDDVSVVTLKSDRELPKPTYVGAKIDDVSVITLKSDRELPKPTDAANIPLLDAIKKIPKYAKLLKCTNKRKLKGNKQVKRYGWTSSHMKFVGVGFLGTIMGSSTRKAWAEQMRKMSDKCERGEPFLGVVPGDMSRGSGDLGDVRRAPGSQPIKEQSPRSKEACVAVGQLCILGGIWKLASEGVWETLEGNERCRFRGTIRLTATSLVHPEEPARTLQQPVEWILPTPTPYRLVEPVQVIE

SEQ ID NO: 97767 - protein, 126 aa, Glycine max
  Coding DNA Sequence Number=SeqID_6082
  Homolog annotation: Hit_ID=Q2QQW4; Match level="QueryCoverage=47%, HitCoverage=7%, E-value=5e-08, Identity=50%"; Hit description =Transposon protein, putative, CACTA, En/Spm sub-class
MDMAWESPDTTDMSQAEERNAEIGNPIEEMIHDLGQKVFQQAHAPLYDNIEIDSKKPLYSSCTSFKKLSVVLALYEKIHVCCNNCILYKDEFAELDYCPVCGVSRYRLKNEDCSVHPIADNRRPAK

SEQ ID NO: 97768 - protein, 25 aa, Glycine max
  Coding DNA Sequence Number=SeqID_6083
MKQRVKSLVRKSTSMKKASIEEWIR

SEQ ID NO: 97769 - protein, 25 aa, Glycine max
  Coding DNA Sequence Number=SeqID_6084
LSYVGVHSVISLILAFILDRVVHHH

SEQ ID NO: 97770 - protein, 97 aa, Glycine max
  Coding DNA Sequence Number=SeqID_6085
MGDSDKCGLYIKENPSRLVALGRVYEGSTAVHNIPLLHGQVKVGVEEVKNAEAPIPIPTDEEVMSPAKPPDRPDHEIDDPLYLMTLTIPQLFVRPLQ

SEQ ID NO: 97771 - protein, 188 aa, Glycine max
  Coding DNA Sequence Number=SeqID_6086
MLRFSVIRQPLILQFKAVFHCDKDTIEIPGFYQRQWEPNYPEIVEFKYDGATYEIQVRQHKGKLFFADGLTTLWTELQIYESVIINFLAYDYHSKFDLHFTPPLHHQTCKRRRASRKHIWTYEITQSMLGAPYSLQLPPSVTQCLIHCGDHMTILRKFGPPLQWNVIVLDKGISDKYITQPWYKFLQE

SEQ ID NO: 97772 - protein, 193 aa, Glycine max
  Coding DNA Sequence Number=SeqID_6087
MVSKGWSFDEASMVDEKGEEKQLLVLRVSLHPSGPVFESKQYVYQNAQNETPSMVQRMSQYKSDLTSKWALAANKDSVNDTVYENTTLARKNRPSFVRVAETPHGRMCGKRHRSSRSKTLPHVLSHGGYEYLEQKLMAENTKKKLKEAAQSKSTEVVMDPPSPIRRHVKWKMARAKKTGQMTFEAAKEIAEKI

SEQ ID NO: 97773 - protein, 78 aa, Glycine max
  Coding DNA Sequence Number=SeqID_6088
MARNVFAPCPYLRDLYGRELKGLLVIIPKVVISLFMVSRVPSGVANCRNLPFGGMATRDSRDACSTKGIRAESPPTFI

SEQ ID NO: 97774 - protein, 158 aa, Glycine max
  Coding DNA Sequence Number=SeqID_6089
  Homolog annotation: Hit_ID=A0ST23; Match level="QueryCoverage=28%, HitCoverage=91%, E-value=1e-11, Identity=73%"; Hit description =Putative reverse transcriptase
MTVKTSDTCSSRRRSQLVCKRMPGADKPVQGASAGVGGCRGWLNYAASEQIMRKEKIPLQAPFAIQAAQLLGRAIGAGLFAITPAGERGMCCKAIKLGNARVFPMSLRCPIQGTELEFVIMVIAVSFGKPVVPAALMNRPTRGERRFAYWALFRFLAH

SEQ ID NO: 97775 - protein, 149 aa, Glycine max
  Coding DNA Sequence Number=SeqID_6090
YALYQIAVEFEHVSYTGIDSSRCGCVMRTTHGLPCAYQGLFEPEVNITEEIETISKRFEELDGCGKVTLKSKLQEISYRDLNSMCAPLEKVKTKVKHSASSSEQPIEARLQEDVLMMSKERASQVLFNPRNPRYMIKKPSRIFQVETSK

SEQ ID NO: 97776 - protein, 68 aa, Glycine max
  Coding DNA Sequence Number=SeqID_6091
MEQDEKRFLYRIRYSSDEKNDPEGMEGGIGDPKSLKTMLATGNRLLPSGINEALGLNLELGLDLKRAD

SEQ ID NO: 97777 - protein, 173 aa, Glycine max
  Coding DNA Sequence Number=SeqID_6092
MAPKKLFTKRSRRDAATEGTSAAPEFDSHHFRSAQHQQCFEAIKGWSFHRERCVQLRDDEYTDFLEEIARRHWTSLVTPMAKFDPNIVLEFYANAWPTEEGVRDMRSWVRGQWIPFDVDALSQFLGDPLVLEEGQECEFSQRRNMTDGFDEEAIAQILCTSGQDFAWTAAGRR

SEQ ID NO: 97778 - protein, 282 aa, Glycine max
  Coding DNA Sequence Number=SeqID_6093
  Homolog annotation: Hit_ID=Q6WAY6; Match level="QueryCoverage=70%, HitCoverage=36%, E-value=2e-11, Identity=27%"; Hit description =Putative uncharacterized protein
MTPSTEDVKKAMQGLFAVLQLSRWGWFHTFFSKKAGPSIRYKEGRIKILSSCEGCPNVPLMGTRGCINYNLVLAIRQLGYPMRGAPLDESITPFIARGFSDHNARVLQGVRKAWDAALKTGLDWLPNLKTVRDDEVKALEESDEVQALKAELERAWVVKEKFKAAIVSSSSEEVKGIITGQRHDLEGRAKGNMWAIIDKCKEKLNLAATHEQRLEDEYAKISAEREVRERVIDSLHQEATMWTDRFALTLNRSQELPPLLAKAKAVADTYSAPEEIHGLLSY

SEQ ID NO: 97779 - protein, 153 aa, Glycine max
  Coding DNA Sequence Number=SeqID_6094
DFQDYFDDAKESRVKQVPKNQASRIKSQRIKIQEQLSFKIQEQSRSTFKTQDSRFKIQEKLISRFKRRNREATVNNSKGKTSKNSFLLPWEGTSFVVQVEGTYTWVIILRTRECTSTWLFKENKGGYIPCGSLACKGFYKVERNLKNCWLLGD

SEQ ID NO: 97780 - protein, 48 aa, Glycine max
  Coding DNA Sequence Number=SeqID_6095
MKMDTSEPYTGAMRGTVHEPQVPCYKVMKKDKDWYLKALHWGNKGHRA

SEQ ID NO: 97781 - protein, 107 aa, Glycine max
  Coding DNA Sequence Number=SeqID_6096
  Gene Ontology: Mol. function=endonuclease activity
  Homolog annotation: Hit_ID=Q9AY32; Match level="QueryCoverage=48%, HitCoverage=78%, E-value=5e-21, Identity=96%"; Hit description=RRNA intron-encoded homing endonuclease
MVVTVKKLVVGPWVGSIGPPPVCTGRLVPSAGDALLSLTGRVVPPTIRYRPSLNHNDADQGSADVAFRTPLAPYEKSKSLGSGGSMVARLKLKGIDGRAPPGVEPAA

SEQ ID NO: 97782 - protein, 51 aa, Glycine max
  Coding DNA Sequence Number=SeqID_6097
MTKPRQKGVQKVNETKVKACETREKREVVAAQLASRRHRLLLDDPGRPKWA

SEQ ID NO: 97783 - protein, 146 aa, Glycine max
  Coding DNA Sequence Number=SeqID_6098
  Gene Ontology: Mol. function=hydrolase activity, acting on carbon -nitrogen (but not peptide) bonds
  Homolog annotation: Hit_ID=A7PFT8; Match level="QueryCoverage=41%, HitCoverage=23%, E-value=2e-21, Identity=70%"; Hit description =Chromosome chr6 scaffold_15, whole genome shotgun sequence
KRKSAQYANRLSPRVGRFINAAGTTGFPTGKRAFCDAGTSSKLLIKGGTVVNAHHQQVADVYVEDGIIVAINPTITVGDEVTVIDATGKFVMPGMQAWHWPSFYNVVTGKTLALPNLIALQHIPLSPAGVIAKRPAPIALPNSCAA

SEQ ID NO: 97784 - protein, 141 aa, Glycine max
  Coding DNA Sequence Number=SeqID_6099
MEKPLFKPFKVSEKAKLKFRELRKQKFPTVEIGDSNNELLSKINRLLKTVPETPQPSEESSKIRTRHTSKLINDINEDNDNNLEQVSKEGSISEKVINPINTKHWETPSKLYYQRPTALDLLLEERGKNNFKSFSANNIYE

SEQ ID NO: 97785 - protein, 191 aa, Glycine max
  Coding DNA Sequence Number=SeqID_6100
  Homolog annotation: Hit_ID=A6FJQ2; Match level="QueryCoverage=19%, HitCoverage=84%, E-value=2e-10, Identity=89%"; Hit description=50S ribosomal protein L5
MRKEKIPHQAPFAIQPAQLLGRAIGAGLFAITPAGERGMCCKAIKLGNARVFPVTTLSTLEDPQICTCRQTLWFMLLCDHHTDLCPSLQHLKQLNSLKLMLQTSTIDLLNLSSKINHNRTIMTSPATRTIPGGGIIPTLDGRILHNSSLIFKMLLAQANHTFLHQSSSNNSNSPRNSKQLRLFHNLPLKNM

SEQ ID NO: 97786 - protein, 58 aa, Glycine max
  Coding DNA Sequence Number=SeqID_6101
  Pfam annotation: Domain name=G-patch; Domain location=8-38; Score =6.8; E_value=0.028; Accession=PF01585.14; Description=G-patch domain
MAFQSFEVPGMGLGKDKGGITSLISAKGNRGKFGLGYKPTQADIKKGITGRKSGGQGS

SEQ ID NO: 97787 - protein, 49 aa, Glycine max
  Coding DNA Sequence Number=SeqID_6102
MATKGWSFVGASMVEEEEENGNVKPVENVIPVGVTPTKSSNRSMYLFVL

SEQ ID NO: 97788 - protein, 68 aa, Glycine max
  Coding DNA Sequence Number=SeqID_6103
MHIHGENHKGKGEGNDEVTLLDIPGGGDREFFMRKNTDTWGHVTRFGTPLRLKLITVGGGGSCLCTTG

SEQ ID NO: 97789 - protein, 143 aa, Glycine max
  Coding DNA Sequence Number=SeqID_6104
MHALLGSFNSGNWSDSDDLDRTGLSCHTITRHLFTEIAYQVTQVPREFNTRFLPFYITCVIRCTCWKRTITNRGIYYLIAIPDEGCYIQSDNEHIAIPGDWRSISKANVPPRVGKIKWLTFYGAYGGGRMMRSGKIRMSQLSL

SEQ ID NO: 97790 - protein, 70 aa, Glycine max
  Coding DNA Sequence Number=SeqID_6105
MWYHVSKKSRRAPKRRPVRVTLFCENAPTMWDQHRLKGALKPGVFTPKAYTLNSPLRPLPPDSGPTHKTF

SEQ ID NO: 97791 - protein, 85 aa, Glycine max
  Coding DNA Sequence Number=SeqID_6106
SETVPPEPFIYEADPGTTLEETQEVATPEITPQQAVEPSTPVLDLSSPQPSQKPSTPVLGLSSPTTSPAGTLVLHLTDEEEDIMD

SEQ ID NO: 97792 - protein, 229 aa, Glycine max
  Coding DNA Sequence Number=SeqID_6107
  Homolog annotation: Hit_ID=A5CB24; Match level="QueryCoverage=41%, HitCoverage=41%, E-value=3e-07, Identity=37%"; Hit description =Putative uncharacterized protein
  Pfam annotation: Domain name=VQ; Domain location=74-104; Score=45.8; E_value=1.6e-10; Accession=PF05678.5; Description=VQ motif
  Subcellular localization annotation: CTP_CleavageSite=71; ConfidenceScore=5.73e-01
MSGPNDSWLQFYNQNSTPSIPDFTVSTANVTTTTIVAATSPSQDMLNSSSSGPTHLSPEGRVAKPTRRRSRASRRTPTTLLNTDTTNFRAMVQQFTGGPSAPYASNPSLAPHVLPNLMGFGFPSRPVPSPTTLVMTSSPPISYLQQQHMFQQQNQQYNLYSTGGGGTQGGGDSNNNRMFFQRLSNNNVNPIMSLPTSNVVVSNNNNRDGDGGAVNTHHGRFLPNTSSSS

SEQ ID NO: 97793 - protein, 30 aa, Glycine max
  Coding DNA Sequence Number=SeqID_6108
MAWLSDCSLCASEGDRFAKKPCFDDAKKVT

SEQ ID NO: 97794 - protein, 67 aa, Glycine max
  Coding DNA Sequence Number=SeqID_6109
  Homolog annotation: Hit_ID=A5C9C8; Match level="QueryCoverage=80%, HitCoverage=6%, E-value=5e-13, Identity=68%"; Hit description =Putative uncharacterized protein
MKEELKMIEKNDMWKLVDRPQHKQPIGEEIYVEQHEGFQIKGEEQEVYKLKKVLGSERRKEKSGTRN

SEQ ID NO: 97795 - protein, 57 aa, Glycine max
  Coding DNA Sequence Number=SeqID_6110
  Homolog annotation: Hit_ID=O64438; Match level="QueryCoverage=61%, HitCoverage=14%, E-value=2e-08, Identity=77%"; Hit description=ARG10
GGLRCYESPKNKITAVPTEEEEIWGAFFKNRESVISLNSNIRLMSVETALGTQGKCE

SEQ ID NO: 97796 - protein, 63 aa, Glycine max
  Coding DNA Sequence Number=SeqID_6111
IAPARHPVDPEKSNRVLGFPALITSLHQIYEVPVTPSKVIKPSTNRAFIKKYCAHRQAQGETP

SEQ ID NO: 97797 - protein, 114 aa, Glycine max
  Coding DNA Sequence Number=SeqID_6112
MPRSPANPSVRRAMCDRLARLLKTAYDDNWSELAEKLGYANASGMLSIKRGVAFPDVQRLNRISEWEIEGGFIPSLDWILTNKGPAVIRYEGTTIVEGLTLSQLASLRANCRSI

SEQ ID NO: 97798 - protein, 108 aa, Glycine max
  Coding DNA Sequence Number=SeqID_6113
  Gene Ontology: Mol. function=electron carrier activity; Cellular component=intracellular; Biological process=electron transport
  Homolog annotation: Hit_ID=Q3SME7; Match level="QueryCoverage=77%, HitCoverage=69%, E-value=1e-26, Identity=60%"; Hit description =Probable cytochrome c5
  Pfam annotation: Domain name=Cytochrom_C; Domain location=18-97; Score=28.7; E_value=2.1e-05; Accession=PF00034.12; Description =Cytochrome c
MIKPVATVEVAEAAGAHVEKSGEEIVKGVCIACHGVGALGAPKIGNAGDWGPRIAQGYETLVKHAIEGIRSMPARGGNAELSDHEVADAVAYMANQAGAKFDAASLKK

SEQ ID NO: 97799 - protein, 97 aa, Glycine max
  Coding DNA Sequence Number=SeqID_6114
MMITKDDDKGDDKKLKDHSKNNSKNSRVQDKNLEEFKTQEEILESRIKIQDSRFKISRIKVQGSRSQESRSRFKTQDSRIKRRLNQDKYEKFFPKIE

SEQ ID NO: 97800 - protein, 88 aa, Glycine max
  Coding DNA Sequence Number=SeqID_6115
MENCTKQLSQPTLRREGDARLAGCVFHERNTRGVATNVYLRKTSEKTGKDAIYELLSEKVRELYLRTGKGVSLRSYIFLNCDEEIRPT

SEQ ID NO: 97801 - protein, 58 aa, Glycine max
  Coding DNA Sequence Number=SeqID_6116
METAKGTTETTANNQNGRNKAEKKQAEKKAQFFRKLPDDVLPEVVCGYFRKSQILLPE

SEQ ID NO: 97802 - protein, 97 aa, Glycine max
  Coding DNA Sequence Number=SeqID_6117
  Subcellular localization annotation: CTP_CleavageSite=57; ConfidenceScore=5.53e-01
MSISPCGSISWSMSSRHKDRTHKDTQWTRRSPTGPKGFQLWLRASISPTGCPFPPARDRARKTPSGPKEVQQGLGVASSDYGPLSVLRSACRPQQGH

SEQ ID NO: 97803 - protein, 301 aa, Glycine max
  Coding DNA Sequence Number=SeqID_6118
  Gene Ontology: Mol. function=adenylosuccinate lyase activity; Cellular component=cytoplasm; Biological process=purine ribonucleotide biosynthetic process
  Homolog annotation: Hit_ID=A5TTK8; Match level="QueryCoverage=99%, HitCoverage=62%, E-value=1e-115, Identity=69%"; Hit description =Adenylosuccinate lyase
  Pfam annotation: Domain name=Lyase_1; Domain location=10-296; Score= -58.8; E_value=5.9e-07; Accession=PF00206.11; Description=Lyase
MNSYKNPLEERYSSEEMLFNFSHNNKFQNWRKLWIALAEIEKDLGLEITDEQIAELKANAENIDYDKAAEYEKKFRHDVMAHVHAYGDVAPSAKGIIHLGATSAFVGDNTDLIQIRDGLLILKKKLVNVMKNLADFAIQYKDLPTLGFTHFQPAQLTTVGKRATLWLQSLVLDIEELDFFLETLRFRGVKGTTGTAASFLELFNGDYSKVKHLDKELSKRFGFDKVFGVSGQTYDRKIDAKVVALLGNIAQSAHKFTNDLRLLQNLKEIEEPFEKNQIGSSAMAYKRNPMRSERIGALAKY

SEQ ID NO: 97804 - protein, 183 aa, Glycine max
  Coding DNA Sequence Number=SeqID_6119
MIMRGQDIYSSQDEPTISPSSSESEEAKGEESSEEIYPQEDGQPLVVKEKCKEISVSSKSKEVVDEGLVRKSLNPCALLVPKRGIITHQVPKIAGMMNVLSGATLFCKITRTPNIFMVCVHRDPLGSDQGVPMNPKRIKVIPDWPTPPSVEGRSPEYEEPRDLRSNPFQGGGNDAILSRKGIG

SEQ ID NO: 97805 - protein, 73 aa, Glycine max
  Coding DNA Sequence Number=SeqID_6120
  Gene Ontology: Mol. function=RNA-directed DNA polymerase activity; Biological process=RNA-dependent DNA replication
  Homolog annotation: Hit_ID=Q94BM2; Match level="QueryCoverage=83%, HitCoverage=3%, E-value=2e-08, Identity=44%"; Hit description=Gag -pol polyprotein
  Pfam annotation: Domain name=Retrotrans_gag; Domain location=2-72; Score=9.3; E_value=0.0067; Accession=PF03732.8; Description =Retrotransposon gag protein
ERRIHGDPLVEYWNDLKSALRKRHIPSYYERELMDKLHRLRQGSMSVKEYRQQIELLLLRAGLSDVPSFSSIS

SEQ ID NO: 97806 - protein, 174 aa, Glycine max
  Coding DNA Sequence Number=SeqID_6121
MASCSRKATTSVSQAELERRNWHREITNFSEGSIDVVVVKEFYANLYDPKDKAPKQVRVRGHLIKFDVDSLNTFLKTPVVVEKVESLPFCSIFARLRPNPQELAARLCIRGFVLNVEGLPWKLLRKDLTTLAQTWSVLSYSNLAPTSHTFDLNLDKARFHSLHSPTPRGLDFQP

SEQ ID NO: 97807 - protein, 76 aa, Glycine max
  Coding DNA Sequence Number=SeqID_6122
  Subcellular localization annotation: CTP_CleavageSite=80; ConfidenceScore=5.05e-01
MHLRDQGSLLNNKEKNKMKDCKNTSGEDVFFTSRISQSLTNSSQALKLVPASSFGLCRSSHSKISQNSLELGPFSL

SEQ ID NO: 97808 - protein, 88 aa, Glycine max
  Coding DNA Sequence Number=SeqID_6123
MGKTTWASLMQNHMKTNPIRPRKEILDDITDSLGDMHIHEKGHKGEEHGNIGDFQLKENQTNLDLPKEWRTSRYHPLDNIIGVTSQKG

SEQ ID NO: 97809 - protein, 324 aa, Glycine max
  Coding DNA Sequence Number=SeqID_6124
  Gene Ontology: Mol. function=RNA-directed DNA polymerase activity; Biological process=regulation of transcription, DNA-dependent
  Homolog annotation: Hit_ID=A7QK04; Match level="QueryCoverage=18%, HitCoverage=13%, E-value=7e-20, Identity=78%"; Hit description =Chromosome undetermined scaffold_109, whole genome shotgun sequence
MVASSNKESMAKIMVDCKSAKDILQKDVKDLASKQIFARWQAILSVFDFDIEYIKGTSNSLPDYLTREFLQKSGRSTGKGARLALPEPTIKKSSTSSGSPTQAGSSTQKNNLEGSSTQIASIKPEPSTQESPKPATAKQTSADYAWAIETLQALQDMGLTKFPKIIKKSWADIASESDDESESNLQTMIQNASMTKTATNTKGKLPLAKAQTPPTKQTNNYIYKNKLLTVLQMEPEFWDKNPFKATAKAFPPGFHYKPTTILKTRTFYELILVDSNSVSIKHFKDPKDQTLNTHSTIQILKVLQPRHFGSDLNKGTRFSVPFDP

SEQ ID NO: 97810 - protein, 93 aa, Glycine max
  Coding DNA Sequence Number=SeqID_6125
MGKYAKKKAAFNKSGTERKKKEEILKQAQSNRGAQRASGAKRATNWRRWAWRKPLRALSQLGAQRPIQQTHRRPAPDPTEAQAQRAWRAQRAI

SEQ ID NO: 97811 - protein, 60 aa, Glycine max
  Coding DNA Sequence Number=SeqID_6126
MYGFILVKWYCHHQKGEDCRQRIKLKVLMMPKDYMNHMLLKDLLKTKQLEIFKMDNQDSL

SEQ ID NO: 97812 - protein, 37 aa, Glycine max
  Coding DNA Sequence Number=SeqID_6127
MVIFHHGDAVEDKREEEASLRSFFEELELSYRHPSNN

SEQ ID NO: 97813 - protein, 64 aa, Glycine max
  Coding DNA Sequence Number=SeqID_6128
  Subcellular localization annotation: CTP_CleavageSite=41; ConfidenceScore=5.30e-01
MEEMNMHKTTRGSPKGTPPQPSSTPIYRKRGILGTCSLPKQARARPSELRLSPEVTNSPRRARG

SEQ ID NO: 97814 - protein, 337 aa, Glycine max
  Coding DNA Sequence Number=SeqID_6129
MAKDIANEDQGKEEDELLTKEHRTTRRHEFFAPLLGPIKEESCSSRSLSSKEGQESLTIHKPQAFIISSIIPRHIKMRATKANPKIGDKEWVELFAKQRRDPLQKLEPPKIQFLMKVYLLIPISRLLPMHPVDIKLPQEDRSSLGKLHEHIYLRDQTTAYPLGLHILRAIDIKMVANRACPCLPVWDSAKKKGFELYCKEEMPIRKMKVEIVNLPLNWSPLFHGKQLIRTSNADDARTFWSQIVWVVSKKASTFGYNGSGIVVHRDKKFDKDVVVVVKKEVLASIQVKSFAEVVDDTIVCRVIIDLTNISIMDKTGDTSNVVVVDEVEPHIQDPASK

SEQ ID NO: 97815 - protein, 141 aa, Glycine max
  Coding DNA Sequence Number=SeqID_6130
MAFAKTLVIETIPTMEITSIHTNNEPSIHENWVRNYDSYVTRALYKDNADKDGDQKIIVYNLMCEKEKIWVNILNKSVLHKASSKTTLFDLHKFVLFQLMKNLPFDLPHTIYINMLRNLEGLGDLDDIYYAALLNKLLWDQ

SEQ ID NO: 97816 - protein, 178 aa, Glycine max
  Coding DNA Sequence Number=SeqID_6131
  Subcellular localization annotation: CTP_CleavageSite=37; ConfidenceScore=5.27e-01
ATCPRLRRATRPHLLRTTRPHLQKATRPRLQRTTSPRLQRAACPHLHRVARSRLHRTPHLCLHRTQVPGPPPDIGGRPTAQAQPEREVIVQLLCILGEDFTQPLQGDEYGSCTPPQLRSPPAEVSVSLCRHDIGIAPTRHPVDPEKSNKALGFLALVVGCCQSYRVLVPPVRSHHRDI

SEQ ID NO: 97817 - protein, 198 aa, Glycine max
  Coding DNA Sequence Number=SeqID_6132
  Gene Ontology: Mol. function=aspartic-type endopeptidase activity; Biological process=DNA integration
  Homolog annotation: Hit_ID=Q94LG0; Match level="QueryCoverage=73%, HitCoverage=10%, E-value=1e-08, Identity=26%"; Hit description =Putative retroelement pol polyprotein
MMRTENVDDEHNAIVVVESEQGRNHLRRHDGLRGRSKLQSCPQRDMSNIQYYYCSENDHVQVRCKQMKEDLEKLRDMNKDGTNSQANVVKSVKDEDDVFWANDEVAKIKWVMDSATSKHICKDREMFNTFKIDREFDHFKLGNGGKFKVEGIWSVRMKLHNALKRNHDSKVKKKVKFSNVVEVLGETSVGGGVCSLSN

SEQ ID NO: 97818 - protein, 54 aa, Glycine max
  Coding DNA Sequence Number=SeqID_6133
VLDIVSDIVDPAASMLLATPDVLDIVSDIVNPASSILHLTFHLALCIVQPDLIL

SEQ ID NO: 97819 - protein, 131 aa, Glycine max
  Coding DNA Sequence Number=SeqID_6134
MASRKRKAPASTSQACYDRFRFTSQEAWDCYSDIVIGRKILLERNVMIYHAEFDEFKYELERKNWHKELTNFMDGSIDVAIVKDFYAYLYDPEDKSPKQVRGHLIKFDEDTLNTFLKTPMLDLNEHAEDHS

SEQ ID NO: 97820 - protein, 86 aa, Glycine max
  Coding DNA Sequence Number=SeqID_6135
  Subcellular localization annotation: CTP_CleavageSite=68; ConfidenceScore=5.54e-01
MLAQLKPPSYSASSSDLASSTTDADNASSLPTKAAKQKSLLSLSSDIKLATDSPTDSGTETATGTETSAAYLSADSATNSAPSPSL

SEQ ID NO: 97821 - protein, 300 aa, Glycine max
  Coding DNA Sequence Number=SeqID_6136
  Homolog annotation: Hit_ID=Q5QJQ3; Match level="QueryCoverage=35%, HitCoverage=82%, E-value=8e-57, Identity=100%"; Hit description =Putative uncharacterized protein
DTGSRQARQGASAGDDGYRDWLNYAASEQIVLRVHHMRAIGTGLFAITPAGERGMCCKAIKLGNARVFPVTTLYAKNEEFLEGREKGYRARIRNHGHSCFLRETCRASCINESANARGEAVCVLGALPLPRSTDSLRSGRSAAASGISSLKGGSAPLTSITKIDAQVRGGETRQDYKDTRRFPLEAPSCALLFRPCRLPDTCPPFSLREAWRFLIAHAVGISVRCRSFAPSWAVCTNPPFSPTAAPYPVTIVLSPTRISRARYVGGATEFLKWWPNYGYTRRTVFGICALLKPVTFGKRV

SEQ ID NO: 97822 - protein, 79 aa, Glycine max
  Coding DNA Sequence Number=SeqID_6137
MDFLEIKILYFQSFKIKHKFKRNGEKGMSERIVIIKKGEIVEAMSSKVILMKPKNQELSKVSSKDSRIKFQGSRFKIQE

SEQ ID NO: 97823 - protein, 169 aa, Glycine max
  Coding DNA Sequence Number=SeqID_6138
KCQLAALSACVNFIRHAKRQMASQKRESIASSSSQLKYDRYKFSSPKAWDRYTNNMFGRKIIPERKVQLSFNDFEEFQGELNRRNWHKKIANLEEGSIDVALVKKFYTNVYDHEDKSPKQVKVRGQWIPFDSAAVNSFLETPVVIEEGESLPTYARFVLLRPNQQELAA

SEQ ID NO: 97824 - protein, 212 aa, Glycine max
  Coding DNA Sequence Number=SeqID_6139
MHMKMSHTKSNNLNNFLGLMINIHAKGEAFRNPQKSAPQPQCPSPSDSTQALEVPTYNVPLSHESTSEVPAMNPEISCPPSDSTQAPEVPTGNVPLSHVSTSEVPQEDKTTRRHAGRESTHCWTVEAIDSEETIKKIKVKVRGVNSLPRELRIIVNFDDQGQAIGEAQALLAGFLGTLAADCKLFPMDYDRWSGPSGVPKAYFDNCFETILK

SEQ ID NO: 97825 - protein, 167 aa, Glycine max
  Coding DNA Sequence Number=SeqID_6140
  Homolog annotation: Hit_ID=A5C365; Match level="QueryCoverage=63%, HitCoverage=13%, E-value=3e-07, Identity=29%"; Hit description =Putative uncharacterized protein
MVKEECKEVSVSSKRLAKRESHFSIKTNIKETSLLRQPPHLLLCKITLVSTVIPLELEVIPQVKELLDECLVRKSLNPCALLVPKIGIMRHQIPMIGGMMNVLSGATLFCKITHVSNIFMTHIHRNSLGVPTNPKRIKVILEWPTPPSIRKIWGFHDLTDFYKSTTQ

SEQ ID NO: 97826 - protein, 59 aa, Glycine max
  Coding DNA Sequence Number=SeqID_6141
SLPAQPSDQQVQELKKTQADLWEKATIHESFVRQKSRSKATRDSRDACSTKGIRAESPP

SEQ ID NO: 97827 - protein, 161 aa, Glycine max
  Coding DNA Sequence Number=SeqID_6142
MNSLIEHATLSEFISTHCIEAFFEELAKRAYRANCVHPLRMNTHPLDAWTRYTDNILGRNILPERKVEIYHYELDEFKAELERQNSHKRLTNLVDGSIDLALVKEFYANLYSSEDHPPKQSRVRGHLVKIDADSLNTFLETPVVLAEGRPYPLTPDIVVCL

SEQ ID NO: 97828 - protein, 95 aa, Glycine max
  Coding DNA Sequence Number=SeqID_6143
MAVIILGTPQDEATTSPSFSESEEAKGEESSEEIYPQEEGQPLMVKEECKEILVSTATPLGLEVIPQVTELLDEGLVHKILNPCALCWIKWPRNN

SEQ ID NO: 97829 - protein, 102 aa, Glycine max
  Coding DNA Sequence Number=SeqID_6144
  Subcellular localization annotation: CTP_CleavageSite=50; ConfidenceScore=5.07e-01
MDLPVSRDKRRDQHTTQVSSPSKRHIAAVGTTSNNMLSKRKTLDEGSLLSSMLKTQHDHRFSSTPYVPIDPGIGPPFQLNVCAKKVLVLCASNEYIFITCIH

SEQ ID NO: 97830 - protein, 80 aa, Glycine max
  Coding DNA Sequence Number=SeqID_6145
MASPMTFGEPSEPVDTQRLTSSSTPLSSRDGESDDMREYLMVIRTFCQPEASEPIDTQRLMSSSTPFVNQRQARPLIRRD

SEQ ID NO: 97831 - protein, 127 aa, Glycine max
  Coding DNA Sequence Number=SeqID_6146
  Gene Ontology: Mol. function=helicase activity; Biological process =viral genome replication
  Homolog annotation: Hit_ID=A2Q378; Match level="QueryCoverage=74%, HitCoverage=6%, E-value=1e-14, Identity=41%"; Hit description =Putative uncharacterized protein
  Pfam annotation: Domain name=DUF889; Domain location=1-124; Score= -37.3; E_value=6e-09; Accession=PF05970.5; Description=Eukaryotic protein of unknown function (DUF889)
MRLEGNIDATDREETSAFAQWILDIGDGIVGQQNDSHGSIEIPKDLLITEYDDPLYAIFNSTFPNLSHHRNNIEYFQSTTILASTNETVQQVNDYILSLILADIISAKNIGQNVYIPRMSMSPLQSP

SEQ ID NO: 97832 - protein, 141 aa, Glycine max
  Coding DNA Sequence Number=SeqID_6147
  Homolog annotation: Hit_ID=Q6L477; Match level="QueryCoverage=65%, HitCoverage=14%, E-value=6e-07, Identity=26%"; Hit description =Putative uncharacterized protein OSJNBa0009L15.8
MTYDTWKEVPAAQKDLIWEDIQAKIDIPKASEGRTKKKVLQTVDERWRRFKSDLTRKWTLAVDKDSVDDTVCEKYGISKEKWAQIVRPVETPRGRYKLMDEKTKKKLKEAAQSGSTEGVIDPPSPIRRHVKWKMARTKKTG

SEQ ID NO: 97833 - protein, 369 aa, Glycine max
  Coding DNA Sequence Number=SeqID_6148
  Pfam annotation: Domain name=Transposase_23; Domain location=138-208; Score=7.4; E_value=0.00018; Accession=PF03017.5; Description =TNP1ENSPM transposase
KTKKKLEEVAQSGRVDGVIDHPSPVRRHVKWKMARTKKTGEIMTEAAKEIAKKIATHGSFVPHRRQDVLAATIGRPEHTGRVRAAGAVAYPADQGPARGVRHRESNEAVPPKPLVGPSSPRVSTKGSCVDTSGNDPETGDSDRCDLYIEADPAHLVAMGRVYEESTVVHSTPLLPGQVKVSVEEVTDADAPVPVPTDEVSLVGHALHTILAWPTHLVKSLSQQVLIVLTISVSPAKPPPKPDLEVDDPLYLMTLIIPELFLRHYQVRWDATVFGVFNPDFPLYIKHEDLSEITHGGQCLSISMHLTETCMRVGNSDIYGFLEPQSIQRFGQSQFESESYIKSWMQSTQRDVYLGAYLNGPDNYLKGIIN

SEQ ID NO: 97834 - protein, 95 aa, Glycine max
  Coding DNA Sequence Number=SeqID_6149
MSRNFTDCLTMGVKFLKAVKRRLHAIKQWSPDEIRISPHATHSLSLDDKGAEFIYARLPPNFLLLNDKGENAGPTGSHMSSGPPPLDDKRCRRRR

SEQ ID NO: 97835 - protein, 148 aa, Glycine max
  Coding DNA Sequence Number=SeqID_6150
  Subcellular localization annotation: CTP_CleavageSite=26; ConfidenceScore=5.06e-01
MAFATSPSPPTFNYNQTLVPIIGASKCKLYSSHKTCGSIENNHGKFPPETKRGAFTNRGKRSGKQWSNNASSSYCKLCKKNNHDTNDCRYKCKKCKRQLHYEKDYFYEKKKKQIFYKIKNPLIILCTPLYLLKNQGMYGMLIVVVQTT

SEQ ID NO: 97836 - protein, 358 aa, Glycine max
  Coding DNA Sequence Number=SeqID_6151
  Gene Ontology: Mol. function=cation transmembrane transporter activity; Cellular component=integral to membrane; Biological process=cation transport
  Homolog annotation: Hit_ID=A7NYF8; Match level="QueryCoverage=38%, HitCoverage=31%, E-value=1e-59, Identity=84%"; Hit description =Chromosome chr6 scaffold_3, whole genome shotgun sequence
  Pfam annotation: Domain name=Na_Ca_ex; Domain location=206-330; Score= 93.9; E_value=5e-25; Accession=PF01699.15; Description=Sodiumcalcium exchanger protein
MTCEKSIIMPNGYEHIIFLSHLHHFQQFLPPLSLANLRIQCLGELHQHRLGLPDAHDEIGVARLEATVEVGDGVNEEGGAVGVGLVEARCRLAVVEGVKAVDGEDREGVVVGGGEALIVEEAEVVAEPDEGGTVEGGGIERVTGAVGNEGERGVEGIGGDGEFEGGFGRKRKRSGGGERKGDENEDEEKAVIGFRSAFSWLVEMTLIISLLSEYVVATIEAASDSWGISVSFISIILLPIVGNAAEHVGSIIFAFKNKLDISLGVAMGSATQISMFVVPFSVVIAWIMGIEMDLDFNLLETGCLAFTIIVTAFTLQDGTSHYLKGVIKHRVGSISELEHKLGWRGASPLGGSPVFESN

SEQ ID NO: 97837 - protein, 75 aa, Glycine max
  Coding DNA Sequence Number=SeqID_6152
MAEKGRRPLKFYLEIAMNALSAPCALSMFIAAVKTLNFQMNELCGPCRAKRAKRALCAKPECLFVEAELRARMKR

SEQ ID NO: 97838 - protein, 59 aa, Glycine max
  Coding DNA Sequence Number=SeqID_6153
MDSRDGGSHRGGGGAPAVVLMGGRISLAGVIDTPQNWQRPVIKAGNPSALLDISGSTGV

SEQ ID NO: 97839 - protein, 417 aa, Glycine max
  Coding DNA Sequence Number=SeqID_6154
  Homolog annotation: Hit_ID=A5B5G7; Match level="QueryCoverage=54%, HitCoverage=15%, E-value=9e-10, Identity=24%"; Hit description =Putative uncharacterized protein
KPRSAACCAKPQMLTGLYNFKLGLAEVSPLNKAKHSRCAKPLLSVEKVELSVPCCTKLNSLTVFGVFVVRLSASCALSLSVILMAFKKRMAPSTPSQARYDRSRFTSQEAWERYTDIIVPRKLLPERNVVVYYTEFDEFKEELERRHWDEELTSFADDSIDVAIVKEFYANLYDPEDKSPKQVRVRGHLIKFDEDTLNTFLKTPVIVEERENLCAYSRFALLRPNPQELAAKLCIPGRGFKLNADGQPLKILRKNMTTLAQTWSVLSFSNLIPTSRISDVTLDRAKLINGIIMKMDMNVGYLISHQISITAQHDSSKLGFPALITALCKARGVQSDFRSLESLSPAINLAYIKKNFWNLDDPTVTFRGPRKARGKRSEVLTTSAAPKTATPSSSTAPAPPILTPAQTPAPSSFTPST

SEQ ID NO: 97840 - protein, 72 aa, Glycine max
  Coding DNA Sequence Number=SeqID_6155
MHDAIKNLMERIQKSTSSDNSRRMLHGLSATTHHQERKTLDEASLLSSESKTQHDHRSTSTPYGSHRPRYRA

SEQ ID NO: 97841 - protein, 110 aa, Glycine max
  Coding DNA Sequence Number=SeqID_6156
MALADINCRAYITMDLVVFSQSKVSVIRPFFEVKDLEAEKLLAMVTASIGKCQQERERGGNHIERGNLVVVHDVEGTTRGEDKSGGCRRVSIGKGWRVSIWKERKLMRWD

SEQ ID NO: 97842 - protein, 96 aa, Glycine max
  Coding DNA Sequence Number=SeqID_6157
MGSSQTPSLKKRFYQVKVKSLGITSLKELGQLMGQLQRQAFRKAYDKIWDLAMVEVSIGVIASLAQYYDQPLRCFTFGDFQLSPMVEEFEEILDAL

SEQ ID NO: 97843 - protein, 189 aa, Glycine max
  Coding DNA Sequence Number=SeqID_6158
  Subcellular localization annotation: CTP_CleavageSite=37; ConfidenceScore=5.47e-01
MPKVKRFRNPQKSAPQPQCPSPSDSTQAPEVPTGNVPLSHESTSEVPAMNPEISSPPSDSTQAPEVPTGNVPLSHVSTSEDPQEDETTRRHVGRESTHCWTVEAIDSEEMIKKIKVKVRGVNSLPRELRIIVNFDDQGQAIGEAQALLAGFLGTLAADCKLFPMDYDRWSGPSGVPKAYFDDCFETILK

SEQ ID NO: 97844 - protein, 116 aa, Glycine max
  Coding DNA Sequence Number=SeqID_6159
MGLRKRVEDGELHACRSTLEAHAITSMAPSSKVEEHERKRNSWGSEKGLRMENCTKQSLRMAPNSWVEDAERKRNSWGSEKGLRMENCTKQSYAWLQTRGWRTHERKRNSWALKKG

SEQ ID NO: 97845 - protein, 81 aa, Glycine max
  Coding DNA Sequence Number=SeqID_6160
MDECIELMKEHNLEMLECLSAHLAVAMTDFARCFQIIIVTRALWNNTEVRAESDTLTPQICLAPDIKIGVPTIKDPIETQP

SEQ ID NO: 97846 - protein, 277 aa, Glycine max
  Coding DNA Sequence Number=SeqID_6161
MAQDDASNEVNYMGNHNHQGFHQRGPQGFYQSDNFLQEHDWRYYPSNNFNQGGSPYQHPSQGSSQQEKPPISIEEMLLSFIQETRANAQETKAFIQANAQETKAFIQETRSHQKSTDAAIRNLEIQIGQLAESTAEKPTETFSVNAEMKPKEDCKVIFTEREEEEKKTEEDVRDEEGEKKEGRERNEEKAQQWEKYSQVEIQQESILQVNTPPHQLIVKKERHGEHEKALSVILSLITTTSLAITWKVLPEYTSFMASLTKRRECKEDVFYVTFMPP

SEQ ID NO: 97847 - protein, 41 aa, Glycine max
  Coding DNA Sequence Number=SeqID_6162
MTEKGFKYTLSIMSFERLSFTTANWRCCGSALIISLKPQSQ

SEQ ID NO: 97848 - protein, 101 aa, Glycine max
  Coding DNA Sequence Number=SeqID_6163
  Homolog annotation: Hit_ID=A7Q5D6; Match level="QueryCoverage=36%, HitCoverage=23%, E-value=1e-08, Identity=78%"; Hit description =Chromosome undetermined scaffold_53, whole genome shotgun sequence
MVVISLSMKLKEEHCSIGFSRPLTNQNKNPFSYGSMEAVAGLTQHNNAKLIADSSFSKLCHGLDANAGPLTNFEVLDFLRSKGASKDPTSVIAKVAQSEYK

SEQ ID NO: 97849 - protein, 159 aa, Glycine max
  Coding DNA Sequence Number=SeqID_6164
EEYQHCRDEILQHSTEEGTSTQDSPNTATFVNDNEIYLNVVGGPNYKRNVYMLGTLSKRFSCSKSAPSTSIAPVEDQIEEMRETINKLNVELLEKANKEKTLEEKMLQLMENHDHQSQDMRQPMQEQSEQIHQQNELMQCILQHLHIQSIIPAPTPSTT

SEQ ID NO: 97850 - protein, 168 aa, Glycine max
  Coding DNA Sequence Number=SeqID_6165
MKPLDSVYFDFPWQGKPRGGSTHLRVKLKTPKEATELIENILQVVPSVVRLMKQANVFTLKKTLKNFTIWEINRDKDILKEDSQASSRVLIINKDSGDHTLAINSTKTRVQVGQLAKKIADKSSNSFVANTEKNPKEECKAVMTKSKRFVEAEEEDSVLSKKKATEKK

SEQ ID NO: 97851 - protein, 116 aa, Glycine max
  Coding DNA Sequence Number=SeqID_6166
MTFESLKSNFDKENHSNKGLYYLQELSTEEANKRIQSWSTNEQLLVGKAYEYIRGVKPTVSWKSLQVWAHIRDLALFCRRFTSLQCITDSLIWGRSKSGVQGKLRCLAIAITVYYI

SEQ ID NO: 97852 - protein, 177 aa, Glycine max
  Coding DNA Sequence Number=SeqID_6167
GHAERIVSKGSRERNIVKVNNDIAETGESRKGMTISGKLGNDHTPFVAASEVATGLPSEIEVGLLLSCSVDCSQLNALTPTAPTPSPKAGYLPEYNKRKAKKRRKRRMQKKVGTRFVGSTPLSKRSVGIRLYRTELSSHTYNLRCSPVSLLSYSTALGTDARLSAFHRYGYPAYLTT

SEQ ID NO: 97853 - protein, 722 aa, Glycine max
  Coding DNA Sequence Number=SeqID_6168
  Homolog annotation: Hit_ID=A1FXU0; Match level="QueryCoverage=43%, HitCoverage=50%, E-value=1e-58, Identity=44%"; Hit description =Putative uncharacterized protein
VAAVRIGRLEHQQLAAEADRAAADQRLGGGDAGGIDLMTGRHIVAAVQHQIGAGDRVAQRLPLQPLRQRDGFHQRVQRLQVALRQRRLAGGGIGAAVEDLPLQVGDMQLVVVGQQQRADAGGGQIQRSRGTEPAQTDDQHRGALEFLLAFRADVLQQQLAAVAKEFLIVKHLRRLGDGADHRHAADAARQHRRYAIDADPADRHRRVIRQAGDMAFQLRQPLRRRRHVFGLGREDVPQRDVGRFHRQRACQLGVVMGGHAQPQPGAVNGRQIGSIEILLAQMHAVSAVLDRQPPVVVDEQPRLITLAQRDGGGDIRFDLLVRQVLDAQLDGGDAGLQQASDPFHAVDDRGCGAVIQLAAAGAKLVQAILVSSMPISRFHGNAGNFRWCEQNLAAHRAAARHDAGQAFGGHWHVAQQHAGVDGEVVDSLLRLFQQRIAEHLPGEVFRHAVDLLQRLVDRHGADGHRAVAQDPLAGFVNIAAGREIHHGVRAPAGGPHQLLHLFFDRRRDRRVADIGVHLHQEIAADDHRLRLRVIDVGGNDGAAGGHFMAHELRRDVVRQVGAPALARVLVAQHLAANALAPHVFTDGDELHLRGDDAGAGIVQLGHAPARQRLARQRQMFEAQMIQPLVRQPLLGEAGAGAAEGGGIAARVDPAGAQFGETGVHVELGLRIAVGAGGVIHRDRLVGFILRVVFAAAEQGRAELNFAHRHLDIAARALQIDTA

SEQ ID NO: 97854 - protein, 56 aa, Glycine max
  Coding DNA Sequence Number=SeqID_6169
MQIQKETYLFWMIAELAKFESSLSHHRLHQMTSAFWVLKATSQRDHGQLWQIEIVA

SEQ ID NO: 97855 - protein, 131 aa, Glycine max
  Coding DNA Sequence Number=SeqID_6170
  Pfam annotation: Domain name=zf-CCHC; Domain location=60-77; Score =34.2; E_value=4.8e-07; Accession=PF00098.14; Description=Zinc knuckle
IALKASSSMQEEEEEEEESDDEEDFSLFVKKFHKFVINRRMERSHNFNNGKKSQEVSPTLKCYKCNQPGHIKANCPSNESWPEKNEKKRYKERRSKKVYIPWDDNDSSDGSEKEINLLSKDYESDENISQE

SEQ ID NO: 97856 - protein, 180 aa, Glycine max
  Coding DNA Sequence Number=SeqID_6171
  Pfam annotation: Domain name=zf-CCHC; Domain location=8-25; Score =21.5; E_value=0.00084; Accession=PF00098.14; Description=Zinc knuckle
MPEKTSSMKCFKCLGRGHITSQCPTKKTMIMGGQDIYSSQDEATTSPSSSKSEEAKWEESSEEIYPQEEGQPLMVKEECKEVSVFSKRFQSSFRAQNFMLFSPSPFIHLLLPPSSHPWPPMVWCLLSLFLSPFHCHSSSKKQRNLLMKKILGLQVPMELTSRSRVEKREVRLRFLHKCQC

SEQ ID NO: 97857 - protein, 221 aa, Glycine max
  Coding DNA Sequence Number=SeqID_6172
MVLKEELVACSRSKGNLSQRLCETETNMLAIVSKYQEELNLAIAHEHKVVDEYALVYAEKEARGRVIKSLHQEATMWMDQSALTLNGSQELPRLLAKAKVMADTYSAPEEIHELLSYYRCESSHSRILSLACIHFLPTPHVWNETTYNVATTAAVSSAAEADPTLPATAHHPLPNVVRRERSTLGHISNPHLGYNRVAYPYGLPPNYTPPVMCDDAGHVPS

SEQ ID NO: 97858 - protein, 173 aa, Glycine max
  Coding DNA Sequence Number=SeqID_6173
MAQPPPRERTLREMAAPDFTYESLCIQYPDEDVPYVLKTGLIHLLQSFMALQFSARNDAIVIRGVHEVATNPSTSSETKKLEGKLDALVNLVIQLALNQKSVPVARVCGLCSSADHHTDLCPSMQQPGAIEQPEAYAANIYNRPPQPQQQNQPQQSNYDLSSNRYNPGWRNQP

SEQ ID NO: 97859 - protein, 66 aa, Glycine max
  Coding DNA Sequence Number=SeqID_6174
MKMLLIPHDVAPCGACRPWIFFINGVLCFLKMNDSGMEKEDDWRCHFKKKMSQEEAHHHRKLWIRA

SEQ ID NO: 97860 - protein, 57 aa, Glycine max
  Coding DNA Sequence Number=SeqID_6175
MENKMKNKPWIIFINGVLCFLKMNDSGMEKEDDWRCHFKKKMSQEEAHHHRKLWIRA

SEQ ID NO: 97861 - protein, 180 aa, Glycine max
  Coding DNA Sequence Number=SeqID_6176
  Pfam annotation: Domain name=zf-CCHC; Domain location=108-125; Score =31.2; E_value=3.8e-06; Accession=PF00098.14; Description=Zinc knuckle
  Subcellular localization annotation: CTP_CleavageSite=15; ConfidenceScore=5.09e-01
DSKSSLLSFTRLKVLAFSLSQDSKSSLLSFIGLTSSPLSFIGLKILCLYAFIGLKVLYEEENEEEDSDDEEDFSLFVKKFQKFVKKRRIERRQNFNNGRRSQEDSQVLRCYKCNQLGHIKANCPSNEEWLEKSDKKRYDERRTKKAYIAWDDNDSSDGSEKEINLQTKDYESDENISQED

SEQ ID NO: 97862 - protein, 103 aa, Glycine max
  Coding DNA Sequence Number=SeqID_6177
MDVLQIANLSATQLGNNPRFPPITMNNDASSIGACRPRIFFINGFLCFLEDEWQRNGERKRERRRHFNEKMSLEEAHHHRRPWIRAWRKKEMNEGRGREEHEN

SEQ ID NO: 97863 - protein, 327 aa, Glycine max
  Coding DNA Sequence Number=SeqID_6178
  Gene Ontology: Mol. function=metalloendopeptidase activity; Biological process=cell wall catabolic process
  Homolog annotation: Hit_ID=A6TB26; Match level="QueryCoverage=100%, HitCoverage=78%, E-value=1e-170, Identity=90%"; Hit description =Putative uncharacterized protein yebA
  Pfam annotation: Domain name=LysM; Domain location=77-121; Score =24.9; E_value=0.00029; Accession=PF01476.11; Description=LysM domain
  Pfam annotation: Domain name=OapA; Domain location=75-147; Score= -1.7; E_value=0.00059; Accession=PF04225.3; Description=Opacity -associated protein A
  Pfam module annotation: Pfam domain module=LysM::OapA; Domain location=77-121::75-147
MLGSLTVLTLAVAVWRPYVYHPSSAPIIKTIELEKSEIRSLLPEASEPIDQAAQEDEAIPQDELDDKTENEAGIHEYVVSTGDTLSSVLNQYGIDMGNISQLAAADKDLRNLKIGQQLSWTLTADGDLQRLTWEMSRRETRTYDRTANGFKMTSEVQKGDWVNSVLKGTVGASFVSSARDAGLTSAEISSVIKAMQWQMDFRKLKKGDEFSVLMSREMLDGKREQSQLLGVRLRSEGKDYYAIRAEDGKFYDRTGTGLAKGFLRFPTAKQFRVSSNFNPRRLNPVTGRVAPHRGVDFAMPQGTPVLAVGDGEVVVAKRSGAAGYYVA

SEQ ID NO: 97864 - protein, 112 aa, Glycine max
  Coding DNA Sequence Number=SeqID_6179
APPPPPQADSVGSFDRERYLRNLVRQQAANHRAHVQTHDSLYQLSLSLQSQGFASFPCPTSDQFRAEVAWPRDWPKAQAAEASAEAPGEPDEAREDEEMSDLLGFLGGSGAT

SEQ ID NO: 97865 - protein, 38 aa, Glycine max
  Coding DNA Sequence Number=SeqID_6180
MPFFQAPELHVEIHKQGFGQQQQAAATAGSSTSASGTK

SEQ ID NO: 97866 - protein, 84 aa, Glycine max
  Coding DNA Sequence Number=SeqID_6181
MYRKYNSGHWSLIAPIDIFLLTLWNFISKRWPIIFFTSMLARKDDRSRSKQEESPDDADRTFPNRHRRNIIWECIEKTIADIGR

SEQ ID NO: 97867 - protein, 72 aa, Glycine max
  Coding DNA Sequence Number=SeqID_6182
MSIRTCRKAWAEQMRKMSDKCERKEPFIGTCRIQFEWNWMHKKLLNCAAKLPNYAKNGCAVLVMGKVVHIVF

SEQ ID NO: 97868 - protein, 126 aa, Glycine max
  Coding DNA Sequence Number=SeqID_6183
MGKVEEAQEQMKANMEAMKEQLATMMEAMMSMKKIMEASAVAIAATRAVAKAKIWEVGTTLMIGKFKTSTPSRHMACLPTVHHPMWHTLPIRMSITPLPYSLKADNLIMQMSLKPWGRHMKCPTTI

SEQ ID NO: 97869 - protein, 19 aa, Glycine max
  Coding DNA Sequence Number=SeqID_6184
WFSDGSPLDVEAITTVRQI

SEQ ID NO: 97870 - protein, 154 aa, Glycine max
  Coding DNA Sequence Number=SeqID_6185
MASRKRKCTAFRPQAQILPERNIKIYHTEFDEFKAKLERRNLDKRLANLQDGSIDVAVVKEFYSNLYNPEDQSPKQVKVRGNLIKIDADSLNTFLETPIVLEEGETLPTYSRFTMMRIDPQEFAARLYIPSRGFVLNAEGHPWKLLRKDLTTLA

SEQ ID NO: 97871 - protein, 61 aa, Glycine max
  Coding DNA Sequence Number=SeqID_6186
DIVSDIVDPAQSVKDITALCVQYFRARCQDIVSDIVDPAASMLLAIPVFSSRMSWTLYPTS

SEQ ID NO: 97872 - protein, 191 aa, Glycine max
  Coding DNA Sequence Number=SeqID_6187
  Homolog annotation: Hit_ID=Q2HW90; Match level="QueryCoverage=85%, HitCoverage=32%, E-value=9e-15, Identity=31%"; Hit description =Putative uncharacterized protein
MDRVQHQVFSKVYGKIWDLAMKEVSAEAIASLTQYYDQSLRCFTFEDFQLAPTIEEFKGILGCPIGGRKPCLFSGYYPSMVRTIGVVKILEQKLDRVKQSRNGVGGIPRKCLEEKVETLASQGEWASFIGVLALLVFRTVLFSNVDGLVDLATIDAFLAYHHDKESPIIAVLANAYDTFDLRCEKSSVRIV

SEQ ID NO: 97873 - protein, 223 aa, Glycine max
  Coding DNA Sequence Number=SeqID_6188
  Gene Ontology: Cellular component=mitochondrion
  Homolog annotation: Hit_ID=Q6YSL1; Match level="QueryCoverage=18%, HitCoverage=34%, E-value=1e-14, Identity=95%"; Hit description =Putative uncharacterized protein orf120
YALLGPRHGGGPVARHEHRAKRRLSNSSEPPYPLAGPGVPVKGASAYPGNAAARDNPPIHSQRGGWHYWQRPSGENAAGAKRGRPVPGEHSIGRKGSQDGGRARGGRDLRMNAGLGHLEWREPHAGDPHVRAIAESLNEVLRFFRRWSQRSAKTNVSTTPSPSGSQTEAECTGKERELGRSILWRSIRSITAHSHDLCREIGAFGGTGELHLLLDRCVGQRAR

SEQ ID NO: 97874 - protein, 62 aa, Glycine max
  Coding DNA Sequence Number=SeqID_6189
MTITKSKKIVESIKRELERCEAEKKTLEKRRLCARNHWPEHRMSLPRYLKLSQMLNLKLLPW

SEQ ID NO: 97875 - protein, 107 aa, Glycine max
  Coding DNA Sequence Number=SeqID_6190
MEWFFQISHPFMIPTQAGDQPRHALAPDHEDYMQPAIPQVPVAFDPPRHAVDDYEGYETIAERLECVLNLRMVTVGTELHDIMQDCLRIARGVPAQMEVLGLDKDGA

SEQ ID NO: 97876 - protein, 118 aa, Glycine max
  Coding DNA Sequence Number=SeqID_6191
MEKSEKKNFSEKKMKKAYITWDDNDMESSEDSENEEINLCLMAKIYESDEEVTSSNNNLSISFDELQDAFADLHRESIKLANKYGKEIKDLKNSLAKFSIGKNNLDVILGKQRCVFDK

SEQ ID NO: 97877 - protein, 40 aa, Glycine max
  Coding DNA Sequence Number=SeqID_6192
MSTVMRIMKLAKYRLKAQVEKDEGPSGEGQSPQVEKDEGS

SEQ ID NO: 97878 - protein, 57 aa, Glycine max
  Coding DNA Sequence Number=SeqID_6193
  Gene Ontology: Mol. function=cyclin-dependent protein kinase activity; Cellular component=cytoplasm; Biological process=protein amino acid phosphorylation
  Homolog annotation: Hit_ID=Q38773; Match level="QueryCoverage=80%, HitCoverage=16%, E-value=2e-14, Identity=76%"; Hit description=Cell division control protein 2 homolog B
MGTPNEDTWPGVTSLLDFKSTFPKWQPKNLKTVVPNLEPAGLDLLCNKKIDDKNEFG

SEQ ID NO: 97879 - protein, 226 aa, Glycine max
  Coding DNA Sequence Number=SeqID_6194
  Gene Ontology: Mol. function=identical protein binding; Cellular component=chloroplast; Biological process=thiamin biosynthetic process
  Homolog annotation: Hit_ID=A9PEX7; Match level="QueryCoverage=91%, HitCoverage=58%, E-value=2e-74, Identity=71%"; Hit description =Putative uncharacterized protein
  Pfam annotation: Domain name=Thi4; Domain location=1-165; Score =166.7; E_value=6.3e-47; Accession=PF01946.8; Description=Thi4 family
MVVCKPAHLFLDELDVAYDEQEDYIVIKHTALFTSTIMSKILARPNVKRFNAVVAKDLIMKEGRVVTNLALVSMNHDTQSCMDPNVMEAKVVVSSCGHDGPLSATGVKRLKSIGMIDNVPGMKALDTKSIGMVVVRLTREIVLGMIVTGMEVAEIGGSPRMGPYLSMMFKLTFKLMERVELKALGRNNAIDGTCGVGTEEPHLIFASTVEFHDGLESMMLDQVASE

SEQ ID NO: 97880 - protein, 84 aa, Glycine max
  Coding DNA Sequence Number=SeqID_6195
MTQLNIDLSLGWRISWHSEAFAAQEPQLEPEPQPEVVLEATPVATPQASPVTSPILEVDGAADADTKSTWDPWLVTAQDIPQPA

SEQ ID NO: 97881 - protein, 198 aa, Glycine max
  Coding DNA Sequence Number=SeqID_6196
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=26%, HitCoverage=50%, E-value=9e-24, Identity=100%"; Hit description=LacZ protein
  Subcellular localization annotation: CTP_CleavageSite=26; ConfidenceScore=5.10e-01
TYQGNPCGVYPDLSSFTGSGVYPDLSSFTGSGVYPDLSSFTGSGVYPDLSSFTGSGVIQKLYSLYQAIRPDHEASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 97882 - protein, 107 aa, Glycine max
  Coding DNA Sequence Number=SeqID_6197
PLDLEIEATLRRNRAERRRKLLQDRTVASILEEETHFSDSLSPDSPSSRESANQHSETATMADEHDQRTTLEDYSSGTVPQGFTSIARPKVQAHNITYPHSLIHLIP

SEQ ID NO: 97883 - protein, 113 aa, Glycine max
  Coding DNA Sequence Number=SeqID_6198
  Homolog annotation: Hit_ID=Q2HVW1; Match level="QueryCoverage=68%, HitCoverage=32%, E-value=1e-11, Identity=41%"; Hit description =Putative uncharacterized protein
MDEAKADKLNRREQSNGESTIFSIQKWTPEMKTEFRLIWIHIWGVPLEIWDTKHFQTLLSTFGEIVDLDEETADRSRLDVARILIRTKEKPIFSKSMMAMVNDNEHHLFLREE

SEQ ID NO: 97884 - protein, 28 aa, Glycine max
  Coding DNA Sequence Number=SeqID_6199
MAFLKEYVLAPMGTISQSTSSLYVPMEK

SEQ ID NO: 97885 - protein, 40 aa, Glycine max
  Coding DNA Sequence Number=SeqID_6200
MDQGFRRSKSKPTLYIKAQDDLIYMGNNTKMMMEFKEDMM

SEQ ID NO: 97886 - protein, 214 aa, Glycine max
  Coding DNA Sequence Number=SeqID_6201
FDEFKKELERRHWDENLTDFSDSSIDITIVKEFYANLYDPEDKSPKQVRVRGHLVKFDEDTLNTFLKTLVVQEEGENLCTYSRFALLRSDPQELAAKLCIPGRGFELNVNGKPLKILRKNMTTLAQTWSILSFSNLIPTSHTSDVTLDRAKLIYVTFRGPRKARGKRSEVPTTSAPPETPAHSSSTTPVPPIQTLVIHPTSTQIPLLAPLSTRP

SEQ ID NO: 97887 - protein, 85 aa, Glycine max
  Coding DNA Sequence Number=SeqID_6202
MKHTPSPPHTYSQNNSKAPKFLKGKVKSWLIWLEAYKNKMPKSSPNMHVKQEVSTRVKPRILCKQSMRQNTPNKIDDDGSNSHQG

SEQ ID NO: 97888 - protein, 381 aa, Glycine max
  Coding DNA Sequence Number=SeqID_6203
MALQIHEGQNFGFGRLLLAVLYESLGEACDDLKKSKDGSSFLVSGPMWLLQLWLNATFEQEMGLIIPQDYAEEVANRSIEGQRALRLTPKTFDQNPQKLFLKYMRIFLSFDKFLPQHAPFISREVGPAWFTDYFPAVDPDNEEEVNEIWSFYLNPQILSCRTDENYNLHPFEFNHSHFCTIGFVTWWEKYYSGRSVGDTTIMISRLESGFTQPTVENIRSNLQARGKTIMTKKIAETSQADVRPKKPTGVKIQEWKQEEKEEEERPLIRKRKSPATSTKSADQTEAGNSQAQMPKKKKKVKQVEPEPSVTVEGGEPARKKKKKTKSSKEQGDNQPVDVQPPSTDVDGTEAEATPSIAEKGNPVEQPDLPQEQPTVEVSFLM

SEQ ID NO: 97889 - protein, 17 aa, Glycine max
  Coding DNA Sequence Number=SeqID_6204
LAKSLLFGTRMGTGVEV

SEQ ID NO: 97890 - protein, 189 aa, Glycine max
  Coding DNA Sequence Number=SeqID_6205
  Gene Ontology: Mol. function=motor activity; Cellular component=cell projection
  Homolog annotation: Hit_ID=UPI00016621D1; Match level="QueryCoverage =80%, HitCoverage=42%, E-value=2e-19, Identity=43%"; Hit description =UPI00016621D1 related cluster
MPISLCESIDWSVPSRYRGRAHKTHSGPGGAQQGPAVSSSGYGPLSVLYVLTFRGLHVLTFRGLQVLTFRGLHVLTFRGLHVLTFRGLHVLTFRGLHVLTFGGLHVLTFRGLHVLTFRGLHVLTFRGLHVLNFRGLHALAFRGLDVLAFRGLHVLHFRGLHVLVFRGLRALTFSGLHIRTLREFKVLYP

SEQ ID NO: 97891 - protein, 342 aa, Glycine max
  Coding DNA Sequence Number=SeqID_6206
VQQNVSVEEIPSCARTSPAPETDAVNVEEQGEGQGIGPSSPQGSSQRSSSEEHFPDEEAIQEAEAGGSDIFPVSSTSKLSASIGIAEDTFIQMQDEDPAAALRLLLNTSQANTSSEKNPGASSSSDADITSTVRQDCLLLKLSMEYARADVLKSIEENPSAAFGHLNFLKKLHNPLTSDEILGKVIQIESIIDQFANTVQKKRENGARLDAQKQAHILLLEKARAAQREVERLTKEAKEGSSEIKACDDNISSWEATITNLLSQVDDLRQKIVTEQAKRKELQEKAADSIQKLVAEKGREGLKAFSASQAVADEARAMESADQVLSKEMATLKKLYEDLIMT

SEQ ID NO: 97892 - protein, 558 aa, Glycine max
  Coding DNA Sequence Number=SeqID_6207
  Gene Ontology: Mol. function=carbon-nitrogen ligase activity, with glutamine as amido-N-donor; Cellular component=cytoplasm; Biological process=translation
  Homolog annotation: Hit_ID=Q1GYD3; Match level="QueryCoverage=88%, HitCoverage=99%, E-value=0.0, Identity=74%"; Hit description =Glutamyl-tRNA(Gln) amidotransferase subunit A
  Pfam annotation: Domain name=Amidase; Domain location=87-538; Score =666.8; E_value=1.7e-197; Accession=PF01425.12; Description=Amidase
MALNLDDIMRIAHLARIEAVDTTGIEPMSHSQDVTQRLREDVVTATNQRELFQSIAPATQDDTLAMINSSLKQLGQQLASKQVSSVELTQAYLQRMAQLNPSINAYVTIDEAKTLAQAKAADARIAAGDFGPLTGIPLAQKDIFCAKGWRTTCSSKMLETFISPYDAHVISQFDAAGAVNLGKTNMDEFAMGSSNETSYFGGVKNPWDVDRVPGGSSGGSAAAVAARLCAAATGTDTGGSIRQPASLCGFTGLKPTYGLVSRYGMIAFASSLDQAGPMAKSAEDCALMMNVMAGFDERDSTSVNREKEDYTRGLDKMKGEQPLKGLRIGLPKEYFADGLNADVAKVIETAIAEYKKLGAEIVEVSLPNNNLSIPVYYVLAPAEASSNLSRYDGVRYGHRAAEYNDLMEMYMKSRAEGFGAEVKRRILIGTYVLSAGYYDAYYLKAQKIRRLIAQDFVEAFKHCDVIMGPAAPSPAFKAGEKTSDPVAMYLEDLYTIAVNLAGLPGMSIPAGFATSSEGKALPVGLQIIGNYFDEARMLDIGHAYQQVTDWHTRMPEGI

SEQ ID NO: 97893 - protein, 59 aa, Glycine max
  Coding DNA Sequence Number=SeqID_6208
VNKAEMLLLLPLLASSKEKDSVLVVANIEVRGGLCDIEKYLLYALGYPYPELSVAVDPA

SEQ ID NO: 97894 - protein, 159 aa, Glycine max
  Coding DNA Sequence Number=SeqID_6209
  Subcellular localization annotation: CTP_CleavageSite=77; ConfidenceScore=5.49e-01
TATPISPCKSISWDRTHKTPSGPGKVQQGPGVSSSGYGPLSVLQGARTPPARSRHHRDCARKTPSGPEEGQQCLGVASSKYGSLSVQGSACCPQQGHQAPYQSSFHLEVLRLQAGAGRNTTAAWGWPAAGNRRTAITSRVHLSSSTKRLERCLRPMADQ

SEQ ID NO: 97895 - protein, 89 aa, Glycine max
  Coding DNA Sequence Number=SeqID_6210
MIEARQKGVRKKNGGDACHPARPSELGCFLQKQPPSGGIFWKAQIVLQMLSFDFWHVMELHELPNDGCQIPQSSQTRVASQQRMLPGRN

SEQ ID NO: 97896 - protein, 363 aa, Glycine max
  Coding DNA Sequence Number=SeqID_6211
MHKGSSSRSQRHSEAQDAPIPFSISSSSLFSLEEQCTQYTKLFSSHSIIDPKFIDMDFFSEESFECIQAFHNSNLIPFMSLKLPVYSELVKAFYSNLEIQESTLIFEVYGIKMVIDQSLFYDLTQLSSDGVPFEGALDDDWKFDFFVHDARRLVCTNQADMTRRLLASSLALESRILHYLIVRILLPRSSNLAQVSEEDLIVMWAFHTDRQIDWAHVVWYRMHKGLRLNAPLPYPHLVTLFLQHFNIPLDFEPYVPIKRSFLIGAAVVASFGYRKERDGSWVKKGAQPNDDEGYLPVEGDSSLLKSILDRFDGLQTYVGERFDSLERQVDTRFEEMNLRIAKVEEDVTIICDCFDLPPLPPSV

SEQ ID NO: 97897 - protein, 95 aa, Glycine max
  Coding DNA Sequence Number=SeqID_6212
MLSTDECGSGGNLGDGGSMHDDVSVQGETNFNDVHAFNQQPSCHTLISSRDHPLLGCDPRLTTLRYLAPIVRKFVKFRDMPEVKRKRCSTFREVP

SEQ ID NO: 97898 - protein, 206 aa, Glycine max
  Coding DNA Sequence Number=SeqID_6213
  Homolog annotation: Hit_ID=Q6WAY4; Match level="QueryCoverage=56%, HitCoverage=20%, E-value=1e-08, Identity=34%"; Hit description =Putative uncharacterized protein
MGSSQMPSLKKRFYQVKVKNLGTTSLKELGQLMGQLQRQAFRKTYGKIWDLAMVEVSTETIASLAQYYDQPLRCFTFGDFQLSPMVEEFEEILGCSLGGRNPTSSQVLFPNVNGSVDLAAIDAFLAYHNHKESPVVAMLADLYDTFDRRFSHLFRQEVRHACPLESHRSCTEKGGANWDQLLASKEGASVNWFPRWKEGRTGVLIS

SEQ ID NO: 97899 - protein, 45 aa, Glycine max
  Coding DNA Sequence Number=SeqID_6214
SDYEPPVNFTECLSPPTRSLGPALTRLHQEVLRPQAGAGQDTTVA

SEQ ID NO: 97900 - protein, 369 aa, Glycine max
  Coding DNA Sequence Number=SeqID_6215
  Homolog annotation: Hit_ID=Q2HW90; Match level="QueryCoverage=47%, HitCoverage=35%, E-value=9e-21, Identity=33%"; Hit description =Putative uncharacterized protein
GVDILVIRTFIPANMGIADGSSSTSSLQQGVWENMGFGHGRSAVEAITSLTQYYDQSLRCFTFREFQLTPTIEEFEEILGCPLGGRKSYLFARFYHSMARIAKAIQISEQELNRVKQNRNGVIGIPRKHLEEKAEALANKREWTSFIDILALLVFGTILFLNVDGLVDLAAIDTYLAYHHSKQSLVITILADTYDTLDLRCEKSSARIIYCTPTLYVWLVSHVFVMKERPLAGSPDGKKEGQECYARYPMRGAPSEEIIACFVARGFNEANAKILQRVRKAWNTVEMKDKELRGSSNGIIGGYHKWLNSRTQGITWLPKLKGLSGKEAEVPKESKEVQALKAELEKTRVIKEKLKTAVTRVRKDCDELR

SEQ ID NO: 97901 - protein, 164 aa, Glycine max
  Coding DNA Sequence Number=SeqID_6216
  Gene Ontology: Mol. function=DNA topoisomerase (ATP-hydrolyzing) activity; Cellular component=chromosome; Biological process=DNA unwinding during replication
  Homolog annotation: Hit_ID=A7MJS7; Match level="QueryCoverage=100%, HitCoverage=21%, E-value=8e-86, Identity=93%"; Hit description =Putative uncharacterized protein
  Pfam annotation: Domain name=DNA_topoisoIV; Domain location=1-164; Score=-78.4; E_value=1.6e-15; Accession=PF00521.11; Description=DNA gyrasetopoisomerase IV, subunit A
MAQPFSYRYPLVDGQGNWGAPDDPKSFAAMRYTESRLSKYAEVLLGELGQGTVDWVPNFDGTMQEPKMLPARLPNILLNGTTGIAVGMATDIPPHNLREVAKAAITLIEQPKTSLDELLDIVQGPDYPTEAEIITSRAEIRKIYQNGRGSVRMRAVWNKEDGAV

SEQ ID NO: 97902 - protein, 228 aa, Glycine max
  Coding DNA Sequence Number=SeqID_6217
MSYPRIITPTLLCRSVSWHPLDPDKSNRALGFPALITGLCQSFGVPITPSKVIRPPITRAFIEKYCTPRKAQGDAPQAVDAPRPPHQADPAGSLGMERYLQHLVRQQAANHRGLSQQGLGFAPFACPTPDQFRVEVEWPGDWPEDQTEEAPTGVPDDAEDARMDEKMADLLGFLGGSGATARLLARQMDSSSVLSRMSPRSANTHSSSFFQILSRAQPKEWCAQQMTR

SEQ ID NO: 97903 - protein, 73 aa, Glycine max
  Coding DNA Sequence Number=SeqID_6218
  Subcellular localization annotation: CTP_CleavageSite=37; ConfidenceScore=5.48e-01
MSCTGLLSAPLHLTKRNASVHPLSQKSLTCAKQSIKLCMSRVSRERKVQVLESFERFCYVKICRDQSLKQEPV

SEQ ID NO: 97904 - protein, 343 aa, Glycine max
  Coding DNA Sequence Number=SeqID_6219
  Homolog annotation: Hit_ID=Q6WAY6; Match level="QueryCoverage=77%, HitCoverage=47%, E-value=3e-13, Identity=24%"; Hit description =Putative uncharacterized protein
MDWDQLLAGIGSRTISWFPRWKEGREGVLFSCGRYPNIPLVGTRGCINYNPTLAIRQLGYPMRGAPTEESMSPFLVRDLGAQSSKTIQRIHKAWETPLRKDQELRGIRNGTIGGYHEWMKVIYEDEEVQTLKSELGKAKLAKEKFKLAATHVRKECAGLREENAITARALDRDQEGSQGRVWPEQFRGALWGSNSELKLRREERDQSRAHSMVLKEELIACSRSKRSLSQRLCETETNMLAIIAKYQEELGLATAHEHRIADEYAQVYAEKEARGRVIDSLHQEATMWMDRFALTLNGSQELPRLLAKAKAMADTYSAPEEIHGLLGYCQHMIDLMAHIIRNR

SEQ ID NO: 97905 - protein, 29 aa, Glycine max
  Coding DNA Sequence Number=SeqID_6220
MVTTTKVESLEWDLSIASLALVNYATKAI

SEQ ID NO: 97906 - protein, 139 aa, Glycine max
  Coding DNA Sequence Number=SeqID_6221
MFSKKEGMMRIMKLAKYRLKAQVKKDEGPSGEGQSPRVEKDEGPSNPCGVYPDLSSFTGSGVYPDLSSFTGSGVYPDLSSFTGSGVYHNLSSLTGSGVYPDLSSFTGSGVIQTFVACIKRSAPTQVHIRLSFFLTNIGE

SEQ ID NO: 97907 - protein, 95 aa, Glycine max
  Coding DNA Sequence Number=SeqID_6222
MASSIINNMDSGEITLEILSTKIRVDHPQGHSNKGQEVQVGQLAKQLADRLSSSFGANIEKNPKEECKAVMTRRRLANNVDEEKTKEKMVKDDKQ

SEQ ID NO: 97908 - protein, 81 aa, Glycine max
  Coding DNA Sequence Number=SeqID_6223
MAPKKLSTKRSSVGSSGLRIIKKGAKIHKVMQAPLELVGLGSSSSMDSFASWKINGSGMEKEEREETPLQGEDKSRRSSPP

SEQ ID NO: 97909 - protein, 139 aa, Glycine max
  Coding DNA Sequence Number=SeqID_6224
  Gene Ontology: Mol. function=lipid binding; Cellular component =anchored to membrane; Biological process=lipid transport
  Homolog annotation: Hit_ID=A7QR85; Match level="QueryCoverage=71%, HitCoverage=66%, E-value=6e-31, Identity=58%"; Hit description =Chromosome chr13 scaffold_149, whole genome shotgun sequence
  Pfam annotation: Domain name=Tryp_alpha_amyl; Domain location=34-109; Score=12.9; E_value=0.016; Accession=PF00234.13; Description=Protease inhibitorseed storageLTP f
MDSNACLPHLLVLAITLVLVSHAMGDSAKDKQKCAESLTGVATCLPYLGADAKAPTADCCSCLTQAMKTNKKCVCLILKDRDDPDLGLKINMTIAVGLPSLCKTPDNLSVFWHVQFLIKPSFFLKEHYTTVLCFHFPMQ

SEQ ID NO: 97910 - protein, 97 aa, Glycine max
  Coding DNA Sequence Number=SeqID_6225
  Homolog annotation: Hit_ID=A5BEV8; Match level="QueryCoverage=53%, HitCoverage=6%, E-value=6e-08, Identity=51%"; Hit description =Putative uncharacterized protein
MTKLLVGHPYAGQLTKDEKIIVADMTKFMRFRCLFMRVDALPEVIVTGRDLSLMNAVKTVFPDATNLLCRFHIDKNVKAKCKTLVAQKNAWDYVMEA

SEQ ID NO: 97911 - protein, 109 aa, Glycine max
  Coding DNA Sequence Number=SeqID_6226
MAPEDLEQLTKNQGPAGGGLELPPKPEVGPSIACVSTKKSYVDPSGQNSDTSDLKKYRLYVDENPPCLVALIRVYEGSNIVHNIPLGNDQVKVGVEEVRDVDARVPIPI

SEQ ID NO: 97912 - protein, 256 aa, Glycine max
  Coding DNA Sequence Number=SeqID_6227
  Gene Ontology: Cellular component=integral to membrane
  Homolog annotation: Hit_ID=A8GCD1; Match level="QueryCoverage=99%, HitCoverage=85%, E-value=8e-67, Identity=55%"; Hit description =Putative uncharacterized protein
  Pfam annotation: Domain name=DUF340; Domain location=66-256; Score =278.6; E_value=1.2e-80; Accession=PF03956.4; Description=Membrane protein of unknown function (DUF340)
MGTSLAFLDNLGTNLLIVFKTALIAAGAILSCSLLALWLLDRRWPWRQQHRQQNLPSRWHMVLESLKLCVAVLAGFLLGLTQWAPLRHASTLSEIALVVLLFLVGVQLRGSGMTLRQITLNRRGMTVALVSLCGSLGGGVLAAWLLGVSLSTGLALASGFGWYSLSGILMTEAYGPVIGSAAFFNDLLRELAAVLLIPVLVNRYRSMALGLSGATSMDFTLPILQRAGGMEIVPAAIVHGFIMNLLAPILIALFSA

SEQ ID NO: 97913 - protein, 242 aa, Glycine max
  Coding DNA Sequence Number=SeqID_6228
MRGALTEESLSPFLVRDFGAQNFKVIQRVHKAWESPLRKDKELRGIRNGIIGGYHEWLKVRTRDVRKECVGLREENTATAKALEQETKRAHKEEHDRDKFRGALWGSNSELKLRREERDRSRAHSMVLKEELATCSRSKRNLTQRLSETETNMLAIITKYQEELSLATAHVHRVADEYAQVYAEKEARGRVIDSLHQEATMWMDRFALTLNGSQELPRLLAKAKAMADTYSAPEEIHELLDY

SEQ ID NO: 97914 - protein, 52 aa, Glycine max
  Coding DNA Sequence Number=SeqID_6229
MDLRLLVLAGRIALGYLLGVLKDERKRGWGHDRPIVALLCAKQAGNVAARQP

SEQ ID NO: 97915 - protein, 108 aa, Glycine max
  Coding DNA Sequence Number=SeqID_6230
MKKQQWKRSGRQRRRGERRRHPLGNKPWKKELHHQDEPWITKLGRMLQWRKRIEGEKERGGSTKFEGIKEGEKWNFEVCLTRLSFIKVTTSVTHASIYRIGSFLEKLS

SEQ ID NO: 97916 - protein, 124 aa, Glycine max
  Coding DNA Sequence Number=SeqID_6231
MIHNESGVYFQSSTPIPIRVLNDNGFQTLKTRMHNTLELTEDQYLDEIYYRQPFANASSQFGFQTMQLKNDDDVKTMLMCNDQYSCVGLIELLCTIGRTPNGILNLLQATMTPTHDALLYYNER

SEQ ID NO: 97917 - protein, 154 aa, Glycine max
  Coding DNA Sequence Number=SeqID_6232
MWAWKRCTTLAPKRTPPVIQNKPLGHRWLRRGNQHIGNDDLIVFRRKLDIMKRHEFLWESYTATVMSSLPLICLVGSVAWRKTKMFVDPNNANRAILAEVAETLQYMVSPQGRNTWKVDDLVPYVEKITILSEEQERITEPAAHGPTSEHRFPP

SEQ ID NO: 97918 - protein, 121 aa, Glycine max
  Coding DNA Sequence Number=SeqID_6233
MESPRTFKWFGVTFWVLGNLSVLTNQDFFTNDFRPDYHIHVEMNFEQGWASILAQHLKGSLNFDMLKDQMLKADDSMNSVLQDNKKLVGDNKNLEDRVLALTIEAKGLETHAVNVEALVRS

SEQ ID NO: 97919 - protein, 260 aa, Glycine max
  Coding DNA Sequence Number=SeqID_6234
  Gene Ontology: Mol. function=aspartic-type endopeptidase activity; Biological process=proteolysis
  Homolog annotation: Hit_ID=Q9LKS8; Match level="QueryCoverage=38%, HitCoverage=26%, E-value=2e-09, Identity=36%"; Hit description =Putative uncharacterized protein T15F17.m
MAEDRPPIVTLEDYYSSFSTPQYFTNIARPKVQATNISYPHSFIQLIQGNLVHGLPNKDMYAHLATYREICNTVKITRVPEDAIYLNLFSFSLADEAKGWLHLFKGNSLRTCSGSFPWPTLKNIYSWTPDEAMELIENMEASDYAILRDRPYAPARKSLLELKSQDALLAKNKLLLASSPMMQVRGCTLCGRARESGMCIAQEDASKEVGQLTKQLAEKSTVNFVAHTEKNPKEECKDVSDEEVEDERKEKEADNIKRKN

SEQ ID NO: 97920 - protein, 827 aa, Glycine max
  Coding DNA Sequence Number=SeqID_6235
  Gene Ontology: Mol. function=translation initiation factor activity; Cellular component=eukaryotic translation initiation factor 4F complex; Biological process=RNA metabolic process
  Homolog annotation: Hit_ID=A7PFP5; Match level="QueryCoverage=94%, HitCoverage=92%, E-value=0.0, Identity=66%"; Hit description =Chromosome chr11 scaffold_14, whole genome shotgun sequence
  Pfam annotation: Domain name=MA3; Domain location=663-775; Score =120.8; E_value=4.1e-33; Accession=PF02847.8; Description=MA3 domain
  Pfam annotation: Domain name=MIF4G; Domain location=257-483; Score =222.9; E_value=7.6e-64; Accession=PF02854.10; Description=MIF4G domain
  Pfam module annotation: Pfam domain module=MA3::MIF4G; Domain location=663-775::257-483
  Subcellular localization annotation: CTP_CleavageSite=29; ConfidenceScore=5.35e-01
MQQGDPTVLSLRPGGGRGGGSRLFAHSSSSSSLSADLPLSRPHASFSLKEWNTGDSRFEGHERVRYTRDQLLQLKEAVEVPDDILKIKQDIEAELFGEDPSWGRAESNLPHQLQNRYSEPDNRDWRGRSGQPPASTDERSWENLRDNREFGNRQQDASQVNRHDQLNSQFARTQISSMQGYIYSVIIYRQASHEKAGQGRAKGPVTVEQGLVAAEQCLVAAKKRRCGRKGGPTPTLVKAEVPWSARRGSLSEKDRVLKTVKGILNKLTPEKFDVLKGQLIDSGITSADILKDVISLIFDKAVLEPTFCPMYAHLCSDLNEKLPPFPSEEPGGKEITFKRVLLNNCQEAFEGAENLREELKRMTVPEREMERTDKGRLLKLRTLGNIRLIGELLKQKMVPEKIVHHIVQELLGSPDSKSCPVEENVEAICQFFNTIGKQLDESPKSRRINDIYFSRLKELSSNLQLVPRLRFMIRDVIELRASNWVPRREEVKAKTITEIHSEAEKNLGLRPGATASMRNSRGGVQGNASSGGFHIARPGAGGLMPGMPGTRKMPGFDNDNWEMPKTRSMPRGDSSGVQAAGCSNSALLSKSTTLNSKLLPQGSGGIISGRNSALVHGGGTFSTSSTNFCLGPEAAPQLSSPAPVPVSSEKPQPPAARLNTDDLCRRTVSLLEEYFSVRLLEEALQCVEELKSPSYHPEVVKEAIYLALDKSPPCVETVANLIEYLYIKKILTPLDIGTGCLLFGSLLDDIGIDLPKAPSNFGEIIGKLILAGGLDFKVVGEILKKVDDDMFRRAIFDSVVGAIRSASEQAILDAQTSDIEVCQSQLK

SEQ ID NO: 97921 - protein, 51 aa, Glycine max
  Coding DNA Sequence Number=SeqID_6236
MSAEKYQSRLYSPMLAVVLSIQSLNNIWMMPPSVNFPGRCRLAFFSISIGE

SEQ ID NO: 97922 - protein, 133 aa, Glycine max
  Coding DNA Sequence Number=SeqID_6237
RVRFVPLFKGPIWERAKKVLVIIPKVVISLLMVSRGIFLFEEHIAADHRFTSTPYVPTNPGKPTKEKVMVKHLHKIKWPNSLKTVPSGVANCRNLPFGERATRDSRVRVPRKEYVRSRHQRLFEGNVGKTGKD

SEQ ID NO: 97923 - protein, 111 aa, Glycine max
  Coding DNA Sequence Number=SeqID_6238
  Subcellular localization annotation: CTP_CleavageSite=65; ConfidenceScore=5.36e-01
MVKKGGGGSFLHPDTVPLIFKDTKLTRTTKTAAPKLPLLIFLLPFSRFVSFLTRVVRDGPRPMVHSEAIGRDTLLPFPIKNWKKEKERKLPIKDRKKIEEICRKVLGLYNI

SEQ ID NO: 97924 - protein, 64 aa, Glycine max
  Coding DNA Sequence Number=SeqID_6239
LSLSLQSQGFTSFLCPTPDQFRAEVTWPGDWPEAPAEAPDEADEAREDEEMTDLLDFLGGSRAT

SEQ ID NO: 97925 - protein, 31 aa, Glycine max
  Coding DNA Sequence Number=SeqID_6240
MRKLIKERMENKVVNFVGLVMAGQKYRNGNN

SEQ ID NO: 97926 - protein, 104 aa, Glycine max
  Coding DNA Sequence Number=SeqID_6241
MTRGNPSDLQPFDPEIDRTFHRLVRHHLVPFEHPEHSVIGDFEHYNFEHPESMAQPPPRERTLREMDAPDFTYESLCIQYPDEDVPYVLKIGLIHLLPKFDGLA

SEQ ID NO: 97927 - protein, 119 aa, Glycine max
  Coding DNA Sequence Number=SeqID_6242
  Homolog annotation: Hit_ID=A5BSR3; Match level="QueryCoverage=91%, HitCoverage=35%, E-value=6e-07, Identity=33%"; Hit description =Putative uncharacterized protein
MAFTKKTGEMTTEAAKEIAEKIDSFEEQASQGSFIPHGRQDVLIAVIGRPKHPGCVRAAGGGVSIRQYFGSAPWTSCNSSSLPPEKLQQLTQQIRNQLEELITEKVTRQLMASFSQMQS

SEQ ID NO: 97928 - protein, 162 aa, Glycine max
  Coding DNA Sequence Number=SeqID_6243
MELEKAQAVKEKFKSVAVRIRKENTELRDINIATTKALQQETKRARKEEYGRNNELKLRREERDQSRVNGMIMKDELKTCLRSMRSLSQRLCETETNMLAIISKYKEELDLATAHEHKVADEYARVYTEKEARGRVIDSLHQETTMWMDRFALTLNGSQDLP

SEQ ID NO: 97929 - protein, 77 aa, Glycine max
  Coding DNA Sequence Number=SeqID_6244
MLLEYLYVKSCDFWIDGDPALRGTRIRATWEYVSSIGGGQQGMVGLYVICGCGELSCTIARPPPSTTCDGYPIILQA

SEQ ID NO: 97930 - protein, 125 aa, Glycine max
  Coding DNA Sequence Number=SeqID_6245
MQQGQTDILIARFLDPNYGVKTVNFIITPLTYREFPIGSFLRHLEVPISFALVGPTQVSITEKRKEFNMDFKNKVKGNIRGQIPLSKHKGLRGVSDSTIENIILKFRSRQCDRGSVNAAKKTSML

SEQ ID NO: 97931 - protein, 243 aa, Glycine max
  Coding DNA Sequence Number=SeqID_6246
  Homolog annotation: Hit_ID=UPI00016621D1; Match level="QueryCoverage =68%, HitCoverage=40%, E-value=3e-13, Identity=34%"; Hit description =UPI00016621D1 related cluster
  Subcellular localization annotation: CTP_CleavageSite=29; ConfidenceScore=5.18e-01
MVNTLTSRGLHVLTFRGLHVLTFRGRHVLAFKGSCTFNFRGLHVLAVKQSCTFTFIGLHALTFRGLHVLTFGGLHVLTFGGLHVLALRRLHVLVVRGLHALTFRGLHTLTFIGLHALTFIGLHALTFRGLHALTFRGQHVLNFGGLHVLTFGGLHILTFGGLHALTFRGTIRPHLQRTTCPRHQRTTCPSFSKGDRPSPLEDYTSSPSEDYTSSPSEDFTSSPLEDYTSSPSENDTSSPSKGH

SEQ ID NO: 97932 - protein, 43 aa, Glycine max
  Coding DNA Sequence Number=SeqID_6247
MARIVEFPVINNGALKRWSVAAMASSSGGGSSLSIPSTSRGGP

SEQ ID NO: 97933 - protein, 112 aa, Glycine max
  Coding DNA Sequence Number=SeqID_6248
  Homolog annotation: Hit_ID=A5BMW4; Match level="QueryCoverage=48%, HitCoverage=10%, E-value=2e-07, Identity=40%"; Hit description =Putative uncharacterized protein
MPHKGQGSPWKFDRNVTHDGYKNRCALVLNNCTIVLTPLRPAEAYANQIRIVRECNLREEQLNIQEKERKEKKNESEQKKEKNKKEDKEEKNMKVSAFAKKREVESALMARE

SEQ ID NO: 97934 - protein, 87 aa, Glycine max
  Coding DNA Sequence Number=SeqID_6249
  Subcellular localization annotation: CTP_CleavageSite=47; ConfidenceScore=5.43e-01
MSCTGSLSAPLHLSKRTTSVHLLSEKGALSQKSLTCAKCTSTNKATYLSLKSDFVKGVWTGIQSFACLGFLERERSKFQRVLRDFVV

SEQ ID NO: 97935 - protein, 44 aa, Glycine max
  Coding DNA Sequence Number=SeqID_6250
MAPVTMGYVLSMSDSMLVGYCDADSVYAYMFLVEVGIVGARYAG

SEQ ID NO: 97936 - protein, 321 aa, Glycine max
  Coding DNA Sequence Number=SeqID_6251
  Gene Ontology: Mol. function=phosphoribosylanthranilate isomerase activity; Cellular component=chloroplast; Biological process =aromatic amino acid family biosynthetic process
  Homolog annotation: Hit_ID=A6T7W7; Match level="QueryCoverage=65%, HitCoverage=46%, E-value=8e-74, Identity=65%"; Hit description =Bifunctional indole-3-glycerol phosphate synthase/phosphoribosylanthr anilate isomerase
  Pfam annotation: Domain name=PRAI; Domain location=18-209; Score =276.9; E_value=4.2e-80; Accession=PF00697.13; Description=N -(5'phosphoribosyl)anthranilate (PRA) isomerase
MEEHDLDAGVRRVLLGDNKVCGLTRPEDAQAAHQAGALYGGVIFAAGSPRQVNEAQAQALIAAAPLKYVGVFRNQVISDVVTLAARLSLAAVQLHGDEDKAYVAELRQALPASVRIWKALSIKDRLPPRDWPHVDRYVLDNGQGGSGQRFDWSLLQGEDLADVLLAGGLSADNCVEAAQLGCAGLDFNSGVESAPGIKDASKVAAEEDTMTTLLNPYFGEFGGQYVPQILMPALRQLETAFVEAQRDPAFQAEFTDLLKNYAGRPTALTLCSNLTKGSKTRLYLKREDLLHGGAHKTNQVLGQALLAKRMGKNEIIAETGA

SEQ ID NO: 97937 - protein, 246 aa, Glycine max
  Coding DNA Sequence Number=SeqID_6252
  Homolog annotation: Hit_ID=Q2HTA0; Match level="QueryCoverage=98%, HitCoverage=43%, E-value=1e-31, Identity=36%"; Hit description=IMP dehydrogenase/GMP reductase, related
  Pfam annotation: Domain name=DUF1723; Domain location=43-92; Score =42.3; E_value=1.7e-09; Accession=PF08330.1; Description=Protein of unknown function (DUF1723)
ERPELKLVSHGRKVEKFGRPAPEIEGLVDPTRLTPLIACSVVTGDLGVIFAFVERWHKETSSFYLLVGELTITLDDVASLLHLPITGTFHSFEPLHVDEAVIMLVELLDVSGEEARAETRKCEARQWIVVAHAYLLHLVGCTLFANKSSTHAHVVHLDVFRDLAQSESYAWGAAALVHMYDQSNEASQSTRQQIVGYLTLLQAYMKGLTASPYQTCIDALTITNVCWMPYGDHRGVRAFDLISCFQ

SEQ ID NO: 97938 - protein, 194 aa, Glycine max
  Coding DNA Sequence Number=SeqID_6253
  Homolog annotation: Hit_ID=Q5XM22; Match level="QueryCoverage=25%, HitCoverage=27%, E-value=8e-09, Identity=59%"; Hit description =Resistance-like protein HAAS-2
  Pfam annotation: Domain name=DUF1723; Domain location=78-129; Score =6.0; E_value=0.1; Accession=PF08330.1; Description=Protein of unknown function (DUF1723)
IPAPDVHDDPMEAPAFVEDIPADAGIEAAEDQHQGFPGSPSGPSVLIAYADHVACSERYELKLSSHGRKVHSLGRPVPAIEGLIAGTGLSPLIACSTSGFHLLVGELTITLDDVSSLLHLPVIGDLHAFEPLHVDDVVQMRVDLLMRRCQKGHWTAAGRTYLLHLLGCTLFANKSATDVHVVYFEALCDLSMTE

SEQ ID NO: 97939 - protein, 139 aa, Glycine max
  Coding DNA Sequence Number=SeqID_6254
MKQTSGNRLQSTENPSNGRTIEKAKRRFDFIHSHRNSKSWIIQGADNPNSSLHIISYVVFLGRTTYLFISMKLPFYLELVKAFYSNLEIQEDSFISEVYGIKMVIDQSLFFELTQLSSDGVPFEGTLDDEWKFDFSVSD

SEQ ID NO: 97940 - protein, 164 aa, Glycine max
  Coding DNA Sequence Number=SeqID_6255
MDVNTITTDAILNLLERPSIPTHDAVLYYNGRWNMSPQNNFVGYAFTGINLKKFDIPKGCSIDQLKDLIKQVAPKGNPPHGIHESQVVRSLFYRQPSHLEYSEKVLEFEIIELKCDDDVLKVLVESNYWKQFVPIEILALFSKVVMENEDDVVTSLRDRILVKC

SEQ ID NO: 97941 - protein, 325 aa, Glycine max
  Coding DNA Sequence Number=SeqID_6256
  Homolog annotation: Hit_ID=Q2HSV3; Match level="QueryCoverage=60%, HitCoverage=30%, E-value=1e-18, Identity=34%"; Hit description=IMP dehydrogenase/GMP reductase, putative
MYDQLNDANLSTSRQLAGYITLLQCWIYKHFPSVAECNVDPNYDEVSPHACRWIVTKKIVKNVSTVTYRQRLDRLRIPDVYWMPYAEHRPVQDFHSISCFSGQLRWGPVVVRYRLERVMRQFGYVQCIPGHLVHSWVSYDDMDDTWTHYSDHLAAADDLCVVPGQCAPDYIDWFFAISHSFMTVPQNDPPRDAYETQPNHIPHKAALTSTHADPDANEPKHAVEACHAITEVLEQHLNAPSTSTHEEVIQKCLRIARGVTEDRNILLRIKLIHGKLADQLDPWAFLALSGAPAITLGAPSNTLVISMVLESRTKSDHDDRGHRLL

SEQ ID NO: 97942 - protein, 388 aa, Glycine max
  Coding DNA Sequence Number=SeqID_6257
  Gene Ontology: Mol. function=phosphatidylinositol N-acetylglucosaminyl transferase activity; Cellular component=integral to membrane; Biological process=GPI anchor biosynthetic process
  Homolog annotation: Hit_ID=Q2HRH2; Match level="QueryCoverage=90%, HitCoverage=86%, E-value=7e-86, Identity=61%"; Hit description=N -acetylglucosaminyl transferase component
  Pfam annotation: Domain name=Gpi1; Domain location=78-260; Score =159.1; E_value=1.2e-44; Accession=PF05024.6; Description=N -acetylglucosaminyl transferase component (Gpi1)
GIIHGTCGSMPSVLEDKSKFSVLGLCVTDPTTSNGLMNGAEDDKKKFSEFGNALQEGDTDRKNNSRSCCCFQLDGSLRKSSQYVLGRSNWVLLMFDSPEQTDVGIHRLPKLHHIHWNGLTVSQYDVHVCFKLNAELAGVLGMASLNAVQIWSTLWIFVGYIFNYIIQGLSVLGILCGFTVPAALVIDMIALATLHISTLHWFISLVYSSQIQALAALWRLFRGRKWNPLRQRLDSFDYTVKQHIVGSLLFTPLLLLLPTTSVFYIFFSIMDTTINLVCLLIEVTISSNSTASPSADITDEMTSYKESLHLKDFNREKSSNLVSALHSNYLSLVSGSTISTVAHGILIGQRCDILVPSALMNAIYAWHPSTFTNAMDVYALQRVLACLS

SEQ ID NO: 97943 - protein, 221 aa, Glycine max
  Coding DNA Sequence Number=SeqID_6258
  Homolog annotation: Hit_ID=A7QFP9; Match level="QueryCoverage=71%, HitCoverage=65%, E-value=2e-23, Identity=42%"; Hit description =Chromosome chr8 scaffold_88, whole genome shotgun sequence
MLTPTTGVPKRRPRSGRTPLQLKNTPADPIHPSAKPKPKPKPYFEISLIDKENNPVAAVAVLVAQPPETSLAEELSAVKKKLERMRADKEKTEKMLNEKHAILDAKMKEMEERGEIQKNLEIEVDRLFRLKELKYRCMRVSPMRTLREKEQGKIVNEAPSQSEVKTEETVASESESESESESVGGECQVLQSPGYLNMDYPGWETFQYEEKLYANGNQLVE

SEQ ID NO: 97944 - protein, 106 aa, Glycine max
  Coding DNA Sequence Number=SeqID_6259
MVVAVVTIVECDNGGGGCYGDEGEVVATTMMMVVAMVTMVECDDDGGGCYGGSDCYGDDGSGGDDDGCGDGGGGNNVKGGGDRLVTVTMAITTIIMVVAWVVRTRE

SEQ ID NO: 97945 - protein, 102 aa, Glycine max
  Coding DNA Sequence Number=SeqID_6260
MVAIQKKCHKEKITGKWKRKGQGKRNGVAREIENREGKITGNCRSPYVKSLPAEMVWKEENRDGGVLKKKRDGCWSPQHRLLFITVLLKLMGQRYKYYPYKC

SEQ ID NO: 97946 - protein, 165 aa, Glycine max
  Coding DNA Sequence Number=SeqID_6261
MVVVRVTKPYTMVMYCRERFVEDESVIGLRDEGVEEVKVPVLSVAVVDGDKRGTQKMDENEWMYESIMSEQADIDYENEEACGTNEPHVDCSDAFNTSEDVLRWTRFVAHENGFVAVILRSDTNTGVTSIGVEKKNLSEEILRLGNVGVPSSFVASQWLEEKAGW

SEQ ID NO: 97947 - protein, 111 aa, Glycine max
  Coding DNA Sequence Number=SeqID_6262
MFTDQITTPTVEDEELLTSTMPTRRENTTLKMPGLLNTNGGAVAEHGLPTQRKKTTLTGECGTEDLDGGSSFSETSNHFTQTNERKKNVAEVRSGVRKETKTTSRQQKEKM

SEQ ID NO: 97948 - protein, 70 aa, Glycine max
  Coding DNA Sequence Number=SeqID_6263
MVTHECPKTVYHRMKTIGEESQTFLSVSGRKLSNGAILLVVAITEFKEKRIEHADDLTKAWSQVRIFNPA

SEQ ID NO: 97949 - protein, 285 aa, Glycine max
  Coding DNA Sequence Number=SeqID_6264
  Gene Ontology: Mol. function=lipid binding; Cellular component =extracellular region; Biological process=lipid transport
  Homolog annotation: Hit_ID=Q43019; Match level="QueryCoverage=39%, HitCoverage=92%, E-value=5e-29, Identity=53%"; Hit description=Non -specific lipid-transfer protein 3 precursor
  Pfam annotation: Domain name=Tryp_alpha_amyl; Domain location=34-121; Score=103.5; E_value=6.3e-28; Accession=PF00234.13; Description =Protease inhibitorseed storageLTP f
MGKSVVEKLLWMAIVCLVLGVISITPKAQAAVTCNQVVSNLTPCISYVLNGGKTVPGPCCNGIKTLFNLAHSTPDRQTVCKCIKNAVSAFHYGKSNVDRAAALPKQCGVNIPYQISPSTDCTSNSDIENDHGTGPGTSFCNEVSTKKIKTYNYAAYTLFRRKPTKLKHPSEPERNFHDEESELPFHERVNVDKDSDFASNSSTPPRNALLLTRCRSAPYRSSSLASRFRSSPVKDQETEFPIPNTTEQQHTSEEPQTEPELGFLREKIASLTEPKKVEEVETERN

SEQ ID NO: 97950 - protein, 599 aa, Glycine max
  Coding DNA Sequence Number=SeqID_6265
  Homolog annotation: Hit_ID=A7QFM8; Match level="QueryCoverage=100%, HitCoverage=100%, E-value=0.0, Identity=66%"; Hit description =Chromosome chr8 scaffold_88, whole genome shotgun sequence
  Pfam annotation: Domain name=MACPF; Domain location=124-345; Score =54.9; E_value=2.8e-13; Accession=PF01823.10; Description=MACPerforin domain
MEEHVPALHTAINAVKALGRGFDVNCDTRLLYCKGVAGSRVVHVDEEHVRDLWLYDDVVVPNVSMDIVKNSQEHVGRRSSGVCSYQEMVEYFNQKANISQSFPLGTFNSAFSFTGSKHIDATETKSLSSDGFYIPLAKVQLTNAHLTLQENVKRDIPVNWDPPSLASFIENFGTHVITSITIGGKDVIFVKHHRSSPLSTLEIKNYIQDIGNQRFSDINNHTSSLQTKFKDKASFTLIPIPYSDLIQVVDPFSFNNQEIHPQSASGTYLSGKFNSFLNFLGYTQDVRVIFRRRGGDDLEQDHSMWLRTVWSSPDVIQMTFCPITDLIDEVPGKEQLTHAIGLYLEYKPPIEELRYFLEFQIAHVWAPLHERIPGQQRKEPICPSLQFSIMGQKLYVSQEQITVGRLPVTGLRLFLEGSKQNRLSVHLQHLSSLPKILRPYWDTDVTIGAPKWQGPEEQDSRWFEPVKWKNFSHVSTAPVENPETFIGEFSGIYVVTGVQLGVWDFGPRSVLYMKLLFSRLPGCTIRRSFWDHTPTNPDNSSFGSRENNTTGSKLFKYVDLSEMSKGPQDPPGHWLVTGGKLGVEKGKIVLRVKYSLLSY

SEQ ID NO: 97951 - protein, 300 aa, Glycine max
  Coding DNA Sequence Number=SeqID_6266
  Gene Ontology: Mol. function=oxidoreductase activity; Cellular component=extracellular region; Biological process=response to oxidative stress
  Homolog annotation: Hit_ID=A7QFK6; Match level="QueryCoverage=92%, HitCoverage=91%, E-value=1e-103, Identity=64%"; Hit description =Chromosome chr8 scaffold_88, whole genome shotgun sequence
  Pfam annotation: Domain name=peroxidase; Domain location=47-264; Score=360.6; E_value=2.7e-105; Accession=PF00141.14; Description =Peroxidase
  Subcellular localization annotation: CTP_CleavageSite=51; ConfidenceScore=5.31e-01
MATTSFYMTIPIFKIRFFLFLCFFGIGSSQLSSDFYSTTCPNALSTIKSVVDSAGCDASVLLNDTTSFTGEQTARGNVNSIRGFGVIDNIKSQVESLCPGVVSCADILAVAARDSVVALGGPSWTVQLGRRDSTTASLSSANSDLPRFDLSLQQLSDNFQNKGLTTAEMVALSGGHTIGQAQCSTFRTRIYNETNIDSSFATSLQANCPSVGGDSNLAPLDSSQNTFDNAYFKDLQSQKGLLHTDQVLFNGGSTDSQVNGYASDPSSFNTDFANAMIKMGNISPLTGSSGEIRTNCWKTN

SEQ ID NO: 97952 - protein, 50 aa, Glycine max
  Coding DNA Sequence Number=SeqID_6267
MGVGGLIRDAVGKWRFGFFQHIGVGDPTVAEIVAIKVPREANQVADTLAS

SEQ ID NO: 97953 - protein, 182 aa, Glycine max
  Coding DNA Sequence Number=SeqID_6268
  Gene Ontology: Mol. function=nucleic acid binding
  Homolog annotation: Hit_ID=Q1SKZ9; Match level="QueryCoverage=49%, HitCoverage=27%, E-value=1e-08, Identity=26%"; Hit description=Zinc finger, CCHC-type
MVPLEPPDTDAAVRSGNAIVSDKDGAMSLDFEEDDKLFSKFSITAQAFDHLCKPWEKVLSGGPWMVFDHYLVVRPLLPNIVASEAKIEKTVVWIHFPGLGECQQSKGSNEVDGISNDSQPTEPSSNEVAVWSVKPRTEKGIDHGGGLGVGVVSASQGPSHASLGGGDEEGSSSMPRDVVVSH

SEQ ID NO: 97954 - protein, 76 aa, Glycine max
  Coding DNA Sequence Number=SeqID_6269
MAHAQPEPVDGSLLRLQDNHFSNQVWEDQERMICPRYDSVWVFTYLDRIHNQQNFQQLPVDADDVLSLHNMLELIS

SEQ ID NO: 97955 - protein, 347 aa, Glycine max
  Coding DNA Sequence Number=SeqID_6270
  Gene Ontology: Mol. function=protein serine/threonine kinase activity; Cellular component=cytoplasm; Biological process=protein amino acid phosphorylation
  Homolog annotation: Hit_ID=B0L641; Match level="QueryCoverage=93%, HitCoverage=57%, E-value=1e-131, Identity=69%"; Hit description=WNK1
  Pfam annotation: Domain name=Pkinase; Domain location=38-267; Score =107.4; E_value=4.2e-29; Accession=PF00069.16; Description=Protein kinase domain
  Pfam annotation: Domain name=Pkinase_Tyr; Domain location=39-272; Score=-37.2; E_value=4e-10; Accession=PF07714.8; Description=Protein tyrosine kinase
  Pfam module annotation: Pfam domain module=Pkinase::Pkinase_Tyr; Domain location=38-267::39-272
MELPDTISTAMYKGRFCTSGGVKSQLGYVETDPSGRYGRFRDVLGKGAMKTVYRAFDELLGIEVAWNQVKLGDVFHSPEQLQRLYSEVHLLKHLNHDSMMIFYGSWIDVNNKTFNFVTELFTSGTLREYRQKYKRVDITAVKNWARQILSGLEYLHSHNPPVIHRDLKCDNIFVNGHQGRVKIGDLGLAAILKSSQHAHSVIEMLTFEFPYSECANPAQIYKKVTSGKIPEAFYRIENLEAQKFVGKCLANVSERPSAKELLLDPFLAMEQLEIQLPPSIPALFTNKSFKLSCPAPFPSEHRDQTKSADMTITGSINEEDNTVFLKVRISDIMGMHNFIPHFAVILQ

SEQ ID NO: 97956 - protein, 63 aa, Glycine max
  Coding DNA Sequence Number=SeqID_6271
MLDFKSDRVRNLVVQGVSFRESFWFRVAFEDGEEKNTLSIMGQGDLTISSELIEFSKFRPSSK

SEQ ID NO: 97957 - protein, 41 aa, Glycine max
  Coding DNA Sequence Number=SeqID_6272
MSSFKVNKILTGGACASYSLSPILMWEWHDQIASNYQTIRF

SEQ ID NO: 97958 - protein, 62 aa, Glycine max
  Coding DNA Sequence Number=SeqID_6273
MEKDALHENSTNGGFNPFSFSLMFGTLSEEKIEESQELVRDVAIAIGRHVSPLRGFDDLPQA

SEQ ID NO: 97959 - protein, 174 aa, Glycine max
  Coding DNA Sequence Number=SeqID_6274
  Gene Ontology: Mol. function=small conjugating protein ligase activity; Cellular component=proteasome complex; Biological process =regulation of protein metabolic process
  Homolog annotation: Hit_ID=P35132; Match level="QueryCoverage=100%, HitCoverage=100%, E-value=3e-77, Identity=81%"; Hit description=SUMO- conjugating enzyme UBC9
  Pfam annotation: Domain name=UQ_con; Domain location=5-168; Score =243.0; E_value=6.8e-70; Accession=PF00179.17; Description=Ubiquitin -conjugating enzyme
MASKRILKELKDLQKDPPTSCSAGPVAEDMFHWQATIMGPADSPYAGGVFLVTIHFPPDYPFKPPKVAFRTKVFHPNINSNGSICLDILKEQWSPALTISKGSIETPKKLPSRARENGGGHWQLSRDVLLSICSLLTDPNPDDPLVPEIAHMYKTDRAKYEATARSWTQKYAMG

SEQ ID NO: 97960 - protein, 334 aa, Glycine max
  Coding DNA Sequence Number=SeqID_6275
  Gene Ontology: Mol. function=4-hydroxybenzoate nonaprenyltransferase activity; Cellular component=integral to membrane; Biological process=ubiquinone biosynthetic process
  Homolog annotation: Hit_ID=A7P2W6; Match level="QueryCoverage=97%, HitCoverage=95%, E-value=1e-89, Identity=49%"; Hit description =Chromosome chr1 scaffold_5, whole genome shotgun sequence
  Pfam annotation: Domain name=UbiA; Domain location=121-332; Score =32.9; E_value=1.1e-06; Accession=PF01040.9; Description=UbiA prenyltransferase family
  Subcellular localization annotation: CTP_CleavageSite=68; ConfidenceScore=5.61e-01
MASALISRSSRRFLKPCSSSVSLYPAIFNPVISSQQSASQNPSQNPPFKLPQLQSFNFEFRKTTGSLSSFHLVAHVSTWPSKENKNHQSGGNVSSSWVELYLPRKVQPYARLARLDKPIGTWLLLWPCMWSITLATTPGHLPDFKMLALFGCGALLLRGAGCTINDLLDRDIDTMASPCFGCLILVACLLLSPHEEPQAFLGLTFNWGALLGWAAIKGSLDPSIVLPLYASGVFWTLVYDTIYAHQDKEDDLKVGVKSTALRFGDSTKEWITGFGIACLGGLAVSGFNAEIGWPYYASLAVASGHLGWQIWTVDLSSRADCNRKYVREVHCINS

SEQ ID NO: 97961 - protein, 348 aa, Glycine max
  Coding DNA Sequence Number=SeqID_6276
MVKLASKEPLCGKVPLVHIYDSILKVKDVWNGMDWDLHKLYSTLPQSAAADVVSVKPMLVVSLPDLWIWEPCVSCTFSVSAIYKWLQGSCFIVGLAGIGFGSLNSLRTSNSLCGSFATKQYQPDLCLWPVVLFLMTLARFIRITRKLLSSIYSDVIMLMMFGGLVVDRPRGDDWIAWIKQASHRFGNMVPIVLCTKWCNRNDVEMIVLNVDESVTIDVRKAGYGGLCTNHSGDFLVGIPDKYLDKTRRRTPNVTYPMKLGTLSAICLLILYNMSQSFAYTSGTIGFYGYAGDTIIMHSEIMAVFSDSKHVDDLIRDGCPQQHLYANELHTIHRDWNLDYSVRPQPQGG

SEQ ID NO: 97962 - protein, 54 aa, Glycine max
  Coding DNA Sequence Number=SeqID_6277
MTDDASKEVWQEVSLKHKVDCLALSVDDMRAFIFAALQQLSHPKIEVFVLEKVQ

SEQ ID NO: 97963 - protein, 105 aa, Glycine max
  Coding DNA Sequence Number=SeqID_6278
  Gene Ontology: Mol. function=protein serine/threonine kinase activity; Biological process=protein amino acid phosphorylation
  Homolog annotation: Hit_ID=Q9LZV1; Match level="QueryCoverage=94%, HitCoverage=10%, E-value=1e-23, Identity=49%"; Hit description =Putative uncharacterized protein T20L15_220
  Pfam annotation: Domain name=LRRNT_2; Domain location=28-68; Score =37.7; E_value=4.3e-08; Accession=PF08263.3; Description=Leucine rich repeat N-terminal domain
MPALRIHGYALAVSFCLITFIAASLPTDPSEVDALIEIKNSLIDPKNNLKNWNKGDPCAANWTGVWCFDQKGDDGYFHVREMNFMWNDLTGTIPKEIGNIKSLKL

SEQ ID NO: 97964 - protein, 116 aa, Glycine max
  Coding DNA Sequence Number=SeqID_6279
  Gene Ontology: Mol. function=endonuclease activity
  Homolog annotation: Hit_ID=Q2HUP4; Match level="QueryCoverage=64%, HitCoverage=25%, E-value=2e-26, Identity=73%"; Hit description =Endonuclease/exonuclease/phosphatase
MVVVLIVVVGVASVDSGDDDDVAHDGCANGNDGGGDDIDDMSKEQGPLHRRPDIVKSKQGFPHFREQVWVKKLVHDRRIRFGTWNIGTLTGKSMEIVDVIVRRKINFMCLQETKWT

SEQ ID NO: 97965 - protein, 344 aa, Glycine max
  Coding DNA Sequence Number=SeqID_6280
  Gene Ontology: Cellular component=chloroplast envelope
  Homolog annotation: Hit_ID=A9PBE4; Match level="QueryCoverage=75%, HitCoverage=72%, E-value=1e-107, Identity=74%"; Hit description =Putative uncharacterized protein
  Subcellular localization annotation: CTP_CleavageSite=47; ConfidenceScore=5.27e-01
MAMLRLSPLSGQNHALSFPSSPSPPPKLQNRPLYLTNLPHLPQRLKLSFAGGDGGDGVGRGGGGGGGGESWGDEGKPKDSSFGILGLFLNGWRSRVAADPQFPFKVLMEELVGVSACVLGDMASRPNFGLNELDFVFSTLVVGAILNFTLMYLLAPTMTSSAASNLPALFASCPKSHMFEPGAFSLLDRLGTLVYKGTIFSVVGFGAGLVGTTLSNGLIKMRKKMDPTFETPNKPPPTFLNALTWAGHMGVSSNLRYQTLNGVEFMLERVLNPLAFKSSVLVLRCVNNVIGGMSFVVLARLTGAQSVGGEQKKENEVALIAEKEKLESEREEGLQNNQSTAPSK

SEQ ID NO: 97966 - protein, 229 aa, Glycine max
  Coding DNA Sequence Number=SeqID_6281
  Pfam annotation: Domain name=zf-C2HC_plant; Domain location=97-152; Score=39.0; E_value=1.7e-08; Accession=PF07567.3; Description =Protein of unknown function, DUF1544
  Subcellular localization annotation: CTP_CleavageSite=72; ConfidenceScore=5.26e-01
MKAGEAGRFRVAAVAAAKAAARGGFWTQNFARSPLKLRLQPRPATPTTPSGDSDDPLRRLCTRQSCNPTSLRPATVSRHHPLLEGSSLFKPTDDRVDAFWKWNSLKDKNNRKSVTCDFGHKTTTGGISRAKRHQLQIKGDVGSCKKVPEDVKLEMIAAYEKKIVETAAYMEAMQEEDEEEEDGILEIARLKSGKKRPATSNEASSTASNKRITTKKGPIDFLFSKAPEE

SEQ ID NO: 97967 - protein, 40 aa, Glycine max
  Coding DNA Sequence Number=SeqID_6282
MGDTLRKMMHQSSFLSLELPDGGGAAQREVSFSDKMFGHG

SEQ ID NO: 97968 - protein, 440 aa, Glycine max
  Coding DNA Sequence Number=SeqID_6283
  Gene Ontology: Mol. function=metal ion binding; Cellular component =integral to membrane
  Homolog annotation: Hit_ID=A7Q9V6; Match level="QueryCoverage=94%, HitCoverage=96%, E-value=1e-153, Identity=67%"; Hit description =Chromosome chr8 scaffold_68, whole genome shotgun sequence
  Pfam annotation: Domain name=zf-C3HC4; Domain location=379-416; Score= 37.5; E_value=5e-08; Accession=PF00097.16; Description=Zinc finger, C3HC4 type (RING finger)
  Pfam annotation: Domain name=zf-MIZ; Domain location=379-419; Score= -7.9; E_value=0.014; Accession=PF02891.11; Description=MIZ zinc finger
  Pfam module annotation: Pfam domain module=zf-C3HC4::zf-MIZ; Domain location=379-416::379-419
  Subcellular localization annotation: CTP_CleavageSite=35; ConfidenceScore=5.46e-01
MEGNNNNNNNNADVFRPSVGPSSSPNSRRYSGILSASNLIQAPLSALLEYSGILPSRSSNQHSQPSSDAANNDGEVSIRIIGPAEQEQREEQQLQQTPPPGLVVGLSHSQNDTVLASGSPRGDAEGAAGTEGAAAGGDGAGRDSSYQRYDIQHAARWIEQVLPFSLLLLVVFIRQHLQGFFVTIWIAAVLFKSNDILRKQTALKGERKMLVLVGISVGFALHVVGVYWWYQNDDLMYPLIMLPPKDIPPFWHAIFIIMVNDTLVRQAAMVFKCILLMYYKNSRGRNYRKQGQMLTLVEYLLLLYRALLPTPVWYRFFLNKEYGSLFSSLMTGLYLTFKLTSVVEKVQSFFAAVKALSRKEMHYGAYATSEQVNAAGDLCAICQEKMHAPILLRCKHIFCEDCVSEWFERERTCPLCRALVKPADLRSFGDGSTSLFFQLF

SEQ ID NO: 97969 - protein, 576 aa, Glycine max
  Coding DNA Sequence Number=SeqID_6284
  Homolog annotation: Hit_ID=A7Q3C7; Match level="QueryCoverage=99%, HitCoverage=77%, E-value=1e-148, Identity=72%"; Hit description =Chromosome chr13 scaffold_48, whole genome shotgun sequence
MKLGFVCEFQAETDERICFLNVCPDEIIRSLFYNKNNDSLITVSVYASENFSSLKCRGKPDAGFPLFQSESLKWPGFVEFDDVNGKVLTYSAQDCIYKVFDLKNYTMLYSILDRNVQEIKISGHIPLKIISIEDGTVLKVFNHLLHRNKKVDFIEQFNEKLLVKQENENLQILDVHNSELMEVSRTEFMTPSAFIFLYDNQLFLTFRNRTVSVWNFHGELVTSFEDHQLWHPDCNTNNIYITSDQDLIMSYCKADSDDQWIEGTAGSINVSNILTGKCVAKIIATSSSAKADECSSSGCSCKQSDSCLMRNSVAEALEDITALFYEEDRNEIYTGNRHGLVHVCGENGKDKYAFGEVVRMERRKHGGLKKESSDNNDNNDNNINFFKMLQSGEVCSKPHRAFASVTISHRFCNMHLTHQYDTYDPSKKMMVLVVYQSKMDGLGRGASMGLGLPPSTSFLSVKLCLGDLLVMGSNPETASLHMQGKGCVQHPSPIPSHSEEPLGNGENQLFLTFRNGALSVWNFCRELVTQFEDHQFVTRLGCNTNNTYITRDQDFIISYCKADSDDQWMEGNGNRL

SEQ ID NO: 97970 - protein, 146 aa, Glycine max
  Coding DNA Sequence Number=SeqID_6285
  Gene Ontology: Mol. function=P-P-bond-hydrolysis-driven protein transmembrane transporter activity; Cellular component=membrane; Biological process=intracellular protein transport
  Homolog annotation: Hit_ID=A7PWB7; Match level="QueryCoverage=60%, HitCoverage=11%, E-value=2e-29, Identity=73%"; Hit description =Chromosome chr8 scaffold_34, whole genome shotgun sequence
  Subcellular localization annotation: CTP_CleavageSite=22; ConfidenceScore=5.18e-01
MASRRGGVSLPDRPSNNSSSVLAKISRSSIVTRGKEVADDAAFVAKKLLRSTGKAAFAVGIPEAEISNLIKTLRGFNDTKIEFKLANVQKIWQRFLYRDSVLLEAERQKTAIGHVDDWAVEFLKLTEDDAFATLIQVLLFFLANYF

SEQ ID NO: 97971 - protein, 115 aa, Glycine max
  Coding DNA Sequence Number=SeqID_6286
MGFPEKESTEPDEVIFASRIKETLKKRRGRHKINQRGGAWWSRVGVWHERERRVEKFPVKRPVGLGCALRGAPNPVISDRNGGRSEDGWRRTAAQTTADGGGYDPLWYQLEALNM

SEQ ID NO: 97972 - protein, 199 aa, Glycine max
  Coding DNA Sequence Number=SeqID_6287
  Gene Ontology: Mol. function=nucleotidyltransferase activity; Cellular component=cellular_component; Biological process =biosynthetic process
  Homolog annotation: Hit_ID=Q9ZVI9; Match level="QueryCoverage=62%, HitCoverage=29%, E-value=2e-47, Identity=74%"; Hit description =Putative phospholipid cytidylyltransferase
  Pfam annotation: Domain name=CTP_transf_2; Domain location=35-167; Score=-13.9; E_value=0.022; Accession=PF01467.17; Description =Cytidylyltransferase
MSYISKLEKNPGQSSISHFQGLGDEIEAGDDRGKLADFAALAHSAIILLLLYSTGSLRCSSCLFSSLFRILGSATRGSHRPIMNLHERSLSVLACRYVDEVIIGAPWEISKDMLTTFNISLVVHGTIAESNDFQKEECNPYAVPISMGIFKVLESPLDITTTTIIRRIVSNHEAYQNRNKKKGESEKRYYEGKSHVSEE

SEQ ID NO: 97973 - protein, 805 aa, Glycine max
  Coding DNA Sequence Number=SeqID_6288
  Gene Ontology: Mol. function=protein binding; Cellular component =nucleus; Biological process=regulation of transcription
  Homolog annotation: Hit_ID=Q9AVK4; Match level="QueryCoverage=100%, HitCoverage=100%, E-value=0.0, Identity=57%"; Hit description =SCARECROW
  Pfam annotation: Domain name=GRAS; Domain location=413-704; Score =453.1; E_value=3.8e-133; Accession=PF03514.5; Description=GRAS family transcription factor
  Subcellular localization annotation: CTP_CleavageSite=32; ConfidenceScore=5.15e-01
MAACALFSAGGNITEDGNVNGSGSASSTPLTSASNSSSMSNEEKKHNLHGGGIMPQPHCERKMVRKRMASEMEVNVHATPPHNSSSTTSDYPRFPRRSSTNMNMLEKGSTSTTTATTTTLAEDNVAIPNYPTVTVTTNYSTMLLPSSTTTTINSSGVAPNYITHHQHHHFQGLVESQDHQQNPVPAVCGFSGLPLFPSQSQRNRDSNNTPTTNNIRNSGGNIVDVVASSSSSSSMDDTSAAAATSGWIDGILKDLIHSSNSVSIPQLISNVREIIYPCNPNLAMVLEYRLRLLLTESTTQNKRGTEGVPLPPSVSSVKLTSNRVVDGIVPNLHFTDASGGAVVVNQHMLSNWGVPQITHHHDNNTNTNTNNSNNPSVSLVTLPSPTPPLPPPHYSPPQEKHPQEEDLAATSTAEVALSRKKKEELREQKKKDEEGLHLLTLLLQCAEAVSSENLEDANKMLLEISQLSTPFGTSAQRVAAYFSEAISARLVSSCLGIYATLPHTHQSHKVASAFQVFNGISPFVKFSHFTANQAIQEAFEREERVHIIDLDIMQGLQWPGLFHILASRPGGAPYVRLTGLGTSMEALEATGKRLSDFANKLGLPFEFFPVAEKVGNLDPERLNVCKTEAVAVHWLQHSLYDVTGSDTNTLWLLQRLAPKVVTVVEQDLSNTGSFLGRFVEAIHYYSALFDSLGSSYGEESEERHVVEQQLLSREIRNVLAVGGPSRTGEPKFHNWREKLQQCGFRGISLAGNAATQASLLLGMFPSEGYTLVEDNGILKLGWKDLCLLTASAWRPPFHSAITHHN

SEQ ID NO: 97974 - protein, 59 aa, Glycine max
  Coding DNA Sequence Number=SeqID_6289
  Gene Ontology: Mol. function=catalytic activity; Biological process =metabolic process
  Homolog annotation: Hit_ID=A3C702; Match level="QueryCoverage=67%, HitCoverage=16%, E-value=3e-12, Identity=72%"; Hit description =Putative uncharacterized protein
MLGARSNSPEIIILGIPSFLGPVLVPGHITTYWLWFILRQLEAIETHSGKFRCKYNTME

SEQ ID NO: 97975 - protein, 230 aa, Glycine max
  Coding DNA Sequence Number=SeqID_6290
  Gene Ontology: Mol. function=molecular_function; Cellular component =cellular_component; Biological process=biological_process
  Homolog annotation: Hit_ID=A7PY90; Match level="QueryCoverage=93%, HitCoverage=48%, E-value=1e-104, Identity=82%"; Hit description =Chromosome chr15 scaffold_37, whole genome shotgun sequence
  Pfam annotation: Domain name=WD40; Domain location=177-223; Score =32.2; E_value=1.9e-06; Accession=PF00400.23; Description=WD domain, G-beta repeat
  Pfam annotation: Domain name=WD40; Domain location=29-67; Score=6.2; E_value=5.4; Accession=PF00400.23; Description=WD domain, G-beta repeat
  Pfam annotation: Domain name=WD40; Domain location=79-117; Score =36.5; E_value=9.8e-08; Accession=PF00400.23; Description=WD domain, G-beta repeat
  Pfam module annotation: Pfam domain module=WD40::WD40::WD40; Domain location=177-223::29-67::79-117
MLDDGFLQPVLNLISNSGTDIILWHGKTGKSVGHVDTNQLKNNMATISPNGRFIAAAAFTADVKIWEIVYAKDGSVKEVLNVMQLKGHKSAVTWLCFMPNSEQIITASKDGSMRLWNINVRYHLDEDPKTLKVFLIPLHDSSGTTLHYDRLSVSPDGKILAATHGSTLQWLCVETGKVLDTAEKAHDSDISCISWAPKPIPMGNEQVLVLATASADKKVKLWASPSIPSS

SEQ ID NO: 97976 - protein, 128 aa, Glycine max
  Coding DNA Sequence Number=SeqID_6291
  Gene Ontology: Mol. function=histone-lysine N-methyltransferase activity; Cellular component=nucleus; Biological process=chromatin modification
  Homolog annotation: Hit_ID=Q10P52; Match level="QueryCoverage=77%, HitCoverage=35%, E-value=1e-41, Identity=81%"; Hit description=LOB domain protein 18, putative
  Pfam annotation: Domain name=DUF260; Domain location=17-119; Score =201.3; E_value=2.4e-57; Accession=PF03195.5; Description=Protein of unknown function DUF260
  Subcellular localization annotation: CTP_CleavageSite=55; ConfidenceScore=5.23e-01
MSSGNGGGGSSSGTGSPCGACKFLRRKCVSGCIFAPYFDSEQGTSHFAAVHKVFGASNVSKLLLSIPVHRRLDTVITICYEAQSRIRDPVYGCVAHIFALQQQFFFSLHTKLTKLTRGIIELNDQYHN

SEQ ID NO: 97977 - protein, 819 aa, Glycine max
  Coding DNA Sequence Number=SeqID_6292
  Gene Ontology: Mol. function=ARF guanyl-nucleotide exchange factor activity; Cellular component=intracellular; Biological process =regulation of ARF protein signal transduction
  Homolog annotation: Hit_ID=A7PYA2; Match level="QueryCoverage=99%, HitCoverage=62%, E-value=0.0, Identity=63%"; Hit description =Chromosome chr15 scaffold_37, whole genome shotgun sequence
  Pfam annotation: Domain name=Sec7; Domain location=91-276; Score =299.3; E_value=7.6e-87; Accession=PF01369.11; Description=Sec7 domain
MVNGLLKTAQGVPLGATTTVLPPRAETLKHEAMKCLVAVLKSMGEWMNKQLRIPDPHSGKKVDNGHEAGVLPMANGNEEEPVEGSDTHSEISNEASEVSTIEQSRAYKLKLQEEFLINANKVGNSPEEIAAFLKDASGLNKTFIGDYLGEREELSLKVMHAYVDSFDFQGMEFDEAIRAFLQGFRLPGEAQKIDRIMEKFAERYCKCNPKVFSSADTAYVLAYSVILLNTDAHNPMVKNKMSAEDFIKNNRGIDDGKDVPEEYLRSLYERISRNEIKMKEVDLESQQKQAVNSNRLSGLDSILNIVVRKHGEDSNMETTTDVVILRFMIEVCWAPMLAAFSVPLNQSDDEIVIALCLKGFHYAIHVTSVMSMKTHRDAFVTSLARWELLTRSLGAYLEHLHLLGEGAPPDATFFTFPQNDSEKTKQAKSTILPVLKKKGPGRMQYAAATVMRGSYDSTGISSNTSGAVTSEQAFTTAAYDDHKNIVLLAFEIMEKIIRDYFPHITETETTTFTDCVNCLIAFTNSRFNKEISLNAIAFLRFCAPKLAEGDLGSSSMNNKSEIRQSALKVLFETLCNHGHLFSLPLWERVFESVLFPIFDYVLHAIDPSGSSTSEVNEVETDGQLDQDAWLYETCALALQLVVDLFVNFYNTINPLLRKVLMLLVSFIKRPHQSLAGIGIAAFVRLMSNAGELFSDKKCGNFVTVNHEHASMAEDDRDPAESGSHDNLESPRTQNLYAYLSDAKCRASVQLLLIQAVLEIYNMYRSRLSAKTILVLFEALHDVALHAHKINSNIILRSKLQEFGSMTQMQDPPLLRLENA

SEQ ID NO: 97978 - protein, 403 aa, Glycine max
  Coding DNA Sequence Number=SeqID_6293
  Gene Ontology: Mol. function=dihydrodipicolinate synthase activity; Cellular component=chloroplast; Biological process=diaminopimelate biosynthetic process
  Homolog annotation: Hit_ID=Q42800; Match level="QueryCoverage=76%, HitCoverage=93%, E-value=1e-150, Identity=86%"; Hit description =Dihydrodipicolinate synthase, chloroplast precursor
  Pfam annotation: Domain name=DHDPS; Domain location=102-379; Score =457.7; E_value=1.6e-134; Accession=PF00701.13; Description =Dihydrodipicolinate synthetase family
  Subcellular localization annotation: CTP_CleavageSite=19; ConfidenceScore=5.04e-01
ASSDSDLPFFFLKSWPHSRASASEDPPFPFAPPISRTLETPGFSEVKKPLIRGMHELGDISFWIEPLEFESTLYAPFALQSVLVNSSDRLRCFVRTSPEDIKALRLITAIKTPYLPDGRFDLEAYDDLVNMQIGQGAEGVIVGGTTGEGQLMSWEEHIMLIAHTVNCFGGKIKVIGNTGSNSTREAIHATEQGFAVGMHAALHINPYYGKTSLDGMVAHFQSVLSMGPTIIYNVPARTGQDIPPHVIQTLAESVNLAGVKECVGNDRIKQYTDDGIVVWSGNDDQCHDARWGYGATGVVSVASNLVPGLMRELMFGGVNPTLNSKLLPLIDWLFHMPNPIGLNTALAQLGVIRPVFRLPFVPLPVDKRIEFANLVKEIGREHFVGNKVVEVLDDDDFFLVSRY

SEQ ID NO: 97979 - protein, 42 aa, Glycine max
  Coding DNA Sequence Number=SeqID_6294
MESVLSKNGHFYVSVYVHTRSMLHELKRYFSKKRIIGMREES

SEQ ID NO: 97980 - protein, 217 aa, Glycine max
  Coding DNA Sequence Number=SeqID_6295
  Gene Ontology: Mol. function=UDP-glucose 4-epimerase activity; Cellular component=soluble fraction; Biological process=carbohydrate metabolic process
  Homolog annotation: Hit_ID=O65780; Match level="QueryCoverage=37%, HitCoverage=22%, E-value=8e-40, Identity=91%"; Hit description=UDP -glucose 4-epimerase GEPI42
MQLRFQLQGRSSVTKGKQGRVKETEGVLNGAVYSHCHGFFSVQKILSAYTTITADAIARFQNKMHGITHMDAALDAMRPLGFRTQLILRTVNELLDELLQVYGGNQGWCFIEEAYYKLLMEALLSKQQGSAEYKFGNLGTGRGTSVLEMVAAFEKASGKKIPLKMCPRRPGDATAVYASTDKAEKELGWKAKYGIEEMCRDLWNWTSKNPWGYQGKH

SEQ ID NO: 97981 - protein, 81 aa, Glycine max
  Coding DNA Sequence Number=SeqID_6296
MDNLSILPREKFQKQEGVVQKIYSQIVSCLSIERERKSTESSVLHWYTVSSHRISQLDELPQVLRRIFMDSATEWVVLEHL

SEQ ID NO: 97982 - protein, 287 aa, Glycine max
  Coding DNA Sequence Number=SeqID_6297
  Gene Ontology: Mol. function=oxidoreductase activity; Cellular component=integral to membrane; Biological process=electron transport
  Homolog annotation: Hit_ID=Q2MIZ3; Match level="QueryCoverage=40%, HitCoverage=56%, E-value=1e-47, Identity=71%"; Hit description =Cytochrome P450 monooxygenase CYP76E1
  Pfam annotation: Domain name=p450; Domain location=32-278; Score= -71.2; E_value=1.7e-09; Accession=PF00067.13; Description=Cytochrome P450
MDYLTTLLLLISIVSASIIRIFIRRFESVRLPPGPRPFPIIGNILELGINPHKSPTKLSKIYGPLMTLKLDSITTIVISSPQVAKQVLHKNGHVFSSRTIPHSVQALDHHRFSIVWLPPSPKWRNLRRVCATKVFSPQLLDSTQILRQQKVHDLLDFVKERCKKGEVIGFCERKMQKILVNVWAIGRDPTIWENPEMFMPERFLECEIDFKGHDFELIPFGTGKRICPGLPLAHRSMHLMVASLVHNFEWKLADGLVPENMNMEEQYGISIKRVQSLLVEAISIKHD

SEQ ID NO: 97983 - protein, 332 aa, Glycine max
  Coding DNA Sequence Number=SeqID_6298
MAGRGADSKILGGTGGKIFIPNRRNKEGRRYGFVRLKGVADARSVEKDLDNSFIRGLKLHVNIPKYGRGEAMKEQTQHKLTGEKAAMAVNKSNHSSREDNHFAGDDRTWSRLSLNISEKDKVRYQNVWVGRLKKLEIFKRLEEEVAWHVGPGISAKYLGDDMALLLGLSDKRAAEIIREETEQSSSLLVWIRCWGIPVLAWKTEYMRRMVAAVGDLVDVDDDVEHMQRLDRARVLVRTPWPPLIQHVTLVQIDGMSHCVYIVEENGGMELTGNRHGRSFWGSSEEVLSDVADDDMDTVCSWSTGIPLSRGAGEPVGDPIVERHDTQSPPLPT

SEQ ID NO: 97984 - protein, 299 aa, Glycine max
  Coding DNA Sequence Number=SeqID_6299
  Homolog annotation: Hit_ID=A7PY22; Match level="QueryCoverage=94%, HitCoverage=9%, E-value=2e-66, Identity=52%"; Hit description =Chromosome chr15 scaffold_37, whole genome shotgun sequence
MVVVGSIHGISLFTHDSKVARVLHLFYRLVVQPNTSRAHTFAEEFLACGGIETLLVLLQREAKAGDSCVLESLSMNPEPQKSEIDSGNEMTKGSQEDDGSKDKSEAIIQDNDQGFLSVDSGSSPDPSSPDVNSDRIFASEIPSAKNLGGISLSISADSARKNVYNVDKSDGIVVGIIGLLGALVASGHLRFGSRAGPDTTSNLLGVGLHDKGGTMFEDKVSLLLYALQKAFQAAPNRLMTNNVYTALLAASINASSAEDGLNFYDSGHRFEHSQLLLVLLRSLPFAPRPLQSRALQVLA

SEQ ID NO: 97985 - protein, 112 aa, Glycine max
  Coding DNA Sequence Number=SeqID_6300
MTALNPDQRKTLSDLARTTNSSNRIDSDRLALRERIKKQKISPQRRAHSCTIRSKLAKSKEKKRTDRNETDIAASDMRKAKKNEIVVTVSVPSRRLRHGVAFASDRLFRSRI

SEQ ID NO: 97986 - protein, 392 aa, Glycine max
  Coding DNA Sequence Number=SeqID_6301
  Homolog annotation: Hit_ID=A5B5G7; Match level="QueryCoverage=54%, HitCoverage=14%, E-value=6e-13, Identity=27%"; Hit description =Putative uncharacterized protein
MVSRKRQAVPAQGGESTWDSSRFTSEIAWHRYQDNVHLRNILPERNVELAPGMFDDFLRELQRRQWHRVLTKLPEKQIDVALVKEFYSNIYDPEDGSHKYCRVRGHVIRFDAETINDFLDTPVILADGEDYSVYSQYLHTYPDHQAITTALCIPGGGFVLNADGAPWKLLRKDLTTLAQTWSVLSYFNLAPTSHTSDLNVDRARLIYGLVMKMDMDLGSFIFDQITQIAQSNTSRLGFPALITALCDAQGVVSDTLTFESLSPVINLAYIKKNCWNPADPSITFPGARRTRARATAPDALPPSQPPSQAVHHQQTSTLAPLDTHSQMLQSLYQGQQIIIQDLHRLSLHLKMDPPLTTPEAYVQQVAWPGVQPSTNRGGGGGAFWSPRHHGWS

SEQ ID NO: 97987 - protein, 35 aa, Glycine max
  Coding DNA Sequence Number=SeqID_6302
MWARLLSSTNLSSFTIVKAVSEDKRQEEANGHVPE

SEQ ID NO: 97988 - protein, 217 aa, Glycine max
  Coding DNA Sequence Number=SeqID_6303
MKAYYDKKLQRKEFQPGQQVLLFNSRLRLFPAQQVQTTAVGAQTAEKEWATRSHTLSAHIGAKRAYDVICAQHVHPLSAQGIPRDTSLGALSGSCALSAYTITVGQLPNPSTSLCSFLNYNDINFSPFPLSCAFLLPLHSFSAFSCEHTHLPSPFTQFSRKEVPSRYALQRGLARTGNFNKKGEHANPAQTANGTPCTEALNTLMTLTNALSAQPWR

SEQ ID NO: 97989 - protein, 228 aa, Glycine max
  Coding DNA Sequence Number=SeqID_6304
MDLDLGNFISLQISQIAQCSTSRLGFLVMITTLCDIQGVVSDTLIFESPSPVINLTYIRKNCWNPADLSITFPGVHRTRTRAPASASEASFPPQPPSQPSSQAPIPPPASTSALLDMHGQMPRWIHLSRLHRPIFSRSHGQEPSPLLIVGGSLLEPKPEPERMLQLMKTLLLTWQQQIGAHGQIWAKAAHDLSFLCLYLVLNGTTLEMLLIIGETLVLEAKVKSRNGT

SEQ ID NO: 97990 - protein, 119 aa, Glycine max
  Coding DNA Sequence Number=SeqID_6305
  Gene Ontology: Mol. function=phosphopantothenoylcysteine decarboxylase activity; Cellular component=cytoplasm; Biological process=response to stress
  Homolog annotation: Hit_ID=Q9SWE5; Match level="QueryCoverage=79%, HitCoverage=45%, E-value=3e-32, Identity=64%"; Hit description =Phosphopantothenoylcysteine decarboxylase
  Pfam annotation: Domain name=Flavoprotein; Domain location=22-117; Score=47.7; E_value=4.2e-11; Accession=PF02441.10; Description =Flavoprotein
MDSSGARRADLRAKAKAMAEKPRVLLAACGSVCAVKFGNVCRSFAEWAVVKVVLTKSALRFIDEQTLPQDVTVYRDEKDWRTWKKLGDPMLHIELCNWAEIMVIAPLSANTLSKVINQT

SEQ ID NO: 97991 - protein, 560 aa, Glycine max
  Coding DNA Sequence Number=SeqID_6306
MRVEEHTTNSRIQTGDVYHRSTQHVTPLRTYANVVASTATDAGQRKQFQPRYTNQRHSQSTVQLEVQWEEKKWLTEAWATILLLGLSDSKAEEIIKDEAQHGTSPFHSLEKWNQRTRPGYRVIWAQCWGIPLEVWDIGSIWKIVVAVGELVEVDDDVEDFRRLDRARVLIRTPWSPFFHHTVQVTIGGEIHMVSIIEEASADARTRANRFRMAMELSEDIHSDDLDTDAEFDSVPAGHPFFCQPNNPDDEGMQSLPGDGRDNTDNTHRALLPDIPRSNGSPMGNTLQTSGLENRERPEPGKAKVPPLAPQIPAYPHAQLGKVNKDEAGKRKEAKTRGVSSEVEERAVFADKERDVEGQKDDDQHRNIGPKNISAALPRKSHIRGIEENKKLGHLNQKPAGPIPQESSRKGSMQSVIVCDIQQPPCGPTNQMGLPNQISANSKQQENNTHVIHNSSCSNECKVFVRRKVWNQKQGQQRGHQLPQGKSPTLDMASTSTGHGKQPDNNSTDKAENSKGTSENTRQVASSQWEVAKILGVINNSVHEAIINKIDEMEKRDTKEA

SEQ ID NO: 97992 - protein, 198 aa, Glycine max
  Coding DNA Sequence Number=SeqID_6307
MERLCKQSFFMSMPNHAMSPIYEARGHMLGGIPCLRYCTRIATGMGWIRPGNGRRCFRIQRRCEKVHRGICEVSSEHGNKCFLSFLYASPTDWSIRTSLCVDHDTHAKRAFPPGSSDHAISAGCVLIALAHDNCLPKWLLALSSLLELSDFDSLREEIALSTTLQFMNPLPSICYNSTKNITRITLKTINFSISWIKI

SEQ ID NO: 97993 - protein, 284 aa, Glycine max
  Coding DNA Sequence Number=SeqID_6308
  Gene Ontology: Mol. function=transferase activity; Biological process= D-ribose metabolic process
  Homolog annotation: Hit_ID=Q8H277; Match level="QueryCoverage=70%, HitCoverage=72%, E-value=3e-35, Identity=57%"; Hit description =Fructokinase
MTGCYFPVTFDRSRSRRGSLRKFKNFMYIIQKMLFQKTKRECRKQLRSAGSNSLRAINPTSVYNSPITCSSKHRRRESHKGPPVVCFGEMMINLVPTVARVSLADAAAYKKFPSGATANVAVGISRLGGSAAFIGKATIFHYGSVSLIKEPCRSAHLAAMNAAKVSGCILSYAANLALPLWPSKEAARQGIMSIWNYADIIKVSVDEIRLLTEGDDPYDDVVIMKKLHHYNLKLLLVTEGARGCRDYTKVLIHNKILHDLYSAYVHKHNAIINATDRNLVLRGV

SEQ ID NO: 97994 - protein, 100 aa, Glycine max
  Coding DNA Sequence Number=SeqID_6309
  Gene Ontology: Mol. function=serine-type endopeptidase activity; Biological process=negative regulation of catalytic activity
  Homolog annotation: Hit_ID=A7PY65; Match level="QueryCoverage=48%, HitCoverage=6%, E-value=1e-10, Identity=64%"; Hit description =Chromosome chr15 scaffold_37, whole genome shotgun sequence
MDELLLVFQNPYRQLHTTRSWNFIGLPPTAKRKLKSESDIIVALSDTGRVHALKASRKMDLVHQHDGKDLVATMQISQAAISKFSFLVYIVTAFSVIKNL

SEQ ID NO: 97995 - protein, 343 aa, Glycine max
  Coding DNA Sequence Number=SeqID_6310
  Gene Ontology: Mol. function=nucleic acid binding; Cellular component= lysosome; Biological process=sphingolipid metabolic process
  Homolog annotation: Hit_ID=A7QFL1; Match level="QueryCoverage=47%, HitCoverage=75%, E-value=2e-38, Identity=46%"; Hit description =Chromosome chr8 scaffold_88, whole genome shotgun sequence
  Pfam annotation: Domain name=SapB_1; Domain location=122-160; Score =34.1; E_value=5.1e-07; Accession=PF05184.6; Description=Saposin-like type B, region 1
  Pfam annotation: Domain name=SapB_1; Domain location=36-74; Score =48.2; E_value=2.9e-11; Accession=PF05184.6; Description=Saposin-like type B, region 1
  Pfam annotation: Domain name=SapB_2; Domain location=77-110; Score =33.3; E_value=8.7e-07; Accession=PF03489.8; Description=Saposin-like type B, region 2
  Pfam module annotation: Pfam domain module=SapB_1::SapB_1::SapB_2; Domain location=122-160::36-74::77-110
MEGRMGLLFLVVLGAAWACDARELANSETSELSIKPDVCALCEEYITKALDYLHENKTETEIISILHNTCHQLPSFKQKCVALVDYYVPLFFSEVATIQPGEFCHKVNLCQDIAHISLKVQEDSCEFCKDTVSTLLEKLKESDTKLEIIETLLKVCNSVEKYANKKSNYYTFIDNCSGGILGLRHGPWSTGDTLMKLMPVDLLGASSRIAGAPSKFSKSQKCPSAFLANFFRGVPRKISSASVNGRRTAEEPSSVELRGRTSSARVNGRRFFRGIPRKKLHTLQSHTSSSIHFSNSDHAIGVDLIAFSVEMTNKAKGKDKEVTGKGSTDRCKDAFDDDKTGGG

SEQ ID NO: 97996 - protein, 114 aa, Glycine max
  Coding DNA Sequence Number=SeqID_6311
MTFYAGFSSTRMSRKNYVMDAWGSLVDCCSEHQFDDCLKKFEISCSPWPMFVAYVNKTWIIPHKEKFVTAWTNDALRKHNNKQVDASSIGACRPRIFFINGFLYFLEDEWQRNE

SEQ ID NO: 97997 - protein, 138 aa, Glycine max
  Coding DNA Sequence Number=SeqID_6312
MALEWWSQRKRFVPVKVPGLWDLHLPYEEKVGPQARLPSPKTAQWKAWILEAPPPVNSEVKLMLGLKRSKVRLFETTLPARHRAMIRAGNPSQEELDWAIEVVWPEMSTPMFMSMQETKPKISLALSIVSQMCEIWGP

SEQ ID NO: 97998 - protein, 614 aa, Glycine max
  Coding DNA Sequence Number=SeqID_6313
  Gene Ontology: Mol. function=oxidoreductase activity, acting on single donors with incorporation of molecular oxygen, incorporation of two atoms of oxygen; Cellular component=chloroplast
  Homolog annotation: Hit_ID=Q208P3; Match level="QueryCoverage=90%, HitCoverage=89%, E-value=0.0, Identity=78%"; Hit description =Dioxygenase RAMOSUS5
  Pfam annotation: Domain name=RPE65; Domain location=51-614; Score =19.7; E_value=1.7e-17; Accession=PF03055.6; Description=Retinal pigment epithelial membrane protein
  Subcellular localization annotation: CTP_CleavageSite=36; ConfidenceScore=5.46e-01
MQTKPIHNTPTYIPPPIRPSPPVHQPPPSIPPTKPRAVSISAPNTPVAVPIPPIVEPDDSNAAYYDYQFLFISQRSETSQPVTLSTVEGVIPADFPSGTYYLTGPGLLADDHGSTVHPLDGHGYLRAFTFDNATKNVKYMAKYIKTDAHVEEHDPKTDKWKFTHRGPFSVLKGGKKVGNTKVMKNVANTSVLKWGEKLLCMWEGGEPYEIQAGTLDTIGRYNMMDGADLENHDESKDGVDVWEVAANLLKPILYGVFKMPPRRLLSHYKVDSRRNRLLTVSCNAEDMLLPRSNFTFAEYDSNFNVVQKQVFRIPDHLMIHDWAVTDTHYIVFANRIKLDVLGSIAAVYGMSPMVSALRVNPSKSTSPIYLIPRFPDKNKDKERDWRVPFEAPSQLWLLHVGNAFEIRYPHRNLDIQIQAAACSYQWFNFSKLFGYDWQKKKLDPSIMNVKGGNELLPHLVQVSIKLDSDYNCQECDVKPMKKWQKSSDFPATNPTFSGKKNKYLYAATTLGSRKTLPCFPFDTVVKLDLESDNSAQTWTAGSRRFIGEPIFVPKGDEEDDGYLLVVEYAVSMNRCYLVILDPKRIGADNALIARIEIPSHLNFPLGFHGFWAAN

SEQ ID NO: 97999 - protein, 173 aa, Glycine max
  Coding DNA Sequence Number=SeqID_6314
MFFHKRWSRESFHQRGPGRTPLEKAPALPNQLTRILTATDSGALSISSASRPSRDGGDSHGVLHQCLAYRGGSSGYALLGHCSAFVYTGAVFRPDRWDNVVAWFFFLHNNPKNYFKEIVNIALKGFKDKHGSKSKANAKWIPVKCNKQKGSTVYGYYFMHWMSTIVLEDFKDN

SEQ ID NO: 98000 - protein, 41 aa, Glycine max
  Coding DNA Sequence Number=SeqID_6315
MTTDRPPLPMSHTGPGRQGCCPCSYISSGAMKNSYLRSSLK

SEQ ID NO: 98001 - protein, 63 aa, Glycine max
  Coding DNA Sequence Number=SeqID_6316
IPQTVFGLFHDSHQFLSGFLVEPIIRLIKVILVASTQTYLPSLEVASTMTYLPSLEVASSKPS

SEQ ID NO: 98002 - protein, 25 aa, Glycine max
  Coding DNA Sequence Number=SeqID_6317
MCKVKWWLDRNIEMAITEATGLQMR

SEQ ID NO: 98003 - protein, 90 aa, Glycine max
  Coding DNA Sequence Number=SeqID_6318
  Subcellular localization annotation: CTP_CleavageSite=36; ConfidenceScore=5.56e-01
MPYLLAKKARKASIAARSTNPSTFGKKTPPKINTARTSMNGVVGIPRKYLEAKARILAGKGEWAPRSYCVALFANSPSSTFIRRPMNLIA

SEQ ID NO: 98004 - protein, 163 aa, Glycine max
  Coding DNA Sequence Number=SeqID_6319
  Homolog annotation: Hit_ID=Q2HW90; Match level="QueryCoverage=92%, HitCoverage=27%, E-value=8e-19, Identity=38%"; Hit description =Putative uncharacterized protein
MDILALLIIGVVLFPNVDGLVDRATIDVFLAFYDYKESPVVTILADLYDTFDRRCEKSSARIVCCTPALYIWLVSHLFHQEVRHVCPLEGHRSCTEKKEANWDQILASKEGGSVNWFPRWKEGRTGILISCGEFPNVPLMGTRGCINYNLVLADAILPPKDIR

SEQ ID NO: 98005 - protein, 69 aa, Glycine max
  Coding DNA Sequence Number=SeqID_6320
MDHQQQGAQHPRGANYPTVMIHPRVRCESRGHDPWEQSQPTIMIRLRGARSGDANQGGMTLGNSHNHSE

SEQ ID NO: 98006 - protein, 32 aa, Glycine max
  Coding DNA Sequence Number=SeqID_6321
MVQPKNMNKKVKWWLDRNIEMAITEATGLQMR

SEQ ID NO: 98007 - protein, 162 aa, Glycine max
  Coding DNA Sequence Number=SeqID_6322
MARRDKLWSFCALLSSRGGEPDDMRRQIMVIPDTFSPFRHDRVRWHAKMVILRLLSSRGGEPDDMRRQIMVIPDTFSPFRHDRVRWHAETNYGHYAPFCHPEVVSPMTCGDKLWSFCTFCHPDTIVSDGTQRQIMVILRLSYPNFVRGPLLDDVRPFFGPRE

SEQ ID NO: 98008 - protein, 53 aa, Glycine max
  Coding DNA Sequence Number=SeqID_6323
STLEDPTSIPLPFIFQEAKESIDEEDPRPTSSNGAYIKILLCAKRAKAALRSG

SEQ ID NO: 98009 - protein, 149 aa, Glycine max
  Coding DNA Sequence Number=SeqID_6324
MLPRPVRSQVACGDTIYGNPHTFQRQKCLQSLHAFKGNNVLTHFEDKNFFSHCIPSKGDNDPHLHFEDGNVFSHCMPSKVTMSSSTFQRRQCLQSLHAFKGDNVLIYISKTTMSSVIACLQKATMSSFAFQRQQCLHLKNFNIYFPYAL

SEQ ID NO: 98010 - protein, 37 aa, Glycine max
  Coding DNA Sequence Number=SeqID_6325
MGLKSTLRLMRTLGSSLGSLANLLGVFYPMPLRAHMG

SEQ ID NO: 98011 - protein, 371 aa, Glycine max
  Coding DNA Sequence Number=SeqID_6326
  Gene Ontology: Mol. function=sequence-specific DNA binding; Cellular component=excinuclease repair complex; Biological process=response to DNA damage stimulus
  Homolog annotation: Hit_ID=Q5PI10; Match level="QueryCoverage=84%, HitCoverage=51%, E-value=1e-148, Identity=82%"; Hit description =UvrABC system protein C
  Pfam annotation: Domain name=GIY-YIG; Domain location=23-130; Score =83.4; E_value=7.4e-22; Accession=PF01541.15; Description=GIY-YIG catalytic domain
  Pfam annotation: Domain name=GerE; Domain location=1-45; Score=46.3; E_value=1.1e-10; Accession=PF00196.10; Description=Bacterial regulatory proteins, luxR family
  Pfam annotation: Domain name=UVR; Domain location=235-270; Score =48.9; E_value=1.8e-11; Accession=PF02151.10; Description=UvrBuvrC motif
  Pfam module annotation: Pfam domain module=GIY-YIG::GerE::UVR; Domain location=23-130::1-45::235-270
MITRGQKVTEISEQLNLSPKTVNSYRYRMFSKLNISGDVELTHLAIRHGLFNAEPLISSTVIYVGKAKDLKKRLSSYFRTQVGSRKTEVLVSNIHNIDVTVTHTETEALLLEHNYIKLYQPRYNVLLRDDKSYPYIFLSGDPHPRLAMHRGAKHAKGEYFGPFPNGYAVRETLALLQKVFPIRQCENSVYRNRSRPCLQYQIGRCLGPCVAGLVSEEEYAQQTDYVRLFLAGKDDQVINQLVQRMEQASVGLRFEEAAHLRDQIQAVRRITEKQFVSNQGDDLDVMGVAYDAGMACLHVLFIRQGKVLGSRSYFPKVPADTELTEVVQTFVGQFYLQGSEARTLPADILLDFNLPERELLAASLSELAGRK

SEQ ID NO: 98012 - protein, 78 aa, Glycine max
  Coding DNA Sequence Number=SeqID_6327
MGVKYLDAVKRMLHPTKQMVIRRCIPDHEIDSVLQFCHSSTPSGHLGIQRTARKAAHFHGDSKCLNNPCCSMRCLMSG

SEQ ID NO: 98013 - protein, 81 aa, Glycine max
  Coding DNA Sequence Number=SeqID_6328
MQRLGLVLVVYDDVSRICPVDLMMKYVQFQWAKHASIVKRSFSALSAIEESGRASISRLLAKHEISALSARVALSSVHDWH

SEQ ID NO: 98014 - protein, 164 aa, Glycine max
  Coding DNA Sequence Number=SeqID_6329
MERSMIDASSGGALGDMTLAEARNLIEKMASNSQQFSARSDAIVIRGVHEVATNSSSSAETKKLEGKLDALVNPQQQQQQQPYFQNVVGPSRPYVPAPIQQQQQQQQQPQKQQTVEAPPQPSLEELVRHMTMQNMQFQQETRASIQSLTNQMGQLATQLNKQQS

SEQ ID NO: 98015 - protein, 157 aa, Glycine max
  Coding DNA Sequence Number=SeqID_6330
MAPRKLSAKRSRKDATAEGTSAAPEFENHHFRSAEHQQHFEAIKGWSFHRERRVQLRDNEYTDFQEEIARWRWTSLITPMVKFDPDVVLEFYANAWPTEEGVRDMRSWVRGQWIPFDSDALSQFLGDPLVLEEGQECEYSQRRNRADDAILPRKGIG

SEQ ID NO: 98016 - protein, 181 aa, Glycine max
  Coding DNA Sequence Number=SeqID_6331
  Homolog annotation: Hit_ID=Q6UUU1; Match level="QueryCoverage=33%, HitCoverage=40%, E-value=1e-18, Identity=78%"; Hit description =Putative uncharacterized protein
MGAAWLMLQRIMLLHNRLSERLPAKPNNFRNRCVLSSVGLHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 98017 - protein, 262 aa, Glycine max
  Coding DNA Sequence Number=SeqID_6332
  Homolog annotation: Hit_ID=Q2HW90; Match level="QueryCoverage=64%, HitCoverage=31%, E-value=9e-13, Identity=33%"; Hit description =Putative uncharacterized protein
ANGLSFIDILALLIFGVVLFPNMEGLVDLAVIDAFLAFHHGKESPVVAILAMYDTFDRGCEKSDARIFFCALALYVWLVSHPFLQEGRPVYPLQGHRSCVEKGKANWDQLLASMEGRLLIGSLARRKEESGFYLHAKDVQMFSLMGTRGCINYNPVLAIRQHGYPMRGVPSDESISPFIARGFSDYNARDRELRGSSNGIISGYHKWLRVRTQGLDCLPNLKTVRDNEVKASKESDEVQALKEKLERARVVKEKFKSIAIKV

SEQ ID NO: 98018 - protein, 593 aa, Glycine max
  Coding DNA Sequence Number=SeqID_6333
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=A8TVQ5; Match level="QueryCoverage=94%, HitCoverage=80%, E-value=1e-180, Identity=70%"; Hit description=Beta- glucosidase G2
  Pfam annotation: Domain name=Glyco_hydro_1; Domain location=39-469; Score=544.4; E_value=1.2e-160; Accession=PF00232.9; Description =Glycosyl hydrolase family 1
MAFKGYFLIGLIAIVVVTSKVTCELEAETVSPIIDISLNRNSFPEGFIFGAGSSSYQFEGAAMEGGREPSVWDTFTHNYPAKIKDRSNGDVAIDSYHHYKEDVGMMKDMNLDSYRFSISWSRILPKGKLSGGINQEGINYYNNLINELLANGIQPLVTLFHWDLPQALEDEYGGFLSPLIVKDFRDYAEICFKEFGDRVKYWVTLNEPWSYSQHGYANGGMAPGRCSAWLNSNCTGGDSATEPYLVTHHQLLAHAAVVRVYKTKYQVSQKGSIGITLVANWFIPLRDTKSDQKAAERAIDFMYGWFMDPLTTGDYPKSMRSLVRTRLPKFTTEQSKLLIGSFDFIGLNYYSTTYASDAPQLSNARPNYITDSLVSPAFERDGKPIGIKIASEWIYVYPRGIRDLLLYTKEKYNNPLIYITENGSAPPDMQRRKEAKQIRNILVTECLSLREHIRQAGFDADFLISLSSVVLQVCWLPHPSLAVGASCVFLSLLLCVLSLFVISAITITRSNTNALIHEVSYLNRSSFPLGFIFGTASSAYQYEGAASEGGKGPSIWDTFTHKYPVGNKQRTCGRGEPEFDFHITHIQGEEEEL

SEQ ID NO: 98019 - protein, 159 aa, Glycine max
  Coding DNA Sequence Number=SeqID_6334
MVIEKRNANIQNLIYGYGGGFISRLSFSENTETFSSLTSYQELRRSEFLIGGYVGSKSLAFVDHTAFCYHDPRAGSPRRYLTVIRTLVSSRGGGPDDTRRYLTVIRALVSSRGGGPDDTRRYLTVIRTLLSSRGGGPDDTQRQNLVILHPCVIQRRRAR

SEQ ID NO: 98020 - protein, 68 aa, Glycine max
  Coding DNA Sequence Number=SeqID_6335
  Subcellular localization annotation: CTP_CleavageSite=29; ConfidenceScore=5.79e-01
MVPPPASPPPPLPPPPLPSNASASPSAVKRTRKASRLRSLSTRPPGADRPVFHVDPTKARLTIPTGRN

SEQ ID NO: 98021 - protein, 204 aa, Glycine max
  Coding DNA Sequence Number=SeqID_6336
MPSPSEDYTPNLSGVCTSLPSVGYTSLPLEDYTSKPSERATRLHLEDYTPHLQRITRPHLQRTTCLTFRGLHNLAFRGLDALAFRGVHILPLRGLHPRLRRVTHPYLQRSTRTQHQRTIHRRHQRATRPRLQRVTRPPLQRTTCPYLQRGLHNLAFRRARRPRLQRSTHPPLSERVHALAFEDYTLTFQGSARPCLQWATRPCL

SEQ ID NO: 98022 - protein, 104 aa, Glycine max
  Coding DNA Sequence Number=SeqID_6337
MASMMEAMLGMRQLMEKNMAIATAVSSATEADPTLLATAHHPPPNAVGRERSGLGHNNNPHLGYNRVAYPYGLPHNYTLPVMHDDAGHVSSPILEGEPPRQPDE

SEQ ID NO: 98023 - protein, 26 aa, Glycine max
  Coding DNA Sequence Number=SeqID_6338
MATPLGITLLSGGEISPTPGLEGNIR

SEQ ID NO: 98024 - protein, 56 aa, Glycine max
  Coding DNA Sequence Number=SeqID_6339
MGGGGGFGCLGKLPGNHITSETSKRVGLRPQKETTPENLVFHGFKQKTQLKHEAKT

SEQ ID NO: 98025 - protein, 40 aa, Glycine max
  Coding DNA Sequence Number=SeqID_6340
MSARKDDRSRLKAQVEKDECLSGEGQSPRVEKDEGPSGEG

SEQ ID NO: 98026 - protein, 82 aa, Glycine max
  Coding DNA Sequence Number=SeqID_6341
MSHLLPEQDVHDMRDELLVATEDVLCLGMDSSPFEVVYAECRNLPFGGRVTHDSRVRVPRKEYARVATNVYLRKTSEKLEKT

SEQ ID NO: 98027 - protein, 48 aa, Glycine max
  Coding DNA Sequence Number=SeqID_6342
MSDSLASYIESDAILPRKGPITRTMSKRLQEDWARAAEEGPRVLMNLR

SEQ ID NO: 98028 - protein, 95 aa, Glycine max
  Coding DNA Sequence Number=SeqID_6343
ASTLGWVVAEQWEEPGYEKKKVPQPVPHKASQKYMYFLQHGKCILTLKNQHQEVQHPENQNQTQIQIHSQHKNQIQDQIQTQIQIQCIRNDKYAD

SEQ ID NO: 98029 - protein, 197 aa, Glycine max
  Coding DNA Sequence Number=SeqID_6344
MKIVISIPLINCDFAGGEHHKDNCYFYSINNFDRRQEPAMYNYYEKGRAPDLESVLVDFMTYQASSKGDCYSMQQQGTQFEKDYSFANYQWESEWKPYYHNEAEGLSNLDDLLMQFMDTVDSMQQDFKRTETQLGKLVDDMTKVVDRREEEYAKIEAHEESILQVTTIHHQLINEEEKDEVSSTPEYPCMATACYVV

SEQ ID NO: 98030 - protein, 54 aa, Glycine max
  Coding DNA Sequence Number=SeqID_6345
MVILCILSSRGGEPDDMGRYNYGHPRLSSIERNEFDSSAGVEIERPNGVSLERN

SEQ ID NO: 98031 - protein, 266 aa, Glycine max
  Coding DNA Sequence Number=SeqID_6346
MEFYANAWPTEEGVMDKRSWGHPLVLEEGQHCEYTDRRSQVSGFDEEAIGQLLCSPGQDFAQSVARSNILPSDHNSDLPLPKCQLVYAILTQISVHVTQLISDAIYQFVGIAPPRHPVDPKKSNRALGFPALITGLCQFYGPGQDQQQQPVGDAPPPPPVQPPSLESISAYMQRMELYMQHLADQQAANHRGQVQLNDSFYQYTLQQQHQDPSPYPWPTLEQFRATVAWSGDRPNFQAGAGLTEAPGDEDGVEEDGNMADVMDFFL

SEQ ID NO: 98032 - protein, 101 aa, Glycine max
  Coding DNA Sequence Number=SeqID_6347
MGEVEEIQEKMKANMEAIKEKMATMMEAMMSVKKIMEANAVAIAATSVVAKVQIQNEHAFPPYGLPLNYTPPNVAYTPNKNVNNSTPIPIESQQPQTDHAH

SEQ ID NO: 98033 - protein, 70 aa, Glycine max
  Coding DNA Sequence Number=SeqID_6348
MNSTSFQGLENQKTSESFWYKEEEEIQRDSRLVKDCNEMMGKELNCHHQKGGDCRSKDFVFDVLMMIVMI

SEQ ID NO: 98034 - protein, 96 aa, Glycine max
  Coding DNA Sequence Number=SeqID_6349
  Homolog annotation: Hit_ID=Q2HW90; Match level="QueryCoverage=89%, HitCoverage=18%, E-value=2e-07, Identity=32%"; Hit description =Putative uncharacterized protein
MGQLQRYAFHKAFGKIWDLATIEVSVEAIASLSQYYDQPLRCFTFEDFQLVPTLEEFEEIPRCPLGGRKPYLFSGFYPSMARVAKVVKISTQELDR

SEQ ID NO: 98035 - protein, 127 aa, Glycine max
  Coding DNA Sequence Number=SeqID_6350
  Gene Ontology: Mol. function=DNA-directed RNA polymerase activity; Cellular component=mitochondrion; Biological process=transcription
  Homolog annotation: Hit_ID=O47884; Match level="QueryCoverage=97%, HitCoverage=13%, E-value=6e-35, Identity=54%"; Hit description=DNA -directed RNA polymerase
MAYFLLDKNFAKLTNLFDTGSGEIFDIYSHMRIELISFIKDSLSEENPELCTILDRVLTRTNSTTKDLIVSLCEDLLPKECTILSVLCFKFWQEKYSFMYSFIQLISQVGRVCSYLDRPVLYSSGIL

SEQ ID NO: 98036 - protein, 17 aa, Glycine max
  Coding DNA Sequence Number=SeqID_6351
MADQQATKSKAKGRKIP

SEQ ID NO: 98037 - protein, 71 aa, Glycine max
  Coding DNA Sequence Number=SeqID_6352
MWDGPICSYFEWESRTSSVASQGQSNGGHLLRPQGDPRTPQLLKNAITKCAPRHPYRTRSKSRTMGDQEEI

SEQ ID NO: 98038 - protein, 239 aa, Glycine max
  Coding DNA Sequence Number=SeqID_6353
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLDKRTCCIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 98039 - protein, 144 aa, Glycine max
  Coding DNA Sequence Number=SeqID_6354
  Homolog annotation: Hit_ID=A5BQ25; Match level="QueryCoverage=86%, HitCoverage=21%, E-value=5e-13, Identity=37%"; Hit description =Putative uncharacterized protein
MKQRETIEDVQKRFTHIVNHLMGLGNIFQEEEINVKELKSVNKTWQPKVIAISISKDLATMTHAKLFGKLREYDMDLTRMAEEEAIDKKNKGLALKTRIPSIQKSKEGMFNKFLKKKKNYGSITFQPKKNFMKENYLPPMDSLA

SEQ ID NO: 98040 - protein, 62 aa, Glycine max
  Coding DNA Sequence Number=SeqID_6355
MWDYVIDAWGSLVDCPFEHQFDDFLKKFEIACSPWPMFVNYVNQTWTIPHKEKFVKAWTNKG

SEQ ID NO: 98041 - protein, 344 aa, Glycine max
  Coding DNA Sequence Number=SeqID_6356
  Homolog annotation: Hit_ID=A5AK77; Match level="QueryCoverage=60%, HitCoverage=26%, E-value=1e-10, Identity=26%"; Hit description =Putative uncharacterized protein
MAQPPPHERTLREMAAPDFTYESLCIQYPDEGVPYVLKTGLIHLLPKFHGLAGEDPHKHLKEFYIVCSTMKPPDVQEDHIFLKAFPHSLEGVAKKIGCTTLLPDPSPAGMTLRGCSWRNSSLHLGPLPLEKTFQGLSNMERSMIDAASGGALGDMTPAEARNLIEKMAPNSQQFSARNDAIVLRGVHEVATDSSSSAENKKLEGKLDALANLVTQLAMNQKSASAHIARNAAGRSKPYVPPPMHQQQQQQQRQQATEAPPQPSLEKLVRQATTQNMQFQQETRAFIQSLTNQMGQMATQLNQAQSQNFDKLPSKTMQNPRNVSAITLRSGKQFEMPPPVAAATP

SEQ ID NO: 98042 - protein, 137 aa, Glycine max
  Coding DNA Sequence Number=SeqID_6357
MERSLIDAASGGALGDMTSVEARNLIEKMASNSQQFSTINDAIVLRGVHDVATDSSSSAENKKLEGKLDALVNLQSRVNEQPEAYAANIYYRPPQQQNQQQQNNYDLSNSRSNPGWRKHPNLRWANPPQQQQPVPPF

SEQ ID NO: 98043 - protein, 63 aa, Glycine max
  Coding DNA Sequence Number=SeqID_6358
MAEEPRRVTLEDYSSSSVPQFFISITRPEWHLQSPFLLLHSTVIDLQEAKDSIDEEDPRPTSL

SEQ ID NO: 98044 - protein, 44 aa, Glycine max
  Coding DNA Sequence Number=SeqID_6359
MGGGGKTAREPHYKRNLKESWASSSKGNNTRKSSLPWIQTKKRK

SEQ ID NO: 98045 - protein, 137 aa, Glycine max
  Coding DNA Sequence Number=SeqID_6360
  Pfam annotation: Domain name=Transposase_23; Domain location=37-107; Score=0.6; E_value=0.001; Accession=PF03017.5; Description=TNP1ENSPM transposase
MQSQGLALPLEPEVGPLAACVSTKGSCVDPSPTDPKTGDSDKCGLYIEENPSRLVVLGKVYEGSTVVHNIPLLHGHVKVGVEKVKDAEAPVPVPIDEVQLVGQALNTFLAWPTYLVKRVLEQATVSPSKPPDRPDPE

SEQ ID NO: 98046 - protein, 408 aa, Glycine max
  Coding DNA Sequence Number=SeqID_6361
  Gene Ontology: Mol. function=ATP-dependent DNA helicase activity; Cellular component=exodeoxyribonuclease V complex; Biological process=DNA repair
  Homolog annotation: Hit_ID=A2XJ40; Match level="QueryCoverage=100%, HitCoverage=26%, E-value=0.0, Identity=87%"; Hit description =Putative uncharacterized protein
MQVLLNTPLDDSGVTLSALTPQHKQAELQFYLPINRLLQAKALDALVKRYDPLSARCPALDFHQVQGMLKGFIDLVFCWQGKYYLLDYKSNWLGEDSSAYTRPAMEQAMAEHRYDLQYQLYTLALHRYLRHRLPDYDYRRHFGGRRSCGDGGRIMIALLEQAVALGVLRPLDVQFARVVASEDEPDILLAAACLSAEAGAGHVCLMLEQLQADTLFEGRQPALALAVWEAAGRPDSARWQQRLAASAAVGDGSGATPLVLRGPRLYLQRMWQNEGEVAAFIGGEGESLAVPEAELRTILDRLFGAASDEPDWQKIAAAVAATRRIAVISGGPGTGKTTTVAKLLAALVQLDESARLRIQLAAPTGKAAARLTESLGSASRQLALTPAQQALFPTEAATLHRLLGAQPS

SEQ ID NO: 98047 - protein, 156 aa, Glycine max
  Coding DNA Sequence Number=SeqID_6362
  Subcellular localization annotation: CTP_CleavageSite=44; ConfidenceScore=5.58e-01
MATQLNQAQSQNSNKLPSQTVHNPKNVSAITLRSGNQIQVPSPVAAPAPEPVKLHSTPEKEDEIVAQKRKLSNKKFHAGGPSSSNSDLPQPLIPLPFPPREISNKKMEEAEKEIEGFIGALSRILAKWPFHYPICYKRRWSFDGSLLVELLWRLDL

SEQ ID NO: 98048 - protein, 252 aa, Glycine max
  Coding DNA Sequence Number=SeqID_6363
MTLNGAEAVSLRVQIRPPLPGDAREARMWQASWPPAPPLAGAAATYSQRSAAVWNQAGHQLVENRLHGGDRGFAGLVGDAGYHQRHVDVCPLIDQRPHDKQAEYRCPLGQFLQEAAAHIADDIHPFAIAISHAVIAGQHARNVKQEEEQQRTEQAAAHRDTGTQRGEHRTHGPPENRVAHASQRPHQAHFDAVNGTVIDRCPVGALLFHGHGHAEHWRGHVRMGVEELKVTLNRLLAFVVVFRIQATDHRHH

SEQ ID NO: 98049 - protein, 74 aa, Glycine max
  Coding DNA Sequence Number=SeqID_6364
MAKPCTELSKGVKRRGAIVTWLRHEGIGSDRTFKLLTKSLGLLSYSTQNRREEKGKGQINQNQFPTKSNLRKSY

SEQ ID NO: 98050 - protein, 60 aa, Glycine max
  Coding DNA Sequence Number=SeqID_6365
  Homolog annotation: Hit_ID=A5C5C1; Match level="QueryCoverage=98%, HitCoverage=7%, E-value=1e-12, Identity=54%"; Hit description =Putative uncharacterized protein
MDALEIYLNEVEMQIEIKVKIVKCERGSEYNGRYDETKQHLGPFAKLLQKCGICMQYIML

SEQ ID NO: 98051 - protein, 156 aa, Glycine max
  Coding DNA Sequence Number=SeqID_6366
MPPTRHPLDPDKSNRALGFSALITGLCQSFGVPITPAFIKKYCTPRQVQGDAPQATDAPPPPHQADLTGSLSMERYLQHLIHEYLYRFSPSQQGQGFAPFACPTPEQFGAEVAWPGDWPEAQAGEEPAGSPGEAEEARMDEEMMDLLGFLGGRGAT

SEQ ID NO: 98052 - protein, 42 aa, Glycine max
  Coding DNA Sequence Number=SeqID_6367
MDKSLKEGEDEWRERERKNTKFYASNKPTNPRSSPRFSTKCA

SEQ ID NO: 98053 - protein, 116 aa, Glycine max
  Coding DNA Sequence Number=SeqID_6368
MGPKSTLRLMRTLRPSLAFLAQSSWSLLSNALGGVGLHHLYKDNWTQPWPMGSEIYPKAHENPKAFSCIFGPIFLESSIQCPWGVGLHQVVYSADGSLSGQIGLASKSKSTLHKLA

SEQ ID NO: 98054 - protein, 73 aa, Glycine max
  Coding DNA Sequence Number=SeqID_6369
MVIFWNFRDLNSPILASGLLGPWESFSLKQSARQGELVPSSLSNWLAWVSFPCTKWPFPINSHAGECFRGLKI

SEQ ID NO: 98055 - protein, 283 aa, Glycine max
  Coding DNA Sequence Number=SeqID_6370
  Homolog annotation: Hit_ID=A5AIE9; Match level="QueryCoverage=91%, HitCoverage=55%, E-value=5e-12, Identity=24%"; Hit description =Putative uncharacterized protein
NHRRSERALRVGVNGIPSHRKQRIRYTNLFSSRSIIDPKFIDMDFFSNESFECIQAFENSNLIPFMSLKLPVYSNLVKAFYSNLEIQEGTLMSEVYGIKMVIGQSLFYDLTQFPSEGVPFEGTLIDDWKFDFSMHDVRRLVCTNQVDMTERLLAGSLAFESRILHYLIVRILLPRSSNLAQVSKEDLIVMWTFHKGLQIDWAHLVRYRMHKALRLNAPLPYPHLVTLFLQHFNIPLDSEPYVPIKRSFLIGTSIIASFGYQKEHDGSWVKKGARHVGEEGHDG

SEQ ID NO: 98056 - protein, 26 aa, Glycine max
  Coding DNA Sequence Number=SeqID_6371
MEEKHGTWEASLRSKEGWEARGRKLP

SEQ ID NO: 98057 - protein, 64 aa, Glycine max
  Coding DNA Sequence Number=SeqID_6372
  Gene Ontology: Biological process=auxin mediated signaling pathway
  Homolog annotation: Hit_ID=P33080; Match level="QueryCoverage=68%, HitCoverage=47%, E-value=4e-17, Identity=100%"; Hit description =Auxin-induced protein X10A
  Pfam annotation: Domain name=Auxin_inducible; Domain location=1-63; Score=10.8; E_value=2.9e-06; Accession=PF02519.5; Description=Auxin responsive protein
MGFRLPGIRKTSIAANQASSKSVEVPKGYLVVYVGDKMRRFLIPALIAVILLEIQGNLDKVVNY

SEQ ID NO: 98058 - protein, 62 aa, Glycine max
  Coding DNA Sequence Number=SeqID_6373
DPEEVPEELPPEPAVDALDFPEDDEDPLPDVDSLEDIMSASEPNSTEESGPGGTANSEDSSS

SEQ ID NO: 98059 - protein, 164 aa, Glycine max
  Coding DNA Sequence Number=SeqID_6374
  Gene Ontology: Biological process=DNA packaging
  Homolog annotation: Hit_ID=P03708; Match level="QueryCoverage=26%, HitCoverage=6%, E-value=4e-17, Identity=97%"; Hit description =Terminase large subunit
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSIETWEAKIGERPDAEVMAERKEHYSAPVPDRVAYLTAGIDSQLESSLSIPSTSRGGPVPAFVPFSEG

SEQ ID NO: 98060 - protein, 56 aa, Glycine max
  Coding DNA Sequence Number=SeqID_6375
  Subcellular localization annotation: CTP_CleavageSite=41; ConfidenceScore=5.07e-01
MAESSKKRKGSSSTTAAAGHRRHKPSEAPTAPIHPPLSSPRSSTLFSSDDQRLWLK

SEQ ID NO: 98061 - protein, 152 aa, Glycine max
  Coding DNA Sequence Number=SeqID_6376
  Homolog annotation: Hit_ID=A6FJQ2; Match level="QueryCoverage=25%, HitCoverage=84%, E-value=3e-11, Identity=92%"; Hit description=50S ribosomal protein L5
MPGADKPVRARQRMRKEKIPHQAPFAIQAAQLLGRAIGAGLFAITPAGERGMCCKAIKLGNARVFPVTTLTKKRVAKFMRRSTLPDKIYVVSQDGVISVIVEKLPPPEPKTIQNLLSLKLIVLQVPRNVAPSFGPRNLMFEVTIRNIPAIFN

SEQ ID NO: 98062 - protein, 254 aa, Glycine max
  Coding DNA Sequence Number=SeqID_6377
  Gene Ontology: Mol. function=nucleotide binding; Biological process =defense response
  Homolog annotation: Hit_ID=A5AXB0; Match level="QueryCoverage=98%, HitCoverage=76%, E-value=2e-47, Identity=42%"; Hit description =Putative uncharacterized protein
MKLQVRIVQQKGSILQRKYTIQAATDHKHVADLRDVTLERCNELQGEYCIDTTTVRCMAWFSAAVSSGVPLVFVNIQTEQIPSMEETHFLKREIATSKQKINNANQIMHGIRLWFLPGLAEISVVLIPQPGEARFGMEIKRTEEGFVYIYSVMRGSPADRAGVREMYEESSANRFLLVISRLQCKSIMPTSACSAGLVHCCDQSEMKDILTSAIDQYETIQVHVMAWPNQTRPSPIPDVGCLAALLHPKSDSSL

SEQ ID NO: 98063 - protein, 167 aa, Glycine max
  Coding DNA Sequence Number=SeqID_6378
MSWNPLGPFLSSSMFKALGLGDVEVRHRKGGLGVFEAFLYALSRWTIGAEDIPLADFAISNQTSSRGNRRCGGGIEGHDSQLASRTEACGRSDTTATALNKKRVAADAVSDDGLTVKCQNVLAATTLVFNIREKKEGKKRRENRRKRVTGERQEEKDKKKEKIAIRD

SEQ ID NO: 98064 - protein, 88 aa, Glycine max
  Coding DNA Sequence Number=SeqID_6379
MAYTHIPDSTSDSPQISVSPYQLDFTLYASGSYNAQWNAPGLLRDKHTLRSSRILGEMEVDEPRLGLWLPLNYQVDMGASQHRTLELG

SEQ ID NO: 98065 - protein, 134 aa, Glycine max
  Coding DNA Sequence Number=SeqID_6380
  Gene Ontology: Mol. function=protein binding; Cellular component =protein complex; Biological process=proteasomal ubiquitin-dependent protein catabolic process
  Homolog annotation: Hit_ID=Q8W424; Match level="QueryCoverage=65%, HitCoverage=36%, E-value=2e-35, Identity=71%"; Hit description=26S proteasome regulatory particle non-ATPase subunit8
MVVYVIVGILGSIVDGAAYGFLPPIFATFKAIHEGKVTNFTTGMLFYVPNPVLVIINVEPKELGIPTKAYYVVEEVKENATQKSQKVFVHVPFKIAAHEVEEIALKGLDARLKEIRGYLDLVIDGKLPLNHEIL

SEQ ID NO: 98066 - protein, 168 aa, Glycine max
  Coding DNA Sequence Number=SeqID_6381
  Subcellular localization annotation: CTP_CleavageSite=62; ConfidenceScore=5.12e-01
MGGYVGAKASLLSTAPLSVTMTQELVARGDTLRLSAPRHLVTPSVIDEQRPMWSSAPFPEMSAFSDGDFSSLTSYPELQAAGPMIRGDTLRLSAPFCHPEAAGPMTSRDQVWSFCTLVSSRGGGPDDTRRYLTVIRTLLSSRGGGPDDKQRPSLVILHPCIIQRRRAR

SEQ ID NO: 98067 - protein, 147 aa, Glycine max
  Coding DNA Sequence Number=SeqID_6382
MSHHSSSVNGKGTSHKDPLSRILDELSSLKLWKEKQERKEKGKKRVEEIIQDERKKIREEERRKIMKEMKREKYVSYSSHNSCKSLSEELRDYYEGRHRSHLRPHSHRREKERKPQEANINLSYFHGKDNVEDNLDWEIREEQQLKK

SEQ ID NO: 98068 - protein, 230 aa, Glycine max
  Coding DNA Sequence Number=SeqID_6383
  Gene Ontology: Biological process=transposition, DNA-mediated
  Homolog annotation: Hit_ID=Q1J7G7; Match level="QueryCoverage=20%, HitCoverage=78%, E-value=2e-14, Identity=74%"; Hit description =Transposase
YDGVHEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMVVGWEMDFVVQAEGILNEICLNSLNRDTGFEMGMATNEIQNDDEVLAIKLIDTVDLEGGPVGKPVVPAALMNRPTRGERRFAYWALAECILAYYVGTDEGVSEVLHVAEKKAAP

SEQ ID NO: 98069 - protein, 98 aa, Glycine max
  Coding DNA Sequence Number=SeqID_6384
ARLAKEKFKSAATHIRKECTEVKLPAFIVDHRVVPGDMSRGSGELGDIRRAPGSQQIKGTKTTKQGGLWGLASCEFCVICGLWPLVIDYQGWVIDYKA

SEQ ID NO: 98070 - protein, 130 aa, Glycine max
  Coding DNA Sequence Number=SeqID_6385
MTNANCPQESLHSASNGNLRQISTSTVVYVTNLEFWVSGVLMLYYCSWRYDRFILSVIHCYLRLLDWRGMVFNQQSCLAIVDSMEFVESNPLFQNPKSMSYFMLLLQLGVGLAFGGLICKDKSGCAWNSS

SEQ ID NO: 98071 - protein, 31 aa, Glycine max
  Coding DNA Sequence Number=SeqID_6386
GWKRMKDRITTDQAPPLPGAKQAENVAAGQP

SEQ ID NO: 98072 - protein, 358 aa, Glycine max
  Coding DNA Sequence Number=SeqID_6387
  Gene Ontology: Mol. function=adenylate cyclase activity; Cellular component=cytoplasm; Biological process=cAMP biosynthetic process
  Homolog annotation: Hit_ID=P0A1A8; Match level="QueryCoverage=90%, HitCoverage=38%, E-value=1e-162, Identity=84%"; Hit description =Adenylate cyclase
  Pfam annotation: Domain name=Adenylate_cycl; Domain location=1-358; Score=157.5; E_value=3.7e-44; Accession=PF01295.9; Description =Adenylate cyclase, class-I
MDIKQRLHDGEIVCFGLDPYCMMLERVTRYLTSVDDTARLDLVRRCFYLKVCENLSSEEQHPRAGWRREILSQLVKEWGWDDEKLAVLDNRAQWKIERVREAHNELLDAMMQSYRNVIRFARRNNLSVSASPQDIGVLTRKLYAAFEALPGKVTLVNPQISPDLSEENLTFIHVPAGRANRAGWYLYNQSPDMSSIISHQPLEYNRYLNKLVAWAWFNGLLTRKTRLHIKGNEFCDLPRLQELVNDVSSHFPLRLPAPTPKALYSPCEIRHLAIIVNLEHDPTSAFRNQVVHFDFRKLDVFSFGQQQQCLIGSIDLLYRNSWNEVRRRTAGHGGSILLQPASARSDSYPRAAAGVGMH

SEQ ID NO: 98073 - protein, 161 aa, Glycine max
  Coding DNA Sequence Number=SeqID_6388
  Homolog annotation: Hit_ID=A5BEV8; Match level="QueryCoverage=39%, HitCoverage=8%, E-value=2e-08, Identity=43%"; Hit description =Putative uncharacterized protein
MVFLVHASYLGMLLETSHLIQSICFGGDLVFQIKGYVKPKSPSRKRSRPYLKDFRNLMFVVKLLSRVNFEKLHTLIKTLWVLLRQRSTLKGFIDHIVDVKADDNCGYRSIAALLGMGEDSWSLVRNELIKELGKWSHDYINLFGGTERFEELRLVWTSGWI

SEQ ID NO: 98074 - protein, 96 aa, Glycine max
  Coding DNA Sequence Number=SeqID_6389
  Subcellular localization annotation: CTP_CleavageSite=65; ConfidenceScore=5.27e-01
MPTFCVCAFCCCASSTFCIFLASSCIPSQSKLSANMLLFFSPLNKAKRSCYAKPLLCVKEAKHALCAKPKGHFGEAELSAPCYAKLRPFSILKIVI

SEQ ID NO: 98075 - protein, 299 aa, Glycine max
  Coding DNA Sequence Number=SeqID_6390
  Gene Ontology: Mol. function=phosphoprotein phosphatase activity
  Homolog annotation: Hit_ID=A5C0F5; Match level="QueryCoverage=51%, HitCoverage=24%, E-value=7e-23, Identity=35%"; Hit description =Putative uncharacterized protein
WSGGRLEYRATPHGDLVGYRSRIDHMENHEFSWVPYRGFEENLPRCAYRDMEIWFASTAIICFSIVEWHQTNRVKLQCGLQQDIPVDPVNLDLLHQIDMRSNHYTDWMEYHAEWINIWKNKHIDVLAGQWVEGIVTHTPAYMEWYRKNTTLFLSVAQQLHDPRTTITHNVAGSGVEQTHFEIPHSQSMYFTPSPVHQTFGHTGESVTATTHEWMIDLFGVDFNTPNSAASYSATLQQFDAPHSFGEQGQSSSATTTNIENTNIEQQHHHDVREPVILERRNPPRNRRPPPCGTGHRLGH

SEQ ID NO: 98076 - protein, 124 aa, Glycine max
  Coding DNA Sequence Number=SeqID_6391
  Subcellular localization annotation: CTP_CleavageSite=43; ConfidenceScore=5.19e-01
MWLRMPPDPWVTHFVSKRPFRGNTGSNKDRRKSLKVYQSHTVLGEKVASAQDFVGNQRERTTLGRGFLFLGQGLTFSPWVKVYDKLGFWLKACRTAGHDICQGLASGSGIKGMSYIISMIHMQQ

SEQ ID NO: 98077 - protein, 266 aa, Glycine max
  Coding DNA Sequence Number=SeqID_6392
  Homolog annotation: Hit_ID=UPI00006A2939; Match level="QueryCoverage =98%, HitCoverage=100%, E-value=1e-11, Identity=29%"; Hit description= UPI00006A2939 related cluster
IFRGLHILTIRGSHGLIFRGLHVLTFRELQFFTIRGLHVLPFRGLHVLTIRGLHALTCRGLHALPIRGLHALTFRGLHVLTIRGLHALTCRGLHVLTIRGLHALTFRGLHVLAIKGLQALIFRGLHVLAIRGSHPFIFRGLHVGLHVLAIRGLHALTFRGLHVLTIRGLHALTCRGMHVLTIRGLHALTFRGPYVLDIRGLDALTFRGLHVLAIRGLHALTCRGLHVLTIRGLHALAIRGLHALSFGGLHVLAIRGLHTLTFRGLH

SEQ ID NO: 98078 - protein, 58 aa, Glycine max
  Coding DNA Sequence Number=SeqID_6393
MILMFAHILLVGQLSYFKLYNINIHEPKAAHSKGWGKLWLEVNSLLVLKAFNVITVAP

SEQ ID NO: 98079 - protein, 189 aa, Glycine max
  Coding DNA Sequence Number=SeqID_6394
MSALKEQMASMMDAMLGMRQLMENNVATAAAVSSAAEVDPTLPATAHPLPSVVGQERSTLGHISNPHLGYNRVAYPYGLPPNYTPPVMHDDTGHVPSPILEGEPPRQSDEVHEDRREYAQGDINFYPLVPIEGPAPNTLPQPNLTGEPRNLPAQPIFFSIEGPPLAAEERRKLDLIEERLRAVEGFGDY

SEQ ID NO: 98080 - protein, 152 aa, Glycine max
  Coding DNA Sequence Number=SeqID_6395
VPPVQLLTGWCVTAKAPPDISAGKCSGRVPFAIQAAQLLGRAIGAGLFAITPAGERGMCCKAIKLGNARVFPVTTLNSINVLRQRSQTVKPLILCEWGYKRILRREKGDTKEFRRLVLCSFGKERRETQKEFRQLVLGEFFLAKGEGNEKDE

SEQ ID NO: 98081 - protein, 179 aa, Glycine max
  Coding DNA Sequence Number=SeqID_6396
  Gene Ontology: Mol. function=aspartic-type endopeptidase activity; Biological process=proteolysis
  Homolog annotation: Hit_ID=A7PT07; Match level="QueryCoverage=67%, HitCoverage=7%, E-value=3e-30, Identity=50%"; Hit description =Chromosome chr8 scaffold_29, whole genome shotgun sequence
MIGVLVRRVPLYSHPIDILGVQTFTTIPEIPQLSEESSKMRTRQTSKLINVIDKDSDKTSEQASEEGFSGQLKGWWNNYLTNDEKSRIYSAIKMDLNRKVITNDDNEGIPDTVNTLIFTIAQHFIPSLWKDRSAELLSNLKCRTLVDFRWYRDIFLTRVYTREDNQQPFWKEKFLASKI

SEQ ID NO: 98082 - protein, 73 aa, Glycine max
  Coding DNA Sequence Number=SeqID_6397
MATEKGYGGLDDATSGEGRKVRVDATRITLISLRLVQQGTQRETLTKFYQMPKVPLLKTKTNTYSVSEQKDKN

SEQ ID NO: 98083 - protein, 158 aa, Glycine max
  Coding DNA Sequence Number=SeqID_6398
  Gene Ontology: Mol. function=secondary active sulfate transmembrane transporter activity; Cellular component=integral to membrane; Biological process=sulfate transport
  Homolog annotation: Hit_ID=A1Z0J1; Match level="QueryCoverage=66%, HitCoverage=22%, E-value=6e-32, Identity=51%"; Hit description =Sulfate transporter
  Pfam annotation: Domain name=STAS; Domain location=1-135; Score=33.1; E_value=1e-06; Accession=PF01740.12; Description=STAS domain
MVALETMNVVGSLTSCYVATVSNIVLSVVVLLTLEFMTPLFKPRTAILGKIPRTTVYRNIQQYPEASKIPGVLIPLTDIDTSGIQAFQELHSSLEKKGVELVLANPGPAVTDKLYASSFANTIGEDKIFLTVAEVVAYCSPKLVEDPCKIYMNFVVGE

SEQ ID NO: 98084 - protein, 78 aa, Glycine max
  Coding DNA Sequence Number=SeqID_6399
MVTITPAKVPQPPFFQGYNLNATCSYHGGVPGHSIEHCMTLNIRICIVSFILPCYKVVTKDNNKYLRALRWGNERHHA

SEQ ID NO: 98085 - protein, 31 aa, Glycine max
  Coding DNA Sequence Number=SeqID_6400
MGQVGFVADLGAALVDDWVFLAGRVVGNEKE

SEQ ID NO: 98086 - protein, 78 aa, Glycine max
  Coding DNA Sequence Number=SeqID_6401
MGYVPTINQFSKNSLRGSPRHFYLGKLATPPPPPHGDQPESHGSSKPSDTPPSTSIPPHKELQVLTGKVYTISRVIEA

SEQ ID NO: 98087 - protein, 156 aa, Glycine max
  Coding DNA Sequence Number=SeqID_6402
MGQPDARFVHGLADRQQPHAGRVAADAPAGGVHARVDDGQVVAEVLDAQRLRIAAVLISVAGRAQASRQAAIERGMGEQADHQAPEGAADAEQLDVGRCRQEGDQRGLACFWIGQGAGQAAADGAQQRQARQGGDEGGGQGHEQGGQRHAEHADQD

SEQ ID NO: 98088 - protein, 195 aa, Glycine max
  Coding DNA Sequence Number=SeqID_6403
  Gene Ontology: Mol. function=helicase activity; Biological process =viral genome replication
  Homolog annotation: Hit_ID=Q2A9E0; Match level="QueryCoverage=68%, HitCoverage=9%, E-value=1e-19, Identity=36%"; Hit description =Putative uncharacterized protein
MQQKRHPHAQSSSQPTINYTSEYDSSGSNFLTAYEDCQSPTNQPVINTEGYSDLGDQHMQCKYCNAQMWYDERISKDKNYGSPRFSLCCGDGKVELPLLQNPPQYLQQLLFDDNTIDSKNYQHNLRAYNMMFAFTSAGIKLDKKINDSRGPPTITIQGQPCHRIGSLLPMSGKNANLHSYISLTEKMKCKIELMP

SEQ ID NO: 98089 - protein, 91 aa, Glycine max
  Coding DNA Sequence Number=SeqID_6404
  Homolog annotation: Hit_ID=Q7PDL8; Match level="QueryCoverage=64%, HitCoverage=8%, E-value=8e-07, Identity=35%"; Hit description =ERYTHROCYTE MEMBRANE PROTEIN PFEMP3
  Subcellular localization annotation: CTP_CleavageSite=35; ConfidenceScore=5.27e-01
VRTCSPLKVMMYSPLKVRACSPMKARACIPMKARVCSPLKERTCSPLKVRTCSPLKARTCSPLKSEEKLEESQGTARDAAIVVGKHASPLR

SEQ ID NO: 98090 - protein, 145 aa, Glycine max
  Coding DNA Sequence Number=SeqID_6405
  Gene Ontology: Biological process=transposition, DNA-mediated
  Homolog annotation: Hit_ID=Q1J7G7; Match level="QueryCoverage=22%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDPRLPIHPTRMTEKTGANEE

SEQ ID NO: 98091 - protein, 89 aa, Glycine max
  Coding DNA Sequence Number=SeqID_6406
MTPGHASDPLPDGHAPQPRVVPQAPQTDIPHVPEPGASSTSVEELRHAVEVCDEIAERLERHLSLGVVTPGSSTHEVIEECLRMARSVT

SEQ ID NO: 98092 - protein, 129 aa, Glycine max
  Coding DNA Sequence Number=SeqID_6407
MHGMLFQLCVHVLIFVMLAFFYCLIAWQLFKIFRIVTAPFIAIRETALFPQDGPSCFCLMETRVQVQTFQNQDMAGAGFEPTIFSLLTRVGSKILRDPITYEKVSEFISPLRERGDFVVIANEQVGGGN

SEQ ID NO: 98093 - protein, 127 aa, Glycine max
  Coding DNA Sequence Number=SeqID_6408
MVSGNRLPRGCNRLPGLKTRSGSYEGFWLRIKGSRLWRPLRNESLVIDYQIVMAAQLIHDRVEMECLEGAWETLEGNARCRFRGTIRFTATSLVHLDEPVRTLQRTVEWILPTPTPYRLVEPVQVIE

SEQ ID NO: 98094 - protein, 80 aa, Glycine max
  Coding DNA Sequence Number=SeqID_6409
DSQGSFIAHGHQDVLIAAIRRPEHPGRVRAVGAGVTIKQYFGPAPRTSHTSSSMAPKDLEELTQQIRDQLEESITKKVTR

SEQ ID NO: 98095 - protein, 67 aa, Glycine max
  Coding DNA Sequence Number=SeqID_6410
GEEVAAQLAQATLARPGELGGNLLPLFPINRLKGAVLRIPQPPGYVFQLFWVFARSSSFFIRSSFFN

SEQ ID NO: 98096 - protein, 92 aa, Glycine max
  Coding DNA Sequence Number=SeqID_6411
LIEARNQSWKPQGPVGLFRVHWVSCGMLLSSNVIYIYVRVVMLVRMIRTRLFAAAQVKSCPGMHSSCVIASLSGCARTVGPPPISGGGPGTV

SEQ ID NO: 98097 - protein, 153 aa, Glycine max
  Coding DNA Sequence Number=SeqID_6412
LCQSFGVPVAPSKVIRPPITRTFIEKYCMQRQAQGDAPQAADAPTPHQAGPVGSFDTEQYLRHLVRQQAANHRAHVQTHDCLYQLSLSLQSQGFTSFPCPTPDQFRAEVVWPGDWPEARAGEAPAKAPDEADEAREDEEMTDLLDFLGGSRAT

SEQ ID NO: 98098 - protein, 103 aa, Glycine max
  Coding DNA Sequence Number=SeqID_6413
  Subcellular localization annotation: CTP_CleavageSite=65; ConfidenceScore=5.03e-01
LSLSLTLPFSSSSFSIEAPSKASTFGHHFCSQIAKGGHFPESWRVFCLCSVLLGYDSLCYLNVVFAWMLWKLGRIDGDPVLRETRIWAMWEYVSSDGGGQQGM

SEQ ID NO: 98099 - protein, 106 aa, Glycine max
  Coding DNA Sequence Number=SeqID_6414
DEAARLIKQLTVVQSGEGGSQTPLWDSASHYSNINWSHPDQEDICGLDMGSTFDMGQELYVGMIKEDPSLKISLIQERINGMFNYNISYRKAWKAKQKAITIEYGD

SEQ ID NO: 98100 - protein, 432 aa, Glycine max
  Coding DNA Sequence Number=SeqID_6415
  Gene Ontology: Mol. function=aspartate ammonia-lyase activity; Cellular component=tricarboxylic acid cycle enzyme complex; Biological process=aspartate metabolic process
  Homolog annotation: Hit_ID=A6BVF0; Match level="QueryCoverage=100%, HitCoverage=90%, E-value=0.0, Identity=87%"; Hit description =Aspartate ammonia-lyase
  Pfam annotation: Domain name=Lyase_1; Domain location=11-343; Score =582.3; E_value=4.9e-172; Accession=PF00206.11; Description=Lyase
NNIRIEEDLLGTREVPADAYYGVHTLRAIENFYISNSKISDVPEFVRGMVMVKKAAAMANKELKTIPRKIADVIIQACDEVLDKGKCMDQFPVDVFQGGAGTSLNMNTNEVLANIGLELMGHQKGEYQYLNPNDHLNKCQSTNDAYPTGFRIAVYASNQKLIDAINQLREGFDRKAKEFETILKMGRTQLQDAVPMTLGQEFHAFSVLLNEETRNLHRTAELLLEVNLGATAIGTALNTPEGYQPLAVQKLAEVSGLPVVPAEDLIEATSDCGAYVMVHSALKRLAVKLSKICNDLRLLSSGPRAGLNEINLPELQAGSSIMPAKVNPVVPEVVNQVCFTVIGNDTCVTMAAEAGQLQLNVMEPVIGQALFESISILTNACYNLLEKCVNGITANKAVCEAYVFNSIGIVTYLNPYIGHHNGDIVGKICAET

SEQ ID NO: 98101 - protein, 32 aa, Glycine max
  Coding DNA Sequence Number=SeqID_6416
LLPWYPRHATKKAVQTFTILCDFDGREKECKA

SEQ ID NO: 98102 - protein, 455 aa, Glycine max
  Coding DNA Sequence Number=SeqID_6417
  Gene Ontology: Mol. function=metallopeptidase activity; Cellular component=extracellular region; Biological process=proteolysis
  Homolog annotation: Hit_ID=A7MEG8; Match level="QueryCoverage=53%, HitCoverage=51%, E-value=1e-63, Identity=53%"; Hit description =Putative uncharacterized protein
  Pfam annotation: Domain name=PepSY_TM; Domain location=119-145; Score= 18.5; E_value=0.026; Accession=PF03929.7; Description=PepSY -associated TM helix
  Pfam annotation: Domain name=PepSY_TM; Domain location=74-100; Score =18.9; E_value=0.019; Accession=PF03929.7; Description=PepSY -associated TM helix
  Pfam module annotation: Pfam domain module=PepSY_TM::PepSY_TM; Domain location=119-145::74-100
MGDEVRIYAVRPAPGAMDTTCVQFASADLGASESRALFVDPYTLAIKGDMTVYGTSGVLPLRTWLDKLHSSLLLGDLGRNYSELAASWLWVAALGGMALWLATRPKRKLKRSKGGFAASRHWHITLGVALLAGLLFFSATGLTWSQWAGGNIDALRANLGWLTPQVNTCLQADAPQTPADPHAEHRGMMPGMKMGPAAQSNALNGDWDRALHAARAAGIDAVKVELRQPKGEGKAWTVTEVDRTAAGGVRPWAVLDDCAGLPHVVESPPGGGGAASGAYAGCRLAGAFPAGACRHAAGGSGAGLLPAGDGREPRGVAAGGRVALARPTARPPGRNAGSGRPPCRGAQVPRGGGDGGGGGRLRDGPSDPRRHRRAIPAADRRLERPDGDHAEPDGAAVYAGVHPAAFHSAVVFLPGGERGAVRRRPACLRACRIFGNVAQARIILVRQDNQRELDH

SEQ ID NO: 98103 - protein, 106 aa, Glycine max
  Coding DNA Sequence Number=SeqID_6418
MENCTKQSLRMAPTRGWRIMNENAFHGATKKGREWRIALSNHYAWLQTRVDEWRIALSNHYAWLETRGWRMHERKRNSWGSEKGLRMENCTKQSLRMTPNSWVEDA

SEQ ID NO: 98104 - protein, 229 aa, Glycine max
  Coding DNA Sequence Number=SeqID_6419
PDAAHSQFTAVPQPAAESVSDDAFLLFAADGFAPSAALLQEVATLSHQRPELNCMLVSLAPRALSSGLQPSLQLFQQLQAQRLWQQNNYAVILRAALVKNAAPLVRIQDVMLAGLLNTQTVWLLDARAEHQVTTVNPPPSYQQFMTEYEKVTRLSHFIPERNRYRQSYLRSGLLQLVQQELNAETQFSNNVRHAVRYFADQFSPQSTMEKLLLKQPDLYFSLMKMRKSR

SEQ ID NO: 98105 - protein, 143 aa, Glycine max
  Coding DNA Sequence Number=SeqID_6420
MPLWGRIASVYTTEFDEFLDELDRRHWREELTDFQDGNIDVAIVKEFYANLYDPKDKSPKQELAAKLCIPMRGFELNVDSYPVNILRKNMTTLAQTWSVLSFSNLIPTSHTFDVTLDRARLIYGIIMKMDMNVGTSSPTRSPS

SEQ ID NO: 98106 - protein, 164 aa, Glycine max
  Coding DNA Sequence Number=SeqID_6421
MIYHSCFKGCPWASGIWLLCPLALHTQQMQALNFSDWVKEMGKCLDEEQLELMLVVAWALWSDRNLLLFQDIQNYPVDVVNKAISFFEEYKKEKLKIVQTPIGWQAPPHGVYKINTDAAIFNQQGIGCLLHPALPSLTSRAIDLDELAVAALFSFLKQGISFHS

SEQ ID NO: 98107 - protein, 115 aa, Glycine max
  Coding DNA Sequence Number=SeqID_6422
MAAQLIHDRVEMECLEGAWDTLEGNTRCRLRGTIRFTATSLVHPEEPARTLQHTVEWILPMPTPYRLVEPVQLIEGDEDPLIEVDSPEEVMSASEADSTKDSGPREMATSGGSSS

SEQ ID NO: 98108 - protein, 136 aa, Glycine max
  Coding DNA Sequence Number=SeqID_6423
MDHFKCLKESMTMLTKLSCPVNGESDLRTNPSQEGENDEDMFKSKGKDPLEGLGGPMTRARARKAKEALQQVLSILFEYKPKFQGEKSKVVSGSLLKSAVKLLYKLSHFINKHKLSFIQKIRVYLFIFVRVILLNS

SEQ ID NO: 98109 - protein, 748 aa, Glycine max
  Coding DNA Sequence Number=SeqID_6424
  Homolog annotation: Hit_ID=A7QZE0; Match level="QueryCoverage=83%, HitCoverage=85%, E-value=2e-75, Identity=37%"; Hit description =Chromosome chr16 scaffold_271, whole genome shotgun sequence
MGKEWYFAGRSSKRGVGGGAEAETQAPSGCMCAVFQFFDFHPFHFPNINQQHQQDQQASFKPPSCTSEDHTTVSKGAEAPRNSLEAEDGDGTVSSLSSKEDDFKIPKNIIQIKTSGATRTSGGNLNDLSSELTSSPGTKTPTLVARLMGLDLLPGANSPSFSSSCLSTPNTQDNVPHLHHHLRHKQHVQTKHRNSVDSSDISATRSLPETPRISSARRSDVDHHHRLSLQIIKENMNLGEDLELPRLSFSKRKSDENNGRSPSHYARQIVKQAKESVSRKVGQDITNTTLKAREENAGQFRSKKSPKTSSLKAIDETETSPNKHSNQSSYSPRLRFIDKHKPSTTTTSTAPSPLTPKDQNMLKLPPPPSPVNTHQPQLPRVLTKPKLQAVVPEQKEFHQNNKSVPKCKKATNEKKFNSRLIKRPPQTSDIIRNKQEEPFIIRPTSPTRASDIKNTKSKKNHPLSSNLLNNISNVPNLLPVKTDPSPSATKIPSKQVCDSRHQESKSSSQLSSCARQRYKQEETTTTLLATRDNNGAFFSSSTVTHPPTPQELQYITAILARTTALNSQGTPTTVSLNQPLDPSIFHHLEHPAGDKDRNFAPKDQLGHRWNRRLLFDLVDEVLREILESQEGEREKRLWFLKGGICNQRGRSVEGLVKRVWKRVEEFPRAKCEVLEDIDELIDLQREKDGERMEEEGEELVAEIEGNIWDTLVHETVIVMDCWENAKKEKLLLYDDSKISSHVCSLSQF

SEQ ID NO: 98110 - protein, 210 aa, Glycine max
  Coding DNA Sequence Number=SeqID_6425
  Gene Ontology: Mol. function=sequence-specific DNA binding; Cellular component=nucleus; Biological process=regulation of transcription, DNA-dependent
  Homolog annotation: Hit_ID=Q56NI6; Match level="QueryCoverage=63%, HitCoverage=55%, E-value=4e-30, Identity=52%"; Hit description=MADS box protein M3
  Pfam annotation: Domain name=K-box; Domain location=45-151; Score =82.3; E_value=1.6e-21; Accession=PF01486.8; Description=K-box region
MRAQPVTCLRCLFLGVRESSTHHIRPCSVVRDINKIIERYRQCRYSKSQTDDSLEHDSQSSYHEFLKLRAKYESLELTQRHFQGEELEPLSFKDLQSLEKQLDITLALTRQHQTKKLLARADELREKEKITTCKVHKLEDLNKQLESKEKDEFSSFILDNNNYIQVHATQGLEWVSHYLGYGFMVMLSIASDNGILYIQVFGSFLTSSNL

SEQ ID NO: 98111 - protein, 21 aa, Glycine max
  Coding DNA Sequence Number=SeqID_6426
MVHDILVKVKLEVTGTSIVLN

SEQ ID NO: 98112 - protein, 124 aa, Glycine max
  Coding DNA Sequence Number=SeqID_6427
MDNEEGVQEQMKADLSALKDQMASISEVMLKLQKTIEDKATATASNRNTAVFGRRYSPQAYPYGLPPDFTPRATPEDLSQAPTFEGQLPPYEDYPGQDDGEGDTHLGPLLHLKIHPRMNYPSRT

SEQ ID NO: 98113 - protein, 32 aa, Glycine max
  Coding DNA Sequence Number=SeqID_6428
MGAKYLEVVKRGSHPNNGWSPDEIRELMKHWA

SEQ ID NO: 98114 - protein, 240 aa, Glycine max
  Coding DNA Sequence Number=SeqID_6429
  Homolog annotation: Hit_ID=Q6WAY6; Match level="QueryCoverage=85%, HitCoverage=33%, E-value=2e-21, Identity=32%"; Hit description =Putative uncharacterized protein
MGRGEWAPFIDILALLIFEGVLFPNVDGLVDLAAIDAFLAYHDRKESSVVAILADLYDTFDRRCEKSSTRIVCCTLALYVWLVLHLFRQVRHACSLESHRSCTEKGGANWDRLLANKEGASVNWFPRWKEGRTGVLILCGGFPNVPLMGTRGCISYNPVLAIRQLGYPMRGAPLKEELAPIIARGFNKTNVEALQKVRKAWETVQKKEKELRGSNSELRLRREERDQSRVDSLILKDELK

SEQ ID NO: 98115 - protein, 67 aa, Glycine max
  Coding DNA Sequence Number=SeqID_6430
MMTKVMTKSSKINQRTTQENPRSIKNNSRVQDKNQEEFKTQEESLETRIKIQGSRSRFKNEEKIQSR

SEQ ID NO: 98116 - protein, 76 aa, Glycine max
  Coding DNA Sequence Number=SeqID_6431
MEGTSFVVQVEGTSTWVVVTENKRGYISYGSVQVEGTSTWLFKENKGGYIPCGSLLVKDFTRLKRNLKDRRFLFES

SEQ ID NO: 98117 - protein, 34 aa, Glycine max
  Coding DNA Sequence Number=SeqID_6432
SKYFRNASVSDSVEILHRSSSFFTVLHPFFVLQR

SEQ ID NO: 98118 - protein, 242 aa, Glycine max
  Coding DNA Sequence Number=SeqID_6433
  Gene Ontology: Mol. function=oxidoreductase activity
  Homolog annotation: Hit_ID=UPI00005FAA46; Match level="QueryCoverage =97%, HitCoverage=97%, E-value=7e-73, Identity=59%"; Hit description =COG1496: Uncharacterized conserved protein
  Pfam annotation: Domain name=DUF152; Domain location=29-242; Score =242.1; E_value=1.2e-69; Accession=PF02578.6; Description =Uncharacterised ACR, YfiH family COG1496
MSDWIVPQWPAPVRVQAYSTTRHGGVSAAPWDSLNLGAHVGDEADRVMHNRQRVVEQLALPAMPQWLEQVHGQTVARLPAAASLPRADAAITRESGVVCAVMTGDCLPVLFCSHDGSEVAAAHAGWRGLCHGVLEQTLAQFHCPASEIHAWLGPAIGPQAFEVGAEVRSAFLAQDAAADAAFRPAGEKYFADIWLLATQRLQAAGVRSVTADARCTYQESADFFSFRRDGITGRMATLIWLR

SEQ ID NO: 98119 - protein, 152 aa, Glycine max
  Coding DNA Sequence Number=SeqID_6434
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
  Subcellular localization annotation: CTP_CleavageSite=22; ConfidenceScore=5.18e-01
MASPCQGLFSQHRVWKKGRATVSEMPQARRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 98120 - protein, 166 aa, Glycine max
  Coding DNA Sequence Number=SeqID_6435
MPHHNLADFEPCLIYAIEGQTVGGIPMPNTLKGPQFRPQPQPLHFGVGRAPPAMAEKGKLDHIEERLKDIEGGEDYAFANLEELFLVPKHGYSQVQAQVAPPITEKEIITMIVDMLLVFYYGNGGVATYPFAGQRGEAHGCAFQRRKCADSPPTFICGNIGKTEGN

SEQ ID NO: 98121 - protein, 195 aa, Glycine max
  Coding DNA Sequence Number=SeqID_6436
MRGAPLEEELAPIIARSFNSTNAEALQKVCKAWEMVQKKDKELRGSNNEPIDGYRRWLKAHMQGLDWLSSLRITKGVEVEALVEDEEVQALRAELEKAQTIKEKFKSAALKIRKENAKLRDVNIAATKALEQKDQKAMLWMDRFALTLNGSQELPQLLAKAKAMADAYSAPEEIHRLLSYCQHMIDLMAHIIRNH

SEQ ID NO: 98122 - protein, 123 aa, Glycine max
  Coding DNA Sequence Number=SeqID_6437
  Subcellular localization annotation: CTP_CleavageSite=44; ConfidenceScore=5.71e-01
MHMTQMQFTNMGARETVSFLDTTSRGSKVPQRMSRGSPVESPTVATYPSAGGRRETRRMRVPRKEYARSSHQRLFEENVGKTGKDAIYELLSERFGSCIYAQGRVFPFAPTYSSICDEEIRPT

SEQ ID NO: 98123 - protein, 43 aa, Glycine max
  Coding DNA Sequence Number=SeqID_6438
MTRQDKPHTSLKEHSNQVTPKAYTPKSPSGSLPPDSGPTQKIF

SEQ ID NO: 98124 - protein, 121 aa, Glycine max
  Coding DNA Sequence Number=SeqID_6439
  Subcellular localization annotation: CTP_CleavageSite=83; ConfidenceScore=5.27e-01
MVKVGTSYVPINVSFSPKVGPGLPGINRDTSYLFCEHRRTSALASVAVTLRVTTTPAALNAPLQGASHSPFRLRNCWEGRSVRASSLLRQLAKGGCAARRLSWVTPGFSQSRRCKTTASEL

SEQ ID NO: 98125 - protein, 155 aa, Glycine max
  Coding DNA Sequence Number=SeqID_6440
MHVEKNVCDSVIGMLLNIQGKTKDGLVNHEDFDDVKKNFLDKGAECGSSIVLMMSKRNHLIAIIKKEENVKVTWARILKRVLLVENVLSSQKEMKEIFQENFIAKCSLKRNSQANTCISIKSFSMDFNCNILLFKKEFFFFSSLSKRLIKGLRVS

SEQ ID NO: 98126 - protein, 244 aa, Glycine max
  Coding DNA Sequence Number=SeqID_6441
  Homolog annotation: Hit_ID=A5AK31; Match level="QueryCoverage=38%, HitCoverage=8%, E-value=5e-08, Identity=35%"; Hit description =Putative uncharacterized protein
  Pfam annotation: Domain name=Retrotrans_gag; Domain location=109-182; Score=-2.0; E_value=0.084; Accession=PF03732.8; Description =Retrotransposon gag protein
CMTRGNPSDLQPFDPEIDRTFHRLVRHHFIPFDHPEHSITGEFVHSVIGDFEHPDLEHYNFEHSDSEHSDFAHSENMAQPPSRERTLREMAAPDFTYESLCIQYPDEDGVAKDWLYYLAPRSITSWDDLKRVFLEKNFPASRTTAIRKDISGLSNMEKSMIDAASGGALGDMTLAEARNLIEKMASNSQQFSARNDAIVIRGVHEVATNSAASSETKKLEGKLDALVNLVTQLALNQKFVPVAR

SEQ ID NO: 98127 - protein, 123 aa, Glycine max
  Coding DNA Sequence Number=SeqID_6442
  Gene Ontology: Mol. function=transporter activity; Cellular component= intracellular; Biological process=transport
  Homolog annotation: Hit_ID=A5BH80; Match level="QueryCoverage=82%, HitCoverage=59%, E-value=4e-26, Identity=59%"; Hit description =Putative uncharacterized protein
MGLGEEVLAQEDERGRCFEPETSEDEWQKSRTRSLRRKAMTASTRLAYSLRKRNTRVANSDFASIFIEDVRDANEEKAVNSFRQVLLTRDLLPDSHDDYHEMLRDSVNALLKDCSSKLPFFDV

SEQ ID NO: 98128 - protein, 90 aa, Glycine max
  Coding DNA Sequence Number=SeqID_6443
MEELINKTQLSPKSNPNVITSAGGLHNRISLPAPYCCHSVPTNKVRDHHSNYGGHPVVYHNSPPPLGHQPGPQGSSLPGDAPPSTKYILP

SEQ ID NO: 98129 - protein, 56 aa, Glycine max
  Coding DNA Sequence Number=SeqID_6444
MEVEEPWQRLWLPLHYQACLVADLGMTFVDDWVMGNKKGRYWLSDDIFGLVGSLAM

SEQ ID NO: 98130 - protein, 55 aa, Glycine max
  Coding DNA Sequence Number=SeqID_6445
MKHSSKLEGGGHMNSARQLHSWGYRKRGEWRIALRAIMKHSSKLEGGGHMNSARQ

SEQ ID NO: 98131 - protein, 28 aa, Glycine max
  Coding DNA Sequence Number=SeqID_6446
MASMDTFCYGSTLRSFQPLAGLICSHAY

SEQ ID NO: 98132 - protein, 765 aa, Glycine max
  Coding DNA Sequence Number=SeqID_6447
  Subcellular localization annotation: CTP_CleavageSite=53; ConfidenceScore=5.16e-01
MSETLGCLPAALLLFASHASPLQLVSHLPGVGTVIAHLACKAGVRTPGNVVVRGSDVARTLNAQVDERLVQGFSMSIAGEALEGGGLGPCRCPIAARDLQQEGSQAQQSNAALSTMHSLPQLLGGWKFAQECFMYITDQGCHSGGTSIKLKLVLSNSNAGIFALLGKHLRIPVSDADDDGILPSDQNTREKLVSDVLKCTDEPKSSEAHLIIKRKMDNEKHFGFAIPQLHGSMQLRGRDEIFSSRPWKPSQSEHGMQTRQERSIKLPATKNALPVGHLRTLCQKHPFEPKMGPQNSTACELCCCTVCDFEASICTKWGQPDAQGCLNWTTVMPTHTGGNITQRSTGLLIPVLHSAFISDVSGMHIMLVAHLWTGAHCKDGQSAPMPAAHFPAINRPQAGTPQQPAGAALEPRAAPGGKEPAALGGTKDGARQKPAPTQLDTCYASSLTILEADARTAAQVGYTIGHPRGLKKICLEDQPQPLRSGKKLLFANPPLEKMSARKIYCKTATRQGHDGETLQSMPEGIKPLVGATSSNDGRVSPVLSTRAGSPLAHADAPKKKPEDPVRGREVDHSVVVPEDEPAHGPLRAWVSFNQQGGPAPAEPLAAGLALVARTSPANQSSATMALPGAGERPGTFGWPWPSIHFTKPEGLYTLDTFLGTCQLVYTSCQAIYMYFGAASGYGKQFNETDECKFVVKAFSTAILKPMEGFLALKINKIVNGIVQALTVAAFLAFAFGGYTTWGKAIFYVLGSIACINAAMGKNGAY

SEQ ID NO: 98133 - protein, 106 aa, Glycine max
  Coding DNA Sequence Number=SeqID_6448
MDPKKSNRVLELPARIMGLCQFYGVPVTPSKVIKPPTNQTFIKKYCAPRQAQGETPQQPGDGRHRQQTHRRHLQSPSAHLQKLERCLRPVVDQQATKSKAKDKKKY

SEQ ID NO: 98134 - protein, 55 aa, Glycine max
  Coding DNA Sequence Number=SeqID_6449
MSAKPKFTYARKGSRVVDRASLAYYHEGSGIRLDYHEESGFSISGDTIEHMSIVK

SEQ ID NO: 98135 - protein, 343 aa, Glycine max
  Coding DNA Sequence Number=SeqID_6450
  Gene Ontology: Mol. function=motor activity; Cellular component=cell projection
  Homolog annotation: Hit_ID=UPI00016621D1; Match level="QueryCoverage =93%, HitCoverage=41%, E-value=1e-21, Identity=34%"; Hit description =UPI00016621D1 related cluster
STLEDPTVFAFKGLHGLTFRGLHALSLKGLHVFDFRGLHTLAFRGVHTLAFRGLHVLTFRGLHLLTVRGQHALTLKGLHGLIFKGLHTITFRGIHVLAFRGLHVLTIRGLHVLPFRGLHALTFRRLHVLAFIGLHVLPFSGVHVLTFRGVHILAFRGLHVLAFKGLDILGFRGLHRVNFRGLHVFTSRGLHALTFRGLHVLAFRGLHILAFRGLHALTFNGLPVLALRGVHGLTFRGLHALTLKGLQVLAFRGLHTLAFRGVHALAFRGLHVLTFRGLHVLTFRGQHALTLKGLHALAFQGLHTLTFRGLLILAFKGLHVLNFRGLHVLTLRVLHTLTFRGLH

SEQ ID NO: 98136 - protein, 31 aa, Glycine max
  Coding DNA Sequence Number=SeqID_6451
MEISSFHQFPDESLSEALNCFHGLLRKTPTH

SEQ ID NO: 98137 - protein, 181 aa, Glycine max
  Coding DNA Sequence Number=SeqID_6452
RPQRHPVDPEEPKQGPGVSNSGYGPLSVLQGARPSSKFMPSWHRDHARYTPSGSGEVQQGPGVSSSDYGPLARHHSSLGMADSRQQTHHHHLQSPSAHLQKLERCLRPVVDQIFFINGFLCFLEDEWQRNGEREREKRRHFKEKISLEEAHHHRRPWIRAWRKKEMNEGRGREEHEILCSK

SEQ ID NO: 98138 - protein, 89 aa, Glycine max
  Coding DNA Sequence Number=SeqID_6453
MEGILPKPTPYRLVEPVQVIEVSSSEEDLEDDPEELPPEPAVDALDLPEDDEDPLPDVDSPEDIMSASEAESTEESGPGGTANSDHSSS

SEQ ID NO: 98139 - protein, 109 aa, Glycine max
  Coding DNA Sequence Number=SeqID_6454
MYPNLQPFLPRKVDMLHTVTTISVKSQKSSNFEIVEAKLLDESRLIQRCFDDNKDDDKGDDKKCQSKNEFKIESRTLQDSRGKLKNTSRFKRKVDFKIQDSRFKNQEKT

SEQ ID NO: 98140 - protein, 165 aa, Glycine max
  Coding DNA Sequence Number=SeqID_6455
  Gene Ontology: Mol. function=protein dimerization activity
  Homolog annotation: Hit_ID=A5ASU7; Match level="QueryCoverage=72%, HitCoverage=22%, E-value=3e-15, Identity=42%"; Hit description =Putative uncharacterized protein
SSFKWLNHHSMLLLQVQRGKIRQTQAENIVIHRWKEIETPLFLPRKDIDVCNNNQQLKQRYNARDEIDPISLNDIDVCNEWLVGEMDQDGDNDAGNDLVFEDDDALNWATVYQASGVGECRMYTRRKKQKTTSVTTAQTSKKQAMVVGSSSRKQKTVQENDEDLD

SEQ ID NO: 98141 - protein, 160 aa, Glycine max
  Coding DNA Sequence Number=SeqID_6456
MVTMMVDTLPVFYYEKLVGYMPASFADLVFTGERIEVGLKRGKFNYVSPIGASGRRTGTAGAKKKEGDAHTGLFLHSARLAKGTYASPGGSSSGSSSNPASLDQQRPPWLGIQHGKELLSKAGSDFHPDPNDVWGPLTISHRQPTGHGHLVEQCLALKNK

SEQ ID NO: 98142 - protein, 368 aa, Glycine max
  Coding DNA Sequence Number=SeqID_6457
  Homolog annotation: Hit_ID=A5CPP5; Match level="QueryCoverage=47%, HitCoverage=37%, E-value=3e-42, Identity=48%"; Hit description =Putative transcriptional regulator
  Pfam annotation: Domain name=LytR_cpsA_psr; Domain location=1-132; Score=32.5; E_value=3.1e-09; Accession=PF03816.5; Description=Cell envelope-related transcriptional attenuator domain
LPRDGGAGLYPDAEAHGSAPGIEATKDAAEGVLGIEIPYYVFVDMHGFAELVDALGGVEITVTERLPKGGPPEGWTGTDVNEWAIGWIEPGKQRMNGDTAQWYARSRYTTDDWDRMKRQRELQEAILAQFTPQTVLTRFNEVAAAGTALISTDLPSDKLPEFFDLMLKAKEQPVTTIELTPESCTLRRRARPPRPDRIGFDRMHRRGTPVCGSVARRRSGAMPVSGDVGVARRRSGVTAMRCGRCRGATKPTAGARRDDRGLPAKSPDVPDDGDRRGRDHRRPVDRRANGSRTQARLRRAAPTATNAPPATSAAAPPPRIHGETLPPVSASSRPSPVSGSSAPAGATAGSWSQLAAASLPCETVIVAV

SEQ ID NO: 98143 - protein, 59 aa, Glycine max
  Coding DNA Sequence Number=SeqID_6458
MVIFYHGDAAEDKGEKELNHQESALDKKLREEASMEEKNEREGGHEIEGEKEGEKLNFE

SEQ ID NO: 98144 - protein, 69 aa, Glycine max
  Coding DNA Sequence Number=SeqID_6459
  Gene Ontology: Mol. function=nucleic acid binding
  Homolog annotation: Hit_ID=A5ATR3; Match level="QueryCoverage=68%, HitCoverage=11%, E-value=2e-10, Identity=55%"; Hit description =Putative uncharacterized protein
MTNEKEPLRKNWYIDNGCSKHMMGDASKFTHISPKKNGHVTYGDNNKGRIYGSNDFQDYFDDAKESRVK

SEQ ID NO: 98145 - protein, 161 aa, Glycine max
  Coding DNA Sequence Number=SeqID_6460
MEGLVDLAAIDAFLAFHHGKESPVVAILAMILSSFEGCPMRGTPSDESITPFIARGFSDHNARDRELRGSSNGIIGGYHKWLRVRTQGLDWLPNLKTVRDDEVKALEESDEVQALKAELERAWVVEEKFKSIAIKGSNSEEVKGIITGQRHDLEGRAKGFP

SEQ ID NO: 98146 - protein, 70 aa, Glycine max
  Coding DNA Sequence Number=SeqID_6461
MSEFTSNCPPQFLANLHQLDFARYVSGSYNAQWKASELLHDKHMLHSSCILEKMKVDEPLLGYGYHCIIE

SEQ ID NO: 98147 - protein, 46 aa, Glycine max
  Coding DNA Sequence Number=SeqID_6462
MTEARQKGVRKQNRGGACHPARPGEQGCFLQKQPPSEEETGRPKWA

SEQ ID NO: 98148 - protein, 81 aa, Glycine max
  Coding DNA Sequence Number=SeqID_6463
MCRNLPLCGRARRGSQVRLPKEENAWSRQQRLFVENVGKNRRKPVMKNIPDLGLVFTFEEGRQKRGSCSYVPSIEEEIRPT

SEQ ID NO: 98149 - protein, 223 aa, Glycine max
  Coding DNA Sequence Number=SeqID_6464
MVAKDQLTMKDKRDEEEKLEKQKKKNDSKALSSKARGREISLSTVIPLELEVIPQLKELLDEGIMRHQIPMIGGMMNVLSGATLFCKITHASNTFMIDIHRDSLGRNNQHENTKKAPLIQLVRNHVTSWEDAQEMGFQTLPYSNIPDTTNIYVFILFTCVEGRSLEFQEPMDLRSNPFQGVGNDAILPPPKALDRRLQEDWARDAKEDPRVLMSLRVDFEPMS

SEQ ID NO: 98150 - protein, 172 aa, Glycine max
  Coding DNA Sequence Number=SeqID_6465
  Homolog annotation: Hit_ID=Q6UUU1; Match level="QueryCoverage=41%, HitCoverage=46%, E-value=4e-18, Identity=70%"; Hit description =Putative uncharacterized protein
MGGGAWPFLVGGVICLVNSDNERDLNLLNSPADFDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERNGLRTGRRFPGRCQEDT

SEQ ID NO: 98151 - protein, 366 aa, Glycine max
  Coding DNA Sequence Number=SeqID_6466
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=8e-39, Identity=27%"; Hit description= UPI00006A17C9 related cluster
  Subcellular localization annotation: CTP_CleavageSite=27; ConfidenceScore=5.32e-01
MRTCSPLKAWTCNPLKTRACSPLKTKACSPLKAWACNPPKVRACSPLKLRACSPLKARACSPLKARTCNPLKARMCSPRKARACSQPKARVCNPQKARACGPRKARTCGPQKGRTCHPLRARTCGPLKAKTCSPLKARTCSPLKARGEGMEPSEGEDVQSSEGEESRPLKARTCNPLKVRMCNTLKVRACCPLMAITCSLLKARTCRPLKAKACSPLMARTCSPLKVRACSPLMGRMCSHLKGRACSPLKARTRSLLKARTRSPLKVRMRSPLKARACNPLKARVSSPLKARRCIPLKARGEDMQPAEGDGVQPSEGEDMWPSEGKDVRPFEGEDMWPSEGEVVRPFEGKDVLPSEGENVQPSEGE

SEQ ID NO: 98152 - protein, 84 aa, Glycine max
  Coding DNA Sequence Number=SeqID_6467
  Homolog annotation: Hit_ID=UPI00006A17C9; Match level="QueryCoverage =97%, HitCoverage=99%, E-value=2e-09, Identity=36%"; Hit description =UPI00006A17C9 related cluster
  Subcellular localization annotation: CTP_CleavageSite=56; ConfidenceScore=5.65e-01
MWSPLKVRTRSPIKARMCSPLKARTCSPQKARACSPLKVRACSPLKVRMCSPLKVRACSPQKACSPLKAKACSPLKARTCSPLE

SEQ ID NO: 98153 - protein, 26 aa, Glycine max
  Coding DNA Sequence Number=SeqID_6468
MVGLCPSSWYPTHRKMLGSCMSEHDM

SEQ ID NO: 98154 - protein, 30 aa, Glycine max
  Coding DNA Sequence Number=SeqID_6469
MDCATISVKQLNSDGKNPDVGKQLSPDEIR

SEQ ID NO: 98155 - protein, 67 aa, Glycine max
  Coding DNA Sequence Number=SeqID_6470
MGSNPETASLHICKGKAAYNIPPPYLRIAKSLWAMGSPRKGVEKKAGLWRVLSYGRKGLRRGDVNWQ

SEQ ID NO: 98156 - protein, 30 aa, Glycine max
  Coding DNA Sequence Number=SeqID_6471
MSSEIIERRLKKLGIRLTLSNLINPDDDEA

SEQ ID NO: 98157 - protein, 73 aa, Glycine max
  Coding DNA Sequence Number=SeqID_6472
  Subcellular localization annotation: CTP_CleavageSite=31; ConfidenceScore=5.36e-01
MLSGTEASSTLQTSSQRSQRPNFEKIQRLTKAGQRFYRGSFMQLPQEASLRGFFKKLPRGFFEKLSQEDSLRS

SEQ ID NO: 98158 - protein, 48 aa, Glycine max
  Coding DNA Sequence Number=SeqID_6473
MGVQAPHKDQKNGRMSSSKGPRTKLGSNKPSGNRLQDVVIDYRLPVLV

SEQ ID NO: 98159 - protein, 93 aa, Glycine max
  Coding DNA Sequence Number=SeqID_6474
MSQHALFRACEARLTGALSKGGKMREVATNVYLWETSEKPKETGTDPENNKDHISQSRGSALDGEEHIGEWRIALGNHYAWLQTRWWRMHERP

SEQ ID NO: 98160 - protein, 260 aa, Glycine max
  Coding DNA Sequence Number=SeqID_6475
MAKFDPDVVLEFYANAWPTKEGVRDMRSWVRGQWNPFDADALSQFLGDPLVLEEGQKCEFSQRRNRADGFDEEAIAQLLCIPGQDFAQTAAGRRVRIMRTSMTTLTQMWMMLLLSNVLPNDHNSDLPLLKCMPPTRHPLDPDKSNRALGFPALITGLCQSFGVPVTPSKAQGDDAPQAVDAPPPPHQADPAGSFVMERARVLLLLRPTLDQFRAEVAWPRDWPEAQAREAPAKAPDDAEEARMDEEMTNLLGFLGGSGAT

SEQ ID NO: 98161 - protein, 63 aa, Glycine max
  Coding DNA Sequence Number=SeqID_6476
MDPTRIKVIPKWPTPPSVEERIPEFQEPLDLRSNPFQGGGKHDVAPLELGVLGSSSSMESFAS

SEQ ID NO: 98162 - protein, 96 aa, Glycine max
  Coding DNA Sequence Number=SeqID_6477
MIQELVARGDTLRLSAPFCHPEAVGPMTSRDKIWSFCTLVSSRGGGHDDTRRYLTVIRTLLSSRGGGPDDKQRQNLVILHPCIIQRRRAEVWEIPY

SEQ ID NO: 98163 - protein, 257 aa, Glycine max
  Coding DNA Sequence Number=SeqID_6478
MVILHLLSSRGGEADDLRRQIIVIRTPLCYLETIESGGTQRQIMVMLQLLSSRGGEPDDMWRQIMVIRTLFRHPKTIESDGTQRQIMVILHLLSSTGCELDGMRRQIMVIRTPFCHPETIESGGTQRQIMVILHLLSSRGGEPDDMWRQIMVIRTLFRHPKTIESDGTQRQIMVILHLLSSTGGELDDMRRQIMVIRTPFCHPETIESNGTQRQIMVILHLLSSRGGEPYDMRRQIMASAHLFGIQRRSSPMARRDK

SEQ ID NO: 98164 - protein, 57 aa, Glycine max
  Coding DNA Sequence Number=SeqID_6479
AGDHDLSFPEFHKLPNDGCQAPHKDQRKVARDHDLSFPEFHKLPNDGCQAPHKDQRK

SEQ ID NO: 98165 - protein, 207 aa, Glycine max
  Coding DNA Sequence Number=SeqID_6480
  Homolog annotation: Hit_ID=UPI00006A2D9E; Match level="QueryCoverage =62%, HitCoverage=85%, E-value=1e-10, Identity=17%"; Hit description =UPI00006A2D9E related cluster
MTTRPRLHRAIHPHLQRTICPRLHRRAPTLAFRELYVLILRGLHVLNIRGLHVLAIRRLHILTFRGQQTLSFRGLHVLTYRELHVLSFRGLHALTLKGLHTLAFRGLHALAFRGLHVLAIRGLHVLPFNGTHALAFKGIYVLLFWGLHVLAFRGLHVIPLTGLTSSASEDFTCLDLEGDTPSPSEECTSSPSEDYTYSPSEGYMPSP

SEQ ID NO: 98166 - protein, 104 aa, Glycine max
  Coding DNA Sequence Number=SeqID_6481
MDSFASWKMSGCRMEKEEREIGSPTSKENMSLEEAHPHRRPWIRAWRKKEMNEGRGREEHEILCSKRALKFGPKSTLRLMRTLGPSLASLAQSSWSLLSNALGG

SEQ ID NO: 98167 - protein, 140 aa, Glycine max
  Coding DNA Sequence Number=SeqID_6482
  Gene Ontology: Mol. function=aspartic-type endopeptidase activity; Biological process=RNA-dependent DNA replication
  Homolog annotation: Hit_ID=Q6WAY3; Match level="QueryCoverage=46%, HitCoverage=4%, E-value=1e-08, Identity=34%"; Hit description =Gag/pol polyprotein
MGASKDEKLLIHFLQESLTGAAATRMQLQNMDKKGHESFKEYAQRWKDMVAQAVPPMTEREMITVIVDTLPVIEVGLKRGKFDHPALTNEKTRANEEDENEEGTHVVVVIPTWPNFPPAQQCHRSANIGPFHYPPPSHPQ

SEQ ID NO: 98168 - protein, 117 aa, Glycine max
  Coding DNA Sequence Number=SeqID_6483
MISRLSQDQFKNQEKYSRESFIKKIQDSRIIKIKIQDSKIQESREDLIKIKGTSTWVVVTENKRGYISWGSVLVEGTSTRLFKENKGGYIPCGSLLVKDFTRLKRNLKDRRLLGDWM

SEQ ID NO: 98169 - protein, 60 aa, Glycine max
  Coding DNA Sequence Number=SeqID_6484
MVIFHHGYAAEDKGKEVASLRSFLEKTSLRSKSLATHTPLITKLTSLRSFLEKIPKEAGA

SEQ ID NO: 98170 - protein, 138 aa, Glycine max
  Coding DNA Sequence Number=SeqID_6485
VCAPYEGFLGLGEVQQGPRVPGSDHQALINRAFNEKFCAPRQAQGEAPQQPGDDQQGATDASPPPSGRRPTTHASTSRYWAHDRQIVITRPAQDVKEALLGGNLELAAKKLPATRSRKGTIEEGSNATPQSDTGFDKH

SEQ ID NO: 98171 - protein, 76 aa, Glycine max
  Coding DNA Sequence Number=SeqID_6486
  Homolog annotation: Hit_ID=A5BEV8; Match level="QueryCoverage=81%, HitCoverage=7%, E-value=1e-10, Identity=50%"; Hit description =Putative uncharacterized protein
MDKWMDITDMGYVIVSRYNVIVVSFSQQQSMTFFPLRSQPPPDSSMHCVICIGHVYENHFVQVNHEHKILLALTFL

SEQ ID NO: 98172 - protein, 99 aa, Glycine max
  Coding DNA Sequence Number=SeqID_6487
MHRRPAHAPPPPHQADPAESLGMEQYLQHLLSLSQQGQGFVSFACPTPDQFRIEVAWPGEWPEAQAEEAPAGAPGDAEEARMNEEMTDLLGFLGGSRAA

SEQ ID NO: 98173 - protein, 68 aa, Glycine max
  Coding DNA Sequence Number=SeqID_6488
MLKRKDVPQSISGRDELDKDELHNVLAVTAGRKQGMQHRSIKQRRWRVSMLMQKPLVITGKFRLLYAF

SEQ ID NO: 98174 - protein, 59 aa, Glycine max
  Coding DNA Sequence Number=SeqID_6489
MAQKYIMKHSQQNMLSNETKPPTLIPKTIPKFLKGKEASTRIKPRLLCKQSMGQNTPND

SEQ ID NO: 98175 - protein, 67 aa, Glycine max
  Coding DNA Sequence Number=SeqID_6490
  Homolog annotation: Hit_ID=A6FJQ2; Match level="QueryCoverage=56%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARGLYTGKMIISKELGNDI

SEQ ID NO: 98176 - protein, 113 aa, Glycine max
  Coding DNA Sequence Number=SeqID_6491
MLAMFLRGRRPTTSTRRLRVHQMTTEGRDMAEDVADMTDDERPDLKLVSHGRKVTLIGRSVPEIEGLVAAIGLSPLIDCSVITGDPGLISAFVERWHSETSTFPRREIVAEIT

SEQ ID NO: 98177 - protein, 45 aa, Glycine max
  Coding DNA Sequence Number=SeqID_6492
ASSARFGQNSGAVKPRTVEKGVSRTYTEVLTAILKYRRTEQNGIR

SEQ ID NO: 98178 - protein, 74 aa, Glycine max
  Coding DNA Sequence Number=SeqID_6493
MKMLLIPHDVAPCGALEWRRKRERRRHFKEKMCLEEAHHHRRPWIRAWRKEMNEGRGREEHEILCSKRAPKFEF

SEQ ID NO: 98179 - protein, 190 aa, Glycine max
  Coding DNA Sequence Number=SeqID_6494
MDVALSEPCALSAYQRLCPTQERLAKNEEAEKGAKFSTFREIRELLSDCAVPRGGGDIPPPVNFSIRKYIVSLELDRVGLDNCIARDRVSSAGELVPLELEMEATFRRNNVERKRKLLHDRTIASILEEAHFSESSSSNSPTSKDSQTAEFEAEVMVEEQPRRVTLEDYSSTSVLQYFSSVARPEVQAQN

SEQ ID NO: 98180 - protein, 106 aa, Glycine max
  Coding DNA Sequence Number=SeqID_6495
  Subcellular localization annotation: CTP_CleavageSite=12; ConfidenceScore=5.36e-01
MIFRQGAVLHVKCMHASSKPPVGLASSLSVKESPLGMAIFACKGNRQFDWRVPSRRLRARSQAMQVQQAMQEGIVICIGGLRFAGIASLAGALWQKGLTSCTGELL

SEQ ID NO: 98181 - protein, 176 aa, Glycine max
  Coding DNA Sequence Number=SeqID_6496
  Homolog annotation: Hit_ID=A2Q377; Match level="QueryCoverage=94%, HitCoverage=41%, E-value=3e-11, Identity=25%"; Hit description =Nucleic acid-binding, OB-fold
MCAMFECLSDVCSGKQAWKFKVQVIRMWSVYLVGEPKKPFSTEMLLIDLVQRYMPMLRRFNEWVKEGVVYVMSFLGVTANSSSSRVTHDYKLLFHVKTSITTCLDLTLPQNGLTIMKAEEVKNTEGGLYIVLFMTSMLTFWVKSLDANELPVIVIQFTKIKTYKGEVVVQKCDEHI

SEQ ID NO: 98182 - protein, 154 aa, Glycine max
  Coding DNA Sequence Number=SeqID_6497
  Pfam annotation: Domain name=zf-CCHC; Domain location=8-25; Score =21.5; E_value=0.00084; Accession=PF00098.14; Description=Zinc knuckle
MQEKTSSMKCFKCLGRGHITSQCPTKKTMIMRGQDIYSSQDEATTSPSSSKSEEAKGEESSEEIYPQEEGQPLMVKEECIIRRQIPKIGGVMNALGGATLFCKITRAPNIFMICVHRDSLGVPMNPKRIKVIPEWPAPPSVLREKAQSFKNLGI

SEQ ID NO: 98183 - protein, 131 aa, Glycine max
  Coding DNA Sequence Number=SeqID_6498
  Subcellular localization annotation: CTP_CleavageSite=24; ConfidenceScore=5.25e-01
MSPPPLGPHNHSQTHLKLSGRLPLQALVSTDLHTTKSLKLSGTWTFLSLELSRHTEASRKGQTPPLNLISGLNRWLCSCSGWTEVMRLVGWPFAQRTSTTHPSSRFFLVLSRGMLCSANGSLSQQIGLARG

SEQ ID NO: 98184 - protein, 160 aa, Glycine max
  Coding DNA Sequence Number=SeqID_6499
  Subcellular localization annotation: CTP_CleavageSite=67; ConfidenceScore=5.28e-01
MWSSAPFPEMSASSGGDFFKSHKLSRTTGGGPDDMRRQNLVIPHPFAIQTQSCPMARRQNLVILHALSSRGGGPDDMRRQNLVIPHPFAIQTQSCPMARRDKIWSFCTLCHPEAAGPMTCGDKIWSFRTPLPFRHSRVRWCAERKFGHSAPFVIQRRRAR

SEQ ID NO: 98185 - protein, 68 aa, Glycine max
  Coding DNA Sequence Number=SeqID_6500
MAHHTEIIIDYCRNVPFCGRAKAGLTGALSKGGKMRGVATNVYLWKTSGKPKKTGQNKNSRFGSCIYA

SEQ ID NO: 98186 - protein, 174 aa, Glycine max
  Coding DNA Sequence Number=SeqID_6501
MSRGGHRARCQADTYGYSASLCHPEAAGPMIRGDTLRLSAPFCHPEAVGPMTGRDKIWSFCTLVSSRGGGPDDTRRYLTVIRTLVSSRGGGPDDSGDTLRLSAPFCHPEAAGPMTSRDKIWSFCTLVSSRGGGPDDTRRYLTVICTLVSSRGGGPDDTRKYPSGYPYKPFFCYL

SEQ ID NO: 98187 - protein, 227 aa, Glycine max
  Coding DNA Sequence Number=SeqID_6502
SKSPAFVDHPTFCYRDPRVWWHAETPDGNRHTKTNVVICTLSGDVSIFWIRRSKSPTFVDHPTFGYHDPRVWWHAETPDGKPQTPFAIQRPESSVACEDTRRDPRVRWHSETPNGNPQTPFAIQRPESPIACGDTRRRRYPSGYLYKTISVNPDPRSQVAGGDTQVVIRTKRFLLILTRERAETNVVICTLCQLGASEPVDTQRLTSSSAPLSSRNGESDDMRRYPS

SEQ ID NO: 98188 - protein, 209 aa, Glycine max
  Coding DNA Sequence Number=SeqID_6503
  Homolog annotation: Hit_ID=UPI00006A2D9E; Match level="QueryCoverage =100%, HitCoverage=85%, E-value=3e-13, Identity=15%"; Hit description= UPI00006A2D9E related cluster
TLTFRALHAALAIRGLHVLAFRGLHALTFRGLPVLVFRRLHALAIRRLHAFAFRGLHVLAFRGLHVLAFKGLHALAFRGLHPLAFIGLHVLPFRGLHAFAFRGIHVLSFRGLHALAFRGLHVLTFRGLHALTFTGLPVLVFRRLHTLAIRGLHAFAFRGLHVLAFRGLHVLAFKGLHAPAFRGLHPLAFRGLHVLPFRGLHAFAFRGIH

SEQ ID NO: 98189 - protein, 539 aa, Glycine max
  Coding DNA Sequence Number=SeqID_6504
  Gene Ontology: Mol. function=methionine-tRNA ligase activity; Cellular component=cytoplasm; Biological process=tRNA aminoacylation for protein translation
  Homolog annotation: Hit_ID=Q8FFX8; Match level="QueryCoverage=100%, HitCoverage=79%, E-value=0.0, Identity=93%"; Hit description =Methionyl-tRNA synthetase
  Pfam annotation: Domain name=tRNA-synt_1; Domain location=6-374; Score=-409.2; E_value=0.012; Accession=PF00133.13; Description=tRNA synthetases class I (I, L, M and V)
  Pfam annotation: Domain name=tRNA-synt_1e; Domain location=168-380; Score=-226.4; E_value=0.085; Accession=PF01406.10; Description=tRNA synthetases class I (C)
  Pfam annotation: Domain name=tRNA-synt_1g; Domain location=8-398; Score=748.1; E_value=5.8e-222; Accession=PF09334.2; Description=tRNA synthetases class I (M)
  Pfam module annotation: Pfam domain module=tRNA-synt_1::tRNA-synt _1e::tRNA-synt_1g; Domain location=6-374::168-380::8-398
MTQVAKKLLVTCALPYANGSIHLGHMLEHIQADVWVRYQRMRGNQVFFICADDAHGTPIMLKAQQLGIAPEQMIAEMKQEHETDFAGFNISYDNYHSTHGDENRQLSELIYTRLKENGFIKNRTISQLYDPEKGMFLPDRFVKGTCPKCKSPDQYGDNCEVCGATYSPTELIEPKSVVSGATPVMRDSEHFFFDLPSFSAMLQAWTRSGALQEQVANKMQEWFEAGLQQWDISRDAPYFGFEIPGAPGKYFYVWLDAPIGYMGSFKNLCDKRGDTVSFDEYWKKDSTAELYHFIGKDIVYFHSLFWPAMLEGSNFRKPTNLFVHGYVTVNGAKMSKSRGTFIKASTWLNHFDADSLRYYYTAKLSSRIDDIDLNLEDFVQRVNADIVNKVVNLASRNAGFIAKRFDGVLSAELADPELYKTFTDAAAAIGEAWESREFGKAIREIMALADVANRYVDEQAPWVVAKQEGRDADLQAICTMGLNMFRVLMTWLKPVLPQLAARAEAFLNTELSWDAIQQPLLGHKVNTFKALYNRIEMKQ

SEQ ID NO: 98190 - protein, 74 aa, Glycine max
  Coding DNA Sequence Number=SeqID_6505
MPPFALKTQNQIIVACMAIHNFIQRNDKSDGEFDSLDEDNEYIDSNEDESEVGPSTTTWEESDAQSKWNDLENL

SEQ ID NO: 98191 - protein, 133 aa, Glycine max
  Coding DNA Sequence Number=SeqID_6506
QNFAQVQKNACAWLAVESLVQNEFWMFASISQRSKCRLIHYRLPLERIDGDPVLRETRIWATWEYASSVGGGQQGMVGLCAHCGCGKTCCAPSPDRHLSGTWRYVAGVRRPWGRQVGCYCPKPSLTNPDPTRA

SEQ ID NO: 98192 - protein, 91 aa, Glycine max
  Coding DNA Sequence Number=SeqID_6507
  Gene Ontology: Mol. function=pyridoxal phosphate binding; Cellular component=chromoplast; Biological process=cysteine biosynthetic process from serine
  Homolog annotation: Hit_ID=A3RM06; Match level="QueryCoverage=49%, HitCoverage=13%, E-value=2e-13, Identity=82%"; Hit description =Cysteine synthase
MRKEKIPHQAPFAIQAAQLLGRAIGAGLFAITPAGERGMCCKAIKLGNARLIGNTPMVYLNNIVDGCVARIAAKLEYMQACCSVKDRHGIP

SEQ ID NO: 98193 - protein, 87 aa, Glycine max
  Coding DNA Sequence Number=SeqID_6508
MDEDQWMYDSMMSEEVDMNVENEEDVSVKLFASRDGVLQWARSLAHDIGFVAVIIRSDTNTGVRGRALFLLIACERSGEYRPKKHNL

SEQ ID NO: 98194 - protein, 97 aa, Glycine max
  Coding DNA Sequence Number=SeqID_6509
  Subcellular localization annotation: CTP_CleavageSite=32; ConfidenceScore=5.14e-01
MALIIGKPFGGGHHPGRSSSHYTPSGTTQMPRAHTTVQPPDTTLILACHSKEGPNIKTNPLASHGGSSINAIEKDRPSGSKRLEDVATSRRFIYQSQ

SEQ ID NO: 98195 - protein, 149 aa, Glycine max
  Coding DNA Sequence Number=SeqID_6510
  Homolog annotation: Hit_ID=A5B6W4; Match level="QueryCoverage=56%, HitCoverage=6%, E-value=4e-09, Identity=39%"; Hit description =Putative uncharacterized protein
LLGVRPQEGELEGSVVKLSWLAHHFSHINIDDGNVEQLQRFTRAWIIRFIRGVLFVNKSSSRVSLSMYAWDLLCLRIYIERCAAPSITKLNQSEERCTTLAPKRTPPVIENKSLGHRWLRRGNQHIGNDDLRVFRRKLDLMKQHEVRRS

SEQ ID NO: 98196 - protein, 56 aa, Glycine max
  Coding DNA Sequence Number=SeqID_6511
MVIVASRENWMNASKMHLLLLVPPRTVEQRSIPYLHRGIDGDSQISQNRTEWDTMR

SEQ ID NO: 98197 - protein, 81 aa, Glycine max
  Coding DNA Sequence Number=SeqID_6512
MGTEGVEVNLWSYWVSDLLDNREPSFRVFLFDNIFLLVVPTAAICFFEGDDASRNHQERYDHLGAQSEHAARLLNTAMHIT

SEQ ID NO: 98198 - protein, 150 aa, Glycine max
  Coding DNA Sequence Number=SeqID_6513
  Subcellular localization annotation: CTP_CleavageSite=34; ConfidenceScore=5.78e-01
MATPPSSPPPPSPTDSTSHSPSTIKRTRKVTRLRSMATRPVRTKRPRVHVDPATGKTDGPYRKKLRTYLGIVARNKSDLTSKWALIADKDGVDDTVCKKYDISKEKWTQFCQSHRDPSWELMEEKKKKQLEEAVKSGSTDTIIDPPSPIK

SEQ ID NO: 98199 - protein, 115 aa, Glycine max
  Coding DNA Sequence Number=SeqID_6514
MEDQVDKATTITIELDGGDGAFENHKASRNRKVKPIRLSMDVDATLSSTNFIMVVEEHKDSVRKRGRKGFDFEENGPTALCIKFPLEGVLNFENKPKTRLCCASYLEDCDVAAIG

SEQ ID NO: 98200 - protein, 220 aa, Glycine max
  Coding DNA Sequence Number=SeqID_6515
  Homolog annotation: Hit_ID=A7P363; Match level="QueryCoverage=61%, HitCoverage=53%, E-value=1e-42, Identity=64%"; Hit description =Chromosome chr1 scaffold_5, whole genome shotgun sequence
MEQSEGFSKAGSDRLIFKLKRSLYGLKQSPSLDDAREDSHFRDPQPKKSRWRLLCMAHILWVGQMLEQSVKATYCWVMKQVGGAAFLIPYMAIRLNDADDESVTRKLSQFGSVMTNGAPIVGVIGGSACIVSLLWALFGRMDANFGGIADRWDYLVGYLGSERLAYAFIWDICLYIIFQPWLIGDNLQNVQENKVVVVKYLRYVPVIGLIAYLFCLDPKE

SEQ ID NO: 98201 - protein, 134 aa, Glycine max
  Coding DNA Sequence Number=SeqID_6516
  Gene Ontology: Mol. function=ubiquitin thiolesterase activity; Cellular component=integral to membrane; Biological process =ubiquitin-dependent protein catabolic process
  Homolog annotation: Hit_ID=A7NUN3; Match level="QueryCoverage=50%, HitCoverage=6%, E-value=1e-27, Identity=85%"; Hit description =Chromosome chr18 scaffold_1, whole genome shotgun sequence
MKGKGQRVQRVYRGRKTKGDEGKRRKAKLRHCRIVKICFGKFGKLNKSIRFPEILDLAPFMSGTSDLPIYRLYGVVVHMDIMNAAFSSHCVCYVKNLQRRWFKVDDSVGLTANDYINWVGLRKLRQRLRIASNY

SEQ ID NO: 98202 - protein, 285 aa, Glycine max
  Coding DNA Sequence Number=SeqID_6517
MCPHRRWLRESSLPRGPGKTQLERVIVRPHRPMWTSIHTGSGARNTSSDLKPLKEGQQCEYSQRRSQASSFDEEAISQLLCVPGQDFSRTAVGKRVRIMHTSMTTLMQIWMTLLLSNILLSDHNSDLPIPKCQLVYAILTQFVGIAPTRHPVDPEKSNKALGFPALITGLLLHAQASIGPGTTPARGGPTTGSYRRTTATSRVHLYSPIEQAANHRGQVWLNESFYQYTLHQQSQDPSPYAWPTPKQSEAVVAWPRDWPNFQTGAGLAGTSGDGDGAQEDDDMAD

SEQ ID NO: 98203 - protein, 158 aa, Glycine max
  Coding DNA Sequence Number=SeqID_6518
  Gene Ontology: Mol. function=metal ion binding; Cellular component =nucleus; Biological process=histone H3-K9 demethylation
  Homolog annotation: Hit_ID=A7Q7J4; Match level="QueryCoverage=68%, HitCoverage=10%, E-value=1e-44, Identity=77%"; Hit description =Chromosome undetermined scaffold_60, whole genome shotgun sequence
MASVINLSCYHHHHIHLLSPRPFLLPLHPLGEINIHQTFIGYTNGRRDWLAWPQILKLKDWPPSNLFEEQLPRHCAEFISSLPFKEYTDPHKGSLNLAVKLPNGSLKPDLGPKTYIAYGFPQELGRGDSVTKLHCDMSDAVCSICLFLSWAVIFKDFF

SEQ ID NO: 98204 - protein, 68 aa, Glycine max
  Coding DNA Sequence Number=SeqID_6519
RSTPDEEGNLPVEDNSTLLRRLMDKFNAMELQVDMRFDAMESRITKVEEDVSFIRTCFDPPPPPPSSS

SEQ ID NO: 98205 - protein, 220 aa, Glycine max
  Coding DNA Sequence Number=SeqID_6520
  Pfam annotation: Domain name=Transposase_23; Domain location=39-109; Score=-4.1; E_value=0.0033; Accession=PF03017.5; Description =TNP1ENSPM transposase
MQSQGLAVPLEPLVGLGPSGPRVSTKGSCVDPSGNDPETGDSDRCGLYIEADPARLVSIGRVYEGSTVVHNTPLLLGQVKVSVEEVRDVDAPVPVPTDEVSLVGQALHTFLAWPTHLVKSLSQQVRWDATVFGVVNPDFPLYIKHEDLSEITHGGQCLNISVLQLWILHLTETCMRAGNSDIYGFLEPQSIQRSGQSQFESESSTAADIGRWWSSCPRNT

SEQ ID NO: 98206 - protein, 73 aa, Glycine max
  Coding DNA Sequence Number=SeqID_6521
MLSREWQPKEHEMELQRLNQNEENGKKKRSTTLKASSSIQEENEEEDSDDEEDFSFFVKKFQKFIKKRRIDRC

SEQ ID NO: 98207 - protein, 129 aa, Glycine max
  Coding DNA Sequence Number=SeqID_6522
MVCTNQADMTRRLLAGSLAFECRIMHYMIVRILPPRSSNLAQSEPFVKVKRSFSIGANVVSSFGYHKERDGSWVKKDTPAQAVEDRSPSPPPQRDHSSSLMHNILDRLDGLHTFVGERFDSLDSRIDAT

SEQ ID NO: 98208 - protein, 148 aa, Glycine max
  Coding DNA Sequence Number=SeqID_6523
QGVPFEGTLVDDWKHVYSSHDARKMVCHDHADMTGRLLAGSFTFECHIMHCILCRILLPRSINLAQASEEDLILLWALQTDDEPFVKVKRSFAIGVGAVTSFGYKKYMDGQWVHKQDLPPPIPSEHTPSPPPQRDTSSSLLTDVLTEL

SEQ ID NO: 98209 - protein, 119 aa, Glycine max
  Coding DNA Sequence Number=SeqID_6524
MASLVDIQENHRNFGLGYKPMRTNMRRSVLERRNRGMGPQLRPQVREALPCHINKSFVSVGLRREEQVAMIHDEAPQEHSSPTTSPVKVLISRTQPSILNEKRIDLRMKKTKIWGFPQS

SEQ ID NO: 98210 - protein, 222 aa, Glycine max
  Coding DNA Sequence Number=SeqID_6525
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=100%, HitCoverage=87%, E-value=1e-107, Identity=82%"; Hit description=Beta- lactamase TEM precursor
  Pfam annotation: Domain name=Beta-lactamase; Domain location=31-222; Score=50.0; E_value=8.3e-12; Accession=PF00144.15; Description=Beta -lactamase
MSIQHFRVALIPFFAAFCLPVFAHPETLVKVKDAEDQLGARVGYIELDLNSGKILESFRPEERFPMMSTFKVLLCGASQKKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPD

SEQ ID NO: 98211 - protein, 183 aa, Glycine max
  Coding DNA Sequence Number=SeqID_6526
  Homolog annotation: Hit_ID=A5B5V0; Match level="QueryCoverage=67%, HitCoverage=27%, E-value=4e-09, Identity=31%"; Hit description =Putative uncharacterized protein
QGVPFEGTIVDNWKFDYSSHDARCMVCNDQADMTSRLLVGSLTFDCRIMHYIIVCILLPRSSNLAQVSEEDLILMWAFQTGRQIDWAHLVQFRMHKALRANAPLPYPHLVTLFLHHFNVPLDDEPYVKVKRSFSIGTSVFTSFGYQKDVDGQWIHKQDLPPPIPYERTPSPPPQKGDSTVGSS

SEQ ID NO: 98212 - protein, 184 aa, Glycine max
  Coding DNA Sequence Number=SeqID_6527
MSVIELCVEVDVAGASAINLTNSLLSCGNNMSHNESGSATVGTNSEEDFDDDDYLISNSYAEDSLDEDEDINEMSDTDDEAVRLIEPLIVVQSGEGGSQTPFWDSASHYSNINWSHPDQEEICGLDMGSNFNMGKELYVGMIKEDPSLKISLIQERINGMFNYNISYRKAWKAKQKAITIEYGD

SEQ ID NO: 98213 - protein, 68 aa, Glycine max
  Coding DNA Sequence Number=SeqID_6528
YNIEIPNGENARNWVANVVLKFHDDLTVNESEIVVFLRQVRWPTGKREDFGRREKKQHCEAEEDEESV

SEQ ID NO: 98214 - protein, 69 aa, Glycine max
  Coding DNA Sequence Number=SeqID_6529
MSRNFMDYATTPSLTSGMLRNFMDCAIMLPFDSRHVAELHGLPNDGCQVPRSGHAKVTSHHTDGPWTIL

SEQ ID NO: 98215 - protein, 143 aa, Glycine max
  Coding DNA Sequence Number=SeqID_6530
MKADMEAMKEQMTTMMEAMMSMRKMIEVNTATVVTASTASEVDPTHPFGLNQVNRLVSDMVGQGGRALESMGGPHFVQVQSKHSFPPYGLPPNYTPPNVAYAPDENVDNSAPIPIESQQPQSGHAQVPRPPWERHMKYLETTL

SEQ ID NO: 98216 - protein, 69 aa, Glycine max
  Coding DNA Sequence Number=SeqID_6531
NSALKGLDDAPQPKSKAPSRWIVVKMSIIILGSFRNNWEAYFNDPRPLEPERLKALRIQWAQYYLRVTY

SEQ ID NO: 98217 - protein, 89 aa, Glycine max
  Coding DNA Sequence Number=SeqID_6532
MEEEFHHQECALDTKLEEDALMDEKKERRGEHKIEGIKEGEKWNFEDCINKQYSRVQGMCPRNPSGDRRRGQVARSIRGLGIGNSSTEG

SEQ ID NO: 98218 - protein, 72 aa, Glycine max
  Coding DNA Sequence Number=SeqID_6533
MRLAHIWTAKRMLVIFDLARLSRLADELKRLYSMANNVSEVNEEGSIGGVGTDGAGKGVGAKASMGGISEDE

SEQ ID NO: 98219 - protein, 112 aa, Glycine max
  Coding DNA Sequence Number=SeqID_6534
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=98%, HitCoverage=20%, E-value=6e-45, Identity=70%"; Hit description=DNA -directed RNA polymerase subunit beta'
MDSSLIEWKELGEEGSPDNENEWEDRKVGRRKNFLVRRIELAKHFLRTNIEPEWMVLCLLPVLPPELRPIIQIDGGRSTPGELVMCQEKLVQEAVDTLLDNGIRGQPMRDRS

SEQ ID NO: 98220 - protein, 171 aa, Glycine max
  Coding DNA Sequence Number=SeqID_6535
KWLRGSFLQKDLGGTSRLKGPVPFDSHRFRSAEHQQHFEAIKGWLFHRERRVQLRDDEYVDFQEEIARRCWMSLVTPMAKFDPDIVLEFYANAWPTEEGVRDMRSWVRGQWIPFDANALSQFLGDLLVLEEGQECEFSQRRNRTDGFDEEVIAQPICIRGQDFSRTAAGRQ

SEQ ID NO: 98221 - protein, 65 aa, Glycine max
  Coding DNA Sequence Number=SeqID_6536
MGQNTPNKIDDDGSKSHQGKNISHHMMQSYPAKALDRRLQVDWARDPREGPRVLMSLRVDFEPMG

SEQ ID NO: 98222 - protein, 101 aa, Glycine max
  Coding DNA Sequence Number=SeqID_6537
MAPDRMQLQNMCKKEHESFKEYAQRMMDYMPSRFAYLVFSGERIKVGLKRGKFDHPGANGENKKEGGTYVVTVVPTWPNFPPTQQCQYSTNISPSHYPPPC

SEQ ID NO: 98223 - protein, 76 aa, Glycine max
  Coding DNA Sequence Number=SeqID_6538
MTSTHDALLYYNERWNMSCQHDFVGYSFTGKNSKRFDIPSGCSINGLKDVIKSFWVFKKVIKLEIIEVKTNNDVLE

SEQ ID NO: 98224 - protein, 151 aa, Glycine max
  Coding DNA Sequence Number=SeqID_6539
  Gene Ontology: Mol. function=small conjugating protein ligase activity; Cellular component=nucleus; Biological process=regulation of protein metabolic process
  Homolog annotation: Hit_ID=Q45W76; Match level="QueryCoverage=93%, HitCoverage=88%, E-value=2e-72, Identity=91%"; Hit description =Ubiquitin-conjugating enzyme 2
  Pfam annotation: Domain name=UQ_con; Domain location=15-147; Score =4.5; E_value=1.6e-05; Accession=PF00179.17; Description=Ubiquitin -conjugating enzyme
MGSEGSTVVVPRNFRLLEELERGEKGIGDGTVSYGMDDADDIYMQSWTGTIIGPPGGVHEGRIYQLKLFCGKDYPDNPPTVRFQTRINMTCVNQETGVVEPHLFPMLANWQRECTMEDILMQLKKEMMSPQNRKLAQPPEGVSILFLIVVT

SEQ ID NO: 98225 - protein, 152 aa, Glycine max
  Coding DNA Sequence Number=SeqID_6540
MGRSREKPSKMEIDLSLKIDTDDEHNEEVDERVKEDNEEEMAQTPDNNKELEVHEATAGEIEDDASVVETSLQDNTKAKAANLRKGAYFKNYLRIGVCFKTNDGGGLFLGVTRHCQWRQRWREAGIVTGSGDIGGERLADRDGEIGQGQSRR

SEQ ID NO: 98226 - protein, 251 aa, Glycine max
  Coding DNA Sequence Number=SeqID_6541
  Homolog annotation: Hit_ID=A7Q979; Match level="QueryCoverage=32%, HitCoverage=8%, E-value=6e-09, Identity=41%"; Hit description =Chromosome chr19 scaffold_66, whole genome shotgun sequence
MEVPRNPNGCDIVAWPGYTCNIPNEIPRDTIIICQPLGLAQGLNTTSKTEVPRRCTTTTSNRRRSLVVLPPPSHEGAPHATVRRRANHQAAAALIFAVIVTAAAAAVVVMAVVEKEKLQEESVIRRFYQIILSWDYFALLKESKANSLLSLTLFPFLKLKNKEKKGTAVSTLVKVKQRYKDVDDYIATYEPLVFEEAKSQIIKEKEEEEALASGEWTIKALGQWRYRAGWVDKKEGNEEKVAGSILPANKN

SEQ ID NO: 98227 - protein, 281 aa, Glycine max
  Coding DNA Sequence Number=SeqID_6542
  Gene Ontology: Mol. function=sequence-specific DNA binding; Cellular component=nucleus; Biological process=regulation of transcription, DNA-dependent
  Homolog annotation: Hit_ID=A7Q6R4; Match level="QueryCoverage=61%, HitCoverage=52%, E-value=2e-60, Identity=66%"; Hit description =Chromosome chr12 scaffold_57, whole genome shotgun sequence
  Pfam annotation: Domain name=WRKY; Domain location=140-200; Score =140.9; E_value=3.5e-39; Accession=PF03106.6; Description=WRKY DNA -binding domain
MKFSAIQENNKRKDHEISLSLQDIATTSGEGPSRINEIFNKQIRQSAPSPPHTTDHDDSLSESELGLSLRLQPSTSHHKESDVGNNNKEDKNDQQLASFASVQNKLQRTHELPGITTHAAFPPNRKARVSVRARCEAATMNDGCQWRKYGQKIAKGNPCPRAYYRCTVAPGCPVRKQVQRCIDDMSILITTYEGTHNHPLPVGATAMASTASAAASFMLLDSSNPISDGTSSFTQAPFPYNTFHPLNPASNFRSISPSDPSKGIVLDLTSNLTEPPIRFST

SEQ ID NO: 98228 - protein, 48 aa, Glycine max
  Coding DNA Sequence Number=SeqID_6543
MKNHIHMARSNLKCREKGLDPHFKLGFKHAQHYTGHGPRNSTKSVRFH

SEQ ID NO: 98229 - protein, 84 aa, Glycine max
  Coding DNA Sequence Number=SeqID_6544
  Subcellular localization annotation: CTP_CleavageSite=45; ConfidenceScore=5.43e-01
MVSESILSDGVDNVASPHFVVISPDSRRHVASPTSSRYLSNVWLNFNMVSEPVLFGGVDSAASPRFVVTSPDSRGRVVSPTSGD

SEQ ID NO: 98230 - protein, 357 aa, Glycine max
  Coding DNA Sequence Number=SeqID_6545
  Gene Ontology: Mol. function=zinc ion binding; Cellular component =intracellular
  Homolog annotation: Hit_ID=Q2Z1Y7; Match level="QueryCoverage=90%, HitCoverage=91%, E-value=1e-106, Identity=59%"; Hit description=Pm27 protein
  Pfam annotation: Domain name=DUF1644; Domain location=49-211; Score =347.3; E_value=2.6e-101; Accession=PF07800.3; Description=Protein of unknown function (DUF1644)
MAKGSRGRHRIASRQFRVTPYPLASCKRDICEDMCQKKCSKALEKKELEDVTCSVCMEYPHNAVLLLCSSHDKGCRPYMCGTSFRHSNCLDQYKKAYTKVISPNRQPMQGTPGVLQDSNLPLEKSEATELACPLCRGQVKGWTVVEPVRDYLNAKKRGCMQDDCLYVGSYKELKKHVRAEHPSARPRMVDPADEQKWRWLEWEREREDVISTVTSAMPGAVVFGDYVIEGHHNDFDTDEEEGSGNAERNGRFQMGLEAMNFFLLLHAVRQGNELNNLGRRLRPELTHNNRVAGQNAAAVLDISDEDNDNDGRYNEDNDDGGVSLVSRLHGHGGGRVLLGRSGRRRRCREARARIGDS

SEQ ID NO: 98231 - protein, 288 aa, Glycine max
  Coding DNA Sequence Number=SeqID_6546
  Gene Ontology: Mol. function=metal ion binding; Cellular component =intracellular; Biological process=ubiquitin-dependent protein catabolic process
  Homolog annotation: Hit_ID=A7PR55; Match level="QueryCoverage=68%, HitCoverage=55%, E-value=3e-51, Identity=47%"; Hit description =Chromosome chr14 scaffold_26, whole genome shotgun sequence
  Pfam annotation: Domain name=Sina; Domain location=33-216; Score= -18.6; E_value=9.3e-06; Accession=PF03145.7; Description=Seven in absentia protein family
MTIQCENGHIACSICCVRLSNKCPMCSMPIGYNRCRAIEKVLECIKMSCPNANYGCKETLSYSKKNEHEKECIYLPCSCPFTGCDFIASSKELFLHFSHRHVGSGTQFTYDKFFTVFLSINQRTVVLKEKSDGNLFVVHNNLEHLGNIVRISCIGPKSTTEFQYEVLARHQGNALILQSFTKIVQGQYTDAPSIVVGKVFVHSHSAQSFSLDYSGYCGNEMYFIPSAFYWRILYLEISILYQRSYSSGPVFSDPHPSVYPCFVHLPTSSKTNLSLIQLKTELSWVLKA

SEQ ID NO: 98232 - protein, 539 aa, Glycine max
  Coding DNA Sequence Number=SeqID_6547
  Gene Ontology: Mol. function=oxidoreductase activity; Cellular component=anchored to membrane; Biological process=electron transport
  Homolog annotation: Hit_ID=Q9AYM8; Match level="QueryCoverage=97%, HitCoverage=98%, E-value=0.0, Identity=70%"; Hit description=CPRD2 protein
  Pfam annotation: Domain name=BBE; Domain location=472-530; Score =112.0; E_value=1.9e-30; Accession=PF08031.3; Description=Berberine and berberine like
  Pfam annotation: Domain name=FAD_binding_4; Domain location=78-217; Score=107.9; E_value=3e-29; Accession=PF01565.14; Description=FAD binding domain
  Pfam module annotation: Pfam domain module=BBE::FAD_binding_4; Domain location=472-530::78-217
MMRLISYFAAIVVALLFSFIPSSADTQENFVQCLYNYPHDNTTTSISKVVYTQTNSSYSSILDFSIQNLRFYNVTSKPLVIVTPLEVSHVQATIICSQRHNMQIRIRSGGHDYEGLSYVSQVPFVVLDLINLREIKVDVENRTAWVQAGATIGELYFSISQKSNTLGFPAGVCPTVGTGGNIGGGGYGFMLRKYGLAADNVIDAEIVDVNGNLLDRKAMGEDLFWAIRGGGGASFGVIVAWKVKLVPVPSTVTVFRVPRTLEQNATEIIHKWQLVANKLDDNLMIRIHLARVTSSKNGKPTVEAQFESTYLGGVDQLIPLMQKRFPELGLVKEDCTETSWIGSVLFMGNFTISGPPEVLLNRTQLVGVLNYKAKSDYVRDPIPDVGLEVLWPLFYEDEAQAAFVQFSPYGGRMYEISESEIPFPHRSGNLFHIQYGVYWKGEGNEEAQKHINWIRRMYSYMEPYVSKSPRAAYFNYRDLDIGANNNNGYTSYDQASVWGLKYFLNNFKRLATVKTKVDPLNFFRNEQSIPSLISKGRKL

SEQ ID NO: 98233 - protein, 539 aa, Glycine max
  Coding DNA Sequence Number=SeqID_6548
  Gene Ontology: Mol. function=oxidoreductase activity; Cellular component=anchored to membrane; Biological process=electron transport
  Homolog annotation: Hit_ID=A7Q4S7; Match level="QueryCoverage=98%, HitCoverage=94%, E-value=0.0, Identity=57%"; Hit description =Chromosome chr10 scaffold_50, whole genome shotgun sequence
  Pfam annotation: Domain name=BBE; Domain location=475-532; Score =106.5; E_value=8.4e-29; Accession=PF08031.3; Description=Berberine and berberine like
  Pfam annotation: Domain name=FAD_binding_4; Domain location=83-222; Score=98.4; E_value=2.3e-26; Accession=PF01565.14; Description=FAD binding domain
  Pfam module annotation: Pfam domain module=BBE::FAD_binding_4; Domain location=475-532::83-222
MEKSNSLPFLSVIVLLLHVSNSLTTPTRESIHDTFLHCLQSHTTNQPDHVSNIVYAQTNTSYTSVLRAFARNARFSAPSTQKPLLIVTPLSENQVQATVVCAKSIGLQLKIRSGGHDFEGVSYISQVPFIILDMFNFQDVTVDVQNEIAVIQAGASLGQVYYRIWEKSKVHGFPAGACPTVGVGGHLSGGGYGNMIRKYGLSVDHVVDAKIVDVKGRILDKESMGEDLFWAIRGGGGASFGVILSYTVKLVPVPENVTVFQIDKTLEENATDLVVQWQKVAPHTDDRLYLRLVLQPVSSNFVKGKKTIRASVEALFLGEADELVKLLGQEFPLLGLKKELCHEMRWIDSVVWWANYNDGSSVNALLDRNHYSVHSNKRKSDYVQTPISKDGFTWIWKKMIELGKVSIVFNPYGGKMNEVPSDATPFPHRAGNLYKIQYTVSWQEPGAAVEKSFLSQIRVLHNYMTPFVSKNPRSAYFNYRDLDIGINSHGKDNFEDGKVYGIKYFNKNFERLVKVKSAIDPENFFWNEQSIPTYPRSNA

SEQ ID NO: 98234 - protein, 160 aa, Glycine max
  Coding DNA Sequence Number=SeqID_6549
MPLVLGDINLVAQKENGALETKPNDNKLDREALCGEISIAILQAFETLVQVVDPDDEVGDGVEEPVEEECGGDEEGVALALHDRFLVAKVLGRGAGISLTARPGFVLPIYVHEKEQAERHHREERLQKVPGHRDQTLSESFQARDGEENNHYGLCGRDVP

SEQ ID NO: 98235 - protein, 272 aa, Glycine max
  Coding DNA Sequence Number=SeqID_6550
  Gene Ontology: Mol. function=methyltransferase activity; Cellular component=Golgi apparatus; Biological process=metabolic process
  Homolog annotation: Hit_ID=A7QQK5; Match level="QueryCoverage=100%, HitCoverage=72%, E-value=1e-102, Identity=68%"; Hit description =Chromosome undetermined scaffold_143, whole genome shotgun sequence
  Pfam annotation: Domain name=Methyltransf_11; Domain location=121 -216; Score=13.4; E_value=0.0046; Accession=PF08241.3; Description =Methyltransferase domain
YMTYTPFSLCPSDSDLAESLILRGCHPLPRRRCFSKTPQKQIPPNSLPKNPFPSSLPDNAVIWDHYQCKSFDCLNKQNPNLGFQPSRDISRFNSYKTDLDLPIQQLFQIAAAAKSVLRLGLDVGGGTGSFAAAMRLRNVTVVTTTMNVVAPNSEAVALRGLVPLHMPLQQRLPLFDGVLDLVRCGRAVNRWIPLTVMEFLLLDVDRVLRGGGYLWVDHFFSKGVDLEKVYAPLIGKLGYKKVKWATGNKTDAGGVKNGEVYLTALLQKPVSR

SEQ ID NO: 98236 - protein, 273 aa, Glycine max
  Coding DNA Sequence Number=SeqID_6551
  Gene Ontology: Mol. function=nutrient reservoir activity; Cellular component=extracellular region; Biological process=cell wall organization and biogenesis
  Homolog annotation: Hit_ID=A7Q4R2; Match level="QueryCoverage=71%, HitCoverage=90%, E-value=1e-85, Identity=77%"; Hit description =Chromosome chr10 scaffold_50, whole genome shotgun sequence
  Pfam annotation: Domain name=Cupin_1; Domain location=117-267; Score =150.4; E_value=5e-42; Accession=PF00190.13; Description=Cupin
  Pfam annotation: Domain name=Cupin_2; Domain location=152-229; Score =39.6; E_value=1.2e-08; Accession=PF07883.2; Description=Cupin domain
  Pfam module annotation: Pfam domain module=Cupin_1::Cupin_2; Domain location=117-267::152-229
MTISSLFSAAKMIFFHLIMDVPPIYKGGKQSPFLNSSIRIQKQNINGSLLDNTPKIINMVTRAHFFCLMALTFTLALAADHSPLQDFCVADPKSQVLVNGLACKDPTLVKANDFFFRGLHLEGNTSNPVGSKVAPVTVSQLPGLNTLGISLARIDFAPWGTNPPHTHPRATEILTVIEGTLEVGFVTSNPGNRHVTKVLQKGDVFVFPVGLVHYQRNVGYGNAVAIAALSSQNPGVITIANAVFGATPDIASDVLAKAFQVDKDVVADLKSKF

SEQ ID NO: 98237 - protein, 314 aa, Glycine max
  Coding DNA Sequence Number=SeqID_6552
  Gene Ontology: Mol. function=protein binding; Cellular component =proteasome regulatory particle; Biological process=proteolysis
  Homolog annotation: Hit_ID=Q0GEA1; Match level="QueryCoverage=67%, HitCoverage=82%, E-value=1e-81, Identity=72%"; Hit description=26S proteasome regulatory particle non-ATPase subunit 12
  Pfam annotation: Domain name=SAC3_GANP; Domain location=112-288; Score=111.0; E_value=3.7e-30; Accession=PF03399.7; Description =SAC3GANP family
MGCNKLYGQMIMNKRRRLLQGGIRLEEQEKNVQCVLIAHDKVVLERERHSSVDFTIAVVFFFSIEVVIGSTQPNHSSCETTSQENSQAMDPKLKEVSQLFDRFKASFLRNDFDNCSNLLSQLKIDSVALFSFVFENLNLAWDIYEHAVVLSVKIEDQDAFERDFFQLKPYYTDACNRLPPSPQEYPILGLNLLRLLVQNRIAEFHTELELLSSAALENPCIKHAVELEQSFMEGAYNRVLSARQTVPHDTYVYFMDLLAKTVRDEIAGCSEKAYDYLSIKDAKQMLLFSSDQELLEYIKECMKMDMKLRLAVEP

SEQ ID NO: 98238 - protein, 383 aa, Glycine max
  Coding DNA Sequence Number=SeqID_6553
  Gene Ontology: Mol. function=potassium channel activity; Cellular component=membrane of vacuole with cell cycle-independent morphology; Biological process=potassium ion transport
  Homolog annotation: Hit_ID=A9QMN9; Match level="QueryCoverage=99%, HitCoverage=88%, E-value=1e-123, Identity=63%"; Hit description=TPK1
  Pfam annotation: Domain name=Ion_trans_2; Domain location=151-233; Score=70.0; E_value=7.9e-18; Accession=PF07885.7; Description=Ion channel
  Pfam annotation: Domain name=Ion_trans_2; Domain location=276-350; Score=45.6; E_value=1.7e-10; Accession=PF07885.7; Description=Ion channel
  Pfam module annotation: Pfam domain module=Ion_trans_2::Ion_trans_2; Domain location=151-233::276-350
MEKEPLLPYFSPRKKPQPFPPLCPLPEHDEIVLPMTPSEFKDRLIFGPSPSSASPRDPSPLADALTLSYNSPKCPSSSNSQDYASPPLFDSQQQQPLNSWLLDPNYESWRKTNLHRSKTAPAMAVISDFNPHTAVQRPQFASQSIVRQGVILLALYLALGVVIYWFNRHNFTATETHPVVDALYFCIVTMCTIGYGDITPNSTATKLFSILFVLVGFGFIDILLSGMVSYVLDLQENHMLTAVKGRRGEKDGKSYIIDVKKGRMRIRLKVALALGVVVICTGVGVGVMHFVEKLGWLDSFYLSVMSVTTVGYGDHAFKTMHGRIFAAIWLLVSTLAVARAFLYLAEARVDKRHRRMAKWILGQDMTVSEFLAADIDNNGFVRY

SEQ ID NO: 98239 - protein, 828 aa, Glycine max
  Coding DNA Sequence Number=SeqID_6554
  Gene Ontology: Mol. function=transferase activity, transferring glycosyl groups; Cellular component=chloroplast; Biological process =glucan biosynthetic process
  Homolog annotation: Hit_ID=Q9XGC1; Match level="QueryCoverage=81%, HitCoverage=77%, E-value=0.0, Identity=77%"; Hit description=Starch synthase, isoform V
  Pfam annotation: Domain name=Glyco_transf_5; Domain location=493-735; Score=374.8; E_value=1.4e-109; Accession=PF08323.2; Description =Starch synthase catalytic domain
  Subcellular localization annotation: CTP_CleavageSite=37; ConfidenceScore=5.34e-01
MASKLRTCFMCWNLSGFNCVNHHNGRNRVVRVSFPASCEMRHRATFSSQHKRQQIKPSAEGGLRQNQDEEDDAAEVSLNNDDSVENLNDATAPLAININGAEQAEQLSGRQLEDLLGMIKNAEKNILLLNEARVRSLEDLEKILAEKEALQGEINVLETRLAETDAQIKVANQEKIHVELLEGQLEKLRNELAQKESTEGKYSELHDLQNGGLSDANPLSHNDSIHSLTEELNSLRAENASLKNTIESFKTQLSDTKNNDERLVALEKERSSLESALKDLESKLSISQDDVSKISTLTVEYKDLWDKVENLQSLLDKATKQADQAVIVLQQNQDLRRKVDKLEESLEEANIYKLSSDKLQKYSELMQQKLKLLEDRLQKTDEEINSYVQLYQQSVKEFQDTLDTLKEESKKGNLEEPVEDMPWEFWSQLLLLIDGWKLEKKISVDDASLLREKVWKRDRRIIDTYIACKKQSEQEAISAFLGLLSSATSPGLHVIHIAAEMAPVAKVGGLGDVVSGLGKALQKKGHLVEIVLPKYDCMQYDRVCDLRALDVLIDSYFDRQLYKNKIWVGTVEGLPVYFIEPHHPDKFFWRGEFYGERDDFRRFSFFSRAALEFLLRAGKKPDIIHCHDWQTAFIAPLYWEIFAPKKGLNSARICFTCHNFEYQGTAAASELESCGLESHRLNRKDRMQDNSSHDRVNSVKGGIVFSNIVTTVSPTYAQEVRTEEGGRGLHSTLSVHSKKLIGIINGIDTDAWNPATDAFLPVQYNATDLQGKAENKQALGRNLGLSSTDVRRPLNDKSKANCTCVLYVTFEMNIPRLFQIALSCEIYL

SEQ ID NO: 98240 - protein, 152 aa, Glycine max
  Coding DNA Sequence Number=SeqID_6555
MANGKTLWKVKIPPYKHAIVPPWRAFLHKFPEAVGKKSVPPFCHGAALAVSFPCFWLDLLFHVQLQYTAIYFTCSTANESFIVAIFKSQLHLSYMESLIFKFIMFTIGNASGKKWISMTNEVLIPLFLIFFLLAYRCNTEVAELCPLIRILG

SEQ ID NO: 98241 - protein, 97 aa, Glycine max
  Coding DNA Sequence Number=SeqID_6556
MWDKGTKTTNSNTILIWMKISKCRCCSWGTQGSIKPHTISSLQQQQQSLVLIDEVSYMDYMMPFRSIKDQSFIDVIYHKICSAILPWHRHLTMQEAR

SEQ ID NO: 98242 - protein, 56 aa, Glycine max
  Coding DNA Sequence Number=SeqID_6557
MASKRERILKATLLKKETGKEESLFHLNAAPRVFLMVRRRSGRNAYLYITRYEIVK

SEQ ID NO: 98243 - protein, 98 aa, Glycine max
  Coding DNA Sequence Number=SeqID_6558
  Homolog annotation: Hit_ID=Q5SMP0; Match level="QueryCoverage=85%, HitCoverage=75%, E-value=5e-13, Identity=46%"; Hit description =Putative uncharacterized protein P0554A06.10
MGSEDAKDPFKGVDWKAVGGEMQQNPSAKPALKKRLPKKVREIPEFYFLPRWPLPKAILFCSACIGGGVAAGMLLETWIEKKVKDFVESGAPNWYPSI

SEQ ID NO: 98244 - protein, 280 aa, Glycine max
  Coding DNA Sequence Number=SeqID_6559
  Homolog annotation: Hit_ID=A7QQM6; Match level="QueryCoverage=71%, HitCoverage=48%, E-value=2e-40, Identity=47%"; Hit description =Chromosome undetermined scaffold_143, whole genome shotgun sequence
MRNAQLGWTRQKVFHVLIGSSNLGYVIYLALTLVAACKGWTCWSHSCGFVFMAFPKVLFFAAFLLLLSFWVDLCHQADDDDDYEGSFCDNPLLEKTSNESNLASIDSHRKCFPFWFARVGNRQKIVILVTLLVFIIVVAFAVVIWIGLGKNPIDSEVAARCRAMLEPGYICMYSADYLEGMLSIQLNGKGMFGCYLNLCLGDLLVMGSNPETASLHMQGQGCVQYPSPIPSHSEEPLGNGRSLNCLWPSEKHWCLLGSNQVAFYLMSEYDVSNALIPIIG

SEQ ID NO: 98245 - protein, 90 aa, Glycine max
  Coding DNA Sequence Number=SeqID_6560
MECCKIAIVLTIYIMAMLVFAHCCVAENVAEDVAAIPPTPMESAGVHLCASAVFVVTAFVVAISLSQEVAPREEKPPVQLLHVFPGSTSY

SEQ ID NO: 98246 - protein, 916 aa, Glycine max
  Coding DNA Sequence Number=SeqID_6561
  Gene Ontology: Mol. function=protein binding; Cellular component =membrane coat; Biological process=intracellular protein transport
  Homolog annotation: Hit_ID=A7PGW2; Match level="QueryCoverage=99%, HitCoverage=99%, E-value=0.0, Identity=57%"; Hit description =Chromosome chr17 scaffold_16, whole genome shotgun sequence
  Pfam annotation: Domain name=Adaptin_N; Domain location=29-652; Score= 210.4; E_value=4.4e-60; Accession=PF01602.11; Description=Adaptin N terminal region
  Pfam annotation: Domain name=HEAT; Domain location=177-212; Score =7.6; E_value=2; Accession=PF02985.13; Description=HEAT repeat
  Pfam annotation: Domain name=HEAT; Domain location=289-325; Score =11.1; E_value=0.6; Accession=PF02985.13; Description=HEAT repeat
  Pfam annotation: Domain name=HEAT; Domain location=331-362; Score =2.5; E_value=11; Accession=PF02985.13; Description=HEAT repeat
  Pfam module annotation: Pfam domain module=Adaptin_N::HEAT::HEAT::HEAT ; Domain location=29-652::177-212::289-325::331-362
MAGSSIMENLFQRTLEDLIKGLRLQLIGESTFISNATEEIRREVKSTDQHTKSIALQKLSYLSAVHAVDMSWACFHVVEVMSSSKFAHKRIGYHAASQSFNDNTPVLLLITNQLRKDLSSTNHFEVSLALDLLSRIATLDLARDLTPEVFKLLSTARVFIRKKAIAVVLRVFDKYPDAVRVCFKRLVENLESSDPQVVTAVIGVFCELAAKDPGSYLPLAPEFYRILVDSKNNWVLIKVLKVFAKLAPLEPRLGKRIVEPVCDHMGRSGAKSLVFECVRTVLTSLSDYESAVKLAVEKVRELLVDQDPNLRYLGLQALSVATPEHLWAVIENKEAVVKSLSDDDSNIKIESLRLLMAMVSESHVADISRVLLNYALKSDPEFSNQILGSILTTCCRNVYEIVVDFDWYVSLLGEMAMIPNCQKGEEIETQLVDIGMRVKDARMQLVRVGRDLLIDPALLGNVHLHRILCAAAWIAGEYVEVAANPFELMDALLQPRTSLLPPSIRAVYINSAFKILIFCLDCYILQNEGSASWYSDNLAGGQSDLLSVKNDTEAAELATCEGSNDEQHEDFNPRNATESSEDLSVKNDIDRVATHGQASTPPTVLGKKNSMHESIVSLLNRIELIFGPLIANQDVEVLERAQNLLSLVQLIKEEIIDNLVQSVVDIANKKVTRVTAIINLLRDAFTTELGPVSTSAQGRIVVPDGLVLKENLDDLQAMCGDIELPSSSSFGTGVPHLTTTSDTSSSNLLKNEESGPLKESTSLIEHRKRHELYYLPSEKSEIVSDEYPPAKKDKKRANQTKPRLALVRLDDGDVAPISVKRPEPRDDSLSGAIKDVLLRSETGPCMSGSSRSKNHGHSHTKERRHRGKEKIVEGEEHDQREKKKSGHCRGRRKTHQRAKSPVNVVSHTPVIPDFLL

SEQ ID NO: 98247 - protein, 185 aa, Glycine max
  Coding DNA Sequence Number=SeqID_6562
  Gene Ontology: Mol. function=DNA-directed RNA polymerase activity; Cellular component=nucleus; Biological process=transcription
  Homolog annotation: Hit_ID=P38421; Match level="QueryCoverage=91%, HitCoverage=96%, E-value=2e-80, Identity=85%"; Hit description=DNA -directed RNA polymerase II subunit RPB7
  Pfam annotation: Domain name=RNA_pol_Rpb7_N; Domain location=8-77; Score=96.7; E_value=7.3e-26; Accession=PF03876.8; Description=RNA polymerase Rpb7, N-terminal domain
  Pfam annotation: Domain name=S1; Domain location=78-161; Score=48.0; E_value=3.3e-11; Accession=PF00575.14; Description=S1 RNA binding domain
  Pfam module annotation: Pfam domain module=RNA_pol_Rpb7_N::S1; Domain location=8-77::78-161
MFFHIVLERNMQLHPRYFGRNLRDNLVSKLMKDVEGTCSGRHGFVVAVTGIENIGKGLIRDGTGFVTFPVKYQCVVFRPFKGEILEAVVTMVNKMGFFAEAGPVQIFVSTHLIPDDMEFQSGDMPNYTTSDGSVKIQKDSEVRLKIIGTRVDATEILMITVLAVVFVNIMKIGLHFWNASLCSDC

SEQ ID NO: 98248 - protein, 210 aa, Glycine max
  Coding DNA Sequence Number=SeqID_6563
  Homolog annotation: Hit_ID=A7QWJ3; Match level="QueryCoverage=74%, HitCoverage=36%, E-value=2e-54, Identity=62%"; Hit description =Chromosome chr10 scaffold_204, whole genome shotgun sequence
  Pfam annotation: Domain name=DUF616; Domain location=55-209; Score= -45.7; E_value=3e-10; Accession=PF04765.4; Description=Protein of unknown function (DUF616)
MPLQINPLRSNSTFFFSLFLSFFLWTAQVCHLNHTFYLLFPYYWDVLKEIQNFCKFSTRTVRCMQGNADSFGGNLSTHLRFFHFDHQNDSSEVPYRICMEKCESVVVVSAIFNDHDKIRQPRGLGSQTLQNVCFFMFIDDITLKGLEYLGLISTKSREYKIGVWRIVKVSKEDLYQNPAMNGVIPKYLFHRLFPYSPIQYLDRCKVATNG

SEQ ID NO: 98249 - protein, 338 aa, Glycine max
  Coding DNA Sequence Number=SeqID_6564
  Gene Ontology: Mol. function=nucleoside-triphosphatase activity; Cellular component=microtubule; Biological process=cell division
  Homolog annotation: Hit_ID=A7Q129; Match level="QueryCoverage=100%, HitCoverage=98%, E-value=1e-117, Identity=58%"; Hit description =Chromosome chr10 scaffold_43, whole genome shotgun sequence
  Pfam annotation: Domain name=AAA; Domain location=150-284; Score =31.2; E_value=3.1e-08; Accession=PF00004.20; Description=ATPase family associated with various cellular activities (AAA)
MADDPMPTRWSFQDFKLCYDAKFGRKKVAENGDDAAGKAVSNGNGNSVTVAIVSNGNKRASEMAVYEQFRSEGQNQIHTNGFVPTLTDERPQKSLLPPFESAEMRALAESLSRDIIRGSPDVKWESIKGLENAKRLLKEAVVMPIKYPKLVLHWSVITMEGYPPFWPTGDRKGDSEKLVKVLFELARHHAPSTIFLDEIDAIISQRGEARSEHEASRRLKTELLIQILVPLPEPVARRAMFEELLPQQPGEESIPYDILEDKTEGYSGSDIRLLCKETAMQPLRRLMSQLEQNQDVVPEEELPKVGPIRSEDIETALRNTRPSAHLHAHKYDKFNADY

SEQ ID NO: 98250 - protein, 84 aa, Glycine max
  Coding DNA Sequence Number=SeqID_6565
MDSNVCLKSFQMEKKKMENNSRSPREGCMDFAVHSQVIKIKEEIEKIKHPSLQLHMRRALLRDVNRLRSRSPLGFADRERAILT

SEQ ID NO: 98251 - protein, 562 aa, Glycine max
  Coding DNA Sequence Number=SeqID_6566
  Gene Ontology: Mol. function=transporter activity; Cellular component= integral to membrane; Biological process=transport
  Homolog annotation: Hit_ID=A9PDX2; Match level="QueryCoverage=99%, HitCoverage=98%, E-value=0.0, Identity=69%"; Hit description =Putative uncharacterized protein
  Pfam annotation: Domain name=Ank; Domain location=154-184; Score=1.0; E_value=24; Accession=PF00023.21; Description=Ankyrin repeat
  Pfam annotation: Domain name=Ank; Domain location=188-221; Score =17.6; E_value=0.046; Accession=PF00023.21; Description=Ankyrin repeat
  Pfam annotation: Domain name=Ank; Domain location=222-252; Score =23.3; E_value=0.00092; Accession=PF00023.21; Description=Ankyrin repeat
  Pfam annotation: Domain name=Ank; Domain location=256-289; Score =26.2; E_value=0.00012; Accession=PF00023.21; Description=Ankyrin repeat
  Pfam annotation: Domain name=Ank; Domain location=51-85; Score=11.3; E_value=0.76; Accession=PF00023.21; Description=Ankyrin repeat
  Pfam annotation: Domain name=Ank; Domain location=86-152; Score=0.2; E_value=31; Accession=PF00023.21; Description=Ankyrin repeat
  Pfam module annotation: Pfam domain module=Ank::Ank::Ank::Ank::Ank::An k; Domain location=154-184::188-221::222-252::256-289::51-85::86-152
MEAKGVRFLAYQSIFSSVGSGDFDGVKKLVEEVKKEEGSSLSDVMSLQNDAGETALYIAAENNLQEMFSFLLSICHFEVVKIRSKADMNAFHVAAKRGNLAPIQKKDNKKAVEVVRTRTKEWKCWGTRSNVNPTDIVRELLNIWPEVCKLCDSSNTSPLYSAAVQDHLDVVDAILDVDVSSMFIVRKNGKTSLHNAARYGVHRIVKTLIARDPGIVCIKDKKGQTALHMAVKGQCTSVVEEILLADPSILNERDKKGNTALHMATRKCRSQIVGLLLSYSAVDVNAINKQQETALDLADKLPYGDSALEIKEALAEYGAKHARYVGKEDDAMELKRTVSDIKHEVQSQLIQNETTRRRVSGIAKELKKLHREAVQNTINSVTLVAVLFASIAFLAIFNLPGQYITDEGKEIGKAKIADHVSFQVFCLLNSTSLFISLAVVVVQITLVAWDTRAQKQIVSVVNKLMWAACACTCGAFLAIAFEVVGKKTWMAITITLLGVPVLVGTLASMCYFVFRQHFGIFRSDSQRRIKRASGSKSFSWSYSANISDLDEYNSDIEKIYAL

SEQ ID NO: 98252 - protein, 511 aa, Glycine max
  Coding DNA Sequence Number=SeqID_6567
  Gene Ontology: Mol. function=binding; Cellular component=cytoplasm; Biological process=phosphoinositide-mediated signaling
  Homolog annotation: Hit_ID=A7P3U9; Match level="QueryCoverage=98%, HitCoverage=67%, E-value=0.0, Identity=85%"; Hit description =Chromosome chr1 scaffold_5, whole genome shotgun sequence
  Pfam annotation: Domain name=HEAT; Domain location=127-162; Score =8.5; E_value=1.4; Accession=PF02985.13; Description=HEAT repeat
  Pfam annotation: Domain name=HEAT; Domain location=168-204; Score =3.9; E_value=7.1; Accession=PF02985.13; Description=HEAT repeat
  Pfam annotation: Domain name=HEAT; Domain location=209-245; Score =23.6; E_value=0.00074; Accession=PF02985.13; Description=HEAT repeat
  Pfam annotation: Domain name=HEAT; Domain location=281-317; Score =6.0; E_value=3.4; Accession=PF02985.13; Description=HEAT repeat
  Pfam annotation: Domain name=HEAT; Domain location=364-400; Score =0.7; E_value=22; Accession=PF02985.13; Description=HEAT repeat
  Pfam annotation: Domain name=HEAT; Domain location=405-441; Score =9.2; E_value=1.1; Accession=PF02985.13; Description=HEAT repeat
  Pfam annotation: Domain name=HEAT; Domain location=86-122; Score =39.5; E_value=1.2e-08; Accession=PF02985.13; Description=HEAT repeat
  Pfam module annotation: Pfam domain module=HEAT::HEAT::HEAT::HEAT::HEA T::HEAT::HEAT; Domain location=127-162::168-204::209-245::281 -317::364-400::405-441::86-122
MADALSLIPAAVLRNLADKLYEKRKNAALDIEGIVKQLATAGDHDKITAVINLLTTEFTYSPQANHRKGGLIGLAAATVGLTSEAAQHLEQIVPPVLNSFSDQDSRVRYYACEALYNIAKVVRGDFIIFFNQIFDALCKLSADSDANVQSAAHLLDRLVKDIVTESDQFSIEEFIPLLRERMNVLNPYVRQFLVGWITVLDSVPDIDMLGFLPDFLDGLFNMLSDSSHEIRQQADSALSEFLQEIKNSPSCASFSTTTLTQKQSFLFIYHFLTRAVLLLKSVDYGRMAEILVQRAGSPDEFTRLTAITWINEFVKLGGDQLVPYYADILGAILPCIADKEEKIRVVARETNEELRALKADPAEAFDVGAILSIARRQLSSELEATRIEALHWISTLLNKYRTEVLEFLNDIFDTLLKALSDPSDEVVLLVLDVHACIAKDPQHFRQLVVFLVHNFRVDNSLLEKRGALIIRRLCVLLNAERVYRELSTILEAESDLDFASIMVQLYKKLFE

SEQ ID NO: 98253 - protein, 499 aa, Glycine max
  Coding DNA Sequence Number=SeqID_6568
  Gene Ontology: Cellular component=plastid chromosome; Biological process=response to cold
  Homolog annotation: Hit_ID=A7PE85; Match level="QueryCoverage=93%, HitCoverage=96%, E-value=0.0, Identity=80%"; Hit description =Chromosome chr11 scaffold_13, whole genome shotgun sequence
  Pfam annotation: Domain name=mTERF; Domain location=103-450; Score =498.2; E_value=1e-146; Accession=PF02536.5; Description=mTERF
MVARRKVLNLLSTLIPHHANAFSRHPHDHNPFTKIPKTLFRVYYGTQSSASKLPEYEMPSVTWGVIQGRKEKLVSRVIIFDYLKGLGIIPDELHDLELPSTVDVMRERVEFLQKLGLTVDDINNYPLMLGCSVRKNMIPVLGYLEKIGIARPKLGGFVKNYPQVLHASVIVELAPVVKFLRGLDVEKDDIGYVLQKYPELLGFKLEGTMSTSVAYLVSIGVNPRDIGPMVTQYPYLLGMRVGTVIKPMIDYLVDLGLPKKVLARMLEKRAYVLGYDLEETVKPNVECLISFGVGRDCLASIIAQYPQILGLPLKAKLSTQQYFFSLKLKVDPEGFARVVENMPQVVSLHQHVIMKPVEFLLGRTIPAQDVASMVVKCPQLVALRVELMKNSYYFFKSEMGRPLQELVEFPEYFTYSLESRIKPRYQRLKSKGIRCSLNWMLNCSDQRFEERLQGHYIETESVGPRFCMGGKLELPGNGLVSDEEEESDDELLYRRTVSL

SEQ ID NO: 98254 - protein, 529 aa, Glycine max
  Coding DNA Sequence Number=SeqID_6569
  Gene Ontology: Mol. function=carbon-nitrogen ligase activity, with glutamine as amido-N-donor; Cellular component=intracellular; Biological process=translation
  Homolog annotation: Hit_ID=A7NXK2; Match level="QueryCoverage=100%, HitCoverage=100%, E-value=0.0, Identity=64%"; Hit description =Chromosome chr5 scaffold_2, whole genome shotgun sequence
  Pfam annotation: Domain name=GatB; Domain location=282-349; Score =102.6; E_value=1.2e-27; Accession=PF01162.10; Description=PET112 family, C terminal region
  Pfam annotation: Domain name=GatB_N; Domain location=67-286; Score =376.1; E_value=5.5e-110; Accession=PF02934.6; Description=PET112 family, N terminal region
  Pfam annotation: Domain name=GatB_Yqey; Domain location=378-525; Score=244.2; E_value=2.8e-70; Accession=PF02637.9; Description =GatBYqey domain
  Pfam module annotation: Pfam domain module=GatB::GatB_N::GatB_Yqey; Domain location=282-349::67-286::378-525
  Subcellular localization annotation: CTP_CleavageSite=52; ConfidenceScore=5.58e-01
MASSIFRSLQVHPFMLYPTTFLRRRNGVFHLTTKATQSQTDTQQRQPQTKVSSSNSTQSKKLDKIPKDYEAIIGIETHVQLSTLTKAFCGCPYSYGSSPNSSICPICMGLPGALPVLNSKIIDFAVKLGLALNCNLAFKSKFDRKQYFYPDLPKGYQISQFDVPIATAGFLDVDIPVEFGGGHKRFGITRVHMEEDAGKLLHAENGNYSQVDLNRAGVPLLEIVSEPDMRNGIEAAEYAAELQRLVRYLGVSNGNMQEGSLRCDVNVSIRPIGQSKFGTKRTITMRKKEGLADYRYFPEPDLPAVILSQEYVDGIKNSLPELPEIKRRRYEQMGLSMQDVLFLANDKNQIVSLKYKLIKADYELTTCLQITGCNQIAEFFDATLAKGADSKLVANWIMSDIAAFMKNEKLTINEIKLTPEELSELIASIKGGTISGKIGKEILFELLAKGGTVKELIQKKDLVQIADPVEIEKMVDKVIVENPKQVEQYRGGKTKLQGFFAGQVMKLSKGKANPGLLNKILLEKLNSKS

SEQ ID NO: 98255 - protein, 455 aa, Glycine max
  Coding DNA Sequence Number=SeqID_6570
  Homolog annotation: Hit_ID=A7P3X2; Match level="QueryCoverage=94%, HitCoverage=73%, E-value=1e-169, Identity=66%"; Hit description =Chromosome chr1 scaffold_5, whole genome shotgun sequence
  Pfam annotation: Domain name=MACPF; Domain location=3-174; Score=7.7; E_value=3.9e-06; Accession=PF01823.10; Description=MACPerforin domain
MEDFQRSFLSRLLTMHPNGENFIRFIENFGTHILVGLGIGGKDLVLVKQDVSSNLDPSELKKHLDELGNQIFNGTCNFLPKSKEQKYKAPQAFDVFGPQIVAFDSSTSVCAKDGITVICAKRGGDTQVRDHSEWLLTVPKKPDAVDFSFIPITSLLKGTPGKGFLSHAINLYLRYKPPMSDLPYFLDYQSHKLWAPIHNDLPLSPATNRTNLSPSLSFDLMGPKLYVNTSKVTVGKRPITGMRLFLEGMKCNRLAIHVQHLLNTPIMLKNKIEDTPIWSEEINDGRFFEAINGKKFYHVCTAPVKYDPRWSSDKDVAFIVTGAQLHVKKHESRSVLHLRLLFSKVSNCAVVKSSWTQGSSGLSQRSGIFSVISTSISGKDQNQKKPVVVLDSSVFPTGPPVPVQTQKLLKFIDTSQLCKGPQDSPGHWLITGARLVLDKRKICLWAKFSLLNTGS

SEQ ID NO: 98256 - protein, 1156 aa, Glycine max
  Coding DNA Sequence Number=SeqID_6571
  Gene Ontology: Mol. function=two-component sensor activity; Cellular component=membrane; Biological process=signal transduction
  Homolog annotation: Hit_ID=A7P3Y6; Match level="QueryCoverage=58%, HitCoverage=98%, E-value=0.0, Identity=72%"; Hit description =Chromosome chr1 scaffold_5, whole genome shotgun sequence
  Pfam annotation: Domain name=PvlArgDC; Domain location=448-585; Score= -62.2; E_value=0.095; Accession=PF01862.7; Description=Pyruvoyl -dependent arginine decarboxylase (PvlArgDC)
MELRGLFQYLVNQLKKGQGIELVLLQELIQQMANVQYTENLTEEQLDAMAGSETLRYQATSFGVTRNNKALIKSTSRLRDALLPKDEPKLAIPLLLLIAQHRSLVVINADAPYIKMVSEQFDRCHGTLLQYVEFLCSAVTPASNYGILIPSLNDLVHLYHLDPEVAFLIYRPVMRLFKSPGNPDVCWPLDDKNAASDASMNFESDPLDHSASMVLNLGSAQNPISWSYLLDTVKTMLPSKAWNSLSPDLYATFWGLTLYDLYVPKNRYESEIAKLHANLKSLEELSDNSSSAITKRKKEKERIQESLDRLISELHKHEENVASVRRRLSHEKDKWLSSCPDTLKINMEFLQRCIFPRCTFSMPDAVYCAMFVHTLHSLGTPFFNTVNHIDVLICKTLQPMICCCTEYEAGRLGRFLYETLKIAYYWKSDESIYERECGNMPGFAVYYRYPNSQRVTYGQFIKCLESTEYMEIRNALIMLTKISSVFPVTRKSGINLEKRVAKIKSDEREDLKVLATGVAAALAARKPSWVTDEEFGMGYLELKPAPSVTKSSAGNSATVQSGINLNVSQTESASGKHVDSGNIVKDQAMRTKTADGRSERTESITVTKSDTGHIKLKSSSMVNGLDAQSSLAPSSVQSGTSKSMENPKQVEESINRASDEHGTRTTELRTSAKRSVPAGSLSKPSKQDPVKEDGRSGKPVARTSGSSSSDKELQTHALEGRYTGTTNVPSSNGNTISGSTKGSNPPVKISLDGPGNESKAEVGVAKSSDIRASMVKDDGNDITDNPRGASSRVVHSPRYENTGVTSKSNDKVQKRASSAEEPDRLGKRRKGDVELRDFETEVRFSEREKMMDPRFADDKSGPEEHGLYRAGDKPLERAKDKGNERYERDHRERMDRLDKSRGDDFVAEKPRDRSIERYGRERSVERMQERGSDRSFNRLPEKAKDERNKDDRNKLRYNDASVEKSHGDDRFHGQSLPPPPPLPPNVVPQSVGAGRRDEDVDRRYGATRHSQRLSPRHEEKERRRSEETVVSQDDAKRRKEDDFRDRKREEIKVEEREREREKANILKEELDLNAASKRRKPKREHLPTGEPGEYSPVAHPPSSAGIGMSLAYDGRDRGDRKGPIMQHPSYVDESSLRIHGKEVASKLNRRDSDPYP

SEQ ID NO: 98257 - protein, 971 aa, Glycine max
  Coding DNA Sequence Number=SeqID_6572
  Gene Ontology: Mol. function=binding; Cellular component=proteasome regulatory particle; Biological process=proteolysis
  Homolog annotation: Hit_ID=O48844; Match level="QueryCoverage=97%, HitCoverage=95%, E-value=0.0, Identity=73%"; Hit description=26S proteasome regulatory subunit (RPN2), putative
  Pfam annotation: Domain name=PC_rep; Domain location=362-395; Score =22.6; E_value=0.0014; Accession=PF01851.13; Description =Proteasomecyclosome repeat
  Pfam annotation: Domain name=PC_rep; Domain location=402-435; Score =28.1; E_value=3.3e-05; Accession=PF01851.13; Description =Proteasomecyclosome repeat
  Pfam annotation: Domain name=PC_rep; Domain location=437-471; Score =33.9; E_value=6e-07; Accession=PF01851.13; Description =Proteasomecyclosome repeat
  Pfam annotation: Domain name=PC_rep; Domain location=472-505; Score =28.0; E_value=3.5e-05; Accession=PF01851.13; Description =Proteasomecyclosome repeat
  Pfam annotation: Domain name=PC_rep; Domain location=541-576; Score =11.4; E_value=0.35; Accession=PF01851.13; Description=Proteasomecyclo some repeat
  Pfam annotation: Domain name=PC_rep; Domain location=577-609; Score =15.9; E_value=0.083; Accession=PF01851.13; Description =Proteasomecyclosome repeat
  Pfam annotation: Domain name=PC_rep; Domain location=611-645; Score =34.1; E_value=4.9e-07; Accession=PF01851.13; Description =Proteasomecyclosome repeat
  Pfam annotation: Domain name=PC_rep; Domain location=689-718; Score =15.3; E_value=0.099; Accession=PF01851.13; Description =Proteasomecyclosome repeat
  Pfam module annotation: Pfam domain module=PC_rep::PC_rep::PC_rep::PC_ rep::PC_rep::PC_rep::PC_rep::PC_rep; Domain location=362-395::402 -435::437-471::472-505::541-576::577-609::611-645::689-718
MLKIEPVCFDICVEQRVWTRESLHEDEEFDQHQRQLAALLVSKVFYYLGELNDSLSYALGAGPLFDVSEDSDYVHTLLAKAIDEYASLKSKAAESSDESIKMDPRLEAIVERLLDKCIVDGKYQQAMGTAIECRRLDKLEEAITRSDNVQGTLSYCIYVSHSFVNLREYRQEVLRLLVKVFQKLPSPDYLSICQCLMFLDESEGVASKLEKLLRSENKDDALLAFQIAFDLVENEHQAFLLNVRDRLAPPKSQPSESSQPKPSETASTQNASASGQDDVQMADDDSAPMVNVPEDPIETMYAERSDLLILKTIKQSVEMRNSVCHSATIYANAIMHAGTTVDTFLRENLDWLSRATNWAKFSATAGLGVIHRGHLQQGRSLMAPYLPQGGTGAGGSPYSEGGALYALGLIHANHGEGIKQFLRDSLRSTTVEVIQHGACLGLGLASLGTADEDIYEEIKNVLYTDSAVAGEAAGISMGLLMVGTGSEKANEMLTYAHETQHEKIIRGLALGIALTVYGREEEADTLIEQMTRDQDPILRYGGMYALALAYRGTANNKAIRQLLHFAVSDVSDDVRRTAVLALGFVLYSDPEQTPRIVSLLSESYNPHVRYGAALAVGISCAGTGLSEAISLLEPLTSDVVDFVRQGALIAMAMVMVQISEASDSRVGTFRRQLEKIILDKHEDTMSKMGAILASGILDAGGRNVTIRLLSKTKHDKITAVVGLAVFSQFWYWYPLIYFISLSFSPTAFIGLNYDLKSPKFEFLSHAKPSLFEYPKPTTVPTTTSTVKLPTAVLSTSAKAKARAKKAEEQKANAEISSAPDSASAVPSGGKGKSSGEKDGDSMQGIGIVDCNSVTEVISSLCYKVDSPTTEKKSEPEPSFEILTNPARVVPAQEKFIKFLQDSRYVPVKLAPSGFVLLKDLRPTEPEVLALTDTPSSTTSAAGGSATGLQSSSSAMAVDEEPQPPQPFEYTS

SEQ ID NO: 98258 - protein, 411 aa, Glycine max
  Coding DNA Sequence Number=SeqID_6573
  Gene Ontology: Mol. function=metal ion binding; Cellular component =nucleus; Biological process=regulation of transcription, DNA -dependent
  Homolog annotation: Hit_ID=A7PGY6; Match level="QueryCoverage=97%, HitCoverage=97%, E-value=6e-78, Identity=45%"; Hit description =Chromosome chr17 scaffold_16, whole genome shotgun sequence
  Pfam annotation: Domain name=PHD; Domain location=362-406; Score= -0.8; E_value=0.016; Accession=PF00628.20; Description=PHD-finger
  Pfam annotation: Domain name=zf-C3HC4; Domain location=363-403; Score= 32.2; E_value=1.9e-06; Accession=PF00097.16; Description=Zinc finger, C3HC4 type (RING finger)
  Pfam module annotation: Pfam domain module=PHD::zf-C3HC4; Domain location=362-406::363-403
MPVTNTTTPTVAEHIKWRRPRNQFNHHQHPISETDPNPQIPSIIQSTRCKSTISSLLLSTFSNNTSSNNDTPTTFNATAHSKKKSNFSASTFRGLGCTAGASQQVSVPAVIRSSADWQGKKTRKKKHKRSSSSSKNKTFHGGVLEGSNPECVDFQDVWCGPGIGFSTDAAAAASVDCVVARKNVSSARGKIDVDKITHREMQRSVVDYCGAFFGIEVVTLVGDMDPFFMGLDRHRSSYVGRRTETFTFLDSTDPDIFTPRSASDSYGTATYYRHVRDPSSDGFAEIMMLQGSLLMGGQLNSHDHFKDWRLDVDNMSYEQLLELGERIGHVNTGLKEDEMGRNIRKTRLQFWDDTSKHQVDKECSICQEEYEAGNELGRLNCEHIYHFQCIKQWAAQKNFCPVCKQQVAARH

SEQ ID NO: 98259 - protein, 50 aa, Glycine max
  Coding DNA Sequence Number=SeqID_6574
MVSINVVWTEVSLVCQHPHHRFSHHFGHALVIDVIKELLIIIFTKIMFSL

SEQ ID NO: 98260 - protein, 190 aa, Glycine max
  Coding DNA Sequence Number=SeqID_6575
  Subcellular localization annotation: CTP_CleavageSite=51; ConfidenceScore=5.34e-01
MLTALAPKVPASTSTTGKKMRHRSRLGNKVPDRQPHGVTTHQTLVPRETIECGVKSNEDGISEERKKRVGEARDRVGFVDDNVGAASELGSDAGGERDVAAGADNHVRLEVSEVAETLDERLQETDRGEVVACGGDCGAFHAVGGAQEEELARGVGGFELLRDGQRRIHVAAGAVAGERHADRVIVGVGG

SEQ ID NO: 98261 - protein, 99 aa, Glycine max
  Coding DNA Sequence Number=SeqID_6576
  Subcellular localization annotation: CTP_CleavageSite=49; ConfidenceScore=5.37e-01
MEILNEWLGAVGERKKLKLFVQGYPVSNPASSQTLTVFGCTSSSPKRVSVMVKRGKNQNYESVLAFKAKMSSGEMVLVFLKMVAAAVGLGREILTGYRF

SEQ ID NO: 98262 - protein, 499 aa, Glycine max
  Coding DNA Sequence Number=SeqID_6577
  Gene Ontology: Mol. function=drug transporter activity; Cellular component=integral to membrane; Biological process=response to nematode
  Homolog annotation: Hit_ID=A7PH11; Match level="QueryCoverage=96%, HitCoverage=98%, E-value=0.0, Identity=68%"; Hit description =Chromosome chr17 scaffold_16, whole genome shotgun sequence
  Pfam annotation: Domain name=MVIN; Domain location=88-499; Score= -223.2; E_value=0.057; Accession=PF03023.5; Description=MviN-like protein
  Pfam annotation: Domain name=MatE; Domain location=288-432; Score =90.0; E_value=7.8e-24; Accession=PF01554.9; Description=MatE
  Pfam annotation: Domain name=MatE; Domain location=56-227; Score =117.5; E_value=4.1e-32; Accession=PF01554.9; Description=MatE
  Pfam module annotation: Pfam domain module=MVIN::MatE::MatE; Domain location=88-499::288-432::56-227
MDREDQKASLLSQLIHITVEDRLKVDNIQRNKDKQQAIERAELYEEVRKQLWLAGPLISVSMLNYSQQIISVMFVGHLGQLPLSGASMATSFASVTGFSLLYYAKQLPNTNVVGMASALDTLCGQSYGAKQHHMLGIHMQRAMLVLMIVSINLAFIWANTRSILVALGQDPEISAEAGQYAQLMIPSLFAYGILQCLNRFLQTQNIVFPMVFSSGVTTLLHILICWTMVFKSGLGNKGAAIANAISYWINVLILILYVKFSPSCSKTWTGFSKEALHGIPSFLKLAIPSALMLLHMLDNFCLTSLNTSTSVWMIPFGLSGAVSTRVSNELGAGHPRAARLAVYFVFIMAIIEGTFVGAVMIIIRNIWGYAYSNEAEVVQYVAIMLPILATSIFLDALQCVLSGTARGCGWQKKGAFINLGSYYLVGIPSAILFAFVLHIGGKGLWLGIICALVVQVSCLLIITIRTDWEQEAKKVKDRVYDSMRAELLNSDIALSLFNL

SEQ ID NO: 98263 - protein, 80 aa, Glycine max
  Coding DNA Sequence Number=SeqID_6578
MTYEVALVKGKICSLKRQQQHASTGIGLRFGATGSVGVGNVSHLASLHYNALPISHCHWLECSVSLPMGFFHHGYVQSSS

SEQ ID NO: 98264 - protein, 112 aa, Glycine max
  Coding DNA Sequence Number=SeqID_6579
  Gene Ontology: Mol. function=nucleotide binding; Cellular component =nucleus; Biological process=translational termination
  Homolog annotation: Hit_ID=A7PH23; Match level="QueryCoverage=58%, HitCoverage=14%, E-value=1e-22, Identity=79%"; Hit description =Chromosome chr17 scaffold_16, whole genome shotgun sequence
MEVGGHHIMNFTLVISDPKQEVEAEPKAVEAEPKVKDKEIPSVQDEEDVPEMTKRHLNVVFIGHVDAGKSTTGGQILFLSGQVDERTIQKYEKEAKDKSRESWLAHLLLFFD

SEQ ID NO: 98265 - protein, 314 aa, Glycine max
  Coding DNA Sequence Number=SeqID_6580
  Gene Ontology: Cellular component=integral to peroxisomal membrane; Biological process=peroxisome organization and biogenesis
  Homolog annotation: Hit_ID=A7PH34; Match level="QueryCoverage=87%, HitCoverage=87%, E-value=6e-69, Identity=46%"; Hit description =Chromosome chr17 scaffold_16, whole genome shotgun sequence
  Pfam annotation: Domain name=Peroxin-3; Domain location=11-301; Score= -128.4; E_value=0.00055; Accession=PF04882.3; Description=Peroxin-3
MLSLIGCIFVIVLRHRRKVFVTVGVLGSGYLLYKLYGAQRHGVQELERELAVQRETEDLMKAQMQAHFENIQKMSDVTLPHAMHELSCRITEELDLSHLLERLIQGKGQPNTLTQSEKLDLWSRLKILSMNLESGDVVDREDQKKFLDNIDFLSQHGMPALISDMEAATKEVLKGTTLHETIMQILNSFMSMGTPNSWIKYMIPEDVRPYSTTYGSDDPVPFDMTEFEQLMMEAWAVLSSAEFGSIVEISLKAVVDTLVELMGTKFSGGSVAGGLPLARVLPQVAQIAVHGNDFFISSIYFIRAVLVRLAFQMF

SEQ ID NO: 98266 - protein, 173 aa, Glycine max
  Coding DNA Sequence Number=SeqID_6581
MLSDLPETASLKAVDGCVAMSPDKSPSVPVEGEALVSPQCQGETAEKSKGVLMAAATTTGGRSKKQRPSKLSPKLLGVYLACLGWVLVWRRGDREGEEEEGERRRRRPWGNENESEKEGSVVEVVFGNIVGGVVVCGWLVLRCGQDRTREGTTNLVGEVANVRRVHTWTLLIG

SEQ ID NO: 98267 - protein, 635 aa, Glycine max
  Coding DNA Sequence Number=SeqID_6582
  Gene Ontology: Mol. function=actin binding; Cellular component =cytoskeleton; Biological process=sensory perception of sound
  Homolog annotation: Hit_ID=Q1SN19; Match level="QueryCoverage=88%, HitCoverage=97%, E-value=0.0, Identity=84%"; Hit description=WD40 -like
  Pfam annotation: Domain name=WD40; Domain location=136-175; Score =21.9; E_value=0.0023; Accession=PF00400.23; Description=WD domain, G- beta repeat
  Pfam annotation: Domain name=WD40; Domain location=204-242; Score =43.5; E_value=7.4e-10; Accession=PF00400.23; Description=WD domain, G-beta repeat
  Pfam annotation: Domain name=WD40; Domain location=295-334; Score =17.8; E_value=0.042; Accession=PF00400.23; Description=WD domain, G -beta repeat
  Pfam annotation: Domain name=WD40; Domain location=409-446; Score =8.3; E_value=3; Accession=PF00400.23; Description=WD domain, G-beta repeat
  Pfam annotation: Domain name=WD40; Domain location=452-490; Score =20.2; E_value=0.008; Accession=PF00400.23; Description=WD domain, G -beta repeat
  Pfam annotation: Domain name=WD40; Domain location=48-86; Score=26.5; E_value=0.0001; Accession=PF00400.23; Description=WD domain, G-beta repeat
  Pfam annotation: Domain name=WD40; Domain location=495-533; Score =36.0; E_value=1.4e-07; Accession=PF00400.23; Description=WD domain, G-beta repeat
  Pfam module annotation: Pfam domain module=WD40::WD40::WD40::WD40::WD4 0::WD40::WD40; Domain location=136-175::204-242::295-334::409 -446::452-490::48-86::495-533
MSHELLETYACMPTTERGRGILISGDAKSNSVVYTNGRSVVMMNLQNPLHVSVYGDHAYPATVARFSPNGEWVASADASGTVRIWGTRNDFVLKKEFRVLSARIDDLQWSPDGLRIVACGEGKGKSFVRAFMWDSGTNVGEFDGHSRRVLSCAYKPTRPFRVVTCGEDFLVNFYEGPPFRFKLSHSVSSDKKGVIFDGKSAEKIGELSSEGGHTGSIYAVSWSPDGKQVLTVSADKSAKVWDITEGNNGKVKKTLTCAGSGGVEDMLVGCLWLNDYLVTVSLGGTISIFLATDLDKAPTTFSGHMKNVSSLTILRSNPRVLLSSSYDGLIVKWIQGIGYSGKLHRKENSQIKCLAAVEEEIVTSGFDNKCGDTEAIDIGSQPKDLSVALLSPELALVSIDSGVVMLRGTKIVSTINLGFIVTASAVSPDGSEAIIGGQDGKLHIYSVSGDTLVEEVVLEKHRGAISVIRYSPDVSMFASGDVNREAVVWDRASREVKLKNMLYHTARINCLAWSPDSHRIATGSLDTCVIIYEVDQPASSRITIKGAHLGGVYGLAFTDEYSLVSSGLIEVKTDDDVLITISWSYTILLQISSLVWWSLLTLVGINMDIESFCVKSVDRLENTDNEFSPPKAPPL

SEQ ID NO: 98268 - protein, 243 aa, Glycine max
  Coding DNA Sequence Number=SeqID_6583
  Gene Ontology: Mol. function=binding; Cellular component=nucleus; Biological process=mRNA modification
  Homolog annotation: Hit_ID=A4PRI6; Match level="QueryCoverage=89%, HitCoverage=83%, E-value=4e-55, Identity=44%"; Hit description =Tetratricopeptide-like helical
  Pfam annotation: Domain name=PPR; Domain location=119-153; Score =33.0; E_value=1.1e-06; Accession=PF01535.11; Description=PPR repeat
  Pfam annotation: Domain name=PPR; Domain location=180-214; Score =11.7; E_value=0.32; Accession=PF01535.11; Description=PPR repeat
  Pfam module annotation: Pfam domain module=PPR::PPR; Domain location =119-153::180-214
  Subcellular localization annotation: CTP_CleavageSite=34; ConfidenceScore=5.17e-01
MARDTSKNIKFASSPINNYLRYYVKTLRGKFNLRRLHSSNFQVQRPTNYPKPHFKGPHIVKRTKAISTHMRNGHCDLALRVFEAIPLRNSVSYNAMISGNGRFRDARVLFDSMPENDAVSWNAMLSGYVWSGHVDEARDVFDRMPHKSQEFRPSPGMGYLQHMFRVGDSRRLVAYLSPNQTGNCLMGGYVKTNMLGDAKQLFDQMPVRDVISWNTMISGYEQDRDLSQARRWFEESPVRDVFT

SEQ ID NO: 98269 - protein, 285 aa, Glycine max
  Coding DNA Sequence Number=SeqID_6584
  Homolog annotation: Hit_ID=Q1SMZ3; Match level="QueryCoverage=98%, HitCoverage=92%, E-value=8e-99, Identity=70%"; Hit description =Prefoldin
  Pfam annotation: Domain name=CASP_C; Domain location=48-269; Score= -94.3; E_value=0.0097; Accession=PF08172.3; Description=CASP C terminal
MVKQVSELRQQISSKELFHEELRRRMKNPRQTGASQNQLVSKSVELEREIHEAEHSLINNKVAQLQEKARKLEADIEMTRKEIEEPTEVEVELKRRLQQMTDHLIQKQAKVRVSYIHLVVIVCECSWITVLNSDWTCLSDQSVQQVESLSSEKASLVFRIEAVSRLLDENMSASGAANMNPASSSSDLESGLWELSNSKLKPMLKARIHSGKIQLGSLLQQLDYIFVTGALFLKRNSTAKLWALIYLVCLHFWVFYILLSHSSPSNEGRSGAQISLENINNTGGV

SEQ ID NO: 98270 - protein, 77 aa, Glycine max
  Coding DNA Sequence Number=SeqID_6585
MVILTGPWKLRAAQFNGRTGRISQQGQRSRRRGLNLKDYRERINNTINHREYTAPNNGKNLLKENCDRFQKLGIEIK

SEQ ID NO: 98271 - protein, 57 aa, Glycine max
  Coding DNA Sequence Number=SeqID_6586
MEVEKGKSRSKMEMEEVLLSLIVEHFLNSSKIKETCDLVEMDLSSIPYEILSKVNIG

SEQ ID NO: 98272 - protein, 617 aa, Glycine max
  Coding DNA Sequence Number=SeqID_6587
  Homolog annotation: Hit_ID=A7QQY2; Match level="QueryCoverage=46%, HitCoverage=58%, E-value=6e-46, Identity=38%"; Hit description =Chromosome undetermined scaffold_146, whole genome shotgun sequence
MDEDQWMYESIMSEEVDMNYQNEEECDVNESHVDCSDAFNTSQRMFYGGLDPLLMKMNLWRNDEYRCRKKEFVRRDIETRKCGCRFKLRGKLVVGGQGWMVKLMCEIHNHELVKSLVGHPYVGRLAKAEMTLIADMTKSMDEDVVRDIFWCHPDAVKLVNYVMDVWGTLVDCPSKQQFDEWLKKFEMVCSSWSITEQQKLAEERKNKRHSQEGRRGTSRKKNNDLADEAGREPHGRRRSSSQMNVMDLEPWEALDVDDTNLSAFLRPCNSNSDSSSLIPGPAGAVQAVMRNRRHHDPLSTQEFLKRVERQSDRDFNTNPWLCALQFVHLQGGDDDVAHGTPLSSIQNNAETERVPLIVALVKSSTPNGFGDITVNLKDPTATLTATVHRKVFSHPDLRKEILTVGSVLILQKVAVFSPNRNTRYLNITLHNIVKVFPKDSGPPSQQLTYPACPVIRTTPSMGSTFSLPLERTEGIMSNLRFDSSFRQVADSDRQRSEVLASTSFRSDNGNDQNRETVSEGENLSLSLDNAGPVKVNCGGELESEVEDQPNPPKLDEGGDILARIAQGNSSATNSIPTSHGEKTGMENHFERQTQMVNKKCSFPHWTEEQLDELLAFD

SEQ ID NO: 98273 - protein, 828 aa, Glycine max
  Coding DNA Sequence Number=SeqID_6588
  Gene Ontology: Mol. function=protein binding
  Homolog annotation: Hit_ID=Q3ECU5; Match level="QueryCoverage=99%, HitCoverage=85%, E-value=2e-95, Identity=30%"; Hit description =Uncharacterized protein At1g48540.1
  Pfam annotation: Domain name=LRR_1; Domain location=22-43; Score=0.6; E_value=2.4e+02; Accession=PF00560.24; Description=Leucine Rich Repeat
  Pfam annotation: Domain name=LRR_1; Domain location=45-65; Score=7.4; E_value=13; Accession=PF00560.24; Description=Leucine Rich Repeat
  Pfam annotation: Domain name=LRR_1; Domain location=67-87; Score =10.3; E_value=3.8; Accession=PF00560.24; Description=Leucine Rich Repeat
  Pfam module annotation: Pfam domain module=LRR_1::LRR_1::LRR_1; Domain location=22-43::45-65::67-87
DALRHVFASRITEVKNSPQWNRLSFVSCACNGLVLMDESLQLLPAVETLDLSRNKFAKVDNLHKCTKLKHLDLGFNHLRTFAPFTQEILCVVLDGIEHKYSASSPTQKGMHKQPASFGIYVPAKDEAVIEGGNIRRKKVSRLVSIKNEETTSICSDEDSASCANDIQNRQDPDLSDNEAEIVDLINRVEHMKKERSIHWLREFKDWMDTASDKSVETRKEGGASLHHQKENYIRKKTNQEQSGDISRYASDSVLASGDDSSMNILESDSSFVDMSASYHRQQHFDYRGLLGNVSGASHFDSRGVDMERLKSSLEGISSSLSQPRSSHSDTVTTQGAQRMTENVNISPLITIHDISGSQSSSACPTSPPHFQEDLLHRRQHLVEEILQLSADSFSVASSDSNTSCSEVDCSEFESSVPKVDNFPCKYYMNGSVDGHLSQNLLKEKFYNPRQGILHARENGNSLSSPTCDPTSKQHSIDFAAGADNAESAFCASQDTGLLEKRKIRKKAKKRIISILEENLDGDASDHTQEQISQGQISPNLKQELDIDDSTEFSGRNYSTQENDDLIVTYFNTSIADSEASELLKPSLICHPGTLLSVLSCHKIEEVCEVLVGMGLQVLRVNFENGETYLFVTRSIEKSRELLCTIHVLDSCGGNGRCSIRSLEQIQVELFDNQICGGSNVSIYQYAMVLVFSKYGSEESWLSRSLFVIGGNVLICIEDLKQLYSLSSNASASPYFRIDSCCSIADIAEMVIEVGGSCCVTLGLTCPRAELHPSTQMNLQTVNHENTAPGSLKLKLQWFSKDHLVKFVSLLKTIHEKETGSPLVVRCIS

SEQ ID NO: 98274 - protein, 152 aa, Glycine max
  Coding DNA Sequence Number=SeqID_6589
MGHLPSMSSTLPPKQNLGEKVVKGVQHIELRSNIARVFEEKHVLDCGCTHNHGSDGVVNGNVFKGEDDLGWVIGRRLKGEVVFVVLEVILTGKKKKGVINGNKYGVKSDGKVDKVEEEGGTREVGRGGSRGRRSRIGRAQCMGRTKHLTHRM

SEQ ID NO: 98275 - protein, 106 aa, Glycine max
  Coding DNA Sequence Number=SeqID_6590
MAGDVHILRDIAFSTKALSGKRSRHVTCWSQEGSEVVDGEDEVLAVSLAHLFDLQLLQLCEMAEVVVERLQLAGGEGLADEGLEGEEIRKGWVLGTLLGRGNLEFQ

SEQ ID NO: 98276 - protein, 385 aa, Glycine max
  Coding DNA Sequence Number=SeqID_6591
  Gene Ontology: Mol. function=D-erythro-sphingosine kinase activity; Cellular component=membrane fraction; Biological process=activation of protein kinase C
  Homolog annotation: Hit_ID=A7QYH0; Match level="QueryCoverage=99%, HitCoverage=78%, E-value=1e-154, Identity=69%"; Hit description =Chromosome undetermined scaffold_247, whole genome shotgun sequence
  Pfam annotation: Domain name=DAGK_cat; Domain location=10-151; Score =101.3; E_value=3e-27; Accession=PF00781.15; Description =Diacylglycerol kinase catalytic domain (pres
DVNGTGRPKRLFVFVNPFGGTKSAVIVFRDQVKPLLEDAQVQLTVQETKHQLHAKQVVQSLDFSKYDGIVCVSGDGILVEFVPSTIVIVVVNGLLQRQDWDTAIKMPLGVVPAGTGNGMAKSLLDSVGDPCTVPNAVLAIIRGRKRKLDVATITQGETRFFSVLMLAWGLVADIDIESEKYRWMGSARIDFYALTRILHLRHYIGCLYFVPAPGFEAYGDPTSYPGSSNNKGSNSELIDEEPLKLQRLGYQGPEIDLENQSWRVLNGPFISVWLHNVAWGAENTKAAPDAKFSDGYLDLIITKNCPKLPLLSLMSDLNNGGHVKVLVLEPGPRLGDQEKEGIIDADGEVLARGKGSYQCEQKALMAYDKLQITVDQGLATIFSPI

SEQ ID NO: 98277 - protein, 91 aa, Glycine max
  Coding DNA Sequence Number=SeqID_6592
  Homolog annotation: Hit_ID=A7QEI7; Match level="QueryCoverage=41%, HitCoverage=9%, E-value=1e-09, Identity=70%"; Hit description =Chromosome chr17 scaffold_85, whole genome shotgun sequence
MDEQTFSIIQVKCSRLGTVIILSLRSPKGLLKNKGVTQGGDWVFCHSGVAGYEWDIGHFHGAQRPSVDCFRNTSFGLSQEEVGPLSDVSGT

SEQ ID NO: 98278 - protein, 225 aa, Glycine max
  Coding DNA Sequence Number=SeqID_6593
  Homolog annotation: Hit_ID=Q8W494; Match level="QueryCoverage=71%, HitCoverage=87%, E-value=3e-15, Identity=33%"; Hit description =Putative uncharacterized protein
MEVEAVQQQRKGAHLKKRALKNKALGITFNEKDLTDYVTGFHKRKKKRRKEAQKQQNEALRRKRTEERKRRKLEREHVLNGGVPPPDEIDGDQEETEEQVESIAETKTYENDDLKVTVVTSEINPEDGSYPSERKEAAVIPPSVVSDKRQGVPISNKKSFKKVAKQRSRPRPSRFGRVSSSWLPNWFLMSMTGVSSSGLFLTFHFGDSRVMEETPNFSPFLLVNR

SEQ ID NO: 98279 - protein, 313 aa, Glycine max
  Coding DNA Sequence Number=SeqID_6594
  Homolog annotation: Hit_ID=Q2HTY2; Match level="QueryCoverage=90%, HitCoverage=95%, E-value=1e-48, Identity=43%"; Hit description =Putative uncharacterized protein
MDETKILLELKSVSSLCVHSFINLLCEETISFLSVFSSDPLFHCIVAFCTLVFLYLPHLFLKIILSPVPILTAILLLSILRLGAIQRLQHERRENHVKHEEQPIVYEENKGSKYKGEKQSPCTIEPDETKSVEQVHQWVHSETEVISDMGFESSSRFVEWNVKAPLEVIYEEYGEGEEAGDDANENVGIMRYPSLSRFYPESDSDSESESEFPAIGDWDSPEDLEFRWGEEEEEDDGDDDDEEEEDREGLIEIALDGCKRKRNLEFNFDEENLIEIDISPSRYRELSGDDEVFSVMVAMKIHGGGSGREEEEG

SEQ ID NO: 98280 - protein, 141 aa, Glycine max
  Coding DNA Sequence Number=SeqID_6595
  Homolog annotation: Hit_ID=Q2HTU7; Match level="QueryCoverage=93%, HitCoverage=64%, E-value=2e-42, Identity=56%"; Hit description =Uncharacterized Cys-rich domain
  Pfam annotation: Domain name=PLAC8; Domain location=45-141; Score= -0.1; E_value=0.012; Accession=PF04749.8; Description=PLAC8 family
MGDLEKKQERVMEEEDKERLVEGVAVLDFDMLCSTVALRAAHGKWGKLGVEDRGRRRRGGCCPCYRFGKNMKRADFGSCYIQGAIYFLLAIGAFLNFIAFAVTRRHCYLYLIVAFGAYLGFFRTRIRKKFNIIVGVFCNCL

SEQ ID NO: 98281 - protein, 74 aa, Glycine max
  Coding DNA Sequence Number=SeqID_6596
MAASRRSTQAVESSVSVIEEWQLLYTIACLHSHYNNRYNNRYNNHYNNHTPTTITATRMITTPMTGFHGRASSS

SEQ ID NO: 98282 - protein, 238 aa, Glycine max
  Coding DNA Sequence Number=SeqID_6597
  Gene Ontology: Mol. function=NADPH:quinone reductase activity; Cellular component=flagellum; Biological process=negative regulation of transcription
  Homolog annotation: Hit_ID=Q8L5Q7; Match level="QueryCoverage=85%, HitCoverage=99%, E-value=2e-96, Identity=85%"; Hit description =Putative quinone oxidoreductase
  Pfam annotation: Domain name=FMN_red; Domain location=45-222; Score= -35.9; E_value=0.019; Accession=PF03358.6; Description=NADPH -dependent FMN reductase
  Pfam annotation: Domain name=Flavodoxin_1; Domain location=43-172; Score=68.6; E_value=2e-17; Accession=PF00258.16; Description =Flavodoxin
  Pfam module annotation: Pfam domain module=FMN_red::Flavodoxin_1; Domain location=45-222::43-172
MFLWPQPFPLFLMPIQRRQALFEWFLTVSNELSMSSCLVWWCYYSTYGHVEKLAEEIKKGAGSVEGVEAKLWQVPETLSEEVLGKMGAPPKSDVPIITPNELPEADGLLLGFPTRFGLMAAQFKAFMDATGGLWRTQALAGKPAGIFYSTGSQGGGQETTPLTSITQLVHHGMIFVPIGYTFGAGMFEMENVKGGSPYGAGTYAGDGSRQPTELELAQAFHQGKYFAGIAKKLKGSSQ

SEQ ID NO: 98283 - protein, 470 aa, Glycine max
  Coding DNA Sequence Number=SeqID_6598
  Homolog annotation: Hit_ID=A7PXL9; Match level="QueryCoverage=92%, HitCoverage=65%, E-value=6e-55, Identity=37%"; Hit description =Chromosome chr12 scaffold_36, whole genome shotgun sequence
  Subcellular localization annotation: CTP_CleavageSite=36; ConfidenceScore=5.24e-01
MSKKKVSGNTMTLKDFHGGSIPSDLPLPSAPGVTVRTSDRAGFDRPSAWGTPMGRSDHWSRPHTSPATRHYDDKTPFLSHTAPIGRNFDEDERKPLDGGSMPRRTISDESIRGGPPPRVEVRPPEFGLGGSSLGRQVAPVSQTPVGAGNSYSGRLTDAVHVGMNPPSLGGSKEQGTAAGGGGYPNAWSMRKEVASAVEPEQPAWSSAGAASKLAHASALEKVSSGRWQSKAVNYQTDAEVVRSPEVENRPHVNVNGVGAYNRTEAVGEKEYYDAMLARHAERGLGIDNPMQGGRNELPNYERSGVSRYSDVRPTSAPHHSGGVQLARNDGKIVGSDLQHPMPSELTERPKLKLLPRAKPVESSEPAVMDYAQGNRQVNDSGHVETVYQAHGHANFVKPVSAGNDNGKDAGQRPKLNLKPRSQPTEKLDGNSERDRIMENLKSFTLALLLSKGHNLEEQLCSLKSKSDGEK

SEQ ID NO: 98284 - protein, 279 aa, Glycine max
  Coding DNA Sequence Number=SeqID_6599
  Gene Ontology: Mol. function=branched-chain-amino-acid transaminase activity; Cellular component=chloroplast; Biological process =branched chain family amino acid metabolic process
  Homolog annotation: Hit_ID=A2Y7C6; Match level="QueryCoverage=93%, HitCoverage=60%, E-value=9e-89, Identity=60%"; Hit description =Putative uncharacterized protein
  Pfam annotation: Domain name=Aminotran_4; Domain location=48-279; Score=146.4; E_value=7.7e-41; Accession=PF01063.10; Description =Aminotransferase class IV
MALSHQPAANGEAEDSYNKMDWDKLGFQVIPTDFMYIMKSNEEGTFSNGDLVPFGTVQIEPHSTVLNYGQGLFEGMKAYRRADGEVQIFRPEQNAMRMQMGAERLLMVAPSVEQYVDAVKQVVHANKRWVPPHGKGALYIRPLLFGSGSVMGIAPAPHCTFLIYTNPISNAYKGRHTNSTLSLLIEDTLPRAFPGGTGGVKNIGNYAPVFQVTKEAKAKGFFDVLFLDAEEHKYIEEVSSCNVFMVKGDVISTSPTLGTILPGITRNSIIQLARDLGYQ

SEQ ID NO: 98285 - protein, 814 aa, Glycine max
  Coding DNA Sequence Number=SeqID_6600
  Gene Ontology: Mol. function=microtubule motor activity; Cellular component=microtubule associated complex; Biological process =microtubule-based movement
  Homolog annotation: Hit_ID=A7R222; Match level="QueryCoverage=97%, HitCoverage=97%, E-value=0.0, Identity=60%"; Hit description =Chromosome undetermined scaffold_394, whole genome shotgun sequence
  Pfam annotation: Domain name=Kinesin; Domain location=457-792; Score =472.3; E_value=6.2e-139; Accession=PF00225.14; Description=Kinesin motor domain
MASRNHSTSKKVGPEEASLDKRRRILGADKMDRQQGGSRVRTPFSVVTNTAATSDTANAAEGAAVVVDFTKDEVEALLNEKKKGNTYDNKKKIEQMMDLIKRLKLCVRWFKRIEEGYMQEKEKLQSELETAEKKCTDTDLRRRCYLCIVVLYAAWLAGTEMKSKIEELEETVSDLRKTISSLEERIVKEESDKLEAINSYGKEKEARTEAEKVRDEKSAELEKVRDEKSVAVKKAISNEDLYKRSQEYNMSLQQYNSRLQSDLETVNEAHKRLETEKATIVESLSNVRGHNKALQDQLVSLKVSQDEAIKQKEILANELKCLREELKQIRDDRDCQLGQVHALTGEIAKYKEYTGKTCTQLDTLMIKTNALEETCSSQKEQIHILQQQLFAEKEKFKNADLSSLETRTMFEEQKRIIRELQDRLADIEFQVMEGEMLRKKLHNTILELKGNIRVFCRVRPLLPEDSTGTDMAVSFPTSTEVLDRGIDLVQSGQKYNFTFDKVFNHEASQQEVFIEISQLVQSALDGFKCMWDKVCIFAYGQTGSGKTYTMMGKPDAPDLKGLIPRSLEQIFQISQSLKDQGWKYTMHVSLYEIYNETIRDLLSLNRSSGNDHTRMENSAPTPSKQHTIKHESDLATLEVCSVDEISSLLQQAAQSRSVGRTQMNEQSSRSHFVFKLRISGRNERTEKQVQGVLNLIDLAGSERLSRSGATGDRLKETQAINKSLSSLSDVIFALAKKEEHVPFRNSKLTHFLQPYLGGDSKTLMFVNVSPDQSSAGESLCSLRFAARVNACEIGIPRRQTQTSTRSSESRLSYG

SEQ ID NO: 98286 - protein, 516 aa, Glycine max
  Coding DNA Sequence Number=SeqID_6601
  Gene Ontology: Mol. function=squalene monooxygenase activity; Cellular component=integral to membrane; Biological process =metabolic process
  Homolog annotation: Hit_ID=A7QGY6; Match level="QueryCoverage=99%, HitCoverage=99%, E-value=0.0, Identity=74%"; Hit description =Chromosome chr3 scaffold_95, whole genome shotgun sequence
  Pfam annotation: Domain name=DAO; Domain location=41-290; Score=-9.9; E_value=5e-05; Accession=PF01266.15; Description=FAD dependent oxidoreductase
  Pfam annotation: Domain name=FAD_binding_3; Domain location=39-399; Score=-77.4; E_value=2.9e-07; Accession=PF01494.10; Description=FAD binding domain
  Pfam annotation: Domain name=SE; Domain location=202-475; Score =647.1; E_value=1.5e-191; Accession=PF08491.1; Description=Squalene epoxidase
  Pfam module annotation: Pfam domain module=DAO::FAD_binding_3::SE; Domain location=41-290::39-399::202-475
MDYPYILGGIMACSFAFFNECAKTSSEGGICSSDEDAGSADIIIVGAGVAGAALAYTLGKDGRRVHVIERDLSEPDRIVGELLQPGGYLRLIELGLQVCILVNNSPDSADCVDEIDSQQVFGYALYMDGKNTKLSYPLEKFSSDISGRSFHNGRFIQRMREKASSLPNVKLEQGTVTSLLEEKGTITGVHYKIKSGQEFTAKAPLTIVCDGCFSNLRRSLCNPKVDVPSHFVGLVLENCNLPYANHGHVILGDPSPVLFYPISSTEIRCLVDVPGQKLPSLGGGEMACYLKTVVAPQVPPELYDSFIAAIDKGNIRTMPNRSMPASPYPTPGALLMGDAFNMRHPLTGGGMTVALSDIVVLRDLLKPLHDLHDASALCRYLESFYTLRKPVASTINTLAGALYKVFCASPDPARKEMRQACFDYLSLGGVFSDGPIALLSGLNPRPLSLVLHFFAVAIYGVGRLLIPFPSPKRMWIGARLISGASGIIFPIIKAEGVRQMFFPATVPAYYRTPPVH

SEQ ID NO: 98287 - protein, 341 aa, Glycine max
  Coding DNA Sequence Number=SeqID_6602
  Gene Ontology: Mol. function=branched-chain-amino-acid transaminase activity; Cellular component=cytoplasm; Biological process=branched chain family amino acid metabolic process
  Homolog annotation: Hit_ID=Q9LPM8; Match level="QueryCoverage=99%, HitCoverage=86%, E-value=1e-101, Identity=58%"; Hit description =Putative branched-chain-amino-acid aminotransferase 7
  Pfam annotation: Domain name=Aminotran_4; Domain location=53-340; Score=230.5; E_value=3.8e-66; Accession=PF01063.10; Description =Aminotransferase class IV
MSLPSVLGNSEDNSKSVAVENCAGINWDELGFNPVPTDFMYVMKCAKGEKFSEGSLIPYGNIEISPFAVILNYGQGIFEGLKAYRTEDGCILLFRPEENAQRMKIGADRLCMPSPSIDQFVAAVKQTVLANKRWNCTRQLAVVAIHHAVEVLVRVEVPPPGKGSLYIRPLLMGTGASLNLSPAPEYTLLIYCSPVTNYHKGSLNLKVESKFYRAISGTGGTGGIKSVTNYAPVYAASIEAKASGFSDVLFLDSATGKNIEEVSACNVFVVKGNAICTPATNGAILPGITRKSIIEIALDMGYQVTERAISVEEMLDADEVFCTGTAVVVNSVSSVTYKETR

SEQ ID NO: 98288 - protein, 397 aa, Glycine max
  Coding DNA Sequence Number=SeqID_6603
  Gene Ontology: Mol. function=protein binding; Cellular component =membrane of vacuole with cell cycle-correlated morphology; Biological process=mitochondrion organization and biogenesis
  Homolog annotation: Hit_ID=A5BCY3; Match level="QueryCoverage=100%, HitCoverage=100%, E-value=1e-144, Identity=65%"; Hit description =Putative uncharacterized protein
  Pfam annotation: Domain name=CBS; Domain location=182-298; Score =32.0; E_value=2.2e-06; Accession=PF00571.19; Description=CBS domain
  Pfam annotation: Domain name=DUF21; Domain location=14-163; Score =113.7; E_value=5.5e-31; Accession=PF01595.11; Description=Domain of unknown function DUF21
  Pfam module annotation: Pfam domain module=CBS::DUF21; Domain location=182-298::14-163
MAVEYTCCSTAFFVHILVIVLLVLFAGLMSGLTLGLMSLSLVDLEVLAKSGTPQDRKHAEKILPVVKNQHLLLCTLLICNAAAMEIIPQSVCSRYGLAIGASVAPFVRVLVCICFPVAYPISKLLDFLLGHRHEALFRRAELKTLVNLHGNEAGKGGELTHDETTIIAGALELSEKTASDAMTPISETFTVDINSKLDRELMNEILEKGHSRVPVYYEQPTNIIGLVLVKNLLTVHPEDEAPMKSVTIRRIPRVPESMPLYDILNEFQKGHSHMAVVVRRCDKTNQQSSQNNANDSVRDVKVDIDGEKPPKEKALKPKMPLHKWKSFPNTNKSSNRGSRSRKWSKNMYSDILEIDGSPLPKLPEEEEAVGIITMEDVIEELLQEEIFDETDHHFEDS

SEQ ID NO: 98289 - protein, 563 aa, Glycine max
  Coding DNA Sequence Number=SeqID_6604
  Gene Ontology: Mol. function=transporter activity; Cellular component= integral to membrane; Biological process=transport
  Homolog annotation: Hit_ID=A7R3Z5; Match level="QueryCoverage=77%, HitCoverage=86%, E-value=1e-167, Identity=68%"; Hit description =Chromosome undetermined scaffold_592, whole genome shotgun sequence
  Pfam annotation: Domain name=MFS_1; Domain location=48-483; Score =114.2; E_value=4e-31; Accession=PF07690.7; Description=Major Facilitator Superfamily
  Pfam annotation: Domain name=OATP; Domain location=45-503; Score= -227.6; E_value=2.5e-06; Accession=PF03137.11; Description=Organic Anion Transporter Polypeptide
  Pfam annotation: Domain name=Sugar_tr; Domain location=44-531; Score=- 160.2; E_value=0.01; Accession=PF00083.15; Description=Sugar (and other) transporter
  Pfam module annotation: Pfam domain module=MFS_1::OATP::Sugar_tr; Domain location=48-483::45-503::44-531
MAQQQEHEGKPESSSSQPESSLEPDMGTKSTMIPSTSWFTPKRLLAIFCVINLLNYLDRGAIASNGVNGSQRTCEGGTCKSGTGIQGDFNLNNFEDGVLSSAFMVGLLVASPIFASLAKSVNPFRLIGVGLSVWTLATLCCGFSFNFWSIAVCRMLVGVGEASFMSLAAPFIDDNAPVSQKTAWLAIFYMCIPAGYAIGYIYGGLVGNHFGWRYAFWVEAILMFPFAILGFFMKPLQLKGAHSSPALISCSSITSFPITKLLVHPGFAPTDSEKALILETVVSEVPDVGVSNGKDEALSLKEEFRDKSSHEPSRSKCAILDQFSRFLKDMKELLLDKVFVVNVLGYIAYNFVIGAYSYWGPKAGYSIYNMTNADMMFGGITVVCGILGTLAGGLVLDFMTNTISNAFKLLSLTTFIGGACCFGAFLFKSEYGFLALFAFGELLVFATQGPVNYVCLHCVKPSLRPLSMAMSTVAIHIFGDVPSSPLVGLIQDKINNWRTTALILTTIFFPAAAIWFIGIFLPSVDRFNEDSEHEVSSVERTSTAPLLEEGTAETSASGQSQEC

SEQ ID NO: 98290 - protein, 211 aa, Glycine max
  Coding DNA Sequence Number=SeqID_6605
  Homolog annotation: Hit_ID=A7QSB5; Match level="QueryCoverage=79%, HitCoverage=40%, E-value=2e-70, Identity=72%"; Hit description =Chromosome chr3 scaffold_157, whole genome shotgun sequence
MPLPPQRMELPPERAPEHDPHQLVEVGPTKLPLAPDRPGSVSGVADKGAKKWKKKGAWRGAYFPKFNVTVAYHRAVLLSRYQWQPKQPEAGVKDGSEGFYRVDVDVPADDWAKIAGFYDVLVFNTGHWWNRDKFPKEKPLVFYKAGQPIVPPLGMLDGLKVVLTNMVTYIQKEFPGNTLKFWRLQSPRHFYGGDWNQNGSCLFNKPLEEDE

SEQ ID NO: 98291 - protein, 48 aa, Glycine max
  Coding DNA Sequence Number=SeqID_6606
MDFRSIDCADVDAAHDETRKNKVKPEQHGSIDLGSKHATVGVDFKDIS

SEQ ID NO: 98292 - protein, 20 aa, Glycine max
  Coding DNA Sequence Number=SeqID_6607
MLGGSQDGSVCSAFRVCGAN

SEQ ID NO: 98293 - protein, 243 aa, Glycine max
  Coding DNA Sequence Number=SeqID_6608
  Gene Ontology: Mol. function=binding
  Homolog annotation: Hit_ID=A5B5A3; Match level="QueryCoverage=81%, HitCoverage=70%, E-value=5e-17, Identity=34%"; Hit description =Putative uncharacterized protein
  Pfam annotation: Domain name=DUF593; Domain location=149-242; Score =78.2; E_value=2.7e-20; Accession=PF04576.6; Description=Protein of unknown function, DUF593
  Subcellular localization annotation: CTP_CleavageSite=33; ConfidenceScore=5.04e-01
MQTTPSLLLHQRLPMDFPPAFNLLTEFGCGFVLLRSLSRIFNLLGLFLMLTFCFKLLRFGWNTKGSIRFLCDSGGIPKLRFCLDNVAREKVSKAKTKPLKKPRHPTSSSSFRRRPNESGERGNAVSDDGSEGKVENEREGCNEDEVFDVMTLRRIVRMERQKANAACADLEKERTAASSSAEEAMAMILRLQSEKSAAEIQATQFRRMAEQKLDYDQEVIESLQWTITQHEFQKCEVEDRIGM

SEQ ID NO: 98294 - protein, 125 aa, Glycine max
  Coding DNA Sequence Number=SeqID_6609
MTSPSQQPLGKTILMALLGFPPGVPPLPHISKINVDGSFLPLQGVSSEIVLDDPCPPHHPNGGLLLSLLEFFHRNWNVSIQFIGREANSVVHSLAALGLHQGSPLCILTSPPPSLAILPKKDSPV

SEQ ID NO: 98295 - protein, 378 aa, Glycine max
  Coding DNA Sequence Number=SeqID_6610
  Gene Ontology: Mol. function=methylmalonate-semialdehyde dehydrogenase (acylating) activity; Cellular component =mitochondrion; Biological process=valine metabolic process
  Homolog annotation: Hit_ID=A7QSD0; Match level="QueryCoverage=97%, HitCoverage=72%, E-value=1e-165, Identity=74%"; Hit description =Chromosome chr3 scaffold_158, whole genome shotgun sequence
  Pfam annotation: Domain name=Aldedh; Domain location=31-378; Score =263.5; E_value=4.5e-76; Accession=PF00171.13; Description=Aldehyde dehydrogenase family
  Subcellular localization annotation: CTP_CleavageSite=33; ConfidenceScore=5.06e-01
METRMLRLSIQRVRKLNFLRPQISALGRSHLSTAAEPSSSKSNPPATQEVVSQVPLSTHEEFKAAVSAAKEAFPSWRNTPITTRQRVMLKLQELIRRDMDKLALNVTTEQGKTLKDAQGDVFRGLEVVEHACGMATLQMGEYVSNVSHGIDTYSIREPLGVCAGICPFNFPAMIPLWMFPMAVTCGNTFVLKPSEKDPGASVMLAELALEAGLPEGVLNIVHGTHDIVNAICDDENIKAISFVGSNVAGMHIYSRAAAKGKRVQSNMGAKNHAIVMPDANVDATLNALVASGFGAAGQRCMALSTVVFVGGSKPWEDKLLERAKALKVNAGTEPDTDLGPVISKQAKERIHRLVQSGVESGARLLLDGRNIVVAVISS

SEQ ID NO: 98296 - protein, 53 aa, Glycine max
  Coding DNA Sequence Number=SeqID_6611
MTKEIASWSEGDQGNKSEGAGSNCPKYKIADCLAKMLEVIIPPCLQGIRDESK

SEQ ID NO: 98297 - protein, 392 aa, Glycine max
  Coding DNA Sequence Number=SeqID_6612
  Gene Ontology: Biological process=RNA-mediated posttranscriptional gene silencing
  Homolog annotation: Hit_ID=O81698; Match level="QueryCoverage=87%, HitCoverage=100%, E-value=1e-106, Identity=62%"; Hit description =Proline-rich protein
MAGKQVGEGLPANLAGMSKNQLYDIMSQMKNLIEQNQQQARQILIQNPMLTKALFQAQIMLGMVQAPQVVPKVQPMVSQNNQQPVQPTQQPNIQPAPLLPGHGGAQDQAGVSQTQIPLRKHQNQPSVPVSSAVPAARHQSQPMAAHSLPMPQHPKGHPTPQMALVSLPQSSQLPNIPPPSLQSSSQPLHPTQMATASSQLQQPMQTSGFPPLQPPLPPQIRPTALPTFHPQYPPQMGANMGFQHAGASHNLPQSMFHPGTKPSASVGSTFPQGQTPLPGQPSSQPPYQVGNMPLGPDFGNQAGNAMQVDRGSSWMLGPSENLAHLSGPPGPPSVVSGQMGAAAKQPLRPPGLTPEMEKALLQQVMSLTPEQINLLPPEQRNQVLQLQQMLRQ

SEQ ID NO: 98298 - protein, 404 aa, Glycine max
  Coding DNA Sequence Number=SeqID_6613
  Gene Ontology: Mol. function=hydrolase activity; Cellular component =mitochondrion; Biological process=cell division
  Homolog annotation: Hit_ID=A2Q1P1; Match level="QueryCoverage=66%, HitCoverage=67%, E-value=9e-71, Identity=52%"; Hit description =Dynamin central region; Dynamin GTPase effector
  Pfam annotation: Domain name=CHCH; Domain location=354-397; Score =37.3; E_value=5.6e-08; Accession=PF06747.4; Description=CHCH domain
  Pfam annotation: Domain name=GED; Domain location=148-211; Score= -8.7; E_value=0.016; Accession=PF02212.9; Description=Dynamin GTPase effector domain
  Pfam module annotation: Pfam domain module=CHCH::GED; Domain location= 354-397::148-211
  Subcellular localization annotation: CTP_CleavageSite=38; ConfidenceScore=5.08e-01
MDYINTSHPNFIGGSKAIEAAVQQTRSSRVGLPVSRVKDALESDKGPATERSGKSRSILARHANGVVADQGVRATSDVEKVVTSGNTGGSSWGISSIFGGGDNRVSVKEMTASKPHTTEPMHNVQSFSTIHLREPPSVLRPLESNSETEAVEITVTKLLLKSYYDIVRKNVEDLVPKAIMHFLDLNELPLEAETVERGYSLPEITTGLPKIRGLPTSSMYSTSSSGDYYEASPKNTKSKNKKSSHSGELQSPFQDSNGNGGPYTSGYPMAGRSARPAPRAAPRPAPVHHAPPPAPAQSGGGSMLGGIGSTIAQGMAFGTGSAVAHRAVDAVMGPRTIQHETVVTEAAAAAPAPTANTFGGDACSIHTKAFQDCLNGYGNDISKCQFYMDMLAECRKNSGATLSM

SEQ ID NO: 98299 - protein, 612 aa, Glycine max
  Coding DNA Sequence Number=SeqID_6614
  Gene Ontology: Cellular component=thylakoid membrane; Biological process=response to singlet oxygen
  Homolog annotation: Hit_ID=A7QM35; Match level="QueryCoverage=99%, HitCoverage=77%, E-value=0.0, Identity=58%"; Hit description =Chromosome undetermined scaffold_123, whole genome shotgun sequence
MSQLSRAVYLENYEDAARLKVAFAATANNDSVGRVMSYLNRAIKEERYGDAAFLRDKAGAGLVGWWSGISEGVNDPHGLIIRITPEHGRYVARSYSPRLSLDKAVYSHSLYRFKGTSIFSAICFLRMQLATSAAGIPLFEFFLTMDKKGEFKSQAVYLKQRGAFHGPPTTSSKTLDAAGRLSSVESTEDKSELFVVSTEDPENGNDRNDGSDPAEGMPGFQNVLKDMIPGVKVKVFKVITPEKVDKDLSNVIEKIIEDEDGDEDEDEEMENDAESLELEEIKSETDQEGDDEIEINAGLGTFEREDQNEFAVKIAIGGLVQKLSGNLSSRDLLRVPAMLEMKGRGSFSFTVEKEVNQQVGLDKGKSSSDKSTKFQGRRRVDHVIFDLAKFIGRGKIPSKVLKEVGELINLTLSQAQSHHQLSGSTIFNRIEIPASFDPLNVQCKPSNIFSFSSGLYIGAHGLYSSEVIHLRRRFGQWQEDNGAKEPSNIEFYEYVEALKLTGDPYVPAGQLETTLGQNIQDENGTPVAFRAKIGKRYQLPHKGIIPEEFGVIARYKGEGRLAEPGFQNARWVDGELVILDGKHLKAGPVVGFVYWAPGYHFLVFFNRLRLQQ

SEQ ID NO: 98300 - protein, 626 aa, Glycine max
  Coding DNA Sequence Number=SeqID_6615
  Gene Ontology: Mol. function=RNA binding; Cellular component =ribonucleoprotein complex; Biological process=mRNA metabolic process
  Homolog annotation: Hit_ID=A5AKJ4; Match level="QueryCoverage=95%, HitCoverage=77%, E-value=1e-130, Identity=42%"; Hit description =Putative uncharacterized protein
  Pfam annotation: Domain name=KH_1; Domain location=114-180; Score =35.5; E_value=1.9e-07; Accession=PF00013.20; Description=KH domain
  Pfam annotation: Domain name=KH_1; Domain location=26-95; Score=50.0; E_value=8.2e-12; Accession=PF00013.20; Description=KH domain
  Pfam annotation: Domain name=KH_1; Domain location=307-375; Score =48.2; E_value=2.9e-11; Accession=PF00013.20; Description=KH domain
  Pfam annotation: Domain name=KH_1; Domain location=399-466; Score =57.3; E_value=5.4e-14; Accession=PF00013.20; Description=KH domain
  Pfam annotation: Domain name=KH_1; Domain location=555-617; Score =60.7; E_value=5.1e-15; Accession=PF00013.20; Description=KH domain
  Pfam annotation: Domain name=KH_2; Domain location=114-177; Score =1.5; E_value=0.2; Accession=PF07650.8; Description=KH domain
  Pfam annotation: Domain name=KH_2; Domain location=26-74; Score=8.6; E_value=0.036; Accession=PF07650.8; Description=KH domain
  Pfam module annotation: Pfam domain module=KH_1::KH_1::KH_1::KH_1::KH_ 1::KH_2::KH_2; Domain location=114-180::26-95::307-375::399-466::555 -617::114-177::26-74
MADPNSNPNHSNAHVNRSRHYTTHVTFRLLCHASRVGAIIGKSGVLIKSLQEATGAKIRIVDAPPDSPDRVILVSAPSVTEDGELSTAQEALLKVFDRVLDVAAGTEVGDLVVSCRLLAETSQVGAVIGKAGKVVEKIRMDTGCKIRVLNEGLPAGTAPSDEIVERASPGAAVKLCLGDLLVMGSNPETASLHMQGKDCLELYQIEGQLTSVKKALIAVSHRLQDCPPPDRTKMTGSRHYEVVQSETFSVPLESLTNLHIDHHLQRSSTLSTLSNRSNGNASGAHKLSAEVNRVSALDPKAYQQEVTFRIICSNDRVGAVIGKGGSIVRALQNESGAIISVGPSLVECEDRLVTITASENPESTYSPAQKAVVLVFSKSVEAGVEKGLELGSKKEPYVTARLVVPSNQVGCLLGKGGAIVSEMRKATGANIRVIGNDQVPMCVSDNDQLVQISGVFSNVQAAIHNATGRLRDHLFVSTQNSGGARSLSSVLAGGQPTLAISHSLNRHSLPGLQAPQTVAGINSRGTNGVSRGLISRKGGLELISGSKTAIVTNTTVQIVVPDDVIGSVYGENGSNLARLRQISGAKVIVHEPRPGTSDRTIIISGTPDETRAAQSLLQAFILAGSS

SEQ ID NO: 98301 - protein, 104 aa, Glycine max
  Coding DNA Sequence Number=SeqID_6616
MAAREVRKLKHLHATRNGSALFLIVVDDVVVVVAAFCSTTSSFRDILWMNAGYYYRRYMKKCKGRLKRKQACVTEEIEQDRCEKRSLIESNNNNRELNENGEWR

SEQ ID NO: 98302 - protein, 414 aa, Glycine max
  Coding DNA Sequence Number=SeqID_6617
  Gene Ontology: Mol. function=Rab GDP-dissociation inhibitor activity; Cellular component=cell surface; Biological process=regulation of GTPase activity
  Homolog annotation: Hit_ID=A7R519; Match level="QueryCoverage=97%, HitCoverage=90%, E-value=0.0, Identity=86%"; Hit description =Chromosome undetermined scaffold_833, whole genome shotgun sequence
  Pfam annotation: Domain name=GDI; Domain location=1-412; Score=939.2; E_value=1.7e-279; Accession=PF00996.9; Description=GDP dissociation inhibitor
MDEEYDVIVLGTGLKECILSGLLSVDGLKVLHMDRNDYYGGASTSLNLTQLWKRFRGDDTPAENLGSSREYNVDMIPKFMMANGALVRVLIHTNVTKYLNFKAVDGSFVYNKGKIYKVPATDVEALKSPLMGLFEKRRARKFFIYVQDYETNDPKSHEGLDLNQVTARQLISKYGLEDDTVDFIGHALALHRDDNYLDEPAKDFVDRVKIYAESLARFQGGSPYIYPLYGLGELPQAFARLSAVYGGTYMLNKPECKVEFDENGKAIGVTSEGETAKCKKIVCDPSYLSDKVQKVGKVARAICIMSHPIPDTKDSHSAQVILPQKQLGRKSDMYLFCCSYAHNVAAKGKYIAFVTTEAETDNPEVELKPGIDLLGPVDEIFYDTYDRFEPCNDHEADGCFISTSITNEQGQDMR

SEQ ID NO: 98303 - protein, 87 aa, Glycine max
  Coding DNA Sequence Number=SeqID_6618
MAIRTDLKFNFFSSIGKGGVGGNGGVGGKGGSVIGIGTVGTGGNGGNNGGVAGKGGSGGKGERWRVANAMSMLEKEIAMNKAKMMQL

SEQ ID NO: 98304 - protein, 94 aa, Glycine max
  Coding DNA Sequence Number=SeqID_6619
MQKCNENTRKIEKKRTAYVVILGKGGVGGNGGVGGKGGSVIGIGTVGTGGNGGNNGGVAGKGGSGGKGERWRVANAMSMLEKEIAMNKAKMMQL

SEQ ID NO: 98305 - protein, 24 aa, Glycine max
  Coding DNA Sequence Number=SeqID_6620
MGHVYGSEFNSKLNYQDSGNGSIN

SEQ ID NO: 98306 - protein, 331 aa, Glycine max
  Coding DNA Sequence Number=SeqID_6621
  Gene Ontology: Mol. function=prenyltransferase activity; Cellular component=integral to membrane; Biological process=menaquinone biosynthetic process
  Homolog annotation: Hit_ID=A9PEJ4; Match level="QueryCoverage=91%, HitCoverage=94%, E-value=2e-74, Identity=47%"; Hit description =Putative uncharacterized protein
  Pfam annotation: Domain name=UbiA; Domain location=101-318; Score= -44.2; E_value=0.019; Accession=PF01040.9; Description=UbiA prenyltransferase family
MAATCCSFTQSSSGFRKLHENIQLQSYFTRQQRSTCSVENIFHRDYGGRFLQVEGWHQHQYLLCARGVELSPSANEEVGEETEEDISKETLIWRAIKLPIYSVAFVPLTVGSAAVYFQTGIFSARCYFVLLASSVLAITWLNLSNDVYDFDTGVDKNKKESVVNLAGRYKFFAGIIIMLESYSGVINLQFSVLGQLLLQCPPFRLSYQGLGEPLCFAAFGPFATCAFYLLHGSSSHFHQVEGDKEVGKMSPLVRLGTKKGAEVVKGAVFMLYALLVAFGLIKALPLTCINKNKIFMAKYFCVRLHALFGVALALGLVLARNTKFTSWPILS

SEQ ID NO: 98307 - protein, 95 aa, Glycine max
  Coding DNA Sequence Number=SeqID_6622
MSLILCLCENETEGRWFYREHGRARGPTTSGSACQATTSGRAWQVGTTGSAWQVGTTGSAWQAGTTTPVTSPCPDKPRVAFWWNALLRSSAALAA

SEQ ID NO: 98308 - protein, 367 aa, Glycine max
  Coding DNA Sequence Number=SeqID_6623
  Gene Ontology: Cellular component=cellulose and pectin-containing cell wall
  Homolog annotation: Hit_ID=A9PJI6; Match level="QueryCoverage=68%, HitCoverage=83%, E-value=1e-102, Identity=73%"; Hit description =Putative uncharacterized protein
  Pfam annotation: Domain name=Phi_1; Domain location=48-307; Score =490.8; E_value=1.7e-144; Accession=PF04674.3; Description=Phosphate -induced protein 1 conserved region
PRRHPVQSSNVDRLAREGPMKKLHVEAQDVDTSLATAVPPDQEQPLVLKYHNGQLLKGRITVNLIWYGTFTPIQRSIIVDFINSLSSAPNAPLPSTATWWKTTEKYKVGGGSPALVVGMQFLHPAYTLGKNLKGRDLLALASKFNEINSITVVLTAKDVAVEGFCMSRCGTHGSTRNVKSNARTAYIWVGNSETQCPGQCAWPFHQPIYGPQTPPLVSPNGDAGVDGMVINLATLLAGTVTNPFNNGYFQGPPTAPLEAVSACTGVFGSGSYPGYPGRVLVDKATGASYNAHDFDMQDPRLKTATWRGCVMVVDIGRWERKQGMDNRGGDGFGLGDHYGEVSIGNDDFGWGGEISFVIVNVKIGVSE

SEQ ID NO: 98309 - protein, 142 aa, Glycine max
  Coding DNA Sequence Number=SeqID_6624
  Gene Ontology: Mol. function=nucleotide binding; Cellular component =integral to membrane; Biological process=transport
  Homolog annotation: Hit_ID=A7R4N0; Match level="QueryCoverage=97%, HitCoverage=37%, E-value=7e-32, Identity=47%"; Hit description =Chromosome undetermined scaffold_744, whole genome shotgun sequence
MFFDSNGFPCPPLHNPSDHFLRIINKDFKLDDEKCFHKTVPKEVVDILVEFYKSSEISNQVQKEVAIIGESEIGFMERNRTRTAFLTQCHILMRRSSLHLFRDVSNYWLRLAMFVLAAISLGTIFFDVGSGDASIEVKQNST

SEQ ID NO: 98310 - protein, 382 aa, Glycine max
  Coding DNA Sequence Number=SeqID_6625
  Gene Ontology: Mol. function=caspase activity; Cellular component =cytoplasm; Biological process=proteolysis
  Homolog annotation: Hit_ID=A2XHI5; Match level="QueryCoverage=78%, HitCoverage=78%, E-value=5e-71, Identity=50%"; Hit description =Putative uncharacterized protein
  Pfam annotation: Domain name=Peptidase_C14; Domain location=100-377; Score=149.9; E_value=7.2e-42; Accession=PF00656.13; Description =Caspase domain
MASRQVRCNQCGSVLMVPAAAVRVVECRVCHGMNQIRPSTGPWSQVYNSFHQFGGRLRSFVNTIMPGSVNRNPGYYYGTTPQLGYYPQPLRPSYNVFGPKRAVLCGIRYHGQDSQQLNGTVNDVKNMNMFLVKYCGFPRESILILTDDMEERDPLKFPTKYNIQMAMRWLIEGSQSGDSLVFHFAGHGAQEPDMSGDELDRSDEVICPVDSREQGNILDDEINATIVRPLPRGAKLHAVIDSCHSGTVLDLAYVWSLREGYWTWDYQYYRVRRPNKDTSGGVAICISGCHDDQSSKETPALSGGYAFTGAFTYSFIYTMLNEPGLSYGRLLSAMRSIIRGIPNDPYASLFNTDFIFASRQDLQEPQLSSSMEFDVYATRVVL

SEQ ID NO: 98311 - protein, 172 aa, Glycine max
  Coding DNA Sequence Number=SeqID_6626
MIYDFIHLPSQTQSFNLESKIVGKKKRRYTITRAILNEFDFHVQKTTRTKSCFTRPGRFKNETIHLPVFNWALNRQVTLHHRLSLSPSAVPAPAQLPPDPPLSTTPSEGDDCESYNFFHKSLNHNKQTLAWHLRPRPPQGPLSGQNHLRAPHQCVVLQRETSRGQAIPQGNE

SEQ ID NO: 98312 - protein, 462 aa, Glycine max
  Coding DNA Sequence Number=SeqID_6627
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=Q9SZC9; Match level="QueryCoverage=95%, HitCoverage=41%, E-value=1e-145, Identity=61%"; Hit description =Putative copper-transporting ATPase PAA1
  Pfam annotation: Domain name=E1-E2_ATPase; Domain location=188-425; Score=309.6; E_value=6e-90; Accession=PF00122.11; Description=E1-E2 ATPase
MCLIADHSAPESADSTRDNFLQIFERKMEERHRQLRESGRELAVSWALCAVCLVGHFSHFFAAKAPWIHVFHSIGFHLSLSLFTLLGPGRQLILDGLKSLLKRTPNMNTLVGLGALSSFTVSSFAALLPKLLLFARLLFPSSSPITIICKFPFDTCLYTCWSPAFTHALLMLKQVDRGWKAFFEEPIMLIAFVLLGRNLEQRAKIKAASDMTGLLSLLPPKARLLLNNGETEVGSVVEVPSDSLSVGDQIIVLPGDRIPADGVVRSGRSTVDESSFTGEPLPVTKVPGSEVAAGSINLNGTLTMEVQRPGSETAMANIVRLVEEAQSREAPVQRLADKVAGHFTYGVMATSAATFTFWSLYGTHILPPALYQGRAVSLALQLACSVLVVACPCALGLATPTAVLVGTSLGAKRGLLLRGGNILEKFAMVDTVVFDKTGTLTVGRPVVTNIVIPICIKNAISR

SEQ ID NO: 98313 - protein, 765 aa, Glycine max
  Coding DNA Sequence Number=SeqID_6628
  Gene Ontology: Mol. function=RNA binding; Cellular component=cytosol; Biological process=loss of chromatin silencing during replicative cell aging
  Homolog annotation: Hit_ID=A7QII7; Match level="QueryCoverage=78%, HitCoverage=100%, E-value=1e-171, Identity=54%"; Hit description =Chromosome chr12 scaffold_103, whole genome shotgun sequence
  Pfam annotation: Domain name=PUF; Domain location=460-494; Score =33.9; E_value=5.8e-07; Accession=PF00806.10; Description=Pumilio -family RNA binding repeat
  Pfam annotation: Domain name=PUF; Domain location=496-530; Score =42.7; E_value=1.3e-09; Accession=PF00806.10; Description=Pumilio -family RNA binding repeat
  Pfam annotation: Domain name=PUF; Domain location=535-569; Score =23.9; E_value=0.00058; Accession=PF00806.10; Description=Pumilio -family RNA binding repeat
  Pfam annotation: Domain name=PUF; Domain location=594-629; Score =35.7; E_value=1.6e-07; Accession=PF00806.10; Description=Pumilio -family RNA binding repeat
  Pfam annotation: Domain name=PUF; Domain location=630-663; Score =19.0; E_value=0.018; Accession=PF00806.10; Description=Pumilio -family RNA binding repeat
  Pfam annotation: Domain name=PUF; Domain location=666-700; Score =25.7; E_value=0.00017; Accession=PF00806.10; Description=Pumilio -family RNA binding repeat
  Pfam annotation: Domain name=PUF; Domain location=704-738; Score =16.5; E_value=0.1; Accession=PF00806.10; Description=Pumilio-family RNA binding repeat
  Pfam module annotation: Pfam domain module=PUF::PUF::PUF::PUF::PUF::PU F::PUF; Domain location=460-494::496-530::535-569::594-629::630 -663::666-700::704-738
MGKEMLENVKDDGGLEELEMLLNEIPQATSLNLYHGKSHHHHDVVVVHRGDDDHDRHHDSFVVSHGMCDDFTQIQYPSVSSPVSGFSLQSDGSSSSLFSSSGHALSDTGSPTPPPLEDLKSTTMPSSSHPNNRFITPDSTTLMRNANGGFVDELGGLCANLSQMYISNQQESPCDFKDASMAMHRPRPPPFPECVSFTGNGPSNNVQYHGDSYSFRRGSFDCVGGVQSPLSWTPVNHDAEINSALMAKFFGSRQCAKMSYETMLSQLHDFSSSMDHHRHSRPLLVDNYYRGGSGNQPPECTASLSRNPMVDALLNAQRNGMNVTEETGMSRSPSSSSRGINLRPYLGVQDLLQYSHSLPNYSARAVPLSNARILQGNIDAIAREESFIIQGEGVNYAASIGLDRSMYRSKAVVRDTGFARHLKRSELDVPYQVVGTYDNDRGARIGCSFPLLPKYSSLAEAQGYIYLMSKDQHGCRFLQKMFDEGTPEDVQVIFNEIIDHVVEPMVNPFGNYLMQKLLDVCNEEQRMQILLIITEEPGQLVRISLNTHGTRVVQKLIETLKTRQQISLAVSALEPGFLALIKDLNGNHVFIFVAAAKYCVDIATHQHGCCVLQRCIGHSNGEYQEKLIAEICANALLLAQDQFGNYVVQFILDLKIPSATACIRLQFEGNYAHLSRQKFGSHVVEKCLAVFNDENRSRVILELLSMPHFEHLLQDPHANYVVQSALRHSEGRLHNLLVEAIESHKAISRNSPYSKKIFSQKLLKK

SEQ ID NO: 98314 - protein, 131 aa, Glycine max
  Coding DNA Sequence Number=SeqID_6629
  Gene Ontology: Mol. function=2 iron, 2 sulfur cluster binding; Cellular component=mitochondrial matrix; Biological process=electron transport
  Homolog annotation: Hit_ID=A7PDR5; Match level="QueryCoverage=88%, HitCoverage=59%, E-value=9e-44, Identity=75%"; Hit description =Chromosome chr11 scaffold_13, whole genome shotgun sequence
  Pfam annotation: Domain name=Fer2; Domain location=21-105; Score=9.7; E_value=0.043; Accession=PF00111.18; Description=2Fe-2S iron-sulfur cluster binding domain
MARIAKSLSLSCCGRISVTFIDKDGEEKHIKVPVGMSMLEAAHENDIELEGKSFDFRILLLRLKILDLEQYNKLEDPTDEENDMLDLAFGLTETSRLGCQVIAKPELDGIRLAIPAATRNFAVDGYVPKPH

SEQ ID NO: 98315 - protein, 260 aa, Glycine max
  Coding DNA Sequence Number=SeqID_6630
  Gene Ontology: Mol. function=protein binding; Cellular component =endoplasmic reticulum; Biological process=vesicle-mediated transport
  Homolog annotation: Hit_ID=A7QGP1; Match level="QueryCoverage=99%, HitCoverage=60%, E-value=9e-90, Identity=61%"; Hit description =Chromosome chr12 scaffold_93, whole genome shotgun sequence
  Pfam annotation: Domain name=DUF1692; Domain location=26-256; Score =306.1; E_value=6.6e-89; Accession=PF07970.3; Description=Protein of unknown function (DUF1692)
MQSDEHCCNSCEEVREAYRKKGWAMTNMDLIDQCQREGYVQRVKDEEGEGCNLQGSLEVNKVAGNFHFATGKSFLQSAIFLADVLALQDNHYNISHRINKLSFGHHFPGLMPLFSGDKDGMPHRCFHILGFLNLNLIPLIEILKVRWVQGPTHGMYQYFIKVVPTIYTDIRGRVIHSNQYSVTEHFKSSELGVAVPGVFFFYDISPIKVNFKEEHTPFLHFLTNICAIIGGVFTVAGIIDSSIYYGQRTIKRKMELGKFT

SEQ ID NO: 98316 - protein, 336 aa, Glycine max
  Coding DNA Sequence Number=SeqID_6631
  Gene Ontology: Mol. function=hydrolase activity, acting on carbon -nitrogen (but not peptide) bonds; Cellular component=cytoplasm; Biological process=nitrogen compound metabolic process
  Homolog annotation: Hit_ID=A9PJQ3; Match level="QueryCoverage=99%, HitCoverage=98%, E-value=1e-148, Identity=78%"; Hit description =Putative uncharacterized protein
  Pfam annotation: Domain name=CN_hydrolase; Domain location=46-218; Score=157.6; E_value=3.4e-44; Accession=PF00795.13; Description =Carbon-nitrogen hydrolase
MEKGRTVVVSALQFACTDDISTNVATAESFQNVTKQGCSDKLVEGGARYKAECGIEEEKTIFKTKRLVRAAHKQGANIILIQELFEGYYFCQAQREDFIQRAKPHKDHPTILRMQKLAKELGVVIPVSFFEEANNAHYNSIAIIDADGTDLGIYRKSHIPDGPGYEEKFYFNPGDTGFKVFQTKLAKIGVAICWDQWFPEAARAMVLQGAEILFYPTAIGSEPQDGSIDSRDHWKRVMQGHAGANLVPLVASNRIGKEIIETEHGKSEITFYGNSFIAGPTGEIISTADDKDEAVLIAQFDLDKIKSMRHCWGVFRDRRPDLYKVLLTLDGINPVQ

SEQ ID NO: 98317 - protein, 528 aa, Glycine max
  Coding DNA Sequence Number=SeqID_6632
  Gene Ontology: Mol. function=protein binding; Biological process=red or far red light signaling pathway
  Homolog annotation: Hit_ID=A7Q6X7; Match level="QueryCoverage=91%, HitCoverage=96%, E-value=0.0, Identity=67%"; Hit description =Chromosome chr12 scaffold_57, whole genome shotgun sequence
  Pfam annotation: Domain name=F-box; Domain location=88-135; Score =37.1; E_value=6.5e-08; Accession=PF00646.24; Description=F-box domain
  Pfam annotation: Domain name=Kelch_1; Domain location=220-265; Score =53.9; E_value=5.7e-13; Accession=PF01344.16; Description=Kelch motif
  Pfam annotation: Domain name=Kelch_1; Domain location=267-316; Score =49.9; E_value=9.1e-12; Accession=PF01344.16; Description=Kelch motif
  Pfam annotation: Domain name=Kelch_2; Domain location=220-265; Score =27.8; E_value=3.9e-05; Accession=PF07646.6; Description=Kelch motif
  Pfam annotation: Domain name=Kelch_2; Domain location=267-316; Score =26.3; E_value=0.00011; Accession=PF07646.6; Description=Kelch motif
  Pfam annotation: Domain name=Kelch_2; Domain location=387-432; Score =1.4; E_value=31; Accession=PF07646.6; Description=Kelch motif
  Pfam module annotation: Pfam domain module=F-box::Kelch_1::Kelch _1::Kelch_2::Kelch_2::Kelch_2; Domain location=88-135::220-265::267 -316::220-265::267-316::387-432
MGGLTSHCHERLTNTKRGKGSGRKWRKMEKNGGGMLQMNGSLSTVVLMGNILNLNNSKTRRNDSHGVLQGESCKRQRLSPNSCEDNPRLIPSLPDEISIQILARVPRIYYLNLKLVCRAWKETFVSSELFCVRKELGSMEEWLYILTKVNDDKLLWYALDPLSRRWQKLPPMPKVGFEDETKKGLISFPLRMWSMMGSSIRIVDVIMSWLGRRDALDWMPFCGCSIGAVDGCIYALGGFSRASAMKYVWQYDPIKNSWAEASPMSVGRAYCKTGILNNKLYVVGGVTRGRGGLSPLQSAEVYDPHTGMWSLLPSMPFARAQVLPTAFLADLLKPIATGMASYKGRLFVPQSLYCWPFFVDVGGEVYDPNLNSWLEMPIGMGEGWPARQAGTKLSVTVDDDLYALDPSNSLDSAKIKVYDYEGDTWKVAAGDVPIHDFTESESPYLLAGLLGKLHVITKDANHNITVLQADMQNEHAESAFSQSILSSPDNSISEDAESSAETQGEFWKVLATRSGRSAELVNCQSLKI

SEQ ID NO: 98318 - protein, 492 aa, Glycine max
  Coding DNA Sequence Number=SeqID_6633
  Gene Ontology: Mol. function=nucleotide binding; Cellular component =postsynaptic membrane; Biological process=catabolic process
  Homolog annotation: Hit_ID=A7Q6T0; Match level="QueryCoverage=91%, HitCoverage=51%, E-value=0.0, Identity=75%"; Hit description =Chromosome chr12 scaffold_57, whole genome shotgun sequence
  Pfam annotation: Domain name=Dynamin_N; Domain location=36-217; Score= 159.9; E_value=6.8e-45; Accession=PF00350.14; Description=Dynamin family
  Pfam annotation: Domain name=MMR_HSR1; Domain location=34-218; Score=- 15.4; E_value=0.028; Accession=PF01926.14; Description=GTPase of unknown function
  Pfam module annotation: Pfam domain module=Dynamin_N::MMR_HSR1; Domain location=36-217::34-218
MEKEEEEQREWRLYEGYNELHALAQDLHTPFDAPAVLVVGHQTDGKSALVEALMGFQFNHVGGGTKTRRPITLHMKYDPQCESPSCHLVSDSDPSLSHHKSLPQIQAYIEAENARLEQDTSQFSAKEIIIKVEYKYCPNLTIIDTPGLIAPAPGRKNRALQAQARAVESLVREKMQHKEFIILCLEDCSDWSNATTRRVVMQVDPELARTVIVSTKLDTRIPQFARPSDVEVFLSPPPSTLDGCILGDSPFFTSVPSGRVGCGSGYLHSSNDEFKQVESPGYCLSSVLDRNNSYSDFTSLPVEFRISQGLFCPINQRVKTKEKAVCFREIEDVASLEEKLGRALSKQERSRIGVSKLRLFLEELLQKRYINNVPLIIPLLEKEYRSVTRKLSDINQELSTLDEAKLKEKGRAFHDMFLTKLSLLLKGTVVAPPDKFGETLQDERINGGAFIGADGVQFPHKLIPAQSPPLRCMLGELKGAMHLGERMAQLTG

SEQ ID NO: 98319 - protein, 149 aa, Glycine max
  Coding DNA Sequence Number=SeqID_6634
  Gene Ontology: Mol. function=DNA binding; Cellular component=nucleus; Biological process=regulation of transcription
  Homolog annotation: Hit_ID=A5C0V8; Match level="QueryCoverage=93%, HitCoverage=73%, E-value=4e-43, Identity=62%"; Hit description =Putative uncharacterized protein
  Pfam annotation: Domain name=NAM; Domain location=5-87; Score=4.9; E _value=6.2e-08; Accession=PF02365.6; Description=No apical meristem (NAM) protein
MPMFNAQQCLEQECRALAEGKQWYYYSRRTQNRVTSNGYWMPMGMEEPVISNSSNKRVGMKKYYVFHLGEAPDGNTTNWIMQEYRLLDSASSSISSRRRSQPKPDHSKWVICRVYERDNDEDDGDGTELSCLDEVFLSLDDLDEISLPN

SEQ ID NO: 98320 - protein, 67 aa, Glycine max
  Coding DNA Sequence Number=SeqID_6635
MVFVGGHGGDASNERGATHVILLHSRIFLKGPLTHIFNYPITIAHGMSLVEACRAIYAPRLEQLVLT

SEQ ID NO: 98321 - protein, 272 aa, Glycine max
  Coding DNA Sequence Number=SeqID_6636
  Gene Ontology: Mol. function=molecular_function; Cellular component =membrane; Biological process=auxin mediated signaling pathway
  Homolog annotation: Hit_ID=Q2HV22; Match level="QueryCoverage=77%, HitCoverage=59%, E-value=2e-61, Identity=54%"; Hit description =Putative uncharacterized protein
  Pfam annotation: Domain name=DUF6; Domain location=85-213; Score=5.4; E_value=0.034; Accession=PF00892.11; Description=Integral membrane protein DUF6
  Pfam annotation: Domain name=TPT; Domain location=35-211; Score= -32.8; E_value=0.048; Accession=PF03151.7; Description=Triose -phosphate Transporter family
  Pfam module annotation: Pfam domain module=DUF6::TPT; Domain location= 85-213::35-211
MLVDICVCRNFFYGYGFRFEKLNLQAAEGRAKVIGTIIGISGAMLMTFFKGVEINIWSSNKINLLHPHLNQNGHVASHHTEFRNKLLGIPCAIAKMNAEYPSPHSSAALMSIMGAIQANIFTLCVERDWSQWKLGFNIRLLTVAYSGMVASGVVVVIIAWCIKKRGPLFVSVFNPLQLLLVDIAAYLMLEEKLYLGSVLGAVIIVCGLYTVLWGTAQELKKKSQLVPLGNTRGESENDRVGERYTSLLTLWIAIASSFTLAPAFRYCLCLSF

SEQ ID NO: 98322 - protein, 403 aa, Glycine max
  Coding DNA Sequence Number=SeqID_6637
  Homolog annotation: Hit_ID=A7Q6S3; Match level="QueryCoverage=98%, HitCoverage=49%, E-value=3e-93, Identity=51%"; Hit description =Chromosome chr12 scaffold_57, whole genome shotgun sequence
MEEGQSSAVILKFELMHAPIIETGPELLGSLDAYAASVHEYKIPPKALQGLHSYCPVHFDAFHAVLVETSIHISLLKASYHTSRQKVSSDSRGSEGAYVEDYVGSNKVMLIKALMAAYDILLEDLRRISTGIGKAIDLTEMTSESDATELFASTPPACVKSIDVQSSLQLSDRPQVSAEKAAHHVNNLFEKSPQPFSWDDHLLISFQSLGNQLLCLWNIFLKFHRENKTKILEFLRKSWEIDRRTEWSIWMVYSKVAMPRQNMSNGVEGTSLSHGMHRSSIITRRFTDDPIQTAAMRAELHRRGIAQMRINNRSLQDMYIFGDPLLVPIIIVERLTNVYHSAIVNSNFIPLEGEGRHILENGSRATKKLCGSSPQKNELVLRIVVFVHGFQACFIFLQLLLSP

SEQ ID NO: 98323 - protein, 26 aa, Glycine max
  Coding DNA Sequence Number=SeqID_6638
MGADRTCKLFASHIRGWMTYLIEARW

SEQ ID NO: 98324 - protein, 104 aa, Glycine max
  Coding DNA Sequence Number=SeqID_6639
MSLRPDARIEIHLNFYKVVVVARVVDFPFMFLSPRRVLSRPQSQSIEDQHGMHVEDQALLCDGLSLMESPFPASPPFCKTVLVVVFVWVSTSLGHSFRKMMRFL

SEQ ID NO: 98325 - protein, 258 aa, Glycine max
  Coding DNA Sequence Number=SeqID_6640
MGSNQAYAFEKSFSSSQEHALRCPYRTHAKARVMSEVEEVQEQMKTDIDAMKEQMTTMMEAMMSMRRMMEVNTTTVVVESTATKVDPTHPPGFNQVNRPASDMVGQGGEALGSTGGPYLVQVQNKHSFPPYVLPPNYTPPNVAHTPDENVKNSAPIPIESQQPQFGHAQVPLPMGGHMKYPETTLYPTLSLTSDMPLRDRHFVVYPCQTLWGASVSPTTTTFTFCSGKSTSCYGGKGKIRSYRRKAEGYLRRWRLCFC

SEQ ID NO: 98326 - protein, 148 aa, Glycine max
  Coding DNA Sequence Number=SeqID_6641
  Gene Ontology: Mol. function=small conjugating protein ligase activity; Cellular component=cytosol; Biological process=regulation of protein metabolic process
  Homolog annotation: Hit_ID=P35132; Match level="QueryCoverage=100%, HitCoverage=100%, E-value=4e-73, Identity=86%"; Hit description=SUMO- conjugating enzyme UBC9
  Pfam annotation: Domain name=UQ_con; Domain location=5-142; Score =266.2; E_value=7e-77; Accession=PF00179.17; Description=Ubiquitin -conjugating enzyme
MALKRINMELKDLQKDPPASCSAGPVANDMFHWQATIMGPIDSPFAGGVFLVSIHFPPDYPFKPPKVSFRTKVFHPNINSNGSICLDILKEQWSAVLTISKVLLSICSLLTDPNPDDPLVPEIAQMYKTNRAKYQATARSWTEKYAMG

SEQ ID NO: 98327 - protein, 36 aa, Glycine max
  Coding DNA Sequence Number=SeqID_6642
MFTVFGVPKHVARAMRPKWCVWVALATVMAATMAAM

SEQ ID NO: 98328 - protein, 92 aa, Glycine max
  Coding DNA Sequence Number=SeqID_6643
MPKNQKNIDAQSKTSIVTEFVSFRDFTEKESPKKAEGGVLSKNGGANSTQAHLALQKIPPEGCCFWRKQPGSPGRAELAWASWAATTSPILL

SEQ ID NO: 98329 - protein, 109 aa, Glycine max
  Coding DNA Sequence Number=SeqID_6644
  Gene Ontology: Mol. function=alanine-glyoxylate transaminase activity; Cellular component=mitochondrion; Biological process =photorespiration
  Homolog annotation: Hit_ID=A7NY44; Match level="QueryCoverage=77%, HitCoverage=19%, E-value=1e-36, Identity=85%"; Hit description =Chromosome chr6 scaffold_3, whole genome shotgun sequence
MQKHYLHNIVQCNSQITFGVSRKGIKHNLIGDVRGRGLMLGVELVTDRELKTPAKNETLHVMDQMKELGVLIGKGGYYGNVFRITPPLCFTKEDADFVADAMDLTLSRM

SEQ ID NO: 98330 - protein, 49 aa, Glycine max
  Coding DNA Sequence Number=SeqID_6645
MAKIYEDKWMYDSVMSEEVDMNDQNEDEAGVNEEHVNCSDAFNTSQVLI

SEQ ID NO: 98331 - protein, 106 aa, Glycine max
  Coding DNA Sequence Number=SeqID_6646
MTRSKTKRMKQALQGLIIILNIKEKEDQSLNLRLDILQSPFRSRSHRKSTSEEEEEEEEEEYLDARSHGRRRRGKPKRDNHLGSIKMTIPTYQGKNDLELYLEWKR

SEQ ID NO: 98332 - protein, 156 aa, Glycine max
  Coding DNA Sequence Number=SeqID_6647
  Homolog annotation: Hit_ID=A5C995; Match level="QueryCoverage=69%, HitCoverage=6%, E-value=1e-10, Identity=36%"; Hit description =Putative uncharacterized protein
MTRGNPSNLQPFDPEIDRTFHKLVRHHLVPFEHSVIGDFEHYNFEQSDFEHSENMAQPPPRERTLREMAAPDFTYKSLCIQYPDEDVPYVLKAGLIHLLPKFHGLAGEDPHKHLKEFHIVYSTMKSPDVQEDHIFLKAFPHSLEGVTKDWLYYLTP

SEQ ID NO: 98333 - protein, 102 aa, Glycine max
  Coding DNA Sequence Number=SeqID_6648
  Subcellular localization annotation: CTP_CleavageSite=39; ConfidenceScore=5.01e-01
MVTSLTSMVDGDDAPSTVDGGVALHGNLLNAPHNLFTARSSSRQQWFVAEEEEQPFPTMVTNGDTGEGWWWVVGGGSAPEMGGGGFGIVFNCVDDWKLNAAR

SEQ ID NO: 98334 - protein, 168 aa, Glycine max
  Coding DNA Sequence Number=SeqID_6649
MAFLGETSSQTVVNSTLGFIFPTESIVYNDSGVSFQASTPVPIRVPNGCDFQTLKTIIHNTLKLTDKQFLDEIYYRQPFTYAATMTPTYDALLYYNGRWNMSRKNEFVGYSFIGKNPKKFDIPIGCTMDELKDLIKQVVPPGISLYGIDETQMVRRLFFRKPSLHKYS

SEQ ID NO: 98335 - protein, 317 aa, Glycine max
  Coding DNA Sequence Number=SeqID_6650
  Subcellular localization annotation: CTP_CleavageSite=31; ConfidenceScore=5.32e-01
MPLRGRIASPTSYDTRQQTWEVTSSRLSFIYARSSSSFASFIHFAVFCVESLMANGLFRRLISIAEINDKKETWKIVVQVINMWTIPRSPKCIVELILVDKKGDKILAQMRNVDAQLNNYGLEIYPKAHENPRAFPCISSPIYLESSSQCPCGNSRSPSPWKAQSRSRSRSRLRFGSRSRPRQRPRSCSRSRGRSLLLQVKVTNSWKENISIEKETPVFYPSDYLHKGYPHLRSNIYKNSSTFWCISSILTTQQRRDTSMKEVQSQTPLDAGLVTLGRHTHRIAVMVATARQRDVASPKLAKRKKHNENEEDDDENI

SEQ ID NO: 98336 - protein, 86 aa, Glycine max
  Coding DNA Sequence Number=SeqID_6651
MDTTASPENLRTCSAAGGDGEVCGERDAGEVYGSEFKSRVGFGREFLKLRSCRVGTEEEDAEHTKRKKRSKRELLYRAFIFSRYRR

SEQ ID NO: 98337 - protein, 152 aa, Glycine max
  Coding DNA Sequence Number=SeqID_6652
MEEFTSTISLNQTMKLREAQAVDQVLLDKIMGVTPVTKYHHLLVCDMAQKVGDIWKTLIVIRDQEKYLGGTFVEDGLSGVGNNGGGVGEMEEGPNEMVGEGKGKENRLRTELAIAPHPLEPGKSSVFHEGEDEDGLAEEDEGEWWYTSGLGI

SEQ ID NO: 98338 - protein, 25 aa, Glycine max
  Coding DNA Sequence Number=SeqID_6653
MGAEKREELEPERQQANRGRISGSK

SEQ ID NO: 98339 - protein, 249 aa, Glycine max
  Coding DNA Sequence Number=SeqID_6654
MALNVSKMCMETCLFLHRVAVVIAIDPSDYPPLVLHDLPLKLVVARKLFPHSQVAFLIPFSFTIEASIKAPNFAHHFYSKSQKEAIFGVVKHTSTLWDFKFQLFVKEFVESMLNLSCLIKLVEMMGRVNLGLNVRMVVMIQFEQNRMRASGISKSAQFVQQKAVKFCAAEFGSCAENAYALLLGGVDGDPMLRGTRIRATWGYVSSVEGGQLGMSGTWRYVAGVRRPWGRQVGCYCPKPSLTNPDPTQA

SEQ ID NO: 98340 - protein, 161 aa, Glycine max
  Coding DNA Sequence Number=SeqID_6655
  Homolog annotation: Hit_ID=A5BXI2; Match level="QueryCoverage=83%, HitCoverage=8%, E-value=1e-07, Identity=31%"; Hit description =Putative uncharacterized protein
MTSSSLCLSSIQTRSGPIDGDVLWMQPKHVSEHVWNGEPDRKLHIKRAVPTYQGFRPQEGEIEGSVVKLSWLAHHFSHINIDEGNIEQLQRFTCAWILRFIGGVLFVNKSSSRVSLRYLQFYVTLNSAVRMRGDLPCLRIYIERCEAPPITKLNQSEVCAS

SEQ ID NO: 98341 - protein, 172 aa, Glycine max
  Coding DNA Sequence Number=SeqID_6656
  Homolog annotation: Hit_ID=Q2HSI5; Match level="QueryCoverage=90%, HitCoverage=42%, E-value=2e-15, Identity=31%"; Hit description=IMP dehydrogenase/GMP reductase, putative
CWIYEHFPLVANSTADKEYDEDSLRACRWIVKKKTMKSIRTPAYRECLDRLQIPDVCWISYGEHRSVRDFHVISCYSSLLHWGPVAVYYRPERVVRQFGYTQTIPAPPIDSWVSYDDIHDRWMHYSDHIVPAGEVCAMPGQCVSDYMDWFFRISHPFMPLGHASDPLPNGHA

SEQ ID NO: 98342 - protein, 251 aa, Glycine max
  Coding DNA Sequence Number=SeqID_6657
AYGRDAFPFMWVVLGCPPFFYVYCCMFEVLNLILPLNSFQCALLRRLNVAPSQLHPNSWEMVRAFKVSLNSMSKKMFEFDSNVFLKFKDHFFKVKVGLVGNYVSHLSPSFLNLLLGKEVNLRLESTLLKLSKLATEFMSDLGCLSSTSPSCSPSDPPIVQVVAATVADSPALPSPHIQVVPAPPSTVLTVSTPLAILVSISPTSIAILLLSAGVTTNVLGHLSHPSLAFPSPALTVLPLTMPSSSLHPNVS

SEQ ID NO: 98343 - protein, 843 aa, Glycine max
  Coding DNA Sequence Number=SeqID_6658
  Gene Ontology: Mol. function=protein serine/threonine kinase activity; Cellular component=cytoplasm; Biological process=protein amino acid phosphorylation
  Homolog annotation: Hit_ID=A7PAY9; Match level="QueryCoverage=27%, HitCoverage=74%, E-value=1e-114, Identity=87%"; Hit description =Chromosome chr16 scaffold_10, whole genome shotgun sequence
  Pfam annotation: Domain name=Pkinase; Domain location=69-308; Score =37.4; E_value=7.1e-11; Accession=PF00069.16; Description=Protein kinase domain
  Pfam annotation: Domain name=Pkinase_Tyr; Domain location=69-315; Score=-128.9; E_value=0.00016; Accession=PF07714.8; Description =Protein tyrosine kinase
  Pfam module annotation: Pfam domain module=Pkinase::Pkinase_Tyr; Domain location=69-308::69-315
MLVARLTKEIVETYQICNPQFKYSEDLNPKRFLTSPSVGVLNDGYDNVNSDLILTVNFVLIHLEKNKRYIVKDLLGHGTFGQVAKCWDSDTNSFVAVKIIKNQPAYYQQALVEVTILTTLNKKYDPEDKHHIVRIYDYFVYQRHLCICFELLDTNLYELIKMNHFRGLSLGIVQLFSKQILYGLALLKEAGIIHCDLKPENILLCTSTVKPAEIKIIDFGSACMENRTVYSYIQREDERKRDHHGGRADGKVNARSWSVQRRRNSENADGNNTIEDDGQPHTRDNLQEGQWIQVKSRRKAPSKIFLVIRRAIDELKAPYQATARVREKDPWKIFQEWGKVWEVFIPQKRNKQGHKYGFVRFKGVEDGDRLERILDNNIYIQGIKMFVNKPKYQRGGNRVHKSIAGLHNRTDTRPPESDALELKSNQVPMATKLKSYVDVVKNRKKEGEERQGPTSANGLTEVNTEPINIQTTKEKTKWLDKAWVGHLKNKGIFDRVEEELQGVFGVEVKTAYWGHDMVILYDLEEEAVNTLNHKEQVHGGSPFFSLQRWTPEMMPSYRLTWLRIWGVPLTAWDAENLASIVLVCGELIELDAATEDRLRVDIARVLVRTNDKLPIARTVVVKVDGIQYSLYVREELESRWGRGQRVEEEEEEDRFPPSPFSTAIVDSDSEPNTHGPQRFSPGSISVSSVGGSSTRSQSCMVERRRRWRNSGNSPNRHGYETPPINHLAQENCNPGCYKADIVSWTKDTVINQKEYGEEMFFQSPELVGRTPKQDCPSQSPATNNSFNNSDFENEEDLHRKIVRELGVSYADKNTCKDKMKHDVINSSIFPQSAVVMGMEQNDP

SEQ ID NO: 98344 - protein, 188 aa, Glycine max
  Coding DNA Sequence Number=SeqID_6659
  Gene Ontology: Mol. function=protein serine/threonine kinase activity; Cellular component=cytosol; Biological process=protein amino acid phosphorylation
  Homolog annotation: Hit_ID=A7PAZ0; Match level="QueryCoverage=75%, HitCoverage=70%, E-value=3e-60, Identity=77%"; Hit description =Chromosome chr16 scaffold_10, whole genome shotgun sequence
MAEGGQPPDYVLRDAKNTSKFFKCIGSLQNIESSESSKNGRSVYQTLTVEEYEARELKKPSIGKEYFNQLNLEAIVTNYPYRKNLPKEDILKESQIRLALIDFLKGLVEFDPAKRWSPFQASKHPFVTGEPFTHPYKPPPETPHMGELGGHKDRVMFKKSLLHQTDQSMFLLWSLILQFSFHYPSITH

SEQ ID NO: 98345 - protein, 260 aa, Glycine max
  Coding DNA Sequence Number=SeqID_6660
  Homolog annotation: Hit_ID=A5BFT3; Match level="QueryCoverage=23%, HitCoverage=4%, E-value=7e-11, Identity=50%"; Hit description =Putative uncharacterized protein
MQRCFELDSVAVFGASSRYCLPVKEAKGSIEDAVKQRERRSVGRWSKMCQVTCARTSRARTLHGAVFCAGCANGQCHGLRRWRQRCFELAAHMDSVTVFSDRQQRSKVRAPKKRCWEVCQKRANESQNGPKLTGLCAPQSLNEKLVRAPAAASGRGEKSPEGQRHKSSLERGNRSPEDGKTSRKVHRNVKIDKNVVNKATSSATSFATLHSRLGHPSVPAMKIVFRLCNIPNINKEPTDFCNNCCIGKSYRLPSSLSHTV

SEQ ID NO: 98346 - protein, 73 aa, Glycine max
  Coding DNA Sequence Number=SeqID_6661
MDGVARAVEQAQSSSGLASGWRPRGSVFSPCKPKGEEEASAAAGKKPQQPLHVVVRKPCCWILVVFVLHHGNS

SEQ ID NO: 98347 - protein, 90 aa, Glycine max
  Coding DNA Sequence Number=SeqID_6662
  Gene Ontology: Mol. function=RNA-directed DNA polymerase activity; Biological process=RNA-dependent DNA replication
  Homolog annotation: Hit_ID=Q2QTF6; Match level="QueryCoverage=96%, HitCoverage=8%, E-value=5e-10, Identity=33%"; Hit description =Retrotransposon protein, putative, Ty3-gypsy subclass
MARVGDGGGDYHQLDGSQRLLLNVMTTQMQQLLNQGQDRIEGVKLNVPPFKGRSDPDAYLDWEIKIQHAFSCNDYPEEQKVKLVAATFSD

SEQ ID NO: 98348 - protein, 83 aa, Glycine max
  Coding DNA Sequence Number=SeqID_6663
MGKGGSRRSLPEEHFPESFRKKCSSGSQRLPEEHFFRKTPRKPLLGTFRKKWFIRKNSGRRALPKELSNFRKTFPEEVPEVIL

SEQ ID NO: 98349 - protein, 57 aa, Glycine max
  Coding DNA Sequence Number=SeqID_6664
MWTTTGEVVAAQLAQASQVASSRSNRLLEEYSGGPKWAWVLFAPPFLLSTPPSAVFW

SEQ ID NO: 98350 - protein, 50 aa, Glycine max
  Coding DNA Sequence Number=SeqID_6665
MSLKALFKTKVLKIFKMDDQDSLESLNREELVKGIYKIVKLSSGLLGDWT

SEQ ID NO: 98351 - protein, 111 aa, Glycine max
  Coding DNA Sequence Number=SeqID_6666
MYPPLFSLNLVDVPSTRTDPQEMYPLLFSVKPKEKGDTKEFRLLVLCSFGKERRETQKEFKRLVLGEFSLAKGEGNEELWKNQKTLESFWQKEEEEEVQRDLEINVENLLV

SEQ ID NO: 98352 - protein, 157 aa, Glycine max
  Coding DNA Sequence Number=SeqID_6667
MGEVDEVQEQMKADMEAMKEQMATMMEAMMSMKKIMEVNAAAVAATRGKELGSTGGPHFVQVQNKHAFPPYGLPPNYTPPNVAHTPDVNNSTPIVIGSQQPQSDHAHVSQLMGETHEIPHHNLSDFEPCIGYATEGQAVSDVPLPNTLESPQIRSQP

SEQ ID NO: 98353 - protein, 43 aa, Glycine max
  Coding DNA Sequence Number=SeqID_6668
MATIALLSRYENVQQASLVADLGVAFVVDWAFLVDRVVGNEKG

SEQ ID NO: 98354 - protein, 61 aa, Glycine max
  Coding DNA Sequence Number=SeqID_6669
MTEDFESYERQKRGLRVLSKIKMRTLSPMKDKESQLKSEISHSLIRIGFIGLVTWSGGRGL

SEQ ID NO: 98355 - protein, 78 aa, Glycine max
  Coding DNA Sequence Number=SeqID_6670
MSFGLKGLLKKTMGCPYCERTTPMPIPDAFVSTVNGSLKSGLYGGSLDHGCGNGGITTDKAAIEPSEAQKTSKGFNGT

SEQ ID NO: 98356 - protein, 99 aa, Glycine max
  Coding DNA Sequence Number=SeqID_6671
MAIVQDLVIANRKKRLIICRIKPDLKRAFKETIKATKEAQDNGEKKNKEGVEKEKEKNDEVVTSEKVKEKVGQTYLSGGGRAEKDEDMRNPVDYVIGGD

SEQ ID NO: 98357 - protein, 51 aa, Glycine max
  Coding DNA Sequence Number=SeqID_6672
MNDEGCDPWSAAPGSTFSLLLLYCEIHLKKGKKLPDQLAQASCTHPDELLA

SEQ ID NO: 98358 - protein, 233 aa, Glycine max
  Coding DNA Sequence Number=SeqID_6673
MENQGCHHQKGGYCRSKLHDDESRLIQGTSFVVQVEGTSTWVVVTENKRGYISCGSVQVEGTSTWLLQREQGRVHPLWIFACKGFYKVEKKSQGPQVAWGLDRQRYTEGGFSGFLQGPYNQQGQWRSHPGNQFNKDQGGPSNRPIQQGPNIFQRTTKLEETLTQFMQVTMSNHKSTESALKNLEVQVGQLAKQIADKSSNSFVANTEKNPKEECKAVMTRSKRFRRLRMRRVL

SEQ ID NO: 98359 - protein, 509 aa, Glycine max
  Coding DNA Sequence Number=SeqID_6674
  Subcellular localization annotation: CTP_CleavageSite=22; ConfidenceScore=5.41e-01
MANAFDPPAPLSPPTQMVYAPSSSTPATSSFPLPCLLLHFPLHRHYDRCLNEHASSSLHFSTFSSYYPIFGHAFFLFTSKHLIGLGISFSRGKFIKEYRWKLPSGGPLPGQCGEWSALRFNHQLPLLKCPKCGEWATVAFAEAIGFNHQLLSRVDNVFAKSVSTKLDNDEVFRRYKDVLKEKNDLAAKVECSAEEKEALNTMVAESAKLIVDLQAQLRDSELTASNLQAKPKEFELKVVNEKKGNKELEDELLTFKKEAMKQHKKKDRKLLDEDEIATMEVSDGEEGKWVDTWPHRGTLGVVLCVKYCTAMLDGHLGFDFNLVEGLAMVDSHDIALISGTIIMSAHWCIGYNTLHWPSVRLIWTLTRNIMVLSEEVYQKMDLGFVEPLEIRQGHICPGFGDTHQRRTLGLTSLWRFDQEHICPGFGETHQGQTFGLKSLWRFDQEHVCLGFGETHQGQILSLTSLWRFDQGHVCPGFGETHQGRTLGLVSLQRFDLEHVCPGFSETYQG

SEQ ID NO: 98360 - protein, 174 aa, Glycine max
  Coding DNA Sequence Number=SeqID_6675
  Gene Ontology: Mol. function=cysteine-type endopeptidase activity; Cellular component=lysosome; Biological process=proteolysis
  Homolog annotation: Hit_ID=A7QDJ6; Match level="QueryCoverage=93%, HitCoverage=52%, E-value=8e-40, Identity=51%"; Hit description =Chromosome chr10 scaffold_81, whole genome shotgun sequence
  Pfam annotation: Domain name=Inhibitor_I29; Domain location=1-43; Score=21.7; E_value=0.00023; Accession=PF08246.3; Description =Cathepsin propeptide inhibitor domain (
  Pfam annotation: Domain name=Peptidase_C1; Domain location=70-173; Score=-2.3; E_value=1.8e-11; Accession=PF00112.14; Description =Papain family cysteine protease
  Pfam module annotation: Pfam domain module=Inhibitor_I29::Peptidase _C1; Domain location=1-43::70-173
MAKRFEIFLSNLNYIIEFNAKRSSPSGYLLGLNNFADWSPSEFQEIYLHSLDMPTDSAPKLNGPLLSCIAPASLDWRNKVAVTAIKNQGSCAAGAIEGIHAITTGELISLSEQELVNCDRVSKGCNGGWVNKAFDWVISNGGITLEAEYPYTGKDGGNCNSDKVLLLSTPCSFP

SEQ ID NO: 98361 - protein, 154 aa, Glycine max
  Coding DNA Sequence Number=SeqID_6676
METILGRFEDLDVFGKVTLKSKLWEIAYPNLNSMCPPPEKVNTKGAQKKPMTIHQRSTKRDSSYWEYVDALHYMQNSNSSVKRSVPSSDQAIPRRTMPMLDQFHSFIHDSIKKFIDVKADGNCGYRAIVALLGDVAPLELVGLGSSLSMDSFAS

SEQ ID NO: 98362 - protein, 195 aa, Glycine max
  Coding DNA Sequence Number=SeqID_6677
MDENQWMYNNIMSEEVDMNEQKEIEAGVNKEHVDCSDALNTSQVFATRDDILHWARCVAYEIEFVAVIMRSTDNRKCGCPFKLREKPVVGGQRWMVNDTKWQQLMKLLEQDQYIHWHKLKDEEFVRDIFKCHLDAVRQDALPGVIIIDRDLTLMNAVKTIFPKCTNLLCSLVDCPFEDRFDDYLKKFEIAYSPWP

SEQ ID NO: 98363 - protein, 229 aa, Glycine max
  Coding DNA Sequence Number=SeqID_6678
MAAEWKRKRERRCHFKEKMSLEEAHHHRRSWIRAWRKKEMNEGRGREEHGILCSKRVLKSENPRTFFSNSIPILLEPLAHGSSDCALDDLNKDSLDALLNNDFDEDYLDNGSNKFFKGHEIGLRASIEAQFCICFVVDQVINDQPFCFLSVCVASSRFYEDDGQQIKIEKFTRNNSFSLWRIKMQALLKEYGIWASLSGTPLKEHINELNSTLMELCDIDVKMEDEDWN

SEQ ID NO: 98364 - protein, 297 aa, Glycine max
  Coding DNA Sequence Number=SeqID_6679
  Gene Ontology: Mol. function=threonine endopeptidase activity; Cellular component=proteasome core complex; Biological process =ubiquitin-dependent protein catabolic process
  Homolog annotation: Hit_ID=A2Q1I9; Match level="QueryCoverage=35%, HitCoverage=22%, E-value=1e-34, Identity=67%"; Hit description =Putative uncharacterized protein
  Pfam annotation: Domain name=Proteasome; Domain location=35-169; Score=-21.7; E_value=7.8e-05; Accession=PF00227.17; Description =Proteasome A-type and B-type
  Pfam annotation: Domain name=XH; Domain location=133-225; Score=14.5; E_value=1.1e-07; Accession=PF03469.5; Description=XH domain
  Pfam module annotation: Pfam domain module=Proteasome::XH; Domain location=35-169::133-225
MEIVGENISSPKGQSKTLFYLFPKQLQVEYALEAVRKGNAAVGVRSTNNVVLGIEKKSTAKLQDSRKIVNLDNHIMLACAELKADTRVLINKARVECQSHRLTVWSTRLIAMDPLTSGDYPKNDMLNAPRTKIGLKRMGELDHKVFVNNCKKRFPLEEAGTKGVELCSLWQENVKNSAWHPFKVVTIDDKAEPRIDDKHPRWLHLRIRPSSLPVLDPAKFNHPRKLKTKAFVDGRWTLAFRDEESCKSALSMILEEINFLSDEVHRRLKPLLNLETALDLSGPEEDSSTLSTSPNSV

SEQ ID NO: 98365 - protein, 42 aa, Glycine max
  Coding DNA Sequence Number=SeqID_6680
LAQGEKSGPGLEASKDEKAQENGGETPRSSSTKKERRPKRKG

SEQ ID NO: 98366 - protein, 143 aa, Glycine max
  Coding DNA Sequence Number=SeqID_6681
  Gene Ontology: Mol. function=endonuclease activity
  Homolog annotation: Hit_ID=Q2HUP4; Match level="QueryCoverage=56%, HitCoverage=28%, E-value=4e-25, Identity=70%"; Hit description =Endonuclease/exonuclease/phosphatase
MSLSTIKAEYMAPAKRSKGKNLVEGNGVGIIVDKEWKKDVVDVRRVGDRIIALKLVVGQDTFNVISGYAPQVGLAEHFKVKFWEDLEGVLQDIPQGEKVFLRGDLNGHVGSVDRVLRGCMGFCLGEMNGEVIHLGVFEALIFL

SEQ ID NO: 98367 - protein, 78 aa, Glycine max
  Coding DNA Sequence Number=SeqID_6682
MVGRVLGRGREGTRPWSSQIPKVSSCLRGLKTKVGKVLGCGRAKYLSDDSGDDGGHDSDHNSGSGDNGGNYDSNLDVN

SEQ ID NO: 98368 - protein, 170 aa, Glycine max
  Coding DNA Sequence Number=SeqID_6683
MQILLLGVKILMPIQQILSFSYEILQVRWCGSIPLRPVPYCLYPLSVSLCVASLIAITPCRLRKHLVLKVVVSTELVPILPRSIVRAQTIPLDQDLPFWCRRVRQAFGIHNGQRSNKRLIIYGGGRQRDTDVGVVARPGSNGVAIADKGRGGGTTRAGRLGPPSGSPEST

SEQ ID NO: 98369 - protein, 163 aa, Glycine max
  Coding DNA Sequence Number=SeqID_6684
  Homolog annotation: Hit_ID=A2Q1D6; Match level="QueryCoverage=52%, HitCoverage=13%, E-value=2e-07, Identity=38%"; Hit description =Ovarian tumour, otubain, related
MSVVIVAVIDSIVNGDTSEGLFVCDVETFEYLVNMDENQWMYDNIMSEEIDMNEKNENEAGVNEEPVDCSDAFNTSRVFATQDDVLQWARSVAYEIEFEAVTVIMRSYPNTGMRGRTLFLLIGCERSDQYRCRKKEFIRRNTGSWKCRCSFKLREKQVVVGQG

SEQ ID NO: 98370 - protein, 235 aa, Glycine max
  Coding DNA Sequence Number=SeqID_6685
MESSIVDATVASRKCRRDEEEEEELEQAFFIIVSFATMLVGAMTWYHDKYFVKETARKLELERHSFLIVYSGEQKLVYMCCLGGKGQQEILEYCKMLCIVKTVSIFQMRNGIKQCEEHVKWKKERCLGEDTRSYFAWNLEMESVLTNVLRDQSNLGNKGGFGWDSTKYMIIVENEIAWNTYVKAKRFRFKVIPNWDDVVDLCAKDRSTGLGAKNALYTDDIMSKEANEEEAIHNE

SEQ ID NO: 98371 - protein, 159 aa, Glycine max
  Coding DNA Sequence Number=SeqID_6686
MAAQLIRDRVEMECLEGAWETLEGNTRCRFRGTIRFTATSLVHPDEPARTLQRTVEWILPTPTPYRLVEPVQVIEVTSSEEDPEEDLEELPPEPAVDALDFLEGDEDPLLEVDSPEEVMSASEADSTEDSGPGETAISGGSSSYEDFPSKPSYGEKRKK

SEQ ID NO: 98372 - protein, 172 aa, Glycine max
  Coding DNA Sequence Number=SeqID_6687
  Subcellular localization annotation: CTP_CleavageSite=60; ConfidenceScore=5.04e-01
MVKFGYNSIKKAQAKKAAKAKTMKVQADKAKVPPPPPISLGVVERANPGPQDEGPSKRLRVELGKDFNPSALIQSSITWGIADLWAKEFEKVNVESEKAQVECAKAKFGDKVKGGRDQRGGIKDQVGVENVEEKLKSDLGEVESKILRTHKFNFKKALCQAWDLAYRIGSSD

SEQ ID NO: 98373 - protein, 106 aa, Glycine max
  Coding DNA Sequence Number=SeqID_6688
MNNVLKILPKHLKYVFLEDNEASPVVISNSLTNEEESRLVEVLKKHNDVALCGACRPWIFFINGVFCSLKIMASEWRWKKDDWRCHFKEKMSQEEAHHHSKPWIRA

SEQ ID NO: 98374 - protein, 38 aa, Glycine max
  Coding DNA Sequence Number=SeqID_6689
MTTSTYCLVGGFFRGSGNVGKLCSPWSSGYPKHNYWQT

SEQ ID NO: 98375 - protein, 72 aa, Glycine max
  Coding DNA Sequence Number=SeqID_6690
MAVVRHTFANPNPVKMRRLARAPSRADSGSEPRLGQVIEKTCFEKMKFPTEDLAFHCEEAPFYKFKEEKKRN

SEQ ID NO: 98376 - protein, 68 aa, Glycine max
  Coding DNA Sequence Number=SeqID_6691
  Gene Ontology: Mol. function=protein dimerization activity
  Homolog annotation: Hit_ID=Q9C761; Match level="QueryCoverage=91%, HitCoverage=9%, E-value=4e-08, Identity=48%"; Hit description =Transposase, putative
MASKSAFSISSQVLNKYRIRLLGDNVQALICTKNWLLRYDEQGKEYEDVEMEKAQANSNMESFIVGDV

SEQ ID NO: 98377 - protein, 473 aa, Glycine max
  Coding DNA Sequence Number=SeqID_6692
  Gene Ontology: Mol. function=amino acid transmembrane transporter activity; Cellular component=integral to membrane; Biological process=amino acid transport
  Homolog annotation: Hit_ID=A7P8G2; Match level="QueryCoverage=95%, HitCoverage=96%, E-value=0.0, Identity=76%"; Hit description =Chromosome chr3 scaffold_8, whole genome shotgun sequence
  Pfam annotation: Domain name=AA_permease; Domain location=43-452; Score=-59.5; E_value=0.00039; Accession=PF00324.12; Description =Amino acid permease
MGMFSGAEYVPIGNDELPSPRENHMRRVSVLPLVFLIFYEVSGGPFGVEDTVHAAGPLLALMGFLVFPFIWSVPEALITAEMSTMFPENSGYVVWVSSALGPYWGFQQGWMKWLSGVIDNALYPVLFLDYLKSGIPALGGGVPRTVSTWALTVALTCLNYRGLTIVGMVAVLLGVFSLLPFVVMGLLSIPDLKPSRWCVMNLDDVDWNLYLNTLFWNLNYWDSISTLAGEVDNPRRTLPKALFYALILVVLGYFFPLLIGTGAVPLNRDLWTDGYFSIIAEIVGGVWLRWWLQAAAAMSNMGMFVAEMSSDSFQLLGMAERGMLPEFFSKRSRFGTPLVGILFSASGVILLSWLSFQEIVAAENFLYCFGMILEFVAFILLRIRHPNASRPYKVPGGTAGAITICIPPTVLIFVVLAFSSNKVLVISLIAMAIGLVMQPCLKIMEERRWMKFSVRSELQDLDNNEESIHSFVG

SEQ ID NO: 98378 - protein, 749 aa, Glycine max
  Coding DNA Sequence Number=SeqID_6693
  Gene Ontology: Mol. function=binding; Biological process=cellular iron ion homeostasis
  Homolog annotation: Hit_ID=Q8GZN1; Match level="QueryCoverage=97%, HitCoverage=98%, E-value=0.0, Identity=62%"; Hit description=Pollen -specific calmodulin-binding protein
  Pfam annotation: Domain name=TPR_1; Domain location=137-170; Score =7.1; E_value=0.75; Accession=PF00515.19; Description=Tetratricopeptid e repeat
  Pfam annotation: Domain name=TPR_1; Domain location=321-354; Score =2.5; E_value=2.7; Accession=PF00515.19; Description=Tetratricopeptide repeat
  Pfam annotation: Domain name=TPR_1; Domain location=707-740; Score =17.3; E_value=0.045; Accession=PF00515.19; Description =Tetratricopeptide repeat
  Pfam annotation: Domain name=TPR_2; Domain location=137-170; Score =12.7; E_value=0.79; Accession=PF07719.8; Description=Tetratricopeptid e repeat
  Pfam annotation: Domain name=TPR_2; Domain location=321-354; Score =1.7; E_value=18; Accession=PF07719.8; Description=Tetratricopeptide repeat
  Pfam annotation: Domain name=TPR_2; Domain location=442-475; Score =1.8; E_value=18; Accession=PF07719.8; Description=Tetratricopeptide repeat
  Pfam annotation: Domain name=TPR_2; Domain location=477-510; Score =12.3; E_value=0.89; Accession=PF07719.8; Description=Tetratricopeptid e repeat
  Pfam annotation: Domain name=TPR_2; Domain location=707-740; Score =21.3; E_value=0.0037; Accession=PF07719.8; Description =Tetratricopeptide repeat
  Pfam module annotation: Pfam domain module=TPR_1::TPR_1::TPR_1::TPR _2::TPR_2::TPR_2::TPR_2::TPR_2; Domain location=137-170::321-354::707- 740::137-170::321-354::442-475::477-510::707-740
MALINWLSMEKALSKETKSTSSGKNERVTIREFCANGSCMEAKELEAKLDEGNIQEAESALREGLSLNFEEARALLGKLEYQRGNVEGALRVFDGIDLEAAIQRLQSSLSEKTPVKKGPTRSESPSSVSQHAATLVLEAIYLKAKSLQKLDKFTEAAKECKRVLDAVEKIFGQGIPDTQVDNKLQEIVSHAVELLPELWKQTGCYNEALSAYRNALLSQWNLDNDCCARIQMAFAVFMLYSGVEASPPSLAVQIDGSYVPKNNLEEAILLLMILLRKFSLGKINWDPSIMEHLTFALSACGQTSILAKQFEELAPGVYHRIDRWNFLALCNSGAGENESALNLLRMSLHKHERPDDLISLLLAAKICSEDPHHAAEGAGYAQRAINIAQGLDGHLKGVGLRMLGLCLGKQAKVSSSDFERSMLQSKALQSLEEAVRLEQNNYDLIFELAIQYAEHRNLTAALSCAKQFFDKTGGSKLKGWRLLALVLSAQKRFSEAEVVTDAALDETAKWEQGPLLRLKAKLKISQLRPMDAIEIYRYLLALVQAQRKSSGPLKLSSQDHGFNPLPAKLLPKGIWSALMDVIIGERDVSLFGFAIVSQVLASNSHVQASGGRAQAGMRQKLRIICFHGCTSSLTFYILQYVVPGIMFDGRGEYQEALIGTFNAVLFEPNYVPSKILMASLILKMGFKASPVARSLLSDALRIEPTNRMAWYYLGLTHKADGRLVDAADCFQAASMLEESDPIENFSCML

SEQ ID NO: 98379 - protein, 129 aa, Glycine max
  Coding DNA Sequence Number=SeqID_6694
MAERRGGFLKKRHRIAVAWRVSNGGRHSHDGHGVGVGLTVMTPRRQQAPARRAAMSTGTKGGDEHRHEGRRQAPARTAVTTRTKQFRTSGTDWPCARSPFLRCKFSRIRSSFRRSWAEGADDESAEGSE

SEQ ID NO: 98380 - protein, 166 aa, Glycine max
  Coding DNA Sequence Number=SeqID_6695
  Pfam annotation: Domain name=zf-CCHC; Domain location=108-125; Score =18.3; E_value=0.0026; Accession=PF00098.14; Description=Zinc knuckle
MHLEAENEFDESITKSHAKQMVNEANLKKNAYDWLQNLTQGSKSLEEYHKEGIMTMRRANAQEPKTSMARTSPRRRDLPPPKQQGSKSPSGKHVPNPSASSTSRSSSIKCFKCLGQGHIALHCPNKKTKVLRDNEIVTSKFSFISSSNISSDNDSGCGTRSLDDGY

SEQ ID NO: 98381 - protein, 598 aa, Glycine max
  Coding DNA Sequence Number=SeqID_6696
  Gene Ontology: Mol. function=kinase activity; Cellular component =Golgi apparatus
  Homolog annotation: Hit_ID=A7QQ45; Match level="QueryCoverage=100%, HitCoverage=100%, E-value=0.0, Identity=78%"; Hit description =Chromosome chr2 scaffold_140, whole genome shotgun sequence
  Pfam annotation: Domain name=DUF248; Domain location=81-587; Score =1054.2; E_value=0; Accession=PF03141.7; Description=Putative methyltransferase
  Pfam annotation: Domain name=Methyltransf_11; Domain location=210 -294; Score=28.1; E_value=3.4e-05; Accession=PF08241.3; Description =Methyltransferase domain
  Pfam module annotation: Pfam domain module=DUF248::Methyltransf_11; Domain location=81-587::210-294
MNNKDGKPVTQPDKSRIVSMAIIFVVLCGFSFYMGIIFCSEKDRFVTMYNQNSIESPKESSISSLQIKYTSFPECSADYQDYTPCTDPRRWRKYGSYRLKLLERHCPPKFERKECLVPPPDGYKPPIRWPKSRDECWYRNVPYDWINKQKSNQHWLKKEGEKFIFPGGGTMFPNGVGKYVNLMEDLIPEMKDGSIRTAIDTGCGVASWGGDLLDRGILTLSLAPRDNHEAQVQFALERGIPAILGVISTQRLPFPSSSFDMAHCSRCLIPWTEYGGVYLLEIHRILRPGGFWVLSGPPINYERRWRGWNTTIEAQKSDYEKLKELLTSLCFKMYKKKGDIAVWRKSPDNNCYNKLARDSYPPKCDDSLEPDSAWYTPLRACIVVPDTKFKKSGLLSISKWPERLHVTPDRISMVPRGSDSTFKHDDSKWKKQAAHYKKLIPELGTDKIRNVMDMNTIYGGFAAALINDPVWVMNVVSSYATNTLPVVFDRGLIGTFHDWCEAFSTYPRTYDLLHLDGLFTAENHRCEMKNVLLEMDRILRPWGYAIIRESSYFTDAITTIGKGMRWECRKEDTDNGSDMQKILICQKKLWYSSNQGSR

SEQ ID NO: 98382 - protein, 60 aa, Glycine max
  Coding DNA Sequence Number=SeqID_6697
MMCHTAPFYKYFQTEHTVHVSMHIQRANTILRLANAYSNISTEYLSPNDYPTCIDFTSDN

SEQ ID NO: 98383 - protein, 152 aa, Glycine max
  Coding DNA Sequence Number=SeqID_6698
MSDWRSGSQSQDWCGRVLWHLKHWGRRPPVSSMSCLPPQPHKPLALGLWPQRMHPPPVEVPKLWGLPHKRRCWYWVADVDGASGVEEEGTSTCLALAFLDPLKLTAQALIGQTIRSNSSSSAKSSNQGLKSKPIGATEIWMTPLPVKEDKSG

SEQ ID NO: 98384 - protein, 228 aa, Glycine max
  Coding DNA Sequence Number=SeqID_6699
ATAGVSLSEVLELSESHPLSETSARLACKRNLEGNLPCKLMLSVSSARSTSHLSLLELSVPSLLSQSSLTRAKRENGAKRAFEDRKPFLKPEVRALHRSSVGDLDLEIEAICRRNNAERKRKFLLVFCMRLRSSVGDLDLEIEATYRRNNTERRRKILQEREVTILEEPCSLESSSIFPPPRESHTGASEAHKMAEDQPRRVTLEDYSSSTVLVQRPTSVPDRSSSIE

SEQ ID NO: 98385 - protein, 34 aa, Glycine max
  Coding DNA Sequence Number=SeqID_6700
MEICNGGLGIMLRDAQTRTKQTHSKALVELKGKR

SEQ ID NO: 98386 - protein, 306 aa, Glycine max
  Coding DNA Sequence Number=SeqID_6701
  Gene Ontology: Mol. function=protein serine/threonine kinase activity; Cellular component=cytoplasm; Biological process=protein amino acid phosphorylation
  Homolog annotation: Hit_ID=A7QQ47; Match level="QueryCoverage=84%, HitCoverage=54%, E-value=1e-75, Identity=58%"; Hit description =Chromosome chr2 scaffold_140, whole genome shotgun sequence
MVSEHILDPLVGPLYLSCSRQLWWLAVGKEGCVEVPELWHVAVGKRSEADEIYKICSVIGSPTTESWADGLKLARDINYQFPQLASVHLSTLIPSRSDDAISLVTSLCSWDPCKRPTAAEALQHPFFQSCFYIPPSLRTRAVTRTPPSAGTRGSLDRQGLKRYSGALPNTKITNNFSSPKLQASIASEHDTHSFINITGVQRKLDMANEDGIKSKKSLKTTQQSKYRLPGKGSPTSINKGRTARGVSETAEKLANMSIGTRRQSLGQTRPPPMKAGVNWISESGNFMLRSGQQIPSERSLTRKVAG

SEQ ID NO: 98387 - protein, 262 aa, Glycine max
  Coding DNA Sequence Number=SeqID_6702
  Homolog annotation: Hit_ID=A5BSR3; Match level="QueryCoverage=27%, HitCoverage=23%, E-value=2e-10, Identity=47%"; Hit description =Putative uncharacterized protein
MKAIGLKNIEAEFDIPKASDLRTKKKILQTVGERWRKFKFDLTSKWALADDKDSVNDTVCEKYDISKEKKGPILSEPQRPFVGENKLMEEKKKKHLEEAVISGSTDTVIDPPSPIKRQVKWKMARTNKIGQMTSGAAKEIDDKIDSLEEQASQGSFVAHGCKDVLTIAIGRPEYPGRVRAAGVGVTIKQYFGPALRTSRTSLSMAPKDLEQLTQKIRPQLEESITEKMQSHGLTLPPELEVGPSAAHVSTKESCVDHSGNDP

SEQ ID NO: 98388 - protein, 153 aa, Glycine max
  Coding DNA Sequence Number=SeqID_6703
  Gene Ontology: Mol. function=nucleoside-triphosphatase activity; Cellular component=nucleus; Biological process=regulation of transcription, DNA-dependent
  Homolog annotation: Hit_ID=Q8H1A2; Match level="QueryCoverage=73%, HitCoverage=16%, E-value=1e-43, Identity=76%"; Hit description=Mini -chromosome maintenance protein MCM3
MDVIADDDLVDSCKPGDRVAIVGIYKALARKRQTVLIANNVSLLNKEANAPIYSAEDVKNIKEITARDDAFDLLTNSLAPSIYGNSWIKIAVVLLMLNGVEKNLKNGIHLRGLEFSLDLLSVRQHLMGAQDMEEKMKLIWTHVSLSNITECYN

SEQ ID NO: 98389 - protein, 80 aa, Glycine max
  Coding DNA Sequence Number=SeqID_6704
DLTILNKVNPSLLLGGLLLKQKGSTKCGYYVMHWMSTIILGNFQNNWEMYFTDPRPLEPERLKALCNQWAKYYLKVKNET

SEQ ID NO: 98390 - protein, 151 aa, Glycine max
  Coding DNA Sequence Number=SeqID_6705
MRSFNKLIYERILEEFEARLSQARFDVASSVGESQLTPLDPAEEQKLRSQCWVVAAGPKCKGHLYGTRDLSHTYKCGSDNFMQHTQGSSNRTEDAAEINRLREELRQSKEEMHIFQSVVLQFLPLEARNIIHQQQRPHQQHRDQQQDQADD

SEQ ID NO: 98391 - protein, 105 aa, Glycine max
  Coding DNA Sequence Number=SeqID_6706
MQHLKVKFNFQQLQQWHVPSSLYKLRKFEWSNLQGKVAKENGKEISKNDNSSDDTTTKFEDVTCWRQRRRKMTSKTKNEKKRKMKRKRKRKRRVRVRRVRVRGRG

SEQ ID NO: 98392 - protein, 123 aa, Glycine max
  Coding DNA Sequence Number=SeqID_6707
MTNLMIQPKIVFRFMQSKAKERKRKNCTKDCYISSLQPWGFLLTKGIPLKNSISHLYIRFEDSGLDNSRDLFAKAMVICTTMRIMVNQEGRDQSTMAQGINVNSNHGRGGFTMAVVRLFMKYL

SEQ ID NO: 98393 - protein, 88 aa, Glycine max
  Coding DNA Sequence Number=SeqID_6708
MATLQESLNTPPQAATPGDPQVAPFVFTLTHSKKGGYKITRMTLGAGLGLPIMWKDLRIWNTNMEEYIRIIDKYQQVQESPDMYLKSH

SEQ ID NO: 98394 - protein, 755 aa, Glycine max
  Coding DNA Sequence Number=SeqID_6709
  Homolog annotation: Hit_ID=Q2HUJ3; Match level="QueryCoverage=28%, HitCoverage=48%, E-value=3e-16, Identity=28%"; Hit description =Putative uncharacterized protein
  Pfam annotation: Domain name=RRM_1; Domain location=101-171; Score =6.3; E_value=0.039; Accession=PF00076.13; Description=RNA recognition motif. (a.k.a. RRM, RB
VRVQQGAEANKVIHRSRSDQRRCGVAEVANTDLIEDDGPRSSHANQHEGQWIQVTGRRKASLKSVSTSRRGNGVPKDSYQCIDIGRLHRVTWRDRMDITSFYFSHFPDGVHEKDLWKKFQEWGRVREVFIPQKNKTGHRYDFVRFKGVEDVALLERKLDNNIYIQGMKLFVNQPKFHRGGGRAAKPSTDLLNRPKISLRVPAGSEQKSHQVPTSTRLKSFVEVVKQSNDETNGSFHSIPGKGLRVDNDEPISIQTSPEKLKWLDNVWVGGLKNKGMFDRVDMEVQGAFGLELKTAYWGDDKIIIYDMDGDTTNQLIHDEQQHGGTPFYSLQRWTPMMEPSHRLTWVCIWGVPLTAWDAENFARFVSAYGDLVELDAMTEERSRVDIARVLIRTEHKPVIDGTVAIVVDGTHFLLKLREEFGCQRGNRSWMERLERLPPSPFSTEVAGSDDKGHMHGVRNFTSGSPLSLPSTWTSPCTEERRGRWRSPESPLRGDWNVNLKGAHVSHQACQGSLPALEGLTPGIGGQHGGNGSQPMALHENGRTEPTSPRPSQQQQLLREEDVGDKAKGASDHVWAKGGDPLDNNLEALLGVKLGSNEGDSAMCMRIKSSHILGLGGTGPNTTRSKTTSPLKVYVRKKAVTPAIHMGRAINSPDQHGIQADSRKLDIDENGRHTQSPAAQGTSLEKPRLAHSPISSNSFKKGLCENEEALHRDIIRDLGLSFAEINTCKDHIVADGTHSSIISTPTGVMGKKPIEP

SEQ ID NO: 98395 - protein, 85 aa, Glycine max
  Coding DNA Sequence Number=SeqID_6710
MGSASGEDATWELEGQMHDAYPTLFDTKRLLQKHIIFLSFSLTHKNPNRAAGGGALESTRNTTIANGERLSDYIEVRDELLTFED

SEQ ID NO: 98396 - protein, 170 aa, Glycine max
  Coding DNA Sequence Number=SeqID_6711
  Homolog annotation: Hit_ID=A7Q9J7; Match level="QueryCoverage=40%, HitCoverage=10%, E-value=6e-15, Identity=60%"; Hit description =Chromosome chr5 scaffold_67, whole genome shotgun sequence
  Pfam annotation: Domain name=Di19; Domain location=41-170; Score=5.5; E_value=1.5e-09; Accession=PF05605.3; Description=Drought induced 19 protein (Di19)
MAAEKGVEMVALECLGKRFNLASNFRLRFAKGIQKERLVVLDEQNKRDILIPGTRGVTIKGVSKNIHCDKGDYDVVSLCFHIDDHHPVQAKIGRKRRVRKVGSGSTMSILRKELREGALQSLLGSSSYLASSNSEPDPLLSSFMFNPAVTDDSFVEDTLVKESLFRVRDL

SEQ ID NO: 98397 - protein, 222 aa, Glycine max
  Coding DNA Sequence Number=SeqID_6712
  Gene Ontology: Mol. function=aspartic-type endopeptidase activity; Biological process=DNA integration
  Homolog annotation: Hit_ID=O23529; Match level="QueryCoverage=29%, HitCoverage=4%, E-value=3e-09, Identity=46%"; Hit description =Retrotransposon like protein
MIASLIKLIQNMKPGRFKTKRFLFGYNLPFRSYIDELASVGIPIRHEEYVDALLEGLPSDYVLVISVIESKKHTPSIAKIEALLYGHETRLTRYNRDTPTTSFASLHYTQGYSHPNTYKIGGFRDSHGRDGDRGTFSDILDIGVVALAEATVVVVLLTSNAKFVSNKDTLQMFAISGLIPFLIQLVHLEPPTLGLIPILSQQAQVIISPMPCSQTQPLMGLL

SEQ ID NO: 98398 - protein, 167 aa, Glycine max
  Coding DNA Sequence Number=SeqID_6713
MAKFDPEIAMEFYANAWPTEEGDFAWTAVERRVWIMRTSITTLTQIWMTLDCAYETPGGPREVQQGLVISCFDYRPLPILWSAGARPGTTIARGGPVVGSYRRTTATSRVHLCSPTEFEAAVAWPGDWPDFQTGAGPAGTSGDGDGALEDDDMADVINFFLGGCKVV

SEQ ID NO: 98399 - protein, 76 aa, Glycine max
  Coding DNA Sequence Number=SeqID_6714
MAKPSTSVHERLSPAPTRIASKGESENGSLLRVLKSVNFREHRTEQGAKFSSFREISKFLTNCEIPRGGGDIPTPL

SEQ ID NO: 98400 - protein, 431 aa, Glycine max
  Coding DNA Sequence Number=SeqID_6715
  Homolog annotation: Hit_ID=Q2HW90; Match level="QueryCoverage=49%, HitCoverage=43%, E-value=5e-24, Identity=32%"; Hit description =Putative uncharacterized protein
MGSNQAPSFKKRFYHVKVKSLELASLQKLRQRMDQVQHQAFRKAYGKIWDLALIEVSVEAIASLAQYYDQSLRCFKFGDFQLVPTIEEFEGILGCPLGRRKPYLFSGFYPSMARVEKVVKISPLELDRLKQNRNGVVGIPRQHLVEKAKALADQGERTLFIDVLALLVFGIVLFPNVDGLVDLAAIDAFLAYHHKKESPTIVVLADAYDTFDLRCEKSSTRIVCCTPALYEDPFTLKKRNQEKLFAYKGVRMSPPPLGISQSLKNSLISLKDENLAPCSALRSLKFSLFQPLSSELFSWLPSQFCANQALKGLPDLDVAFSMNPVNDPVHAHSSPVLVHMMDPEKEAGPTLVQMAQAQAQAEEMALALVEWALRPLECCPPGPAKAPGMQRPHPFQKEKGLGRIGVSSGEGRAEVDGAGVEGAGASTFPEK

SEQ ID NO: 98401 - protein, 84 aa, Glycine max
  Coding DNA Sequence Number=SeqID_6716
LAQASWLLHHEAIWWPMRAKGYDEDKARNKGKEPLEGLGGPMARARTKKAKEALQQVLTMLFEFRPKLQVEKLQIVNCTMFQEE

SEQ ID NO: 98402 - protein, 157 aa, Glycine max
  Coding DNA Sequence Number=SeqID_6717
MIEMNFIQENKRKPIEREIITIAQKINRPNYQKTVPSGVANCRNLPFDERATRGLTGASSKGERHAESPPTFIRGKHRKNQKGVRAFAKRDIQWLSARKNPEEDELSSSLSAPLQVIERTTSAHPLSETSVLSQNPLMRAKRSRSALSARARTRPPI

SEQ ID NO: 98403 - protein, 49 aa, Glycine max
  Coding DNA Sequence Number=SeqID_6718
MGLKQAHAFKKRFSSSQEEAQEQMKADMEAMKEQMTTMMEAKMSMRKMR

SEQ ID NO: 98404 - protein, 184 aa, Glycine max
  Coding DNA Sequence Number=SeqID_6719
  Pfam annotation: Domain name=MAP7; Domain location=6-168; Score= -84.7; E_value=0.1; Accession=PF05672.2; Description=MAP7 (E-MAP-115) family
MSLHSSSSVNGEGSTPNDPMYKILDELRSLKLWKQKQERKEKEKKRVEEISQDEREKTREEERRKIMKEMKREKHASYSSHNSCKSLSEELCDYYEGRHMSHLRPHSHRRENERKPQEANINLPCFHGKDNVEAYLDCEIRVEQKLKRKSTLKSYDSYSDPNKDQGLGILGAAPSKPEDYKGKK

SEQ ID NO: 98405 - protein, 286 aa, Glycine max
  Coding DNA Sequence Number=SeqID_6720
  Homolog annotation: Hit_ID=Q5XM22; Match level="QueryCoverage=40%, HitCoverage=66%, E-value=7e-26, Identity=50%"; Hit description =Resistance-like protein HAAS-2
MITLDDVSSLLHILITGALHSFEPLVTSGAVTLLTELLEVTPDEATAETRQAGGPHVQLSWLRDMYQSRCRARQWVAAARMYLLHLVGCTLFANKSAIHVHVVHLQAFRDLGQVGAFSWGEVALVHLYDQLNEASQAPTRKIASYISLLQMGQIIVYIRPERVVQQFGYIQTVPPPPVRDSLTGTDIDDRWISHPFVTPTKETVELRPAPPPPPHDDDFVEPPVPEVPVASDLPTHSVVDCTGCVRIAEHLERVINLRMVTEGIDLYDIMDLCLRIARGDDPDDKS

SEQ ID NO: 98406 - protein, 220 aa, Glycine max
  Coding DNA Sequence Number=SeqID_6721
  Gene Ontology: Mol. function=RNA-directed DNA polymerase activity; Biological process=RNA-dependent DNA replication
  Homolog annotation: Hit_ID=Q5NRP4; Match level="QueryCoverage=44%, HitCoverage=6%, E-value=8e-09, Identity=35%"; Hit description =Putative gag-pol polyprotein, identical
  Pfam annotation: Domain name=zf-CCHC; Domain location=86-103; Score =22.6; E_value=0.00058; Accession=PF00098.14; Description=Zinc knuckle
PQEANINLLYFHGKDNVVANLDWEIRVEQKLKKKSTSKSYGSHSYPKKDQRQGILGVTPSKPKDDKGKTIEKQAPKASMQEKTSSIKCFKCLGRGHITSQCPTTKTMIMRGQDIYSSQDEATTSPSSSESEKAKGKNLALASIATPLGLEFIPQVKKLLDEGLVCKSLNPCALLVPKIGIIRHQVPKIGGMMNVLSGATLFCKITRTPNIFMVYVHRDPL

SEQ ID NO: 98407 - protein, 224 aa, Glycine max
  Coding DNA Sequence Number=SeqID_6722
MLLSSTVIHICVRVVMLVRMIRTHLFAATRVKSCPDKHSSCTIASLSSCARTVGRPPISGGGPGTDKSKLLAPHPGACCPSMHSSCTIASLSGCARTVGRPPISRGGPGTDKRKQLAPHMCFDDNKDDDKKPKRMISRLSQDQFKNQEKDSRESFIKKIQDSRIIKIKIQDSKIQESREDLIKISIKKFFKTLSNIRRFHKIITKEFYSLVIDYQIIVINYQWF

SEQ ID NO: 98408 - protein, 129 aa, Glycine max
  Coding DNA Sequence Number=SeqID_6723
  Homolog annotation: Hit_ID=A2Q1A3; Match level="QueryCoverage=46%, HitCoverage=15%, E-value=6e-10, Identity=43%"; Hit description=RNA -directed DNA polymerase
MTDLYSQVEVTLKKSLQVQLWEAAYAYESMLRQKARIKWLKERDSNSTYFHRLINHRRRKNAIPASWCREAAQFLNCSTLEFPFTYLGIPVGVSSKSWIVWQPIVRKFEVKLAKWKQRTLSMGGQNHSY

SEQ ID NO: 98409 - protein, 179 aa, Glycine max
  Coding DNA Sequence Number=SeqID_6724
MRGAPAEESISHFLVRDFGAQSFKIIQRVHKAWERPLRKDKELRGIRNGIIGGYHEWLKVRTRGLDWLSKLKIINEENFEAPEEDEEKIQLPQEPLNEKPRGLARKSMAETNSELADCSRSKRSLSQCLCEIETNMSAIVRKYQEELNLATGHEHKVADEYARVYVEKEARGRVIDSLH

SEQ ID NO: 98410 - protein, 240 aa, Glycine max
  Coding DNA Sequence Number=SeqID_6725
MGEAEEVQEKMKAEMEAMKEQMATMMEAMMSMKKIMEANAVIVAATSAVAKVNPMLPSGLKQMNHPTSNMVGKDLGSTDDPMMCKFKTSTPSRHMACLPNYTPPNVAYIPNEDVNNSTPILIKSQQPQSDHAHVSRPMEETHGMPHHNLADFEPCLGYATEGQAIGGIPLQNTLEGPQCHPQPQPSHSTAVKNPHVMAEMGKRKGSGPLKEVLDFDKYKGTTCPKNHPKMYCRRCGHTQR

SEQ ID NO: 98411 - protein, 110 aa, Glycine max
  Coding DNA Sequence Number=SeqID_6726
GVGIEEEEPIDLRSNPLQGGGDDAILPRKGPVTRAMSKRLQEDWARATEEGHRVLMNLRMNGSGMEKEERERRHHFKEKMSLEEAHHHRRPRIRAWRKKEMNEGRGRGIL

SEQ ID NO: 98412 - protein, 187 aa, Glycine max
  Coding DNA Sequence Number=SeqID_6727
LEEGQECEFSQRRNRANGFDEEAIAQLLCTLGQDFARTAAGRRVRIMRSNMTSLTQMWMTLLLSNVLPSDHNSDLPLPKCQLVYAILTWMSVHVAQLIAGAIYLFAGMPPTRHPLDPDKSNRALGFPALITGLCQSFGVPVTPSKVIRPPITRAFIEKYCTPRQAQGMHLRTQTHHRHLIRPIPLGH

SEQ ID NO: 98413 - protein, 127 aa, Glycine max
  Coding DNA Sequence Number=SeqID_6728
MTRGNPSDLQPFDPEIDRTFHRLVRHHFIPFDHSEHSITGESVHSVIGDFEHPDLEHYNFEHSDSEHSDFAHSENMAQPPPHERTLREMAAPDFTYESLCIQYPDEDVPYVLKTGLIHLLPKFHGLA

SEQ ID NO: 98414 - protein, 65 aa, Glycine max
  Coding DNA Sequence Number=SeqID_6729
MFSYSPFAKRKPRAKRIFGHALSRESKALSTQPLHLRLIWSAKLAKAELSQFQFDLNSAKRRPNR

SEQ ID NO: 98415 - protein, 120 aa, Glycine max
  Coding DNA Sequence Number=SeqID_6730
  Subcellular localization annotation: CTP_CleavageSite=28; ConfidenceScore=5.27e-01
MYKDKRARTKPMGPKSTLRLMRTLGPSLASLTQSSWSLLSNAIIFSKKPLEKASQRSHEEASRVSQGALHGRARARLTGAFSKGGKMRGVATNVYLWKTSKKPMETGQNENSKFGSCIYA

SEQ ID NO: 98416 - protein, 71 aa, Glycine max
  Coding DNA Sequence Number=SeqID_6731
MSTLKEQMASMMGAMLGMRQLMENNVATAAAVSSAAEADPTLPATAHPLPNVVGRERSTLGHISNPHLGYN

SEQ ID NO: 98417 - protein, 131 aa, Glycine max
  Coding DNA Sequence Number=SeqID_6732
MGDQEETQEQMKADMSALKEQMASMMEAMLGMRQLMEKNAATAAADGEGTHTGHDGNPHLGDNRAADPHGLPPNYSPSVLQDDAGHIAPPMVEREMITMMVDTLLVFYYEKLVGYMSSSFADLVFAEERIE

SEQ ID NO: 98418 - protein, 184 aa, Glycine max
  Coding DNA Sequence Number=SeqID_6733
PGHRGRAAGVIPDGRRAAGPLATRGLRGARPPACAQHLFAAPPALGARGRGWGRCGGRWPAAAGLYVRHALAPESHHRDDEPAAARAAAAPRRAGRFRDHRGRLRGREPLPGHAHARAQEPGQERARDLCGFAVQEPVARAAAGIHRCAARADRRVARAAPCHGAPPQRLSAARLCAVPVAGPP

SEQ ID NO: 98419 - protein, 184 aa, Glycine max
  Coding DNA Sequence Number=SeqID_6734
MKVDMPALKEQMASMMDAMLGMRQLMENNVAIAAAVSSAAEADPTLPATTHHPLPNMVGRERSTLGHISNPIWDTTEQLTLTDYHLITRHQSCVMMRVMSLPPSLKGSLLDSRTRFTRIVESMPNETSISTPWSPLRGRHPTQCLSPTSLENLETSQHNQYSSPQKDCPWQRKKKGNSISSKRD

SEQ ID NO: 98420 - protein, 135 aa, Glycine max
  Coding DNA Sequence Number=SeqID_6735
MPPPRHPLDPDKSNKALGFPALITGLCQSFGVPVTPSKVIRPPITRAFIEKYCTPRQAQGDAPQAADAPPPPHQADLVGSFGMERYLQHSVCQQAANHRGQISSGLRLHGPEIGLRPRQGRRPQGSRRCRGGPHG

SEQ ID NO: 98421 - protein, 67 aa, Glycine max
  Coding DNA Sequence Number=SeqID_6736
MWAIIDECKEKLNLAATHEQRLEDEYAKISAEREARERYWQSKLPFPALDMGLNQAPAFTKRFIESS

SEQ ID NO: 98422 - protein, 91 aa, Glycine max
  Coding DNA Sequence Number=SeqID_6737
YDHDYEFELGTVVQVEGTSTWVVVTENKRGYISCGSVQVEGTSTWLFKENKGGYIPCGSLLVKVFTRLKRNLKDRRSLGDWMKARFVVEPV

SEQ ID NO: 98423 - protein, 232 aa, Glycine max
  Coding DNA Sequence Number=SeqID_6738
  Gene Ontology: Mol. function=endonuclease activity; Cellular component=mitochondrion; Biological process=response to DNA damage stimulus
  Homolog annotation: Hit_ID=A7MK80; Match level="QueryCoverage=96%, HitCoverage=69%, E-value=1e-103, Identity=79%"; Hit description =Putative uncharacterized protein
  Pfam annotation: Domain name=UvdE; Domain location=1-187; Score= -39.7; E_value=8.7e-11; Accession=PF03851.5; Description=UV -endonuclease UvdE
MGGVLPELQPLFSRCGELARAHNIRLSFHPGQYTVLASDNDDVVDRALEDVEYHTLCAVLMGYGRQFQDFKINIHMNGKRGIEGFRAAFMRLSPEARNMLTVENDEISCSLDDVLQARALCPVVLDIHHHWVKENQFIQASDARVALILESWRGVRPVLHYSIAQEGLIPESGFPDQEQLTASKPKLRAHSDYYFNQTLNDWALSFDRFDIMCEVKMKNLARDRLYDYAQTR

SEQ ID NO: 98424 - protein, 200 aa, Glycine max
  Coding DNA Sequence Number=SeqID_6739
  Homolog annotation: Hit_ID=Q6WAY6; Match level="QueryCoverage=89%, HitCoverage=38%, E-value=2e-18, Identity=30%"; Hit description =Putative uncharacterized protein
MASQEEWVPFRDILALLIFGVVLFPNVDGLVDLAAIDAFLAYHHSKEIPVRRIDWDQHLAGIGGNTINWFPRWKEGKEGVLFSCGDYPNVPLIGTRGCINYNPALAIRQLGYPMRGAPTEESLSPFLVRDFGAQSLKVVQRVHKAWKSPLRKDKELRGIRNGIIGGYHEWLRVHTRGLVWLSKLKVINEENFEAPEEDEK

SEQ ID NO: 98425 - protein, 91 aa, Glycine max
  Coding DNA Sequence Number=SeqID_6740
  Homolog annotation: Hit_ID=A7NVG2; Match level="QueryCoverage=42%, HitCoverage=4%, E-value=6e-08, Identity=69%"; Hit description=Beta -galactosidase
MLRQPKWGHLKELHAVVKSYSTTLLEGKQNKFSLGQLLEDNSELQQQFSSWIKTIVAVPVKAWGVVQCESRKKHINVPLDRSSQVVVKATK

SEQ ID NO: 98426 - protein, 144 aa, Glycine max
  Coding DNA Sequence Number=SeqID_6741
  Gene Ontology: Mol. function=calcium ion binding; Cellular component =flagellin-based flagellum; Biological process=ciliary or flagellar motility
  Homolog annotation: Hit_ID=A7QBM2; Match level="QueryCoverage=86%, HitCoverage=88%, E-value=6e-26, Identity=50%"; Hit description =Chromosome chr1 scaffold_75, whole genome shotgun sequence
  Pfam annotation: Domain name=efhand; Domain location=42-70; Score =24.2; E_value=0.00049; Accession=PF00036.23; Description=EF hand
  Pfam annotation: Domain name=efhand; Domain location=6-34; Score =19.2; E_value=0.015; Accession=PF00036.23; Description=EF hand
  Pfam module annotation: Pfam domain module=efhand::efhand; Domain location=42-70::6-34
MRVNTEFERVLKYFNEDGDGKISPSELRNRLGMMGGELLFKDAEKLIEELDSDGDGLLSLENFVKIMEDAGEEKLKDLAEAFEMYRNTEMYGFITTKSLQRMLRRLGESKSMEQCTTMIDHFDLNGDGLLVKQLRFSRLLIIGN

SEQ ID NO: 98427 - protein, 43 aa, Glycine max
  Coding DNA Sequence Number=SeqID_6742
MQILIKKYRNGNNSSYMAPNEVIPKRGERSCFEIQFRLKNHLI

SEQ ID NO: 98428 - protein, 76 aa, Glycine max
  Coding DNA Sequence Number=SeqID_6743
MAPRKLATKRSRKDKAAEGTSSAPEYDNHRFRSAEHQQRFEAIKGWSFLWERRVQLRDDEYTDFQEEIVRRHWASL

SEQ ID NO: 98429 - protein, 121 aa, Glycine max
  Coding DNA Sequence Number=SeqID_6744
MGEVEEVQEQMKADMEAMKEQMATMMEAMMSMKKIMEANAVAVATTSAIAKVNPMPPSDLNQMNHPTSDMVGKDLGSTDGPMMCKFKTSTPSCHMACLLTIHHPMWRTLLKRMSITLLHTH

SEQ ID NO: 98430 - protein, 113 aa, Glycine max
  Coding DNA Sequence Number=SeqID_6745
  Homolog annotation: Hit_ID=A5BEV8; Match level="QueryCoverage=53%, HitCoverage=7%, E-value=1e-07, Identity=44%"; Hit description =Putative uncharacterized protein
VSVDKWMDITEMGYVIASWYNVILVSLSRQQSMKFFPLRSQPPPDSSGHRMICVSHVFGNHFVQEKLAVRRLSTQGWVSFFQMDRLFTMILGFTSKLRLRCPFEYQTTVILQA

SEQ ID NO: 98431 - protein, 175 aa, Glycine max
  Coding DNA Sequence Number=SeqID_6746
  Gene Ontology: Mol. function=helicase activity; Biological process =protein amino acid phosphorylation
  Homolog annotation: Hit_ID=Q9C925; Match level="QueryCoverage=93%, HitCoverage=16%, E-value=1e-36, Identity=42%"; Hit description =Putative uncharacterized protein F14G24.23
  Pfam annotation: Domain name=DUF889; Domain location=1-167; Score =111.2; E_value=3.2e-30; Accession=PF05970.5; Description=Eukaryotic protein of unknown function (DUF889)
MRLQGNAQSIDDQETTKFAKWILDIGDGVIGNQNDGYATVEIPQYLLITEYNDPIDAIVRSTFPDLYQHHSNPEFFKCRAILASTNETIEEVNDYILCLIPGEHMEYLSSDYIEKSETIDSWHFQSITTEFLNSLNISGLPNHCIKLKIGSPIMLLRNLDQTEGKKSNACVMVLD

SEQ ID NO: 98432 - protein, 164 aa, Glycine max
  Coding DNA Sequence Number=SeqID_6747
TKVLFCAFCYPEAADPMTCGNHLVQHLFAIYKTQSMIASRDKRRLLRLLSSRGGGPNDMREPFGGGPDDMQLSARSMSDKRAETDSAPFIIQEQRVDWNSKLGGKHAETDSAPFIIQEQQTEWINAHRRILRPLSFRNIKNNKLGGKRAETNSVPFIIQEQQVG

SEQ ID NO: 98433 - protein, 39 aa, Glycine max
  Coding DNA Sequence Number=SeqID_6748
MVPWAKRSFNATEESGRASISRPCVKHKISALSATVVFY

SEQ ID NO: 98434 - protein, 146 aa, Glycine max
  Coding DNA Sequence Number=SeqID_6749
MRHRIPMIGGMMNVLSGATLFCKITHASNIFMIHIHRDSLGSYQGVPTNPKRIKIILEWPTPPSIRKICGFHDLTNFYKRPYLTPTYQTPHDVAPCGACRPWIFSINGVLCFLKFNGSRMEKGKDDWRCHLKEKMSQEEVHHHRKP

SEQ ID NO: 98435 - protein, 211 aa, Glycine max
  Coding DNA Sequence Number=SeqID_6750
  Homolog annotation: Hit_ID=Q2HW90; Match level="QueryCoverage=94%, HitCoverage=46%, E-value=4e-18, Identity=27%"; Hit description =Putative uncharacterized protein
MGSSQKHPLKKRYQVKIKSLEVTSLRELGQLMGQLQRQAFRKAYGKIWDLARVEVSMEPIASLSRYYDQPLRCFTFEDFQLVPTVKEFEEILGCPLGGRKPYLFSGFYPSTTRVAKVVKISAQELDRVKQNRNGVVEVPRKCVLFPNMEGLVDLAVIDAFLAFHHGKESPVVAILAMHDTFDQRCEKSGARIVCCTPALYVWLVSHLFLQE

SEQ ID NO: 98436 - protein, 143 aa, Glycine max
  Coding DNA Sequence Number=SeqID_6751
MTGRLISGSLALESRILHYLIVRILLPRSSNLAQVSEEDLIVMWSFHTGRQIDWAQLVRSFLIGAAVVASFGYRKERDGSWVKKGLMDFKPMLVKGLMLWNDKWTRDSMKWTQGSQRLKKMSPSFATALIYLHHHHQFRHYHY

SEQ ID NO: 98437 - protein, 105 aa, Glycine max
  Coding DNA Sequence Number=SeqID_6752
  Homolog annotation: Hit_ID=A6FJQ2; Match level="QueryCoverage=36%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLVTPGFPSHDVVNDGQCQACMPAGRL

SEQ ID NO: 98438 - protein, 144 aa, Glycine max
  Coding DNA Sequence Number=SeqID_6753
  Subcellular localization annotation: CTP_CleavageSite=21; ConfidenceScore=5.16e-01
MAPLSSLQNGQMTKSNRTTLRGSSQRDLQKDRMSPHLPNFTTKVACICIPKNHVNCIDFLHLMSKSCGFGMTGPLDESISCFLIRVDPWVLVPITFRGLHVLALRGLHVLTFRGLHALGSEDYTSSSSEDYMSSPSEGYAPSPS

SEQ ID NO: 98439 - protein, 49 aa, Glycine max
  Coding DNA Sequence Number=SeqID_6754
YGTLDGVLSDMVLQVFRCLSYMHDIKSMKENYLPELNEMYQKSASKLQR

SEQ ID NO: 98440 - protein, 52 aa, Glycine max
  Coding DNA Sequence Number=SeqID_6755
MTLRQHGLKPNHKTMEDIHGEQDEEQGIKESPNKKIEEAKEHHLDEDALDTT

SEQ ID NO: 98441 - protein, 105 aa, Glycine max
  Coding DNA Sequence Number=SeqID_6756
MSLLYQVRFLRHYIVGSVSPGSEIPRWFNNEHEGISVSLDASLYTGLVCYQICQMNHPRRLRYFLLNVDPIPYQFKHTEINITRYKEPKMLCPRFSVLGCYFVYI

SEQ ID NO: 98442 - protein, 165 aa, Glycine max
  Coding DNA Sequence Number=SeqID_6757
MVDRGGEENRPPRRTLSDYAYQQGPKHYNNIVIPPFINKLVELKLALLCVIGLHSFDGMDHEDPYTLLSTFMELCSTMGASDEDAEAVYLRAFPFSLTKMVLDASTRGTMMSKSLEEAIVIIDSIAAHDYQSHHGRTPIQRKGNMVCSGILCKSSAYPNSAQNRL

SEQ ID NO: 98443 - protein, 152 aa, Glycine max
  Coding DNA Sequence Number=SeqID_6758
MGDQEEMQEQMKADMSALKEQMASMMDAMLGIRQLMENNMVTAAVVSSAAEADLTLPATAYHPLPNVVGREKSTLGHVSNPHLGYNRVAYPYGLPPNYTPPVMRDDSDEVHEDCREYAQGDIDFYAPVPVEGPAPNTLPQPNLTGEPRNLPA

SEQ ID NO: 98444 - protein, 279 aa, Glycine max
  Coding DNA Sequence Number=SeqID_6759
MSGMDECMKKCTWHRFYEYGNPGNCPLLRYNIWAAWRPTAGIIPKVVISLLMVSRGIIPFEEHIAAVGTISNNMLSKRKTLDEVESPIVATYLSAGGRHGAHGCVFQERKMRAVATNVYSRKTSKKLERCGLRTLGVKGSGVVFTHGEGEKREVVAAQLAQARWLPPSSPRRAGLLPPEGTAFCWNILEGPNFTDYATFPSLTSGMLRNFTDCAIMLPFDSRHVVELHGLPNDGCQVPRSGQAKIQHGRGKQYDHGNMMTPLLNSVSLQTMALVNSLWP

SEQ ID NO: 98445 - protein, 113 aa, Glycine max
  Coding DNA Sequence Number=SeqID_6760
  Subcellular localization annotation: CTP_CleavageSite=54; ConfidenceScore=5.14e-01
MKYQDANNYQLQIFAVSRICPLDLMMKYVQFQLSLANQWAKRASTTKRSFSVLSATEESGRASISRSCAKREISMLSATGVFSQAQQLGYRTLRRSGHRIPQHTIVPISGKEL

SEQ ID NO: 98446 - protein, 134 aa, Glycine max
  Coding DNA Sequence Number=SeqID_6761
MEAMKEQMTTMMEAMMSMRKMMEVNTTIVIAASTATEVDPTYPFGLNQVNRLVSDMVGREVKHWEVRAAPNLCRSKASIPFHHMACHPTIHHLMLHMLPMRTSITLLPYPLRAKNPNLVMHRSLNPWERHMKYL

SEQ ID NO: 98447 - protein, 155 aa, Glycine max
  Coding DNA Sequence Number=SeqID_6762
MFIDPNNANTATLGEVVETLQYMVSPQGRNTWTVDDLVPYVEKLAILSQEQERITEPVAHGPASERRFPPQQFHMLQSSVETRGFDRRREIVQAEDFSQHMEQRGHGMYYTPPTFAQYPSQMYQYPFEGHDTDMSASEHSLVVLRKHNLIFHGRP

SEQ ID NO: 98448 - protein, 142 aa, Glycine max
  Coding DNA Sequence Number=SeqID_6763
MDNEEGVQEQMKADLSALKDQMASITEAMLKLQKTLEDNATTTASNAVREAEPVLQPTINLGRDRNPTVFGLRYSPQAYPYSLPLDFTPCVAPEDVSQAPTFEGQLPPYVDYPLQEDNEGDTHLGPLLPLKDPSPMNYLNQT

SEQ ID NO: 98449 - protein, 79 aa, Glycine max
  Coding DNA Sequence Number=SeqID_6764
MKKTHGVATNVYSRKTLEKPKRGFWILKIRVRELFTHREGSIRGVALAPTYPQITSGTNERLKLTLQEENEITDDRRRR

SEQ ID NO: 98450 - protein, 81 aa, Glycine max
  Coding DNA Sequence Number=SeqID_6765
MLAAQLAQASRVASSRSNSLLEEYSGGPKWAWVLFAPPFLLSVEERIPEFQEPMDLRSNPFQGGGNDAIPFLVLKLTTRLK

SEQ ID NO: 98451 - protein, 98 aa, Glycine max
  Coding DNA Sequence Number=SeqID_6766
KGNACDVGSKYTLEVHISDLGNEGALIVHGKWPRGNLPQRDPGRIRRPKELVPLPSMTVTALGALYISSALRPSRDGHFSGSDASSSGTMSIPISRKK

SEQ ID NO: 98452 - protein, 34 aa, Glycine max
  Coding DNA Sequence Number=SeqID_6767
MPQPGQPDEVVVARLRPVEHHPEPVSGDGRPNYL

SEQ ID NO: 98453 - protein, 109 aa, Glycine max
  Coding DNA Sequence Number=SeqID_6768
  Subcellular localization annotation: CTP_CleavageSite=40; ConfidenceScore=5.51e-01
ASVAVTLRVTTTPAALNAPLQGASHSPFRLRNCWEGRSVRASSLLRQLAKGGCAARRLSWGELELHRGGGRSRTSGSPGLQEFDRCEPERDRDSDAILPPQGHWIENSK

SEQ ID NO: 98454 - protein, 118 aa, Glycine max
  Coding DNA Sequence Number=SeqID_6769
MRILFYRPRFKKSKVVLQWGLLSWEPNLDIWGETNLGVKVSVSGRASILFHKARVTMMIRKQRAKLVMATARWALKHPVYGIVILWLGIYTDSPNVSKLCSFISSMNSSILISVHSGK

SEQ ID NO: 98455 - protein, 90 aa, Glycine max
  Coding DNA Sequence Number=SeqID_6770
MNSLSASDALSEFIKTVEFMNVQTNSQSDICMASRKRKSMASRPAAQYDTRHSQSLEAWNRYTDNILGQNIIPERNVTIYHTEFDELKWS

SEQ ID NO: 98456 - protein, 136 aa, Glycine max
  Coding DNA Sequence Number=SeqID_6771
MEISEDTDIPVILGRPFMLTASFIVDMGKKKLELGFEDQKIDFDLFVEDKPAPEHNVCLQVMEGGQEVLKGFNFLEKGLKNNLQNFFLKNSPFAKRKPRAKRISVHALSHESRALNAQPLHLRPIWSAKLAKVELS

SEQ ID NO: 98457 - protein, 61 aa, Glycine max
  Coding DNA Sequence Number=SeqID_6772
MKKILGLQAPMELASKWDCHHQKGGDCGSNAFQDYFNDAKESRVKQVSRIKIKIQDSRIKI

SEQ ID NO: 98458 - protein, 87 aa, Glycine max
  Coding DNA Sequence Number=SeqID_6773
MGSNQEHAFKKRFHQVKVKYGSNQLARVREEDGSSLHSLFDHCQHMIELNNLQNWGLLMSTKEHALRCPYRMRAKARVMSEIEEVQE

SEQ ID NO: 98459 - protein, 92 aa, Glycine max
  Coding DNA Sequence Number=SeqID_6774
  Homolog annotation: Hit_ID=Q6UUU1; Match level="QueryCoverage=93%, HitCoverage=58%, E-value=8e-34, Identity=82%"; Hit description =Putative uncharacterized protein
MAYERGGDFLEDARKILNREVRGPRQSRFSIGSAPLTSITKSDAQISGGETRQDYKDTRRFPLAAPSCALLFLPFGLPVSFRCYGAFVSFHA

SEQ ID NO: 98460 - protein, 135 aa, Glycine max
  Coding DNA Sequence Number=SeqID_6775
  Homolog annotation: Hit_ID=A9N427; Match level="QueryCoverage=53%, HitCoverage=72%, E-value=8e-23, Identity=58%"; Hit description =Putative uncharacterized protein
RTAKENPMRKILLLAAVLLASAPIVTQAEEITLLPAIKLQIGDRDSYGHYWDGGRWRDKDYWHRHYEYRDKHWRKLEKKQRKAYEKGYHDGRKDAKKRIHCGEDSCGSYGHITAGTLLRTVIKDIQTCYSSRDNP

SEQ ID NO: 98461 - protein, 76 aa, Glycine max
  Coding DNA Sequence Number=SeqID_6776
MACNLRLTALRNLTPIVKQSVKFRDMSGVERKHHCAIRKSKCFRNASVSDPVEILHRSSSFFTVLHPFFVRSSFFN

SEQ ID NO: 98462 - protein, 192 aa, Glycine max
  Coding DNA Sequence Number=SeqID_6777
GVQEQMKVDLSALKDQMASITEAMLKLQKTIEDNATAAASNTTREAELVLQPAINLGRDRNATGFNRRYSPQAYPYGLPPDFTPRTAPDDLSQAPTFAGQLPPHDPTPHELPQPNIVHHVPSPSAPVKELVPFAKDKGKIDLLEERLRAVEGLGNYPFSDLADLCLDGGIFYGRKTVNALLSRQLSRSSSGV

SEQ ID NO: 98463 - protein, 60 aa, Glycine max
  Coding DNA Sequence Number=SeqID_6778
  Gene Ontology: Biological process=transposition, DNA-mediated
  Homolog annotation: Hit_ID=Q1J7G7; Match level="QueryCoverage=50%, HitCoverage=42%, E-value=5e-10, Identity=96%"; Hit description =Transposase
GHQELTILRSDLPSQWLLFLSAVPPVQVLTGWCVTAKAPPDISAGKCSGHAARNHHTRRA

SEQ ID NO: 98464 - protein, 80 aa, Glycine max
  Coding DNA Sequence Number=SeqID_6779
  Homolog annotation: Hit_ID=A5BVY1; Match level="QueryCoverage=75%, HitCoverage=4%, E-value=6e-07, Identity=46%"; Hit description =Putative uncharacterized protein
MGFSVEGNEHMVCILKKSIYSLKASFSPMVSGTNDLGLLHETKKFLSINFEVKDMGELIFVSMFWLMSHGQVDENFINAL

SEQ ID NO: 98465 - protein, 105 aa, Glycine max
  Coding DNA Sequence Number=SeqID_6780
  Homolog annotation: Hit_ID=A7Q2G2; Match level="QueryCoverage=88%, HitCoverage=38%, E-value=2e-09, Identity=33%"; Hit description =Chromosome chr1 scaffold_46, whole genome shotgun sequence
  Pfam annotation: Domain name=zf-CCHC; Domain location=79-96; Score =24.5; E_value=0.0003; Accession=PF00098.14; Description=Zinc knuckle
MFKQGMTTKENDKKKKGIALKASFCIQEESGRENLNEIEEDDDFSFFIKRFNKFLRNKGNQRRTNFNPKRKGEDSPFVPKCYECNQPRHLRVDCPSFKKRMEKSD

SEQ ID NO: 98466 - protein, 18 aa, Glycine max
  Coding DNA Sequence Number=SeqID_6781
MSRNFTDCLTMGIKYLEV

SEQ ID NO: 98467 - protein, 72 aa, Glycine max
  Coding DNA Sequence Number=SeqID_6782
  Subcellular localization annotation: CTP_CleavageSite=65; ConfidenceScore=5.05e-01
MGVQIETRPTWAFQKIPPEGGCFWRKQPSSPGRAGKSKPRHFHNVSVTFLGDFAKIFNRSSFVLRRSSVFNR

SEQ ID NO: 98468 - protein, 226 aa, Glycine max
  Coding DNA Sequence Number=SeqID_6783
  Homolog annotation: Hit_ID=UPI00016621D1; Match level="QueryCoverage =96%, HitCoverage=40%, E-value=6e-17, Identity=32%"; Hit description =UPI00016621D1 related cluster
GLHAFTFTGLHVLPIRGLHALTLRGLHVLAIRGLHVLAFGGLHVLTFRGIHVLTFRGLHVHAFKGLYDLAIRGQEALTFRGLHVLTIRGLLVLTFRGLHALAIRGLHAFTIRGLHVLAITRLHVLTIRGQHALTFRRLHALSFRGLHVLTFRGLQAFTFRGLHVLAFRGLHALTFRGLHVLAIRGHYTSSPSEDYTPLTFRGLHVLAIRGQHVLTFRGFHVLTFIG

SEQ ID NO: 98469 - protein, 136 aa, Glycine max
  Coding DNA Sequence Number=SeqID_6784
MNSLSALIALSDRAFLGQAQFVAASSELNVFQKKKKALVQGPQLYDTRRFHSFEAWTRYIDNVLGRHILAKRKVEIYHTELDEFKAELERRNFHKRLTNLADSNFDLAFCEGVSCQPLQSRGAFTKTSPEGLLLTA

SEQ ID NO: 98470 - protein, 179 aa, Glycine max
  Coding DNA Sequence Number=SeqID_6785
  Gene Ontology: Mol. function=ATP-dependent helicase activity; Cellular component=alpha DNA polymerase:primase complex; Biological process=DNA replication, synthesis of RNA primer
  Homolog annotation: Hit_ID=A9MI30; Match level="QueryCoverage=81%, HitCoverage=19%, E-value=1e-64, Identity=79%"; Hit description =Putative uncharacterized protein
  Pfam annotation: Domain name=Helicase_C; Domain location=65-155; Score=24.6; E_value=0.00033; Accession=PF00271.22; Description =Helicase conserved C-terminal domain
  Pfam annotation: Domain name=PhnA_Zn_Ribbon; Domain location=7-37; Score=7.9; E_value=0.099; Accession=PF08274.3; Description=PhnA Zinc- Ribbon
  Pfam module annotation: Pfam domain module=Helicase_C::PhnA_Zn _Ribbon; Domain location=65-155::7-37
MCHDCGWLAECQRCDSYYTLHQQHRQLRCHHCDSQRPLPHQCPGCGSTHLLPVGVGTEQLEQQLSTLFPGVPVSRIDRDTTSRKGALEQHLADVHRGGARILVGTQMLAKGHHFPDVTLVSLLDVDGALFSADFRAAERFAQLYTQVAGRAGRADAAGAPVSAAAAVDQPRTVSCGRSG

SEQ ID NO: 98471 - protein, 333 aa, Glycine max
  Coding DNA Sequence Number=SeqID_6786
  Gene Ontology: Mol. function=transporter activity; Cellular component= integral to membrane; Biological process=transport
  Homolog annotation: Hit_ID=Q66C37; Match level="QueryCoverage=100%, HitCoverage=71%, E-value=1e-128, Identity=68%"; Hit description=MFS Superfamily, Anion:Cation Symporter Family transporter
  Pfam annotation: Domain name=MFS_1; Domain location=1-333; Score =96.1; E_value=1.1e-25; Accession=PF07690.7; Description=Major Facilitator Superfamily
  Pfam annotation: Domain name=PepSY_TM; Domain location=283-309; Score= 2.5; E_value=40; Accession=PF03929.7; Description=PepSY-associated TM helix
  Pfam annotation: Domain name=PepSY_TM; Domain location=52-80; Score =14.6; E_value=0.39; Accession=PF03929.7; Description=PepSY -associated TM helix
  Pfam module annotation: Pfam domain module=MFS_1::PepSY_TM::PepSY_TM; Domain location=1-333::283-309::52-80
MYFVAFIDRVNVGFAKDAMAIDIALSQSAFALGAGIFFAAYALFGIPANLLMNRWGAKRWLSATTALWGALSACTGLVTNEQQFIVLRFLLGIAEAGFYPGILLLASIYFPNKVRASVIGIFVLGVPAALTLGSPLSGALLEMHGVLGKPGWFWMFVLEGLPAVALGVFAFFYLDDSPQQARFLTEEERAALVAQLAAEQQQTETSSVKAAMRSGKVWHLALIYGALQIGVYGLMFFLPSQVASLMGTHLGFKASLVAAIPWAFSALGVYFLPRFADRNTARRLPIAVGCMIAAALGLVVSSYAGPLLAIVALSCCAVSFLAVQPIFWTFPAQ

SEQ ID NO: 98472 - protein, 91 aa, Glycine max
  Coding DNA Sequence Number=SeqID_6787
MQTIRKNHCIQSQTGIYGSLSMNNNYLYSKLHSTRITTFMTYKNIHDVQEHTRTSTVVCGSKGSLNCKHHQLHDKGSSIKSMLYKLFGREQ

SEQ ID NO: 98473 - protein, 55 aa, Glycine max
  Coding DNA Sequence Number=SeqID_6788
MAAQLIHDRVEMECLEGVWETLEGNARGTSTHASAHCGVDITYTYSIATSGGSSS

SEQ ID NO: 98474 - protein, 80 aa, Glycine max
  Coding DNA Sequence Number=SeqID_6789
MIPPPRIVPVAGEHKLQAIQLLQTVAQKGKDFLFVASWVTRLTKASSLPSSFLVSADEDEFVATSCTPLMTIASLLALNC

SEQ ID NO: 98475 - protein, 66 aa, Glycine max
  Coding DNA Sequence Number=SeqID_6790
VADSDDEGSTDLRTNPLQGGGDDAILQRRGPITRAMARRLQEDWARDAGEGPRVLMSLRVDFGSMG

SEQ ID NO: 98476 - protein, 344 aa, Glycine max
  Coding DNA Sequence Number=SeqID_6791
MADHAAAAADRAFLRQAAPGRLLRLAHVLGLDVKAVDVVEQAVEGFHHHRHIPIHRVIARGQRFTLQRDQRIAHHAHAVGVGEGDRAGQQARFAHPFQTGGVAVAVQHVHPGEAGRVARGAGARFDHRHAGAHAAPVRQIGMDAGMADAHAGHVGDGVQRAGRALSDDNAQILSALRHGYSPSIEGAARGAGWRPRRWFSASPKPMMPAMIIKSFRLLAIKIVHSTYRQHSSATTTGSGHSGIRYGWWKWRRRRLISAATAMMMYTSCSRITVNEVSDSRSEQNASSADGTPNSRVAIQGVPKRGWMIFSARLNVSSQKPSRPLANIMRLNCATMAMMALNPDR

SEQ ID NO: 98477 - protein, 46 aa, Glycine max
  Coding DNA Sequence Number=SeqID_6792
KWVYDPNMENARMSKHENKWYAILQIKSLLNAYDDAMTHAKCEAGI

SEQ ID NO: 98478 - protein, 147 aa, Glycine max
  Coding DNA Sequence Number=SeqID_6793
MSSKVILIMPKNQELSKDSRIKFQDSKFKNNQDQDSRLKIQESREDSIKINIKKFFKTLSSTRSFHKIITKEFYSLVIDYQKRIHLLGDCYTENKRGYISCGSVQVEGTSTWVFKENKGGDIACGSLACKGFYKVERNLKNRRLLGD

SEQ ID NO: 98479 - protein, 152 aa, Glycine max
  Coding DNA Sequence Number=SeqID_6794
  Homolog annotation: Hit_ID=Q2HTA0; Match level="QueryCoverage=70%, HitCoverage=16%, E-value=5e-12, Identity=40%"; Hit description=IMP dehydrogenase/GMP reductase, related
  Pfam annotation: Domain name=DUF1723; Domain location=68-117; Score =47.9; E_value=3.6e-11; Accession=PF08330.1; Description=Protein of unknown function (DUF1723)
MGAKHLKMTKYKLHATKPRSPDEIRERLELKLSSHGRKVENFGWSASEIEDLVAATGLSPLVACSLDTGDRGLRSIFAERWHKKTSSFHFPVGEVTISLDDVTSLLHLSITGALHSFKALHVDEVVFLLVELIEVSLEKARAETIQCYGVGN

SEQ ID NO: 98480 - protein, 103 aa, Glycine max
  Coding DNA Sequence Number=SeqID_6795
MSETLLKDVEGTSIMESPHHSVHFEHSEYSVAGDSEHSDFEYSTTNFHTENMAQPPPHERTLREMAAPGFTYESLCIQYPDEGVPYVLMTGLIHLLPKFHGLA

SEQ ID NO: 98481 - protein, 85 aa, Glycine max
  Coding DNA Sequence Number=SeqID_6796
  Subcellular localization annotation: CTP_CleavageSite=28; ConfidenceScore=5.34e-01
MATQLNQAQSQDSNKLPSQTMQNPKNVRAITLRSGKQIEVPPPVAAPTPKKMDEIVAQKRNLPDHERANKNYHVGGPSSSSSDLQ

SEQ ID NO: 98482 - protein, 64 aa, Glycine max
  Coding DNA Sequence Number=SeqID_6797
MQQGQADILIARFPDPNYDVKTVFQRKLKTYNGGSKVRKDARQIKLTRNKRRTMVTSKENERSD

SEQ ID NO: 98483 - protein, 45 aa, Glycine max
  Coding DNA Sequence Number=SeqID_6798
MAGKGQQTHRRHLQSPSAHLQRLERCLRPVVDQQATKSKAKVGHT

SEQ ID NO: 98484 - protein, 206 aa, Glycine max
  Coding DNA Sequence Number=SeqID_6799
  Gene Ontology: Mol. function=ATP-dependent helicase activity; Cellular component=plasma membrane; Biological process=ribosome biogenesis and assembly
  Homolog annotation: Hit_ID=A5FH33; Match level="QueryCoverage=99%, HitCoverage=45%, E-value=4e-62, Identity=59%"; Hit description =DEAD/DEAH box helicase domain protein
  Pfam annotation: Domain name=Helicase_C; Domain location=23-97; Score= 94.2; E_value=4.1e-25; Accession=PF00271.22; Description=Helicase conserved C-terminal domain
MSKVLIFTNNKKNSDLLFTKIEELFPGQFDVIHSNKSQNYRLKAMKRFENEEIRGLITTDVMARGLDISDITHVINFETPEVPEQYIHRIGRTGRADKNGKAVTFVTKKEEPLVLDIELLMDKELKFIDFPEEVKINPKKIASEEDQIIMKNPAQVKLYEGGGAFHEKKDKNKKENWGGPSKRKAPKKFGANRAQQKAISKSKRKK

SEQ ID NO: 98485 - protein, 112 aa, Glycine max
  Coding DNA Sequence Number=SeqID_6800
  Pfam annotation: Domain name=G-patch; Domain location=15-59; Score =15.9; E_value=0.0022; Accession=PF01585.14; Description=G-patch domain
MIQESAGTATPSKEVDSPGYPDGARVGYEPGMGLGKDSHGNADVVDVRGNPHKYGLGSEPGKPGRRNAPSRLRADRAWPGHVSQCFASAAIMFEEEVAAIGEEAPQDPLSFV

SEQ ID NO: 98486 - protein, 145 aa, Glycine max
  Coding DNA Sequence Number=SeqID_6801
MVGYEPSSFTDLVFAGERIETSLKSGKFDHLALMNEKTGANEEDENEEGTHVVAAIPTWPNFPPAQQHHYSANINSSHYPPPSHPQRSSLNQPQSPPSTQPMLNTTCSTNQNTNQGRNFAAKKPVEFTPIPVSYANLLPSLLDNQ

SEQ ID NO: 98487 - protein, 132 aa, Glycine max
  Coding DNA Sequence Number=SeqID_6802
  Homolog annotation: Hit_ID=A5AK77; Match level="QueryCoverage=47%, HitCoverage=7%, E-value=2e-07, Identity=42%"; Hit description =Putative uncharacterized protein
MTRGNLSDLQPFDPEIDRTFHRLVRHHLVPFEHPEHSDIGDFEHHSFEHSDFEYSENMAHPPPRERTLRELAAPDFTYESLCIQYPNEYVPYVLKTGLIHLLPKIHGLASEDPHKHLKEFHIVCSTMKPPDV

SEQ ID NO: 98488 - protein, 138 aa, Glycine max
  Coding DNA Sequence Number=SeqID_6803
  Pfam annotation: Domain name=G-patch; Domain location=89-133; Score =15.2; E_value=0.0028; Accession=PF01585.14; Description=G-patch domain
MPKATLDKLPFNASHLRPRSMVVRAFDGSRRDGQLIIVSGEEDILVSCPSSMPYVEVVEESLETSFQALEVVSSAYMESPPVQPRSSGAALVVARVMLGHGYEPGMGLGRNRNGIASLVEFTKNHGCSGWDTSLCAPT

SEQ ID NO: 98489 - protein, 126 aa, Glycine max
  Coding DNA Sequence Number=SeqID_6804
STRAPVLRRGGRTDRRLAPGSMGPLTSSYVLCGSREANEGKLEELTLTLSLFDWSGEATAYTTALLPRLASGKASTLLASLALACAKAYKVLFARSKSFRQSERSDPTEIPHIRCAQYAATARRSY

SEQ ID NO: 98490 - protein, 148 aa, Glycine max
  Coding DNA Sequence Number=SeqID_6805
MSHHSSSVNGEEKIERKEKGKERVEINQDERQQIREEERRKILKELRKEKHASYSSHDSCKILSEELHDYYEGRHRSHLIPHYHRREKERNPQEANINLPYIHGKDNVEAYLDWEIRVEQQLKRNSSSKSYGSHSYPKKDQGQVYFPS

SEQ ID NO: 98491 - protein, 112 aa, Glycine max
  Coding DNA Sequence Number=SeqID_6806
  Subcellular localization annotation: CTP_CleavageSite=50; ConfidenceScore=5.60e-01
MWKRQHLLFLHSSRKTHTQSFIIPHFPKNRPNSQNSPQWSRQLSQPTLLRASEARLTGASSIGGKCAESPPMFIERKTLEKSKETGHEEYSRFGRMVLAPLTFVPKDNSLRL

SEQ ID NO: 98492 - protein, 33 aa, Glycine max
  Coding DNA Sequence Number=SeqID_6807
MKSKVRFLVKFLLLVYPMDSQHLQIRVHNFQAI

SEQ ID NO: 98493 - protein, 15 aa, Glycine max
  Coding DNA Sequence Number=SeqID_6808
MQYLGSDPRSSPNEQ

SEQ ID NO: 98494 - protein, 109 aa, Glycine max
  Coding DNA Sequence Number=SeqID_6809
MHDVMLKVWSTDHYARLMLGGLCMSKHGSCLSMQGVMLKVWSTDHYARLMLGGLCMSKHGSCLSMQGVMLKVCSVNQYACLMLGRLFMSKYDPCLAKHRVLLLLNKWPQ

SEQ ID NO: 98495 - protein, 289 aa, Glycine max
  Coding DNA Sequence Number=SeqID_6810
  Homolog annotation: Hit_ID=A2Q243; Match level="QueryCoverage=32%, HitCoverage=58%, E-value=5e-10, Identity=32%"; Hit description =Nucleic acid-binding, OB-fold
  Pfam annotation: Domain name=Rep_fac-A_C; Domain location=62-201; Score=-51.2; E_value=0.0039; Accession=PF08646.1; Description =Replication factor-A C terminal domain
EFKERLLDLGVEVSRVLLPGDQATSQVSGGSQLSSKDSFLSKAEAKTILEIDAISEDVVCVTVGTISKIVMDNHSWSYPACAQCHRKTDIQTGPFTCGCGKDNDQPVLRYKVEVMVTQNNESSTFLLWDHECAELIGETADDVNRVKIELVNFCCFWQDGDLDLDASPQALDKLLGHMLAFKVRIQSKFKNAVVLRYSKDLDLINVVLEMLPDSEACSKIDPSNADCNDATHAECQSLSVTADHDLVAGLPLTPKKRIPSNEADDELGSSQISPAQLSSNKLTRHSHKS

SEQ ID NO: 98496 - protein, 190 aa, Glycine max
  Coding DNA Sequence Number=SeqID_6811
  Gene Ontology: Mol. function=chloramphenicol O-acetyltransferase activity; Biological process=response to antibiotic
  Homolog annotation: Hit_ID=P62577; Match level="QueryCoverage=100%, HitCoverage=100%, E-value=1e-101, Identity=83%"; Hit description =Chloramphenicol acetyltransferase
  Pfam annotation: Domain name=CAT; Domain location=6-180; Score=389.4; E_value=5.8e-114; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWRVIENMVFPSQPNPWVSFTSFDLNVANMDNFFAPVFTMGKYYTQGDKVLMPLAIQVHHAVCDGFHVGRMLNELQQYCDEWQGGA

SEQ ID NO: 98497 - protein, 85 aa, Glycine max
  Coding DNA Sequence Number=SeqID_6812
VEEISNRPWRTEPTYVAKYGDDLWLGVKGQPRSDIADPKSRGKQPRSYAKVPKQSLTGKGSDRTMTTRRAQVIHRSDETLKVAFQ

SEQ ID NO: 98498 - protein, 234 aa, Glycine max
  Coding DNA Sequence Number=SeqID_6813
MAEPSKKRKGYSSRSQWHSEAQDTPILSFISSSSFFSSEEQRTRDGVPFEGALDDDWKFNFSVHDARRLVCTNQADMTGRLLASSLALESRILHYLIARILLRRSSNLAQVSEEDLIVMWAFHTSRQIDWAHLVRYRMHKALRLNAPLPYPHLITLFLQHFNIPLDFEPYVPIKRSFLIDAAVVASFGYRKKRDGSWETLLSFRVFWTGLMDFKPMLVRGLTPWNVKWTHDSRR

SEQ ID NO: 98499 - protein, 218 aa, Glycine max
  Coding DNA Sequence Number=SeqID_6814
  Gene Ontology: Mol. function=hydrolase activity, acting on acid anhydrides, in phosphorus-containing anhydrides; Cellular component =intracellular; Biological process=nucleobase, nucleoside, nucleotide and nucleic acid metabolic process
  Homolog annotation: Hit_ID=P76257; Match level="QueryCoverage=100%, HitCoverage=34%, E-value=1e-109, Identity=90%"; Hit description =Probable ATP-dependent helicase yoaA
MAHAVARAIDKAQPLVVEAGTGTGKTYAYLAPALRAKKKVIISTGSKALQDQLYSRDLPTVAKALKYKGRLALLKGRSNYLCLERLEQQALAGGDLPVQTLSDVIILRAWANQTEEGDISTCASVPEDSPAWPLVTSTNDNCLGSDCPLYKDCFVVKARKTAMDADVVVVNHHLFLADMVVKDSGFGELIPEADVMIFDEAHQLPDIASQYFGQSLSS

SEQ ID NO: 98500 - protein, 223 aa, Glycine max
  Coding DNA Sequence Number=SeqID_6815
MSCLVIITPTFLCRSVSWCMPPTRHPLDPDKSNRALGFPALITGLCQSFGVPVTPSKVIRPPITRAFIEKYCTPRQAQGDAPQAADAPPPPHQADLVGSLGMERYLQHLVRQQAANHRGQVQIHECLYQLSLSQQGQGFVPFVCPTPDQFRAEVAWPGDWLEAQAGEAPAEAPGDAEETCMDEEMTDLLDFLGGSRSHMTMGSPDSYSFLCFILYHLHVILFL

SEQ ID NO: 98501 - protein, 119 aa, Glycine max
  Coding DNA Sequence Number=SeqID_6816
MEEFEAQVAWPGDQPSSFGGGGGWASAVQEPDIEEPPAPAPIEDKDELTPPEPSYFDAGTHTVQEEETAPNQIPQPSPAPAYIPEDAAPVVEPEQLIQDSSAALTLDLNEDQPQEEQDV

SEQ ID NO: 98502 - protein, 248 aa, Glycine max
  Coding DNA Sequence Number=SeqID_6817
MILLDNGEIESERSSDDEMPPLEDCSDVDVVEPVYGDVLVTRRSLNKQSKAVQPTHSSIMHIRGCNICGGAHESGMCMVQEDVSKEVNYMTNPHRQGFHQGGPPRYNQGGISIKAKVSLSNHKSIKSAIINLEVQVDQLAKQLVETSTDNFGANMEKNPKEECKEGEDNKREEGDEEKEESKEKGEKVLPTKTKSQLAREARKEIPSVRVKDIPYPLVPPKKDKEQYFARFLDIFNKLEIIIPFREAL

SEQ ID NO: 98503 - protein, 63 aa, Glycine max
  Coding DNA Sequence Number=SeqID_6818
  Homolog annotation: Hit_ID=A5YPB7; Match level="QueryCoverage=63%, HitCoverage=22%, E-value=2e-08, Identity=60%"; Hit description =Putative gag protein
MRSIQMQEVMEESEEANQEEIIIWDNPYVSRCRNGERPISIWEEMKIAMRIKFVPSHYHRDLH

SEQ ID NO: 98504 - protein, 108 aa, Glycine max
  Coding DNA Sequence Number=SeqID_6819
EFKNVFPKEIPHGMPPSRGIEHQTQRKDAHAKVEYVKRLYDQVNVQIAKKNESYTKQANKKRKEVVLEPGDDLGHLRANVFQEGGNDESPETGQIQAKGPSGEGRRPK

SEQ ID NO: 98505 - protein, 191 aa, Glycine max
  Coding DNA Sequence Number=SeqID_6820
  Homolog annotation: Hit_ID=A1FZ36; Match level="QueryCoverage=95%, HitCoverage=75%, E-value=9e-20, Identity=34%"; Hit description =Putative uncharacterized protein precursor
MAAISFPLMLALLSAQAPMAANAERDYTGPTEASSIGPGICDPGMDMLPNGGGVVIRRCGKNGTVAGVGSNIDAATANTNGFLAVAEEGPVCSVFARDPYVSLPAPGVGIKAQCSSTPLSAYGMTTTTAGQNVLELAINLAATQAWCNVDYYNGSAHGYKYPYTCNRPGQSWSVAGLGSSVDDANAMAMRL

SEQ ID NO: 98506 - protein, 34 aa, Glycine max
  Coding DNA Sequence Number=SeqID_6821
MEEIHGKEDEEQGIKLHIELVGLGSSSSMESFAS

SEQ ID NO: 98507 - protein, 115 aa, Glycine max
  Coding DNA Sequence Number=SeqID_6822
MEHETFLATWLAEIDFSLNGLERFSNLQPQPSYHEKPMKNLWMVEAVYPMMLVFPPEFSPLKTILFGNPSQDTVEKLMEALEEDYKDGNEINESRQFIGGVLDLEKRINRLDTLT

SEQ ID NO: 98508 - protein, 108 aa, Glycine max
  Coding DNA Sequence Number=SeqID_6823
MPKEANFIIEEIHEGSFGTHANGHYGKEWGSLEADWHECCLSPCTDIEPRYELLLGQRRIPWFPWDGSSTPFEVEVPSQRIIMELGFLYKSQNRGSSDAYDQLPYRRS

SEQ ID NO: 98509 - protein, 198 aa, Glycine max
  Coding DNA Sequence Number=SeqID_6824
  Homolog annotation: Hit_ID=A5AZ88; Match level="QueryCoverage=81%, HitCoverage=13%, E-value=2e-09, Identity=33%"; Hit description =Putative uncharacterized protein
MERSMIDAASGGALGDMTPTEARNLIEKMASNSQQFSARNDAIVIRGVHEVATNSSSSGETKKFEGKLDALVNLVTQLAMNQKSAPVARLYGLCSSADPHTDLCPSGQQSEAIEQPEAYVANIYNRPPQPQQQNQPQQNNYDLSSNRYNPGWRNHPNLRWSNHSQQQQQQQLYFQNVAGPSRPYVPPPIQQQQQQPQK

SEQ ID NO: 98510 - protein, 272 aa, Glycine max
  Coding DNA Sequence Number=SeqID_6825
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIHRHTRNHLIKLMSINSFRTQMNRIIIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 98511 - protein, 99 aa, Glycine max
  Coding DNA Sequence Number=SeqID_6826
MKNERRTDEKRRKTFTDLLTETSRKHYGSTSAWIFFTETIFSPKKAEMHSQGDRAAQCTRQDKMSNEELKLQDPRCRIQCPGHPARKYWTHKSVIPLTD

SEQ ID NO: 98512 - protein, 129 aa, Glycine max
  Coding DNA Sequence Number=SeqID_6827
SEFLIEDTQEQEPRFCRPPHNLYHTGPEVIGGEPDDMRRQIMVIPYLLSFRDNRVRWHAETNYGHSPPFVNREERIWQYQDDVGRSVLIIFKIFAVREVPRHVGSLKGRVKAQSVKFCNILEAKEGMIA

SEQ ID NO: 98513 - protein, 56 aa, Glycine max
  Coding DNA Sequence Number=SeqID_6828
MNEFDILVSLILSVATCPSRASEGEAHGCAFQRRKGRQKRGFCSYVPSFGEEIRPT

SEQ ID NO: 98514 - protein, 289 aa, Glycine max
  Coding DNA Sequence Number=SeqID_6829
  Homolog annotation: Hit_ID=Q2HW90; Match level="QueryCoverage=57%, HitCoverage=43%, E-value=2e-12, Identity=30%"; Hit description =Putative uncharacterized protein
MARIAKVVKILAQELDRVKQNRNGVVKIPRKHLEEKAKALADQGEWVLFIDVLALLVFGVILFPNVDRLVDLAAIDAFLAYHHSKESPVVAVLADAYDTFDLRCEKSGARIVCCTPALYVWLVSHLFHHESRPGHLSVGSPDGRKEEPESCPCARGSPSEESTTPFITRGFSDPNARIFQRVRKAWSAVQRKDKEFRGSSNGIVGGYHKWLKARTQELDWLPKLKVSSEEEAETPDESEEVQALKVELERAQAVKEKFKTTAMMVRKECDELGDINVATAEALEWEIKR

SEQ ID NO: 98515 - protein, 51 aa, Glycine max
  Coding DNA Sequence Number=SeqID_6830
  Subcellular localization annotation: CTP_CleavageSite=36; ConfidenceScore=5.01e-01
MAESSKRRKGSSSSTTTAGHHRHGPSDDPLTPPNPSLSSSRSLTLFSIDVQ

SEQ ID NO: 98516 - protein, 102 aa, Glycine max
  Coding DNA Sequence Number=SeqID_6831
  Subcellular localization annotation: CTP_CleavageSite=94; ConfidenceScore=5.45e-01
MVQQFFVRGIRPHLSAIHPKMPLRTCRPFVLIKVRPWTALNLSSSASIFPLSSAKGTDSFMGVGEVGIWRTMFGWGSSCGDRSLRWSRGPRWVSPSSSSCPG

SEQ ID NO: 98517 - protein, 55 aa, Glycine max
  Coding DNA Sequence Number=SeqID_6832
MCTCAIFGAPKCLSMHVCEFSQGDVCDVSNKYTLEEWPRGSLPQRGQEGQGGRRN

SEQ ID NO: 98518 - protein, 27 aa, Glycine max
  Coding DNA Sequence Number=SeqID_6833
MAFYGGSKGLHLMKKIQGLQAPHGATS

SEQ ID NO: 98519 - protein, 26 aa, Glycine max
  Coding DNA Sequence Number=SeqID_6834
MKKNCPRFHKWLEKKGYAKPKETSGK

SEQ ID NO: 98520 - protein, 70 aa, Glycine max
  Coding DNA Sequence Number=SeqID_6835
MKKILGLQAPMELASLMLAFNGGLPESAPDCQPKLLNVRSLVRLNIQASSADPSFKTTPDLDSPLTFRLT

SEQ ID NO: 98521 - protein, 123 aa, Glycine max
  Coding DNA Sequence Number=SeqID_6836
MRGYLMVTAPFVNQGQTTLTTDVETNIVFCTFCRPDPGSQVTGWGYLWLPAPFVNQGQMSPLNAQRLKSFLHVLSSLPVKSGDMRGYLMVIHTFGQPGANEPVDARGLTSSSAPFVVLHREVK

SEQ ID NO: 98522 - protein, 271 aa, Glycine max
  Coding DNA Sequence Number=SeqID_6837
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIQHFLSHCLLPSVDPDEKSAVNHIVAPLVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 98523 - protein, 156 aa, Glycine max
  Coding DNA Sequence Number=SeqID_6838
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
  Subcellular localization annotation: CTP_CleavageSite=30; ConfidenceScore=5.22e-01
MKHFTDTLISANILTSHQDQRRAKGSGIKSAGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 98524 - protein, 102 aa, Glycine max
  Coding DNA Sequence Number=SeqID_6839
MAGRRAHFEFAHHGGCPYFPNLCLPYLRLDGSLMPDGDVGFTLATTLVAAIATALASIIFFTLIMTSIIVVIFSFMATMWAFTFSCTSSVLPITLALAQERM

SEQ ID NO: 98525 - protein, 79 aa, Glycine max
  Coding DNA Sequence Number=SeqID_6840
MEARNPHVSPEMRRGYHYSPRCVSFTSAARMRGDLPCLRIYIERCAAPPITKLNQLEGLGGLGLELSVLGLGLGLRIRV

SEQ ID NO: 98526 - protein, 283 aa, Glycine max
  Coding DNA Sequence Number=SeqID_6841
HYTDNILARNILLERNVKLYITEFDDFRREVERRNWHRELTNFFEGSIDVVVVKEFYANLYVPEDKAPKQVRVQGHLIMFDADSLNTFLKTQVVLEQGESLPSYSRFCRLRPDPQELVVWMCIPGRGFVLNAEGLPWKLLRKDLTTLVQTWIMKMNMNIGALISGQISFIAQSSSSRLGFPALITALCKARGVTSDSLTYESLSPAINLAYIKNSWNLDDPSVTFPGTKKSRAKRSEALSPSAAPAPSTSALPSAPAAPVLPEPAPGTAPNYVELAGCGPTTT

SEQ ID NO: 98527 - protein, 82 aa, Glycine max
  Coding DNA Sequence Number=SeqID_6842
MHTGARFRPYRRREMSADHAHHHNSDLPLPKCQLGLRPDRTGKIPSGPGEVQQGPGVSSSDYEPLSVLRSTCPPQQGHQASY

SEQ ID NO: 98528 - protein, 79 aa, Glycine max
  Coding DNA Sequence Number=SeqID_6843
MASDPGQIRDLVWRQIQPFHEHNHGVSAEGSLIRHNGLWTGLVEPELGKSVQVNWKRKRWGGACRRHTLVRGAFVVESW

SEQ ID NO: 98529 - protein, 56 aa, Glycine max
  Coding DNA Sequence Number=SeqID_6844
MEPWGLMANGCGSGGCLSEEVECGRRSGGGVDMNDDGWKKKNKKEEEWIEEKEREV

SEQ ID NO: 98530 - protein, 572 aa, Glycine max
  Coding DNA Sequence Number=SeqID_6845
  Gene Ontology: Mol. function=sugar:hydrogen symporter activity; Cellular component=integral to membrane; Biological process =carbohydrate transport
  Homolog annotation: Hit_ID=O04249; Match level="QueryCoverage=78%, HitCoverage=87%, E-value=0.0, Identity=72%"; Hit description=Sugar transport protein 7
  Pfam annotation: Domain name=DUF81; Domain location=132-398; Score= -71.8; E_value=0.06; Accession=PF01925.10; Description=Domain of unknown function DUF81
  Pfam annotation: Domain name=MFS_1; Domain location=45-440; Score =94.4; E_value=3.6e-25; Accession=PF07690.7; Description=Major Facilitator Superfamily
  Pfam annotation: Domain name=Sugar_tr; Domain location=30-489; Score =449.5; E_value=4.5e-132; Accession=PF00083.15; Description=Sugar (and other) transporter
  Pfam module annotation: Pfam domain module=DUF81::MFS_1::Sugar_tr; Domain location=132-398::45-440::30-489
MAGGSFTTGTVSKERAEQYKGRVTAYVIISCIVAATGGALFGYDIGISGGVTSMDDFLIEFFPSVYRQKKHAHENNYCKYDNQGLAAFTSSLYIAGLVASLMASPVTRKYGRRVSIIGGGISFLIGSALNASAVNLIMLILGRVMLGVGIGFGNQAIPLYLSEMAPTHLRGGLNMMFQVATTFGIFTANMINFGTQKIKPWGWRLSLGLAAVPALLMTVGGIFLPDTPNSLIERGLAEKGRKLLEKIRGTKEVDAEFQDMVDASELAKSIKHPFRNILERRYRPELVMAIFMPTFQILTGINSILFYAPVLFQSMGFGGDASLISSALTGGVLASSTFISIATVDRLGRRVLLVSGGLQMITCQIIVAIILGVKFGADQELSKGFSILVVVVICLFVVAFGWSWGPLGWTVPSEIFPLEIRSAGQGITVAVNLLFTFIIAQAFLALLCSFKDRNGTRIGTQPVRGSQNQIETFVVAAAGLGAERLASLEDLDMAHDEVRAGAFHHHAGAVAVVEPPPASLMELGTRHRGGLEDNRGSGEERFPLEGNQGVMHYGGNVGHHVEPSTLIPIVEG

SEQ ID NO: 98531 - protein, 122 aa, Glycine max
  Coding DNA Sequence Number=SeqID_6846
  Gene Ontology: Mol. function=protein serine/threonine kinase activity; Cellular component=plasma membrane; Biological process =protein amino acid phosphorylation
  Homolog annotation: Hit_ID=A7QBV3; Match level="QueryCoverage=49%, HitCoverage=6%, E-value=7e-19, Identity=75%"; Hit description =Chromosome chr1 scaffold_75, whole genome shotgun sequence
MANLQPQSFRKQMLDWLARLRIVEDAAKGLEYLHTGCNPSIIHHDIKIGNILPGINMRAKVSDFGLSSFTKTFMFLFSLTPKNPNRATGGGALENTRNAIIDNRECLSDYIEVRDELLTRGD

SEQ ID NO: 98532 - protein, 64 aa, Glycine max
  Coding DNA Sequence Number=SeqID_6847
  Gene Ontology: Mol. function=protein serine/threonine kinase activity; Biological process=protein amino acid phosphorylation
  Homolog annotation: Hit_ID=A7QBV3; Match level="QueryCoverage=98%, HitCoverage=6%, E-value=5e-18, Identity=71%"; Hit description =Chromosome chr1 scaffold_75, whole genome shotgun sequence
MARSLTRKGDEMNIMDPSLKGNSKIESIWRVVEIAMQCVEQHGASKPRMQEIILAIQDAIKIEK

SEQ ID NO: 98533 - protein, 310 aa, Glycine max
  Coding DNA Sequence Number=SeqID_6848
  Gene Ontology: Mol. function=signal transducer activity; Cellular component=membrane; Biological process=signal transduction
  Homolog annotation: Hit_ID=A4W5S4; Match level="QueryCoverage=100%, HitCoverage=48%, E-value=1e-139, Identity=85%"; Hit description =Methyl-accepting chemotaxis sensory transducer precursor
  Pfam annotation: Domain name=HAMP; Domain location=34-103; Score =60.8; E_value=4.5e-15; Accession=PF00672.16; Description=HAMP domain
  Pfam annotation: Domain name=MCPsignal; Domain location=134-310; Score=149.5; E_value=9.2e-42; Accession=PF00015.12; Description =Methyl-accepting chemotaxis protein (MCP) signaling domain
  Pfam module annotation: Pfam domain module=HAMP::MCPsignal; Domain location=34-103::134-310
MAYTPLPGWNWTIVGEVDKSVLLASVNAMRDRFLLAGVVLSILFAALFVVLIRRMLTRPLRNVIHLARQYAAGDLRSSLPVTRQDEVGQLIDAINGIGGGLQKIVLQVREAAGEIHLGTNALASDTGEISEQINKQASSVEETSASMEQLAATVQQNAANMEQTQQLVGETSLAVHQGGETVAHAVSTMDDIREASKRIEDITRVIESIAFQTNILALNAAVEAARAGEHGKGFAVVAQEVRALAGRSANAVKEIEQLIGDTLRKVSEGHALSEQTRLAMDAIIVHIDNISQLVTEINHASREQSAGIGQ

SEQ ID NO: 98534 - protein, 37 aa, Glycine max
  Coding DNA Sequence Number=SeqID_6849
MNRGARGRVRMDARLVVNISMSRVRLRTIEKCYWEAA

SEQ ID NO: 98535 - protein, 76 aa, Glycine max
  Coding DNA Sequence Number=SeqID_6850
MGLSSVTRSSHVFAPPDLPTQPTNAKGKAKIAEEQNDKAIPAPDEDIPMKSPSEKKDGCGKKEVSLEEAGEFLHII

SEQ ID NO: 98536 - protein, 63 aa, Glycine max
  Coding DNA Sequence Number=SeqID_6851
PRVVPRALETDIPHVSEPGAPSTYARPAVVEPRHAVEVCHVIAKRLEHHLSLRGSRQAHRHMR

SEQ ID NO: 98537 - protein, 108 aa, Glycine max
  Coding DNA Sequence Number=SeqID_6852
MMLLSLEECMKYPRIHLHQLRLRSLKQQQQQQPYFQNVVGPSRPYVPPPIQQQQQQQQQPQKHQTVEAPPQPSLEELVRQMTMQNMQFQQETIASIQSLTNQMGQLAT

SEQ ID NO: 98538 - protein, 185 aa, Glycine max
  Coding DNA Sequence Number=SeqID_6853
MAPEDLEQLTQQIRDQLEESIIEKGLALPLEPEVGPSAARVNTKESCADLSGNDPNMGDSDKCGLYIKENRPRLVTQGRVYEGSTIVHNIPLLHDQVKVSVEEVRDADAPIPVPTEEGVVGPAKPADRPDYEVDDPLYLMTLTIPQLFLKPLQVMWDAIVFGVFNEDFPLYIKHEDLSEIAHCGQ

SEQ ID NO: 98539 - protein, 83 aa, Glycine max
  Coding DNA Sequence Number=SeqID_6854
YIKQKGNRNEEKEGVLKQAQPNTRAKRAKKTGAKRGVELEDVESVTCAKPQLRAKHAIQQKHRLSLQGALSARSERAKREVSR

SEQ ID NO: 98540 - protein, 108 aa, Glycine max
  Coding DNA Sequence Number=SeqID_6855
MPRGGGATSMAHGLGAARSVRERYTPPVIGKGAATEVDSLSAKVTNITGLSGVTRSGQVFAPLHPTELPSKGKAPMTQESVGAATPSKEVDPPVVKGAERRKISKEGQ

SEQ ID NO: 98541 - protein, 130 aa, Glycine max
  Coding DNA Sequence Number=SeqID_6856
MTRGNPGNLQPFDLEIDRTFHRLVRHSVHPDNSVHFEHCEHFEHSEYFVAGDSEYYDFEHSTTNFHTENVAQPPPRERNLREMVAPDFTYESLCIQYPDEGVPYVLKTGLIHLLPKFHGLAGEDPHKHLK

SEQ ID NO: 98542 - protein, 92 aa, Glycine max
  Coding DNA Sequence Number=SeqID_6857
  Subcellular localization annotation: CTP_CleavageSite=36; ConfidenceScore=5.03e-01
MSSWGKKTVSFLRVSSLLEQDCSCGQGFGKRVRSCKANLKRRSGPTTEVLGKQGKGYGESRGVGPVCGRISIANLWGCPLFKRERFGGPSRD

SEQ ID NO: 98543 - protein, 71 aa, Glycine max
  Coding DNA Sequence Number=SeqID_6858
CPVSDSLVSGKLEDDSDDWGSSRIGGVVLSYSIFLFLSALFLLQVASISKSNGTKSPVEDLPRIQSTSMSS

SEQ ID NO: 98544 - protein, 74 aa, Glycine max
  Coding DNA Sequence Number=SeqID_6859
MMTTKVDDKSDEQKAQVNQRTSQENQEQVKSSRIKNNSRLKKKAYKQESRFKIQDLKNQDQDSRIKKGLNQDKY

SEQ ID NO: 98545 - protein, 63 aa, Glycine max
  Coding DNA Sequence Number=SeqID_6860
MGGKCAESPPMFIRGKRRKNRKRRGLRTLSVKGSGVLFTHGEGFLNPRLTNKIEKDHFKALDL

SEQ ID NO: 98546 - protein, 76 aa, Glycine max
  Coding DNA Sequence Number=SeqID_6861
MHTCGWANTENVRQGPAYSLLMLLENRQQLLQLLISKGGRYNHRKTFAIIQWQKEMVSQPVPHKESHRYVYFLKHG

SEQ ID NO: 98547 - protein, 43 aa, Glycine max
  Coding DNA Sequence Number=SeqID_6862
MSELPSKRETRADDNGGVISSTGRISALITGRDDYTNAKLVEP

SEQ ID NO: 98548 - protein, 321 aa, Glycine max
  Coding DNA Sequence Number=SeqID_6863
  Gene Ontology: Mol. function=motor activity; Cellular component=cell projection
  Homolog annotation: Hit_ID=UPI00006A2D9E; Match level="QueryCoverage =86%, HitCoverage=99%, E-value=3e-11, Identity=15%"; Hit description =UPI00006A2D9E related cluster
LDALAFRGVHILPFRGLHALAFVGLHTLTFKGVHILNFRGLYIVAIRGLHVLPFRGQHDLPFRGLHALALTGLHVLTFRGLHNLAFRGLDALAFRGVHILPLRGLHALAFVGLHTLTFKGVHILNFRGLYIVAIRGLHVLAFRGLHVLPFRGQHDLPFRGLHALALTGLHVLIFRGLHNLAFRGLDALAFRGVHILPLRGLHALAFVRLHTLTFKGVHVLNTRGLYIVAIRGLHVLAFRGLHVLHFRGLHAHTFKGYLHRTTRPWLQDYTSSFSERYMPSPSEDYMPNLSGVCTSLPSVGYTSLPLEDYTSNPSEVYTSLP

SEQ ID NO: 98549 - protein, 171 aa, Glycine max
  Coding DNA Sequence Number=SeqID_6864
METCLGVEELLQRMIDQGRLEVGSEGKEEQHICMQSMEGSSVAKPKPLVIYFTKSAASQKPGHPLIAKPVPFPYQNSHAVPWRYTPPREKEEEATDVSSLSAKVTNITGLSGVTRSGRVFAPPDLPVQPADIKGKGKVVEEQDGEAPHASNKDIPAKGPPEKKDGKKNGRP

SEQ ID NO: 98550 - protein, 54 aa, Glycine max
  Coding DNA Sequence Number=SeqID_6865
DPHGPGVSLPPTGLVTNDLRHVAFLVRFKVEGECDAASVGRGGGGELGGVVIFL

SEQ ID NO: 98551 - protein, 104 aa, Glycine max
  Coding DNA Sequence Number=SeqID_6866
MAGRRARFEFAHHGGRPYFPNRCLPYLRLDDSLMPNGDVGFTLATMLVAAIATALASIIFFTLIMASIIAAICSFMASMSTSIYSYTSSALPITLALARVRTWG

SEQ ID NO: 98552 - protein, 143 aa, Glycine max
  Coding DNA Sequence Number=SeqID_6867
MAAQLIHDRIVMECLEGVWETLEGNERCRFRGTVRLTATSLVHLEQPARTLQQPVEWILPTPTPYRLVEPVQLIEVSSSEEDLEEDPEELSPKPAMDAPDLPEDDEDPLSDVDSPEDIMPASEADSTEESGLGGTSNSDDSSS

SEQ ID NO: 98553 - protein, 130 aa, Glycine max
  Coding DNA Sequence Number=SeqID_6868
  Gene Ontology: Mol. function=aspartic-type endopeptidase activity; Biological process=RNA-dependent DNA replication
  Homolog annotation: Hit_ID=Q69F85; Match level="QueryCoverage=41%, HitCoverage=2%, E-value=5e-09, Identity=53%"; Hit description=Gag -pol polyprotein
MKGSRAGIILEGPNNVTLEQALKPNFKASNNQAKYEALIAGLKLEREDEAKKLRCYVARSLSRDRLPTDTRPRRQYCPSTTTLPKLSWTILNALKCNVVPCRACRPWIFFINGILYFLKIKGSGMKKEKR

SEQ ID NO: 98554 - protein, 384 aa, Glycine max
  Coding DNA Sequence Number=SeqID_6869
  Gene Ontology: Mol. function=transferase activity, transferring glycosyl groups; Cellular component=membrane; Biological process=RNA- dependent DNA replication
  Homolog annotation: Hit_ID=A7PNR7; Match level="QueryCoverage=17%, HitCoverage=13%, E-value=1e-23, Identity=72%"; Hit description =Chromosome chr8 scaffold_23, whole genome shotgun sequence
  Subcellular localization annotation: CTP_CleavageSite=52; ConfidenceScore=5.53e-01
MNQPISPTLCLASSVLPSLGRTTNTTLKCGGSRMSPKALCGWKRNFQFHSKRCGRSPYHIKSPETFQLGLENMRWLVMGDDDTVFFTENLVTMLAKYDHNEIYYIGDNSESMEQNAALTYDMAFGGGGFSITGQSSQSHKHHLHTIRDIDINFFGAPSQRSLPPITFTDRDFKGINPSTRTTPWMSIIIANFMVSKVLIDQGNSTEILYWKTFQRLKVSPNTVHPYSSPLLGFTLNELGTIVSTLHLKMKFSTLTKEIVNDKVIPYPPTRELAKPHPTAAEGTQVMSVDEGPSIRALTIYRESPNDEFDIDPHNDTSERGLKAIEELARLHLTCWESIPALSVITSPSVLSPTRYHRRKGRWEKNDTKLLEKKRTNSSMSTSSE

SEQ ID NO: 98555 - protein, 81 aa, Glycine max
  Coding DNA Sequence Number=SeqID_6870
MASYGVKDSIDEEDPRPTSSTWSYIKKDLLMDQPMRRKEESMKFDEPRQRMHGYMDLVDKSDDLEQALQKNEVSWVEDESN

SEQ ID NO: 98556 - protein, 73 aa, Glycine max
  Coding DNA Sequence Number=SeqID_6871
MEILLQLVGYSISNGKFLGVIILAAWFFCLWQGGIKSLAARARLTGALSKGGKMPGVATNAYLWETSEKLKET

SEQ ID NO: 98557 - protein, 36 aa, Glycine max
  Coding DNA Sequence Number=SeqID_6872
MGGISCQTCKRYDMGLIPALQEVMPGAPHRFCALHL

SEQ ID NO: 98558 - protein, 215 aa, Glycine max
  Coding DNA Sequence Number=SeqID_6873
MPLWGRIASVYTTEFDEFLDELDRRHWREELTDFQDGNIDVAIVKEFYANLYDPKDKSPKQVRVRGHLIKFDEDTLNTFLKIVVVVEEGETLCAYSRFILLRLDPQELAAKLCIPMRGFELNVDSYPVNILRKNMTTLAQTWSVLSFSNLIPTSHTFDVTLDRARLIYGIIMKMDMNVGYFISHQISLIAQHDTSRLGFPTLITALCKAKEFSQI

SEQ ID NO: 98559 - protein, 112 aa, Glycine max
  Coding DNA Sequence Number=SeqID_6874
MALNQSMQKGVAQMKNGKWPKSDERSTYKARLKYDEYTPLSASRGRILNEIINVVLKDADHGVHKLLRIIDMCKAGEKTLDLDIIGHLVMSNEKGQEVLVGTKEKDIPYSDL

SEQ ID NO: 98560 - protein, 41 aa, Glycine max
  Coding DNA Sequence Number=SeqID_6875
MEEIHGEDDEEQGIKLHVELVGLGSSSSMESIASSRSMEVE

SEQ ID NO: 98561 - protein, 65 aa, Glycine max
  Coding DNA Sequence Number=SeqID_6876
MENALSNHYAWLQTRGWRMHERKRNSWGSEKGREWRIALSNHYGWLSLVGGRMHERKSNSWGSPK

SEQ ID NO: 98562 - protein, 128 aa, Glycine max
  Coding DNA Sequence Number=SeqID_6877
MLSNHVIFSATPLHAFSGGTSPSNSWHKSSQCLHHSTNAVINAGSILHCLIKAICWNPVHDNNGIICGSGSGLKIPKHINNNCSTVTHRDSNAREPMTFSCTLFTRMRMLTALASFSTFCIPSTLHLM

SEQ ID NO: 98563 - protein, 94 aa, Glycine max
  Coding DNA Sequence Number=SeqID_6878
MWSRQLSQPTLRREGDAGLTGASSKKGKCAESPPTFIRGKRRKNRKRRGLRTLSVKGLGVVFTHREGINTPRVRHKGRQPLIMCANMTSIWGIL

SEQ ID NO: 98564 - protein, 94 aa, Glycine max
  Coding DNA Sequence Number=SeqID_6879
MLPFDFRCVTETYGLCINIFLVFQHVLEFHKLPNDGYQAPHKDQRKVAFEIKSDSINKSFKVNRHRLKPFLTNPSLVDVVVEETSLLHPTLPPP

SEQ ID NO: 98565 - protein, 156 aa, Glycine max
  Coding DNA Sequence Number=SeqID_6880
  Subcellular localization annotation: CTP_CleavageSite=43; ConfidenceScore=5.39e-01
SEVKKGSAPQAVLSLSNLLGKIVSVTKIQAEGLPKRFRNVSVRNFAKVSTVLRHSSFVLHRSSIFNGLPSLVTDVWGANTFPVRKYNSRAFHLKVRRLRLFRFFRRFPQINVGGDSARIPFVEHASRESRVALPLKGRLRHLVIDYQKEVIDYQCF

SEQ ID NO: 98566 - protein, 91 aa, Glycine max
  Coding DNA Sequence Number=SeqID_6881
MACLDQQHSGRVGQAVVVVEDLSISDLDDSSNLDCICCLKGHNYSTIVGFAVKEIAAKKDRDLYGDLQKNIDHRLLQQLQISDSWQAELLG

SEQ ID NO: 98567 - protein, 156 aa, Glycine max
  Coding DNA Sequence Number=SeqID_6882
  Homolog annotation: Hit_ID=A5AV98; Match level="QueryCoverage=64%, HitCoverage=13%, E-value=5e-20, Identity=52%"; Hit description =Putative uncharacterized protein
GSTLDKQWKLPSWSTVGAEGISGGTVKCVEIGKNTNGESTLLGRQVQFYLGVFDHDLVMLEEKFVTIIDASSNEEKTHYKVWERSNRLSLMLMRMIVADSIKTTLPKIESAKRFMGSVGEPSQTANKFVVGTLMSTLTTMKFNSSNDAILPRKGIG

SEQ ID NO: 98568 - protein, 195 aa, Glycine max
  Coding DNA Sequence Number=SeqID_6883
MSSYATSLEPKSQLTIILALGRKQNKEKEKKRKGEKEKIPDQKNQKKGEKGKFPIKENGGIQKRKIILDQRSEEKSRNMQKGLRTRQYLNNTDLSPSKQEKKGNHDLKWSFPFDCQPKSCVSVTFSPRTKQKQKRKRPKTFKVEIPTKKHHSQEKVQLIHDHASCSHFSKENTETIFSLTSYPELRRSEFLIEDT

SEQ ID NO: 98569 - protein, 105 aa, Glycine max
  Coding DNA Sequence Number=SeqID_6884
  Gene Ontology: Mol. function=nucleic acid binding
  Homolog annotation: Hit_ID=A3AA33; Match level="QueryCoverage=93%, HitCoverage=24%, E-value=1e-32, Identity=64%"; Hit description =Putative uncharacterized protein
VITGIALPVGSDKLYSGSTDGTVRIWDCHTGQCAKVINLGAEVTSLISEGSWIFVGLQNAVKAWNIQAMSEFTLDGPKGRVRAMTVGNNTLFAVAEDGYKKGSRT

SEQ ID NO: 98570 - protein, 97 aa, Glycine max
  Coding DNA Sequence Number=SeqID_6885
MRRNKRRKRYQIACQTLTKGGLAFHCHERLLHFRGLMWIEEDGWIEEEKRIMDIERGFPKLEILRLTMYSLENSKSSGVVLSRCMGYGLPFYFLIFS

SEQ ID NO: 98571 - protein, 154 aa, Glycine max
  Coding DNA Sequence Number=SeqID_6886
  Homolog annotation: Hit_ID=Q6UUU1; Match level="QueryCoverage=72%, HitCoverage=93%, E-value=4e-35, Identity=60%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPSCALLFLPFGLPVSFRCMAALSHSTPDTQFR

SEQ ID NO: 98572 - protein, 82 aa, Glycine max
  Coding DNA Sequence Number=SeqID_6887
MSLILVGYSVFEERKGKASKRKRKKEKGNGKFPSLRIQQWAVPPTPSVAAASLLLSSVSSLPSIADSFYFLLSAPSSPSSLP

SEQ ID NO: 98573 - protein, 215 aa, Glycine max
  Coding DNA Sequence Number=SeqID_6888
MEGDSIIHIVAYADDVVRVSVETVIDPEAEVPYATSEIQYEKQAVYTFVAWPTHLVKAVLDEHPQSIPHNEDAHVPKPANVDADDPLRGLMKYSFDIYDKPLEISFDGSFLGIVDASTSIFITYSDVTEIIAGDKSICMSGVRYSVKVSCMLLEPQSLVCSKDRHSECEQYLERWLKESDREVYTGPYFHHVMTKLKKTLSPETKAVAPKWIEVK

SEQ ID NO: 98574 - protein, 310 aa, Glycine max
  Coding DNA Sequence Number=SeqID_6889
  Homolog annotation: Hit_ID=Q9AVH2; Match level="QueryCoverage=50%, HitCoverage=67%, E-value=1e-57, Identity=62%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDN

SEQ ID NO: 98575 - protein, 68 aa, Glycine max
  Coding DNA Sequence Number=SeqID_6890
MTGKVEKCEILRVREAKFGVSGNWSPKTCSKAWAEQMRKMSDKGESKSHFQGKLGVEGSNLESEEFLP

SEQ ID NO: 98576 - protein, 328 aa, Glycine max
  Coding DNA Sequence Number=SeqID_6891
MVLKEELMAGSRSKRSLSQRLCETETNMLAIIAKYEEELGLATAHEHRIADEYAQVYAEKEARGRVIDSLHQEATMWMDRFALTLNGSQELPRLLAKAKAMADTYSTPEEIHGLLGYWKNTITKRAARDPYRTRSKSRTMGDQEETQEQMKADMSALKEQMASMMEAMLGMKQLIEKNAATAAAVSSAAEADPTLLATTHHPPSNIVGRGRDTLGHDGSPHLGYNRAAYPYGLLPNYSPPVLQEDAGHIASPVHEREPPQQPDEVHKDPQDYARRDVEFYPPIPEGPAPGTLPQPNIAAPPIVLSTEGPPPATEERRKLDLLEERLRA

SEQ ID NO: 98577 - protein, 199 aa, Glycine max
  Coding DNA Sequence Number=SeqID_6892
MCKGNQLDGEESTLGNNLGMETHSSQSEYSLESHGQGVEKVEETHMVVCCAKLYTDGEESGFCPLNNKYEDMADNEKMEGQTCVEGELGEGKGEGQMHSVGVEKEFDGVVVRKQLFEVNTTLEKGYPQQSFKVLSKIFRKKNLCSTGRTFFRKLSGRTFFRKKVLPDEQFVLPEELPPVTFSEKGSSERINYFTGRTFF

SEQ ID NO: 98578 - protein, 750 aa, Glycine max
  Coding DNA Sequence Number=SeqID_6893
  Gene Ontology: Mol. function=DNA binding; Cellular component=nucleus; Biological process=regulation of transcription
  Homolog annotation: Hit_ID=Q8W239; Match level="QueryCoverage=14%, HitCoverage=42%, E-value=7e-54, Identity=93%"; Hit description=GT-2 factor
  Pfam annotation: Domain name=Retrotrans_gag; Domain location=99-193; Score=5.7; E_value=0.015; Accession=PF03732.8; Description =Retrotransposon gag protein
MVKMLMEQKGITYNDAKNASMEQNNGLEDKESAMEPEPSSTSEDEENKPEADSILNSSHHYWAKGVKMPMFEGEDLLGWIVRAEKFFVVQHVQQSTKVRLAFINMEGNALHWFQYWKQKTKRKSWFVFKATLIKRYGGTGRGDVYEHLATLHQMGITTKFIQEFEVLGLHKEIYAKIHPHKPKDLSSAMELATDFEEAEKEGNPEVELHSRGFHFQPKGEMWIHNVEGSTTNTFHNNQRQNQTLTGEARSSVNVMAANQSESTRGPFVAGHKCPGKNLRLLILAKDECINNEVEFTRMEEELENTFDNIGEIKEEREKLIESPMLGDSAVLGTGGGGSGDAVAAPPPAASGGAHDGGVDGGDGGGGGSNSGDDRVEEGERSFGGNRWPKQETLALLKIRSDMDVAFRDASVKGPLWEEVSRKLAELGYNRNAKKCKEKFENVYKYHKRTKEGRSGKSEGKTYRFFDQLQALENNPAIHGKQSPTPPKPPPQTTALSATPVSIVVTTTTTTPSSIIMPLPLPPVSNNNNNTTVPSTTSLPMPQSILNITPPSTLNITIPSFPPSNPTTYFPTQTPNPTSNNNNNPPSTITPPSFPNFPADLLSNSSSSSTSSEETPTTEARGRKRKRKWKDFFERLMKEVIEKQEELQRRFLEAIEKREQERVVREEAWRMQEMQRINREREILAQERSIAAAKDAAVMTFLQKIAEHQQQETINLEPALNNNSITVVPQQPVPQATPTSTPTPQQAQTTT

SEQ ID NO: 98579 - protein, 81 aa, Glycine max
  Coding DNA Sequence Number=SeqID_6894
MAHAQVALDLVIRLGDLWILMNSSWLPQTSQTIRLITTFKGHILELFLHQVVEHERREFLELRGLQLMRRGARLFRRDMLP

SEQ ID NO: 98580 - protein, 301 aa, Glycine max
  Coding DNA Sequence Number=SeqID_6895
MNSSACKRCQSGAVSRSVFPEGGRQAYFGQRSDPPGERLDWRGKRLAAWRRDSAAGGRRPVFSGRLHGLQQVDKRGAERRRGRLMAGKDVKARADVDLLRRDFLQVQLRGVVCDHPIAQQCDIALLPDQAPGRQKGVGLDDLAVRRVAFGDLADGGMPHRAGAWHHPFGLGGRLPGCALAFQRLHGQIGAARRAVQAADRQIQLAVSQPGQQALRAVFHHRHPGMRVAAVEAFEHLRQIAEQRIDAHPYPQALLAVSAQAAQFVKRVEQLIGGGVYPPVKQLADRRQAHAAVAALQQPRAD

SEQ ID NO: 98581 - protein, 185 aa, Glycine max
  Coding DNA Sequence Number=SeqID_6896
MFIDGLRPQSKQLLDASAGGKIKMKTPKEATELIENMSTSDHVILRDRVHQPTKKSLLGLSSQDALLVIPFVVVLMNQAIAFPLKSILRKLITWEISRGKDTTKEDFQVSSKVPTISKGNGDHTLAINSTKTRVNLRTGHYSKGQIFMRGLQSWRRLSLNLCKSQCLTTRAWSQPSRTLRSRWDS

SEQ ID NO: 98582 - protein, 59 aa, Glycine max
  Coding DNA Sequence Number=SeqID_6897
MDNHEHANHRDTVQARIKNKGIRQHKVNDQAQNIDFNIPDSSEDESSESTHQLKSTLSN

SEQ ID NO: 98583 - protein, 171 aa, Glycine max
  Coding DNA Sequence Number=SeqID_6898
  Gene Ontology: Mol. function=transmembrane receptor activity; Cellular component=integral to membrane; Biological process=signal transduction
  Homolog annotation: Hit_ID=P02942; Match level="QueryCoverage=70%, HitCoverage=21%, E-value=4e-26, Identity=54%"; Hit description =Methyl-accepting chemotaxis protein I
  Pfam annotation: Domain name=MCPsignal; Domain location=1-152; Score =143.3; E_value=6.6e-40; Accession=PF00015.12; Description=Methyl -accepting chemotaxis protein (MCP) signaling domain
VIDGIAFQTNILALNAAVEAARAGEQGRGFAVVAGEVRNLAQRCATSAKEISSLVDGVTGDIAVGVRLVEQAGETMNAIVGSVNQVTSLMDNISYASEEQSKGIEQVGVAVTQMDQVTQQNAALVEEVATTAVGVEEQAALLAQAVAVFQLAEGETRQDEAQASAAVAGWA

SEQ ID NO: 98584 - protein, 70 aa, Glycine max
  Coding DNA Sequence Number=SeqID_6899
MPIFPCRCIGWDRAHKTPSGPPTNRAFIKKYCVSRQAQGETPQQPGDGRQRATDAPPSPLEFTSAHPQKG

SEQ ID NO: 98585 - protein, 95 aa, Glycine max
  Coding DNA Sequence Number=SeqID_6900
MRKLTKLPIISPKTPYPRKSKEKEVHPNLKFRSPTCSHTLHDSKNALLSRFGAEMMAKGWSFVRVSMENGEEENGNVREREGCLKFSVLLSEERE

SEQ ID NO: 98586 - protein, 170 aa, Glycine max
  Coding DNA Sequence Number=SeqID_6901
MAASDQAILHDRSHVPTKKSLLELSLQDALLAQNKLLAKQLEILTETLIMQVGGCSIYGGAHESGYCIPLEYAAKEVDYMGNQHRPGFNVDGFLGYQQGSNFNQNQGQWRSHPRNQFSKDQGGSSKMPQNQGPSLYERTTKLEQTLAQFMQVSMSNYKSTESAIKNLEIQ

SEQ ID NO: 98587 - protein, 512 aa, Glycine max
  Coding DNA Sequence Number=SeqID_6902
VDSRGSPALQRVHAGGGDGGVRHLAVHRHFHLQAAVVRRHDLIAEAGRDQQVGFRQALAQQPAGTEQAAEFLVVGEVQFNRALARTGHGFQRPQREGEAGEVALADRGGAAVEAAVLDLGAVRIVLPAVAGRHHVAVGVERDAAAAGAIFAPYDQVGDGLHAVGAHFIGRHGMGLGRQAEALQQFGGADGVRGVVARRRVGRHAHQFLQEAHFFVEVGVHPGVESGVIGHGSARCVVGEIVEQPLHRLCGQLHVVVGGGFERVVADAGVLAAHEQHGLRHDLVQLHGVVAGAAGHAMHRHAQRLHRAFPALLPGRRAGRGGGAHGFLERVAQAAAQADRFQFGQHVAGQRIALRVAGGAQVEAEAAFAGHHVDRAVGHFQHADGADRVAVARGAAFDEHDQFGRGHGGVAASIHRRGAGVAGGAVDPHAVAHAAVDGGDHAQRQAHFVQHGTLFDVHFDEAQVTGRVALELGNVIDAQSRARHGLAHADAVGVPLFEPARLEVADQRAGTEE

SEQ ID NO: 98588 - protein, 157 aa, Glycine max
  Coding DNA Sequence Number=SeqID_6903
MLHKILTKEVDSHASQQDKNSMEGSWSEFSEVKASSWARKVELPSFDRNIEGGTDLKGSRSKEGSVIKNHTLCGGEKTKNDEAKLAREKKIKKVMEEEVDPSITREKHKENRVTNVGCENDFLDNPIIDLIKKEVEAGDSTKPHCFQDLDFHKKIVM

SEQ ID NO: 98589 - protein, 182 aa, Glycine max
  Coding DNA Sequence Number=SeqID_6904
MAPTRHPLDPDKSNRALGFPALITGLCQSFGVPVTPSKVIRPPLTRAFIEKYCTQRQVQGDAPQAADAPPPHQAGPAGLFDTEQYLRHLVHQQAANHRAHVQTHDCLYQMSLSLQSQGFTSFPCPTLNQFRAEVTWPGDWPEAQAGEAPAGAPAEAPDEADEAREDEEMTDLLDFLGGSGAT

SEQ ID NO: 98590 - protein, 71 aa, Glycine max
  Coding DNA Sequence Number=SeqID_6905
MINAGMICPLRCHEEMHDAIKEHARGLSATMHHQKRKTLEEASLLSSESETQHDHRSTSTPYSSHRPGYRA

SEQ ID NO: 98591 - protein, 67 aa, Glycine max
  Coding DNA Sequence Number=SeqID_6906
MTLDLLFVMDRPVTCNILDQGVEPQYNLLHVDGWAVGQEEVTTLILGPPGSEKEAIEKAKLDLHLKI

SEQ ID NO: 98592 - protein, 162 aa, Glycine max
  Coding DNA Sequence Number=SeqID_6907
MTLLLSNILPSDRNANLPLRKYQLVCVVPTWGSHPQDTQWTRKSPTGPWGFQLWLRAFISPTGCPYPPGKGSRLQDTQWTRRSPTGSWSCQALITGLCQFYGVPVTSSKGIRPPTNRAFIKKYCVSRQAQGETPQQPGDGRQRAIDASPPPLEFTSAHPQKG

SEQ ID NO: 98593 - protein, 164 aa, Glycine max
  Coding DNA Sequence Number=SeqID_6908
ESARHRMHCKGRTKSLGEATMGSLAAILRAVREEEAKAPEESKEVQAIKVELEKTQAVKEKFKAWKEEHDRNKFRGALWGSNSELKLRRDERDQSRVEGLILKDELKACIRSKRSLSQQLSETEGNMLAIIDKYREELNLATAHEHRLVDEYAKVSVEKEARGR

SEQ ID NO: 98594 - protein, 124 aa, Glycine max
  Coding DNA Sequence Number=SeqID_6909
  Homolog annotation: Hit_ID=Q0RSL4; Match level="QueryCoverage=77%, HitCoverage=21%, E-value=2e-07, Identity=28%"; Hit description =Putative uncharacterized protein
MKLAKYRLKAQVEKDEGPSGEGQSPQVEKDEGSSNPCGVYPDLSSFTGSGVYPDLSSFTGSGVYPDLSSFTGSGVYHDLSSFIGSGVYPDLSSFTGSGVYPDLSSFTGSGVIQISVACIKRSAP

SEQ ID NO: 98595 - protein, 103 aa, Glycine max
  Coding DNA Sequence Number=SeqID_6910
  Homolog annotation: Hit_ID=A1CR97; Match level="QueryCoverage=48%, HitCoverage=44%, E-value=2e-12, Identity=74%"; Hit description =Putative uncharacterized protein
MGGGAWPFLVGGAICLVNSVNERDLSLLNSYVEVRVIFEIHRDGDRSLQLLVFNEEFLVSASHQLALTTSLPFVHTARRSYRLNGPVKCSDCGDVSGSLPATL

SEQ ID NO: 98596 - protein, 139 aa, Glycine max
  Coding DNA Sequence Number=SeqID_6911
MAKYDPEIVMEFYVDAWLIEEEVRDKHSWFLGHPWVLEEGQCCEFSERRSQASGFDKEAIGQLLCISGQDFARSVPGRRVQIMRTSMTTLTQIWMTLLLNNILPSYRNSNLPLPKCQLVYAILTQVSIHVAQLISDAIY

SEQ ID NO: 98597 - protein, 138 aa, Glycine max
  Coding DNA Sequence Number=SeqID_6912
DDKGDDKNLKGQSKNECKMFKIESRTLQDSRGKLKNTSRFKRKVDFKNQESRFKDQAFKNQDQDSRLMIQESREGLIKIRYILCGTSRGYIYLGSTENKRGYISCGSILVEGTSTRFKENKGRYIPCGSLLVKGFLQG

SEQ ID NO: 98598 - protein, 78 aa, Glycine max
  Coding DNA Sequence Number=SeqID_6913
MRDGKRSSYVIGIGVNSGVGLAGKFLIALEPAPKWALPAGRVVVGARAWGAFLWMGVGDLGCTGAELEESPMRVEKLG

SEQ ID NO: 98599 - protein, 206 aa, Glycine max
  Coding DNA Sequence Number=SeqID_6914
  Gene Ontology: Mol. function=translation initiation factor activity; Biological process=translational initiation
  Homolog annotation: Hit_ID=A7PFP1; Match level="QueryCoverage=37%, HitCoverage=28%, E-value=6e-24, Identity=72%"; Hit description =Translation initiation factor IF-3
  Pfam annotation: Domain name=IF3_C; Domain location=1-53; Score=15.1; E_value=6.1e-06; Accession=PF00707.13; Description=Translation initiation factor IF-3, C-terminal domain
VKVVVNLKGRENEFRNIAIELIKRFQSDVGELATEETKSFRDRNIFRVMVPKKATLQKAQEPPKRKDKSAVDEVSAGQGGLHSFQGIPSAWRQWRWRLQQGRATWHVATVTGDKGLHIAGPIGASRGATRGGDLGEREAPVMLAFSASVGFKRRWLKGRLQFTVACKICVLKVKKKVVAVEREVAGGCLCVESGADQFVFFHFIKA

SEQ ID NO: 98600 - protein, 1087 aa, Glycine max
  Coding DNA Sequence Number=SeqID_6915
  Gene Ontology: Mol. function=cellulose synthase (UDP-forming) activity; Cellular component=membrane; Biological process=cellulose biosynthetic process
  Homolog annotation: Hit_ID=A8R7F0; Match level="QueryCoverage=100%, HitCoverage=100%, E-value=0.0, Identity=81%"; Hit description =Cellulose synthase catalytic subunit
  Pfam annotation: Domain name=Cellulose_synt; Domain location=237 -1083; Score=2015.1; E_value=0; Accession=PF03552.5; Description =Cellulose synthase
  Pfam annotation: Domain name=PHD; Domain location=36-85; Score=11.5; E_value=0.00059; Accession=PF00628.20; Description=PHD-finger
  Pfam module annotation: Pfam domain module=Cellulose_synt::PHD; Domain location=237-1083::36-85
MEASAGLVAGSHNRNELVVIHGHEEPKALKNLDGQVCEICGDGVGLTVDGDLFVACNECGFPVCRPCYEYERREGSHLCPQCKTRYKRLKGSPRVEGDDDEEDVDDIEHEFNIDEQKNKHGQVAEAMLHGRMSYGRGPEDDDNSQFPTPVIAGGRSRPVSGEFPISSNAYGDQMLSSSLHKRVHPYPVSEPGSARWDEKKEDGWKDRMDDWKLQQGNLGPEPDEDPDAAMLDEARQPLSRKVPIASSKINPYRMVIVARLVILAFFLRYRLMNPVHDALGLWLTSIICEIWFAFSWILDQFPKWFPIDRETYLDRLSIRNSEQHGKFMRDLTKIEYISEISNTFKLFRIYIYSTDKVILLKSQIVIRYEREGEPNMLAPVDVFVSTVDPMKEPPLVTANTVLSILAMDYPVDKISCYISDDGASMCTFESLSETAEFARKWVPFCKKFSIEPRAPEMYFSEKIDYLKDKVQPTFVKERRAMKREYEEFKVRINALVAKAQKVPQGGWIMQDGTPWPGNNTKDHPGMIQVFLGSSGGLDTEGNQLPRLVYVSREKRPGFQHHKKAGAMNALVRVSAVLTNAPFMLNLDCDHYVNNSKAAREAMCFLMDPQTGKKVCYVQFPQRFDGIDTHDRYANRNTVFFDINMKGLDGIQGPVYVGTGCVFRRQALYGYNPPKGPKRPKMVSCDCCPCFGSRKKYKEKNDANGEAASLKGMDDDKEVLMSQMNFEKKFGQSSIFVTSTLMEEGGVPPSSSPAALLKEAIHVISCGYEDKTEWGLELGWIYGSITEDILTGFKMHCRGWRSIYCMPKRAAFKGTAPINLSDRLNQVLRWALGSIEIFFSHHCPLWYGFKEKKLKWLERFAYANTTVYPFTSIPLVAYCILPAVCLLTDKFIMPPISTFAGLYFVALFSSIIATGILELKWSGVSIEEWWRNEQFWVIGGVSAHLFAVIQGLLKVLAGIDTNFTVTSKATDDEEFGELYTFKWTTLLIPPTTILIINIVGVVAGISDAINNGYQSWGPLFGKLFFSFWVIVHLYPFLKGLMGRQNRTPTIVVIWSVLLASIFSLLWVRIDPFVLKTKGPDTKLCGINC

SEQ ID NO: 98601 - protein, 99 aa, Glycine max
  Coding DNA Sequence Number=SeqID_6916
MEDESSETTTPEPLVRRKKADQTQKAAATSEKSLEATSEPSEPMADTASIQQAADPSTPKDQTTPVLSPNISPTATPELHLTDEEDVQTQDTQDRSQDF

SEQ ID NO: 98602 - protein, 187 aa, Glycine max
  Coding DNA Sequence Number=SeqID_6917
  Homolog annotation: Hit_ID=Q2HW90; Match level="QueryCoverage=75%, HitCoverage=33%, E-value=1e-11, Identity=33%"; Hit description =Putative uncharacterized protein
MGQLQQQGGWLSLRKAYGKIWDLARVEVSMEPIASLSQYYDQPLRCFTFEDFQLVPTVKEFEEILGCPLGGRKPYLFSGSIPPRQELPRKGQRPWKIKANGLSFIDILALLIFGVVLFSNMEGLVDLAVIDAFLAFHHGKESPVVAILAMYDTFDRGCPSIRYKVTARASKKERRIGTNSWLAWRGV

SEQ ID NO: 98603 - protein, 138 aa, Glycine max
  Coding DNA Sequence Number=SeqID_6918
  Homolog annotation: Hit_ID=UPI0000ECC274; Match level="QueryCoverage =47%, HitCoverage=96%, E-value=5e-22, Identity=69%"; Hit description =UPI0000ECC274 related cluster
MTTLVIGGTRGIGRETCRASCINESANARGEAVCVLGALPLPRSLTRCARSFGCGERYQLTQRRSFAPSWAVCTNPPFSPTAAPYPVTIVLSPTRISRARYVGGATEFLKWWPNYGYTRRTVFGICALLKPVTFGKRV

SEQ ID NO: 98604 - protein, 80 aa, Glycine max
  Coding DNA Sequence Number=SeqID_6919
  Subcellular localization annotation: CTP_CleavageSite=43; ConfidenceScore=5.46e-01
MKNGGKSSRNRSRKRLGSVTEAPQLGFSSRKQFFSLISRRWLPASSPRRAGLPPPEGTAFCWNTLEGPSGPGCYFHTPFY

SEQ ID NO: 98605 - protein, 32 aa, Glycine max
  Coding DNA Sequence Number=SeqID_6920
MENEREGDEHSRFKRRENGYGDLDDATSGEGR

SEQ ID NO: 98606 - protein, 134 aa, Glycine max
  Coding DNA Sequence Number=SeqID_6921
MVLFGNLVQPPIVNADSPTVLHPSRNQLLLLISDHCEASLLRDYLDGTHPLAIGDRINDSSLQKLGYLLLHYIKNHRKIEENDGTSQIPEPSSTPALEETHPSTPVVEPEQPIQDSSATPALDLNEDQPQEEQD

SEQ ID NO: 98607 - protein, 137 aa, Glycine max
  Coding DNA Sequence Number=SeqID_6922
MGIAPKRHPVDPEKSNRALGFPALVTGLYQSYRVLVPPRQGHIIIGIAPARHPVDPKKSNKVLELSSSNYGSLSVLQSTYNPQQVHQAPFNQAFIKKYCVSRQAQGETPQQPGDGRQRATDAPPSPLEFTSAHPQKG

SEQ ID NO: 98608 - protein, 51 aa, Glycine max
  Coding DNA Sequence Number=SeqID_6923
MAQPPPRETLREMDTPNFTYESLCIQYPDEGVPYVLEIGLIHLLPKFHGLA

SEQ ID NO: 98609 - protein, 82 aa, Glycine max
  Coding DNA Sequence Number=SeqID_6924
  Homolog annotation: Hit_ID=A5AYU6; Match level="QueryCoverage=76%, HitCoverage=11%, E-value=3e-11, Identity=52%"; Hit description =Putative uncharacterized protein
MVNLCLMGKDYESDEEVSLKKKCYINSRCSKHMTGDSSKFTHISPKKSGHVTYGDNNKGRILGVRKIAKMMIHGYGINALLT

SEQ ID NO: 98610 - protein, 69 aa, Glycine max
  Coding DNA Sequence Number=SeqID_6925
MSTTKPSSNNRREMSARIAKVAETLGEIRWNYKSLTMEFEHAGKTVKLVGEQQCRQHQGASTTMNCILP

SEQ ID NO: 98611 - protein, 80 aa, Glycine max
  Coding DNA Sequence Number=SeqID_6926
MAYTHIPDSTSDSPQISASPYQLDFTLYASGSYNAQWNAPRLLHDKHTLRSSRILRKMEVEEPWLGLWLPLSGYGIKFSI

SEQ ID NO: 98612 - protein, 536 aa, Glycine max
  Coding DNA Sequence Number=SeqID_6927
  Gene Ontology: Mol. function=catalytic activity; Biological process =cellular metabolic process
  Homolog annotation: Hit_ID=A8GCC4; Match level="QueryCoverage=33%, HitCoverage=52%, E-value=1e-93, Identity=95%"; Hit description=NAD -dependent epimerase/dehydratase
  Pfam annotation: Domain name=ADH_zinc_N; Domain location=358-505; Score=-14.6; E_value=0.013; Accession=PF00107.17; Description=Zinc -binding dehydrogenase
  Pfam annotation: Domain name=Epimerase; Domain location=362-536; Score=-21.4; E_value=1.4e-05; Accession=PF01370.12; Description=NAD dependent epimerasedehydratase family
  Pfam annotation: Domain name=NAD_binding_4; Domain location=364-536; Score=-64.6; E_value=0.00013; Accession=PF07993.3; Description=Male sterility protein
  Pfam annotation: Domain name=adh_short; Domain location=360-489; Score=-53.5; E_value=0.041; Accession=PF00106.16; Description=short chain dehydrogenase
  Pfam module annotation: Pfam domain module=ADH_zinc_N::Epimerase::NAD_ binding_4::adh_short; Domain location=358-505::362-536::364-536::360 -489
PNDDSSPHLAARRLTGEILRQSGVPVTELRAGIIVGPGSAAFEVMRDMVYNLPVLTPPRWVRSKSSPVALENLLPDHLGADADRPRADPGAEARSARRRPAAAGADPAAAAHLRSGGRHHAAARTGGGRFRRLGLRSGGAGPLAPRLRLLSETGRLFAGHRRHPRGPMANGAAVGGRRRLFLRQYSVADPRPHGRHDRQRRGLWPPGAREPGAGRRDRRLESHHAETAAATGAAVRHEGAGAGAAELHHYRSRRSPHAGRARLVASGRLQRAAVLVRHDARASVHFPRHGEAHRRTCRGSGPPTALNAVHLSINRTVCRCASGLSDCIAHEITEEWHLICWERRKRPPVFRFWVRIESVMKVLVTGATSGLGRNAVEYLRRQGIKVRATGRNQAMGGLLEKMGAEFIHADLTNLISSQAKAMLTDVDVLWHCSSFTSPWGTEEAFELANVRATRRLGEWAAAYGVAQFIHISSPAIYFDYHHHRNVAEDFRPQRYANEFARSKAAGEQVIQQLALSNPQTHFTILRPQGMVGPHDK

SEQ ID NO: 98613 - protein, 45 aa, Glycine max
  Coding DNA Sequence Number=SeqID_6928
MENCTKQSLRMAPNSGGVSGAKTHHVLQKGCLNENAINGAPKKGL

SEQ ID NO: 98614 - protein, 87 aa, Glycine max
  Coding DNA Sequence Number=SeqID_6929
  Gene Ontology: Mol. function=microtubule motor activity; Cellular component=microtubule associated complex; Biological process =microtubule-based movement
  Homolog annotation: Hit_ID=A7P105; Match level="QueryCoverage=96%, HitCoverage=15%, E-value=5e-16, Identity=44%"; Hit description =Chromosome chr19 scaffold_4, whole genome shotgun sequence
MQLSSQEEAIKQKDVLATEVSSLRGELQQVRDERDRQLSQEKCSLKDNQIKALEEQLATAEKKLQVSNISAYETRTEYKGQQKFVNE

SEQ ID NO: 98615 - protein, 113 aa, Glycine max
  Coding DNA Sequence Number=SeqID_6930
  Subcellular localization annotation: CTP_CleavageSite=75; ConfidenceScore=5.29e-01
MSSLSQYRPFSLPITQSSTKAIPKSATRHACLPHAQCPNTTYSANQKGILQQKASITPARVPQPPFFRGYDSNATCAYHGGVPGHSIEHCMTLKRKVQRLIDAGWLKFEENCL

SEQ ID NO: 98616 - protein, 54 aa, Glycine max
  Coding DNA Sequence Number=SeqID_6931
MTQRHPYPLARVKSCLGMHSRCVIASLSGCARTVGRPPISGGGPGTVKRKLLAP

SEQ ID NO: 98617 - protein, 162 aa, Glycine max
  Coding DNA Sequence Number=SeqID_6932
MPHQLVNGSIDLALVKEFYANLYSSEDCPPKQSRVRGHLVKIDADSLNTFLETPIVLSEGETLPTYSKYYRLPTDYKEIETWFPALITAFCRARGVVSYSVTFEHLSPVINLAYIRKNCWNLDDRAVSIQGARRARARPAELPSTFVAPTPASTSAALSVPA

SEQ ID NO: 98618 - protein, 144 aa, Glycine max
  Coding DNA Sequence Number=SeqID_6933
MKDKRDEEEKLEKQRKRRIVRPCLQGQGEGKRGKDSSKKIVKKENHFASKCDIKRALLLKQSFYLLLSRESYLSTTIPCELEVIPQVKEFLDEGLVRKSLTLCALLVPKIAQLIELVRNHVPSWEDAQEKGFSDLILLQHAKHH

SEQ ID NO: 98619 - protein, 77 aa, Glycine max
  Coding DNA Sequence Number=SeqID_6934
MGVQIAPRPIWALQKIPPEGEKSKAEALPKRFRNVFREEFRKGFQPFFNVLHSFFIVLRSSRGKYLEPSFSIHSMYP

SEQ ID NO: 98620 - protein, 93 aa, Glycine max
  Coding DNA Sequence Number=SeqID_6935
MGWKEVLAASTRGQVLVVKERPEEEANLEEEVLLNIVKGAGRSHLSFLPGDGSSNLLDKRAMASSMQSMLDLEQVDSVIVNKSTKMMRTGRKS

SEQ ID NO: 98621 - protein, 240 aa, Glycine max
  Coding DNA Sequence Number=SeqID_6936
  Gene Ontology: Mol. function=protein binding
  Homolog annotation: Hit_ID=A7QQ79; Match level="QueryCoverage=92%, HitCoverage=76%, E-value=1e-67, Identity=41%"; Hit description =Chromosome undetermined scaffold_141, whole genome shotgun sequence
  Pfam annotation: Domain name=LRR_1; Domain location=103-125; Score =4.3; E_value=49; Accession=PF00560.24; Description=Leucine Rich Repeat
  Pfam annotation: Domain name=LRR_1; Domain location=127-150; Score =6.7; E_value=18; Accession=PF00560.24; Description=Leucine Rich Repeat
  Pfam annotation: Domain name=LRR_1; Domain location=152-174; Score =7.4; E_value=13; Accession=PF00560.24; Description=Leucine Rich Repeat
  Pfam annotation: Domain name=LRR_1; Domain location=176-198; Score =6.3; E_value=21; Accession=PF00560.24; Description=Leucine Rich Repeat
  Pfam annotation: Domain name=LRR_1; Domain location=31-53; Score=8.0; E_value=10; Accession=PF00560.24; Description=Leucine Rich Repeat
  Pfam annotation: Domain name=LRR_1; Domain location=55-77; Score=2.9; E_value=89; Accession=PF00560.24; Description=Leucine Rich Repeat
  Pfam annotation: Domain name=LRR_1; Domain location=7-29; Score=5.8; E_value=25; Accession=PF00560.24; Description=Leucine Rich Repeat
  Pfam annotation: Domain name=LRR_1; Domain location=79-101; Score =5.1; E_value=34; Accession=PF00560.24; Description=Leucine Rich Repeat
  Pfam module annotation: Pfam domain module=LRR_1::LRR_1::LRR_1::LRR _1::LRR_1::LRR_1::LRR_1::LRR_1; Domain location=103-125::127-150::152- 174::176-198::31-53::55-77::7-29::79-101
MLLGHKQLNCLELSDTEVGSNGLHHLSGLSSLQKINLSFTMISDSSLRKLCGLSSLKSLNLDAYQITDAGLANLTSLTGLTDLDLFGARITDFGTNYLKKFKNLRSLEICGGGLTDTGVKNIKELSSLVCLNLSQNSNLTDKTLELISGLTGLVSLNVSNSRITNAGLQHLKTLKNLRSLTLESCKVTANDIKKLKSMYLPNLSYLREEWKDNLKLYIGYNNDFMEGVILLVLRSFVVLL

SEQ ID NO: 98622 - protein, 212 aa, Glycine max
  Coding DNA Sequence Number=SeqID_6937
  Gene Ontology: Mol. function=ribose-5-phosphate isomerase activity; Cellular component=intracellular; Biological process=pentose -phosphate shunt, non-oxidative branch
  Homolog annotation: Hit_ID=A7Q5Y6; Match level="QueryCoverage=86%, HitCoverage=74%, E-value=4e-54, Identity=61%"; Hit description =Chromosome chr14 scaffold_54, whole genome shotgun sequence
  Pfam annotation: Domain name=Rib_5-P_isom_A; Domain location=99-210; Score=2.8; E_value=9.3e-10; Accession=PF06026.5; Description=Ribose 5-phosphate isomerase A (phosphoriboisomerase A)
  Subcellular localization annotation: CTP_CleavageSite=56; ConfidenceScore=5.33e-01
MASIFLSSPPSFSSAHHNASTHLILHTPNSLNLRTMSHSLPIRAITLTWDYLKRLAANKAVEFVKRGMVLDPGTGTGSTATFVIAKLGTLLASGQLIDIVGVPTSKRTEDKVLFLGIPLFVLGLTIDDADEVDPNLNLIKGCGGALVCKKMVEAASNKFVTDKDDTKLVDGLGGSGLAMPVELQELFKEEGMEVKLRSEESGKPYESDVDTC

SEQ ID NO: 98623 - protein, 667 aa, Glycine max
  Coding DNA Sequence Number=SeqID_6938
  Gene Ontology: Mol. function=transcription cofactor activity; Biological process=regulation of transcription, DNA-dependent
  Homolog annotation: Hit_ID=Q8H6Q7; Match level="QueryCoverage=98%, HitCoverage=48%, E-value=0.0, Identity=61%"; Hit description=CTV.22
MQNLKLQTMKESYLPEMNEMYQKIANKLHQHDSLPQQPKLDQIDKLRAYKSMLERMMALLQIPKNNILPNFKEKLGSYEKQIINLLINSNRPRKGMNSVQAGHHPPTHMSSMQQPQSQVTQVHSHENQMNSQLQSTNLQGSVPTMQQNNIASMQHNSLSGVSTGQQNMMNSMQPGTNLDSVHGNSVNSLQQIPMNSLQQNPVSTAQQTNINSLPSQGGANVIQPNALQSGSSALQHQLKHQQEQQMLQSQQLKQQYQRQQLMQRQLLQQQQQLHHPGKPQLSSQLQTHQMPQLHQMNDINDIKMRQGMGVKSGVFQQHLTSGQHSTYSHQQLKQGSAFPVSSPQLLQAASPQIQQHSSPQVDQQNHLPSKTKVTTPLQSSNSPFVGPTPSPPLAPSPMPGESEKSIPCVSSISNAANIGLQQTGGAVAPAQSLAIGTPGISASPLLAEFSCPDGAHGNALAATSGKSTVTEQPLERLINAVKSISRKALSAAVMDIGSVVSMNDRIAGSAPGNGSRAAVGEDLVSMTNCRLQARNFIAQDGSNGIKRMKRYTSAIPLNVVSSPGSMNDSIKQLTASETSDLESTATSSVKKPKIEVNHALLEEIREINHRLIDTVVDISNEDVDPTAAVAAAEGAEGIIVKCSFIAVALSPSLKSQYASSQMVDSHF

SEQ ID NO: 98624 - protein, 408 aa, Glycine max
  Coding DNA Sequence Number=SeqID_6939
  Homolog annotation: Hit_ID=Q9SIR6; Match level="QueryCoverage=24%, HitCoverage=27%, E-value=1e-16, Identity=44%"; Hit description =Putative uncharacterized protein At2g25270
MEEWVQHPRDNTALSKLLPCMDENTAQKTLDITRNTSFQVVNLLNAFIINIANANMPPIQADKDIYYNQSGPSMPLLCNPFLPDLTERACGPMEVDLKGASIRLGSCSRADVEGGHVSSEVVQCRSKLSSVEVNCPVSREFVLCLGVGRGSLDECESYRSMWLAKPSSLDICCSGYFCQVVRDGRVRRVRPSAVVGEPVLVTVILPPSTSGGTRKACGNEDVRSPPRVQPILFDLDDEYHCASMPVKLTNPKGSYKLVVQASESDDFPFFRAAPSHPPHLNVASSQLHPNSWVMVRAFEILCPFFNVQPSVLVFLFFFQIKLSGKIGWVSLNSVSKKLFEFDSNVFHRFKDHFFRVLATDVVIDGMPLIFNKDGEPHFPFYWQSDPTRFKSYDKDLLTLVERVDKAIL

SEQ ID NO: 98625 - protein, 254 aa, Glycine max
  Coding DNA Sequence Number=SeqID_6940
  Gene Ontology: Mol. function=transcription regulator activity; Cellular component=nucleus; Biological process=regulation of transcription
  Homolog annotation: Hit_ID=O81348; Match level="QueryCoverage=97%, HitCoverage=70%, E-value=1e-30, Identity=33%"; Hit description =Symbiotic ammonium transporter
  Pfam annotation: Domain name=HLH; Domain location=85-134; Score=48.4; E_value=2.5e-11; Accession=PF00010.17; Description=Helix-loop-helix DNA-binding domain
MNDDFGCTNAVSFDEMVRFNNDSSNVVAAIGPKVEYTDSYLKSSEEEFGTSCYWPKRGVENNHELEAKTIRDNDRGTKRARTSTETQYHVMSERKRRQDIAEKFLALSATIPGLKKLDKATVLREALNYMQQLQQRIAVLEKAGGNKNKSIKSLIITKSRLCSASCETNSISEVLPEVEARGLGKEVLIRIYCEKRKGIILKLLALLKDLHLSIASSSVLPFGNSILNIIIIAQMSEKYNMTVNDLAKSLKQIF

SEQ ID NO: 98626 - protein, 194 aa, Glycine max
  Coding DNA Sequence Number=SeqID_6941
MKDLFKRWTEHLDSTRSRVSHLPPEIHAGKSYSMENYQWEQELQPYNQYEEERSSNLDNLLMQFKETIESTQRAFKSLEIQVGKLAKEVTKFVATREENFVEVEAYEESLVEEHDSREKDEEKSEEKAQQWDECSQEERHGEYEKALSVILSLIAITSLAMIWKVFLEYMSFMESLAKRQKCKEDVFYVTFMPP

SEQ ID NO: 98627 - protein, 176 aa, Glycine max
  Coding DNA Sequence Number=SeqID_6942
  Gene Ontology: Mol. function=transcription regulator activity; Cellular component=nucleus; Biological process=regulation of transcription
  Homolog annotation: Hit_ID=A7R4Y3; Match level="QueryCoverage=82%, HitCoverage=57%, E-value=7e-20, Identity=39%"; Hit description =Chromosome undetermined scaffold_813, whole genome shotgun sequence
IDKATILSEAITHVKRLKERVRELEEQRKKTRVESVSFVHQRSHIATVKGTTSGAMNSDECCRTNEALPTVEARVFKKDVLLRIHCKIQSGILIKILDHLNSLDLSTISNSVMPFGSSTLDISIIAQMGDNFNVTTMNDLVKNLRMTLSQSSEVFEDPKILQVLALRVDVILALEL

SEQ ID NO: 98628 - protein, 93 aa, Glycine max
  Coding DNA Sequence Number=SeqID_6943
  Gene Ontology: Mol. function=protein serine/threonine kinase activity; Biological process=protein amino acid phosphorylation
  Homolog annotation: Hit_ID=A7QGS1; Match level="QueryCoverage=76%, HitCoverage=11%, E-value=1e-20, Identity=63%"; Hit description =Chromosome chr16 scaffold_94, whole genome shotgun sequence
MKIFTNRGSNCFDAFAAICRCIEDQARIEKFLEDYRAIKPTRFTYADIKRITNGFSESLGEGAHGAVFKGMLSQEILVVVKILNDTEGDGKDF

SEQ ID NO: 98629 - protein, 339 aa, Glycine max
  Coding DNA Sequence Number=SeqID_6944
  Gene Ontology: Mol. function=binding; Cellular component =intracellular; Biological process=RNA processing
  Homolog annotation: Hit_ID=A7PF56; Match level="QueryCoverage=79%, HitCoverage=85%, E-value=6e-43, Identity=41%"; Hit description =Chromosome chr11 scaffold_13, whole genome shotgun sequence
MATKYAHGTQKQVFIDGWLQLGKKMLLRSSSAPILTSLLHYSKESSSEPEHILNLPKTASALSLSQNLVEIDLKKSSSPKRKNRVPLSSVPKNQQSKKIKERDEGKDPQQKTCMKAKSSIQELFSSLDLDKGLLDHEERGSGKKDSWLQTSVMGGGMGSDGGWICGGCNGSGRGSGGGHGKRWGFHEGNDHGRDRTEAYYQNMIEANPSDALLLGNYAKFLKEVCDDYPKSKEYLERAILANPDDGHILSLYAELIWQLEKDANRAEGYFDQAIKSAPYDSYVLASYANFLWDAEEDEEDKDCKNKSNHSHTYPTDLFHGANHHIHLTAAIETSPLFLK

SEQ ID NO: 98630 - protein, 40 aa, Glycine max
  Coding DNA Sequence Number=SeqID_6945
MVVDLLQYVNDTLGRCKPKKVTYMDAGGEKIQEEIDYLEE

SEQ ID NO: 98631 - protein, 121 aa, Glycine max
  Coding DNA Sequence Number=SeqID_6946
MSLPRHGRSNQSTTIAWSFWLPLPHLHHKLVHATTVKGLEASRVKLVITGAEEIGGDGGGIGLTRLFGCRRASHLQQEIQTLSDSEEEESKRAKFRKDKEKEKGVEVEGDDVDALKLWCGV

SEQ ID NO: 98632 - protein, 320 aa, Glycine max
  Coding DNA Sequence Number=SeqID_6947
  Homolog annotation: Hit_ID=A5B5B5; Match level="QueryCoverage=21%, HitCoverage=38%, E-value=6e-07, Identity=46%"; Hit description =Putative uncharacterized protein
MRRKEKKKGMRRFLCCGALLMGSTGGGKEKGRVMMAFGERGVDVFCDQSMLGGGVRWLRSSERFKFLTTSFSTNAKTTYYSFCTSSANKNNNKNMIVDERYRQLENLDMVTAAKILFSDPPKKRKFGYPFSFPLTMFTLSPLALFRISSSTFAALNMSTSLPLFGSVFYYHIWSFKLQEVEQKRKLKEEEEAKEKEKEMELNPPEEKEEKSDPQLAQVKVRLEKLEEAVKEIVVETKKHSGSNLGENQATDDEKKRLNSSAPRDPSTTDSASNKAVDEDHSGKHDILKSKPKLREETKGSVATPNPSLQDPKGNQSGGAS

SEQ ID NO: 98633 - protein, 162 aa, Glycine max
  Coding DNA Sequence Number=SeqID_6948
MLSFNDLGQKRWPKVEALLEASMENEEEESYFLAFLCVRRGQFSKASNIYIKTLRMKPRAWFRGFGCYRTPTKEDCAAVWCAVNYIDGLYVRLSQPGDPLRHPPVVHDDTYVEPDIPQYPMAMTAIEEAPADAPSHVEQPRHAVVDTVVEPKDSNRRYKSVQ

SEQ ID NO: 98634 - protein, 267 aa, Glycine max
  Coding DNA Sequence Number=SeqID_6949
  Gene Ontology: Mol. function=binding; Cellular component =mitochondrion; Biological process=negative regulation of cell proliferation
  Homolog annotation: Hit_ID=A7P5X1; Match level="QueryCoverage=80%, HitCoverage=24%, E-value=2e-60, Identity=55%"; Hit description =Chromosome chr4 scaffold_6, whole genome shotgun sequence
MMNASERNATTKLRRVGKKLLKKSSVHKLLPLLQKLESLLSSLEQEPTEPIQESLVPSKKALISDKLLRHTDEDVKLSVLSCITEITRITAPDAPYDDEQMKEIFKLIAASFEKLSHISGHEKALDILDNVDKVKLCMVMLDLECNDLAIEMFKHFLRFIRSNHPRNAIHSMESIMTLILQESDDISPDLLRPLLDSVWNENKALSPMSWILGEKVIRNCAVKLKPYLMKAVESSGRALNEYADIVTDICQNKSESVNVIFQMVLNF

SEQ ID NO: 98635 - protein, 131 aa, Glycine max
  Coding DNA Sequence Number=SeqID_6950
MKKNIHPMKPLIHEGSKAMKHGHTVEVSRPASETHRTHKRVRLRCDAMSIATAVVGHGWMQETRDRTRLNKWTRASKREMSASSPSQAKKQDDDTKALWTYVTKIKSVGDGGTYEITCHICDFTFNGSYTK

SEQ ID NO: 98636 - protein, 308 aa, Glycine max
  Coding DNA Sequence Number=SeqID_6951
  Gene Ontology: Mol. function=cinnamoyl-CoA reductase activity; Cellular component=cytoplasm; Biological process=cellular metabolic process
  Homolog annotation: Hit_ID=A7QA56; Match level="QueryCoverage=99%, HitCoverage=98%, E-value=1e-130, Identity=69%"; Hit description =Chromosome undetermined scaffold_69, whole genome shotgun sequence
  Pfam annotation: Domain name=3Beta_HSD; Domain location=15-260; Score= -55.2; E_value=1.5e-06; Accession=PF01073.10; Description=3-beta hydroxysteroid dehydrogenaseisomerase family
  Pfam annotation: Domain name=Epimerase; Domain location=14-227; Score= 40.4; E_value=3.6e-10; Accession=PF01370.12; Description=NAD dependent epimerasedehydratase family
  Pfam annotation: Domain name=NAD_binding_4; Domain location=4-212; Score=-63.9; E_value=0.00012; Accession=PF07993.3; Description=Male sterility protein
  Pfam annotation: Domain name=Polysacc_synt_2; Domain location=14-191; Score=-195.9; E_value=0.083; Accession=PF02719.6; Description =Polysaccharide biosynthesis protein
  Pfam module annotation: Pfam domain module=3Beta_HSD::Epimerase::NAD _binding_4::Polysacc_synt_2; Domain location=15-260::14-227::4 -212::14-191
MPTDTSSVSGGEIVCVTGAGDDPKNGHLKELEGGKERLTLHKVDLFDIDSIKEALNGCHGVFHTASPVTDNPEEMVEPAVNGTKNVITAAAEAKVRRVVFTSSIGTVYMDPNTSRDALVDESFWSDLEYCKNTKNWYCYGKTVAEQTAWDVAKERGVDLVVVNPVLVIGPLLQPTINASTIHILKYLTGSAKTYVNATQAYIHVRDVALAHILVYETPSASGRYICAESSLHRGELVEILAKFFPEYPIPTKCSDEKNPRVKPYIFSNQKLKDLGLEFTPVKQCLYDTVKNLQENGHLPVPPKQEDSY

SEQ ID NO: 98637 - protein, 32 aa, Glycine max
  Coding DNA Sequence Number=SeqID_6952
MGTNTIPAQGFDQKGYILIYSPLVLPNVHFIE

SEQ ID NO: 98638 - protein, 89 aa, Glycine max
  Coding DNA Sequence Number=SeqID_6953
MVYSPTNWYHRTLKFKDPIEGVAMASATNAGGFIHVLLVLDGKNYDQWVVRMEAILGFHEILGIVKEGISEKKKDDATIMKKDFKAKMM

SEQ ID NO: 98639 - protein, 206 aa, Glycine max
  Coding DNA Sequence Number=SeqID_6954
  Gene Ontology: Mol. function=phosphoprotein phosphatase activity; Cellular component=protein serine/threonine phosphatase complex; Biological process=protein amino acid dephosphorylation
  Homolog annotation: Hit_ID=A7P656; Match level="QueryCoverage=61%, HitCoverage=27%, E-value=1e-37, Identity=65%"; Hit description =Chromosome chr4 scaffold_6, whole genome shotgun sequence
  Subcellular localization annotation: CTP_CleavageSite=51; ConfidenceScore=5.05e-01
MGLLNGKRSFLGMRIKGLAGKYKKERKRWQRKRGSFLLLLFSSTQRHRFIALSLVRTQFLMGIYLSTPKTEKASEDGENDKLRFGLSSMQGWRATMEDAPPTSVMFTVLLYDICHLMLWLYTREAIHAAHPCLDESTSYFGVYDGHGGKAVSKFCAKYLHLQVLKSEAYLAGDLGTSLQKSFLRGDLASWSLQDINIAGKQDLDTY

SEQ ID NO: 98640 - protein, 752 aa, Glycine max
  Coding DNA Sequence Number=SeqID_6955
  Gene Ontology: Mol. function=voltage-gated potassium channel activity; Cellular component=integral to membrane; Biological process=potassium ion transport
  Homolog annotation: Hit_ID=A7QFZ6; Match level="QueryCoverage=99%, HitCoverage=96%, E-value=0.0, Identity=64%"; Hit description =Chromosome chr9 scaffold_90, whole genome shotgun sequence
  Pfam annotation: Domain name=Ion_trans; Domain location=157-429; Score=72.4; E_value=1.5e-18; Accession=PF00520.22; Description=Ion transport protein
  Pfam annotation: Domain name=cNMP_binding; Domain location=530-630; Score=33.4; E_value=8.1e-07; Accession=PF00027.20; Description =Cyclic nucleotide-binding domain
  Pfam module annotation: Pfam domain module=Ion_trans::cNMP_binding; Domain location=157-429::530-630
MFDSGYKSQYIGGQKEKFVRLDDLDSNCSMPSSSRGMKKLRFNLDSLPIPLPGRGRKRASKSFRQGMKKSSDGLKTFGRSLKTGVTTWAVFPEDLKVSEKKVFDPQDKNLLYWNKFFEILCIVSVACDPFFFYLPYFNHKSFCLAIDNNLASFAVPMRTICDFIYLLRISFQFRTAYIAPSSRVFGRGELVIDPTKIAKRYLQRYFIIDFISVLPIPQIIVWKYLYRSGRVEVLETKTALLRIVILQYFPRFLRFLPLASEVKRTAGVFSENALLGAMYYLIWYMLASHITGSVWYLLAIERNDTCWKDACKKVEGCNTHFLYCSNSNKHMSGYESWRNVSETVLKSRCFVEDDSSEFNYGIFSQAIQSDIVASVEVFPKFCYCLWWGLQNLSTLGQGLLTSTYPKEVLFSIVIAIMGLILFALLIGNMQTYLQSMSVRLEEMRIKRRDSEQWMHHRLLPPELRERVRRYDQYKWLNTRGVDEESLVQSLPKDLRRDIKRHLCLNLVRRVPLFANMDERLLDAICERLKPSLYTEGTYIVREGDPVNEMHFIIRGRLESVTTDGGRSGFFNRGLLKEADFCGEELLTWALDPKSAASLPTSTRTVKAINEVEAFALEAEELKFVASQFRHIHSRQVQHTFRFYSQQWRTWAAIYIQAAWRRHYRRKIAEQRRREEEEFCDSDYENGDGSASALVKRRDTSVSPSGLRLGTTVYASRFAANALHGHRLRGSSSRETIKLQKPPEPDFGNLDDD

SEQ ID NO: 98641 - protein, 250 aa, Glycine max
  Coding DNA Sequence Number=SeqID_6956
  Homolog annotation: Hit_ID=A7PVI8; Match level="QueryCoverage=100%, HitCoverage=80%, E-value=1e-112, Identity=77%"; Hit description =Chromosome chr9 scaffold_33, whole genome shotgun sequence
MGTGQDLLVRRGESVPLNFEGPIFVCTRNDDLESVLQSTPSSRWGGVVIGRALDLVFFQNGMLEPWLESKGLEDANQVLAYFAVSKIGETPIDGRTDINPEGLTAAYGKWASIVAARLNAGGLSCKVLDKEVFQKQMLEKLIWICSVMLVGARHGGVSVGVVDKEFRTELSSLITELASAASSEKGLTFEEAMEERLCAYSRAVAHFPTAVKEFKWRNGWFYSLSEKATAQGKPDPCPLHSQWLKELRIV

SEQ ID NO: 98642 - protein, 539 aa, Glycine max
  Coding DNA Sequence Number=SeqID_6957
  Homolog annotation: Hit_ID=A7Q487; Match level="QueryCoverage=68%, HitCoverage=80%, E-value=1e-142, Identity=66%"; Hit description =Chromosome chr9 scaffold_49, whole genome shotgun sequence
  Pfam annotation: Domain name=Kelch_1; Domain location=232-278; Score =15.8; E_value=0.039; Accession=PF01344.16; Description=Kelch motif
  Pfam annotation: Domain name=Kelch_1; Domain location=282-330; Score =29.7; E_value=1.1e-05; Accession=PF01344.16; Description=Kelch motif
  Pfam annotation: Domain name=Kelch_1; Domain location=425-486; Score =22.3; E_value=0.0018; Accession=PF01344.16; Description=Kelch motif
  Pfam annotation: Domain name=Kelch_2; Domain location=232-278; Score =10.5; E_value=2.4; Accession=PF07646.6; Description=Kelch motif
  Pfam annotation: Domain name=Kelch_2; Domain location=282-330; Score =8.5; E_value=4.1; Accession=PF07646.6; Description=Kelch motif
  Pfam annotation: Domain name=Kelch_2; Domain location=365-423; Score =18.6; E_value=0.024; Accession=PF07646.6; Description=Kelch motif
  Pfam annotation: Domain name=Kelch_2; Domain location=424-486; Score =9.4; E_value=3.3; Accession=PF07646.6; Description=Kelch motif
  Pfam annotation: Domain name=SSXT; Domain location=2-61; Score=12.2; E_value=8e-05; Accession=PF05030.3; Description=SSXT protein (N -terminal region)
  Pfam module annotation: Pfam domain module=Kelch_1::Kelch_1::Kelch _1::Kelch_2::Kelch_2::Kelch_2::Kelch_2::SSXT; Domain location=232 -278::282-330::425-486::232-278::282-330::365-423::424-486::2-61
MACYDTLQYLDENKKLIVAIMENMKLGKIDKCAEYQEKIQQNLMYLATIADLQHSQTLIMPPQMIPPPSRMQPEYYMQHPQGVAMVQQQGIFPPNMQLQFGNPQQQLHQHAIQGQITRIGNGTYPMHSENVLEGGHSGGSTSTASPNNACGGSMQGTSEDGDGFALVADFLWASTSSTLPTSTKPSAFVVPSNHNKKKYENATASGRFLAAAYADLDAPQLKWQKMAPAPVPRLDGAAIQIRDLLFVFAGYGTIDFVHSHVDVYNFTDNTWGGRFDMPKEMAHSHLGMVTDGRYIYVVTGQYGPQCRGPTAHNFVLDTQTRKWRDLPPLPVPSIKHKQQIQREGEGSGQTHLFPPSFLDAGFTLCLCCFWMLTVFGSKKIMGRLHVMGGSKENRHTPGLEHWSLAVKDGKALENEWRSEIPIPRGGPHRACVVVDDRLYVLGGQEGDFMAKPGSPIFKCSRRQEVVYTDVYMLDDDMKWKTLPPMPKANSHIEFAWALVNNSIVIVGGTTEKHPITKKMVLNGEVVQFNLNTLVTTSSF

SEQ ID NO: 98643 - protein, 255 aa, Glycine max
  Coding DNA Sequence Number=SeqID_6958
  Gene Ontology: Mol. function=FMN binding
  Homolog annotation: Hit_ID=A7Q485; Match level="QueryCoverage=80%, HitCoverage=52%, E-value=1e-102, Identity=87%"; Hit description =Chromosome chr9 scaffold_49, whole genome shotgun sequence
MEENRKITMEIVQQNRILHQFSPPEPFNLTQFLLLHFSFPLFTLMPTVQPFHSSDPIFSFSPLAIHTRNLLADPRCTLVVQIPGWSGLSNARVTLFGDVYPLPEDQQEWAHKQYIAKHQQGPSQQWGNFYYFRMQNISDIYFIGGFGTVAWVDVKEYETLQPDKIAVDGGEQYLKELNAIFSKPLKKLLSSETEVDDAALISIDSKGTDIRVRQGAQFNIQRISFDEGQSVETLEEAKAALRKLIHKGKVYNLQK

SEQ ID NO: 98644 - protein, 169 aa, Glycine max
  Coding DNA Sequence Number=SeqID_6959
  Gene Ontology: Mol. function=acetylglucosaminyltransferase activity; Cellular component=membrane
  Homolog annotation: Hit_ID=Q5BM96; Match level="QueryCoverage=59%, HitCoverage=23%, E-value=6e-20, Identity=49%"; Hit description =Secondary cell wall-related glycosyltransferase family 14
MWLILWDTDPSESQLLDMSHYDTMLETGAAFARPFGEGDVVLEKIDDLILNRSSNGLVQGEWCSNSEINKTTKASEAEEEFCSQSSNVDAVKPGPFGIKLKTLQAEIVNSRKFRTSQCKSFERPWEFGTEDSRLCLLKAEFVSISLHSQHNPFCSNFISSYLQLKQSSS

SEQ ID NO: 98645 - protein, 875 aa, Glycine max
  Coding DNA Sequence Number=SeqID_6960
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q9LU41; Match level="QueryCoverage=90%, HitCoverage=74%, E-value=0.0, Identity=67%"; Hit description=Calcium- transporting ATPase 9, plasma membrane-type (EC 3.6.3.8) (Ca(2+) -ATPase isoform 9)
  Pfam annotation: Domain name=Cation_ATPase_N; Domain location=109 -192; Score=51.3; E_value=3.3e-12; Accession=PF00690.17; Description =Cation transporterATPase, N-terminus
  Pfam annotation: Domain name=E1-E2_ATPase; Domain location=206-451; Score=160.8; E_value=3.7e-45; Accession=PF00122.11; Description=E1 -E2 ATPase
  Pfam annotation: Domain name=Fe-ADH; Domain location=293-614; Score= -219.4; E_value=0.032; Accession=PF00465.10; Description=Iron -containing alcohol dehydrogenase
  Pfam annotation: Domain name=Hydrolase; Domain location=484-765; Score=32.7; E_value=1.3e-06; Accession=PF00702.17; Description =haloacid dehalogenase-like hydrolase
  Pfam module annotation: Pfam domain module=Cation_ATPase_N::E1-E2 _ATPase::Fe-ADH::Hydrolase; Domain location=109-192::206-451::293 -614::484-765
MNVRVVTINSLQMHACTGHRNRSSDLLKNGKNENSKMLLWQHCFSDWPMLREINRSGQLLAQNLKKRNSLALMLSVLMISTAASPPTPAGDYDIGLEQLVSMAKDQNISALQQYGGASLQHIRGLSNLIKSNPDKGVSGDDADLLKRKNAFGTNTYPRKKGRSFWRFLWEAWQDLTLIILIIAAAVSLALGIKTEGLAEGWYDGGSIAFAVLLVIVVTAVSDYRQSLQFQNLNAEKQNIQLEVIRGGRTIKISIFDIVVGDVIPLKIGDQVPADGVLITGHSLAIDESSMTGESKIVHKDHKTPFFMSGCKVADGVGLMLVTGVGINTEWGLLMASISEDNGEETPLQVRLNGVATFIGVVGLSVAVLVLAVLLGRYFSGHTKDLDGNVEFVAGKTSLSNAVDGVIKIFTIAVTIVVVAVPEGLPLAVTLTLAYSMRKMMADKALMTVVEAYVGSTKVNPPDDSSKLHPKALSLINEGIAQNTTGNVFVPKDGGETEVSGSPTEKAILSWAVKLGMNFDVIRSNSTVLHVFPFNSEKKRGGVALKLGDSGIHIHWKGAAEIVLGTCTQYLDSDGQLQSIEEDKKAFFKDAIDDMAARSLRCVAIAYRSYELDKVPSSEQDLDQWSLPEYELVLLAIVGIKDPCRPGVKDAVKVCTDAGVKVRMVTGDNLQTAKAIALECGILASIEDAVEPNIIEGKKFRELSEKEREDIAKKITVMGRSSPNDKLLLVQALRKGGEVVAVTGDGTNDAPALHEADIGLSMGISGTEVAKESSDIIILDDNFASVVKVVRWGRSVYANIQKFIQFQLTVNVAALVINVVAAITSGDVPLNAVQLLWVNLIMDTLGALALATEPPTDRLMHRSPVGRRFGLIGFLT

SEQ ID NO: 98646 - protein, 670 aa, Glycine max
  Coding DNA Sequence Number=SeqID_6961
  Gene Ontology: Mol. function=RNA-directed DNA polymerase activity; Cellular component=exocyst; Biological process=exocytosis
  Homolog annotation: Hit_ID=A5BJM0; Match level="QueryCoverage=96%, HitCoverage=95%, E-value=0.0, Identity=52%"; Hit description =Putative uncharacterized protein
  Pfam annotation: Domain name=Exo70; Domain location=41-638; Score =361.4; E_value=1.5e-105; Accession=PF03081.6; Description=Exo70 exocyst complex subunit
MESLEAARKCLTTSLETSSAIASALDESRSRLQLLNQRYLSLQASLRPISKQKCSFVNIDQCIDSVLCSAAALLKVSDSVQQLEHSLLTDPSSDLYTYVSDTKKLEEALKLLTDNCRLAVGWLKDVFEFLQDKAITNELYLLNVKKSLRILQELQVKEESSRLDGGLLSTAFDKLELEFHRLIIANSMPLPLVSLTSHIGQQASIAKQALPLTSSLAGELHAIIERLHANGRLDKCQSIYVEVRGMNARRSLKTLDLSYLEILTAEFEGAQCIESYIDQWGCHLELVVKQLLKTECRLSAIVFEKIGPEAWMGCFAKIAIESGILSFIQFGRIVTERKNDPFKLLNLLSIFKVLNGLRLIFNQLFSVKACKEIRTVTEDLIKQVVNGASEVFWQLPAQVRLQRPTSPPSDGSVPRLVSFVIDYCNQLLGDAYRPHLTQVLGIHLSWRKEAYEEGIVFCQIYNAIKEVAVNLDSWSKAYEDITLSYLFMMNNHCHFCNLRGTVLGNMMGDSWLKAHEQYKDYYAALYLRNSWGKLLSILVVQRDILSPTSASVTSQDLTKRLNAFNLAFDERYKKQSNWVISDEILRENVCKHLVEGIIPIYRAYVKNYCLLIENDAKVDKHMKYTAQSLENKIRSLFQPRQRKGSSSKQTDLISKIKEVSHQFRLTLAAL

SEQ ID NO: 98647 - protein, 76 aa, Glycine max
  Coding DNA Sequence Number=SeqID_6962
MAITEKVEKYPFWLKEGVDSVRSTSLESYEQLAQYKARQVFGLNAVQEKGSGDDIHHILKHMRESGQELPQGTLQG

SEQ ID NO: 98648 - protein, 456 aa, Glycine max
  Coding DNA Sequence Number=SeqID_6963
  Gene Ontology: Mol. function=damaged DNA binding; Cellular component =nucleus; Biological process=proteasomal ubiquitin-dependent protein catabolic process
  Homolog annotation: Hit_ID=A9PF88; Match level="QueryCoverage=100%, HitCoverage=93%, E-value=6e-69, Identity=69%"; Hit description =Putative uncharacterized protein
  Pfam annotation: Domain name=UBA; Domain location=124-163; Score =45.2; E_value=2.3e-10; Accession=PF00627.22; Description=UBATS-N domain
  Pfam annotation: Domain name=UBA; Domain location=411-447; Score =34.4; E_value=4.1e-07; Accession=PF00627.22; Description=UBATS-N domain
  Pfam annotation: Domain name=XPC-binding; Domain location=355-389; Score=26.1; E_value=0.00013; Accession=PF09280.2; Description=XPC -binding domain
  Pfam annotation: Domain name=ubiquitin; Domain location=1-55; Score =4.5; E_value=0.094; Accession=PF00240.14; Description=Ubiquitin family
  Pfam module annotation: Pfam domain module=UBA::UBA::XPC -binding::ubiquitin; Domain location=124-163::411-447::355-389::1-55
MAVKKNIEDVQGKDNYPCGQQLLIHNGKVLKDETTLVENKVSEDGFLVVMLSKSKTSGSAAASSVQPASNPPTTVSTSNSTPPSDPPVQTQAANNSTSSTDAPTTNVSADTYGLAASNLVAGSNLEQTIQQIMDMGGGNWDRDTVSRALRAAYNNPERAIDYLYSGIPEAAEVAVPVPQTAGISSGAVPVGPNSSPLNMFPQETISSTGAGLGSLDFLRNNPQGRVAAPKNATIDSVHHAILNPESEKEQRRKRWVFINAGDWLENSPGKRWVAAGKSRTRLWMSEFGQKRSLSVLGCGWGIEEDRGSEYKGIGFSKSGCEGCESCHDGCDLNLRHDGFTWSRISLQHTVLVTTLPVLQELGKQNPGLLRLIQEHHGEFLQLINEPVDGSEGDIFEQPEQDMPHAINVTPAEQEAIGRLEAMGFDRASVIEAFLACDRDEQLAANYLLENAGDFED

SEQ ID NO: 98649 - protein, 160 aa, Glycine max
  Coding DNA Sequence Number=SeqID_6964
  Gene Ontology: Mol. function=signal transducer activity; Cellular component=cytoplasm; Biological process=two-component signal transduction system (phosphorelay)
  Homolog annotation: Hit_ID=A7QIM4; Match level="QueryCoverage=71%, HitCoverage=73%, E-value=5e-45, Identity=81%"; Hit description =Chromosome chr9 scaffold_104, whole genome shotgun sequence
  Pfam annotation: Domain name=Hpt; Domain location=92-160; Score=19.4; E_value=0.014; Accession=PF01627.14; Description=Hpt domain
MRGVVVTDRLPVQGAPLRATLIKHFDHQIHLSELVESAKTGLPLWMLGLGADLLWADMNRLLAFLFHQGVLDEQFLQLQQLQDETSPNFVSEVVNIYFHESEKLLRNLRALLMEKEFSDYKKMGIHLNQFMGSSSSIGAKRVRNVCVAFRAATEQNNRAG

SEQ ID NO: 98650 - protein, 74 aa, Glycine max
  Coding DNA Sequence Number=SeqID_6965
  Homolog annotation: Hit_ID=A6FJQ2; Match level="QueryCoverage=51%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARLLIRFNWMILYHTDIVKMENRHSH

SEQ ID NO: 98651 - protein, 665 aa, Glycine max
  Coding DNA Sequence Number=SeqID_6966
  Gene Ontology: Mol. function=hydrogen ion transmembrane transporter activity; Cellular component=integral to membrane; Biological process=proton transport
  Homolog annotation: Hit_ID=A7Q493; Match level="QueryCoverage=98%, HitCoverage=75%, E-value=0.0, Identity=76%"; Hit description =Chromosome chr9 scaffold_49, whole genome shotgun sequence
  Pfam annotation: Domain name=H_PPase; Domain location=103-665; Score =787.1; E_value=1.1e-233; Accession=PF03030.7; Description=Inorganic H+ pyrophosphatase
MNRQFKIQRPGSGGDLPQGGEYNPSSSFPVARRVNSSHSIMMEDDMETGTLGAYQDKLRTFPNMRTKPYTPLIFRILLGINVRVLFILLLFGLGAIFYVGASTSPIIVFVISVCILSFLVAIYLTKWVLAKDEGPPEMVQISDAIRDGAEGFFRTQYGSISKMAMLLALVILCIYLFRSTNPQQESSGLGRTTSAYITVASFLLGALCSGVAGYVGMWVSVRANVRVSSAARRSAREALQEFVQIATRAGGLSAIIVVGMAVIGIAVLYATFYVWLEVDSPGSMKVTDLPLLLVGYGFGASFVALFAQLGGGIYTKAADVGADLVGKVEQGIPEDDPRNPAVIADLVGDNVGDCAARGADLFESIAAEIISAMILGGTMAQRYPSGFILFPLVVHSFDLIVSSAGIFSIRGTRETGVIVPVEDPMTILQKGYSFTIVLAVLAFGLSTRWLLYTEQAPSAWFNFALCGLIGIITAYIFVWIAKYYTDYKHEPVRILALSSSTGHGTNIIAGVSLGLESTALPVLVISVSIISAFWLGHTCGLVDETGNPTGGLFGTAVATMGMLSTAAYILTMDMFGPIADNAGGIVEMSQQPESVREITDVLDAVGNTTKATTKGFAIGSAALASFLLFSAYMDEVSSFAHEPFKQEGGPSLEVKIGYPSTTHMV

SEQ ID NO: 98652 - protein, 44 aa, Glycine max
  Coding DNA Sequence Number=SeqID_6967
MEDFGYGYMLRHPKKYMKDSKVIRKATYSGCKQSNMDIDEVYQL

SEQ ID NO: 98653 - protein, 510 aa, Glycine max
  Coding DNA Sequence Number=SeqID_6968
  Gene Ontology: Mol. function=structural constituent of ribosome; Cellular component=intracellular; Biological process=translation
  Homolog annotation: Hit_ID=A7Q4A5; Match level="QueryCoverage=80%, HitCoverage=96%, E-value=1e-131, Identity=60%"; Hit description =Chromosome chr9 scaffold_49, whole genome shotgun sequence
  Pfam annotation: Domain name=DUF1666; Domain location=194-420; Score =367.5; E_value=2.2e-107; Accession=PF07891.3; Description=Protein of unknown function (DUF1666)
MEFLKIKKFRKSQKANGEKDLADKAVPEPEEPKLNTDGPDQCKSENADSAGEAEDDDDFITNEVKRRLKELRRNSFMVLIPEEDSCPEEGEDEEEEEAGETCSNEWRDVEAEGQQWWRGFDAVFEKYCERMLFFDRMSTQQLSEVGKGSQYTSTPSPRSASKKLASPLRCLSLKKFEEPDDETEHLQQPEHDPYQDIETAYVGQICLTWEALHCQYSHMSQKISWQHDNPTCYNHSAQEFQQFQVLLQRFIENEPFEQGRRAEIYARTRNNLPKLLQVPNIRGSDHELTDDSEMRVLAPDLIGIIESSILTFHLFMKRDKKKSSGATNQNQLDTPLQQIQSTLEKKVVKLKELRRKKKNWKKNSWPQKHEDIQVLLGLIDVKILSRVLRMTRMTREQLFWCEEKMKKLDLSNSSFSSFSFGSITVAGFEDVIKSALQLFRISWEEFGILYDNEGKNNWELRWMGEAEAEGGKAIIALESANAIVAWLANTIGATTRGCFSRSFSYRCLCR

SEQ ID NO: 98654 - protein, 553 aa, Glycine max
  Coding DNA Sequence Number=SeqID_6969
  Gene Ontology: Mol. function=catalytic activity; Cellular component =cellular_component; Biological process=metabolic process
  Homolog annotation: Hit_ID=Q9MB42; Match level="QueryCoverage=98%, HitCoverage=93%, E-value=0.0, Identity=87%"; Hit description=Beta -amyrin synthase
  Pfam annotation: Domain name=Prenyltrans; Domain location=426-468; Score=43.8; E_value=6.2e-10; Accession=PF00432.12; Description =Prenyltransferase and squalene oxidase re
  Pfam annotation: Domain name=Prenyltrans; Domain location=475-530; Score=34.5; E_value=3.9e-07; Accession=PF00432.12; Description =Prenyltransferase and squalene oxidase re
  Pfam module annotation: Pfam domain module=Prenyltrans::Prenyltrans; Domain location=426-468::475-530
VGEAKERMWRLKIAEGGNEAYIFSTNNFVGRQTWEFDPEAGTPEERAQVEAARKDFYHHRFKVKPCADLLWRFQDLMEVIIMLVLEQEIGFEIMVILGVFDWCGSNPMPPEFWILPSFLPMHPAKMWCYCRLVYMPMSYLYGKRFVGPITPLILQLREELFTQPYEKVNWKKARHQYAKEDLYYPHPLVQDLIWDSLYIFTEPLLTRWPFNKLIREKALQVTMKHIHYEDETSRYITIGCVEKVLCMLACWVEDPNGDAFKKHLARIPDYLWVSEDGMTMQSFGSQEWDAGFAVQAFLATNLIEEIGPTLAKGHDFIKKSQVKDNPLGDFKSMYRHISKGSWTFSDQDHGWQVSDCTAESLKSKKGGLAAWELAGAQEWLELLNPTEFFADIVVEHEYVECTGSAIQALVLFKNLYPGHRKKEIENFIANAVRFLEDTQTADGSWYGNWGVCFTYGSWFALGGLAAAGKTYINCAAIRKAVKFLLSTQREDGGWGESYLSSPKKIYVPLEGSRSNVVHTAWALMGLIHAGQADRDPKPLHRAAKLLINSQLER

SEQ ID NO: 98655 - protein, 60 aa, Glycine max
  Coding DNA Sequence Number=SeqID_6970
VSRSEKEKESRCRCRRCCRCYGGFTEWVVGGFPVAVVLPSLALGGSDANCYWWMRPGEIG

SEQ ID NO: 98656 - protein, 844 aa, Glycine max
  Coding DNA Sequence Number=SeqID_6971
  Gene Ontology: Mol. function=protein binding; Cellular component =cytoplasm; Biological process=humoral immune response
  Homolog annotation: Hit_ID=A3BVN4; Match level="QueryCoverage=73%, HitCoverage=89%, E-value=1e-147, Identity=47%"; Hit description =Putative uncharacterized protein
  Pfam annotation: Domain name=YTH; Domain location=651-736; Score =187.2; E_value=4.3e-53; Accession=PF04146.6; Description=YT521-B -like family
DVFFQGGWHFNMLATPLSNDIKNKLLSIVLDDQLDDVVIWNPSPTDGHHNLILCDMKIFKDKKWQPWFIINQAKTTYDIAFSPPPNPKAQKQPLAVSRSSLAENSIKLDVDGSSLGNPGKAGFSEILCDNLGQWLSSFLGSCGFATSLNAELHVLFHGLSLAWNSGYKSVEEANICANWLSKKGSSSTEPMSTLVPCPISLSPMSLVDALRIFMAATQPPQGPDRTTEEIPAEPDNLKEQGTTTIGHSRETTSQSGSLGSVGDCPLYPPNVYAPQAQAFYYRGFDNGNGEWDEYSSYVNSEGLDIGSPGVYNENPSLIFHSGYGFNPQVPYGPYSPVTTPLPSVGVDTQLYSPQQFPYTGPPYYHQLVPPSLPYLNSPTPVSQPELTNLVGIDQQVDNMFFGPRAGYPSVGSFGRGNFPVAPGSFGFHESQQGFEGSRSGGIWSDCSKPSERQRSLMPLSPSVSPQPMGSLGSFGPSVGMASHQQQSLYGFGSGSNSYGRGYLPNQGSSFGGTSISNLNDRSFASLENSRRQGRPTASLCNCNGTLDILSEQNRGPRASKLKNQISTENNSVDSSKNSASTAKFQNESLNRSDFATDYKDAKFFVIKSYSEDNVHKSIKYGVWASTPNGNRKLDDAYRQAMEKQDACPIFLFFSVNASAQFCGVAEMVGPVNFDKSVDFWQQDKWSGQFPLKWHIIKDVPNSQFRHIILENNDNKPVTNSRDTQEGVEMLTIFKNYETDVSILDDFDFYEDRQKAMQERKARQQSSMVATGLVGENEHRSSANTTGDFMKQMSKSFALVVRLDENNKEVVADRDSLVSHGHGPIGNVVKPDDGQSVTASSTQTS

SEQ ID NO: 98657 - protein, 442 aa, Glycine max
  Coding DNA Sequence Number=SeqID_6972
  Gene Ontology: Mol. function=transporter activity; Cellular component= integral to membrane; Biological process=transport
  Homolog annotation: Hit_ID=A5AGQ9; Match level="QueryCoverage=83%, HitCoverage=73%, E-value=1e-129, Identity=64%"; Hit description =Putative uncharacterized protein
  Pfam annotation: Domain name=MFS_1; Domain location=57-428; Score =59.3; E_value=1.3e-14; Accession=PF07690.7; Description=Major Facilitator Superfamily
  Pfam annotation: Domain name=Sugar_tr; Domain location=48-441; Score=- 33.2; E_value=1.1e-07; Accession=PF00083.15; Description=Sugar (and other) transporter
  Pfam module annotation: Pfam domain module=MFS_1::Sugar_tr; Domain location=57-428::48-441
MKCEEKEARGVKGQSEEEESRRSKGRGKTGAEGPTYTVDDALVALGFGNFQILVLAYAGVGWVSEAMEMMLLSFVGPAVQTAWNLSAHEESLITSVVFAGMLIGAYSWGIVSDKHGRRKGFLITATVTALAGFLSAFAPNYIFLIVLRSLVGIGLGGGPVLSSWFLEFVPAPNRGTWMVVFSAFWTLGTIFEASLAWIVMPKLGWRWLLALSSLPTSFLLLFYKVTPESPRYLCLKGRTADAINVLEKIARVNGRELPSGILVSEHEIELHKIDNPTEDARLLSPRTNEDEHPKGIVSNLGAISSLLVLLSPKLARSTLLLWAVFFGNAFSYYGLVLLTTELNGHSKCMSDKLQTEKSQDVRYKSVFIASFAELPGLLLSAAAVDKLGRKLSMSIMFFMCLHGCHQTAAVLLFEIVSLVSGICVMFFPIETMGQELRNNVQV

SEQ ID NO: 98658 - protein, 195 aa, Glycine max
  Coding DNA Sequence Number=SeqID_6973
  Gene Ontology: Mol. function=pyruvate kinase activity; Cellular component=chloroplast stroma; Biological process=glycolysis
  Homolog annotation: Hit_ID=A2WX15; Match level="QueryCoverage=55%, HitCoverage=15%, E-value=7e-21, Identity=55%"; Hit description =Pyruvate kinase
  Pfam annotation: Domain name=PK; Domain location=4-135; Score=-224.9; E_value=5.1e-05; Accession=PF00224.12; Description=Pyruvate kinase, barrel domain
MLDKRAATLFCATWPCVLFGKDGMMSMVVKSTTKDSVKCAVVDGGELKSSASHGTMVARGDLGAELPIEEVPLLQEEIINLCCNMGKVVIVATYMLESMIVHPTPTRAEGLMVEEMFLDYILIVTDRVADIENGLFPHKATPLFDKLAFEKTQQALGGHLDHHYHLEDKVFFNGIGDVRKGIMAQQDTTSKHRHE

SEQ ID NO: 98659 - protein, 141 aa, Glycine max
  Coding DNA Sequence Number=SeqID_6974
LRDFLHRIFEEDFEDSAPIKVFLLVWESNGSSRWPSVVSGRIYNLQLSLSGAPSRRSAHFLSVGIGLSAALGRSAQFPSIGIALSAPYSFSGRPKVTIFKIPTVKLNDSGIEAYVSLKVEDMTKFEADEELLACVSKAPVC

SEQ ID NO: 98660 - protein, 139 aa, Glycine max
  Coding DNA Sequence Number=SeqID_6975
  Subcellular localization annotation: CTP_CleavageSite=11; ConfidenceScore=5.61e-01
MAVRRSDSRPVALALVAIAACHSLNSRLRFFISFAVQGNSQSRSTPWNPKVRARVMGELMKVARGVAMREKRVVLELAPLMEMRVATVEPRVVVNFARFVDVEFEACALSTAFSEEAIARERMRYNIIHGIILFQGNLS

SEQ ID NO: 98661 - protein, 497 aa, Glycine max
  Coding DNA Sequence Number=SeqID_6976
  Gene Ontology: Mol. function=histone acetyltransferase activity; Cellular component=nucleus; Biological process=regulation of transcription, DNA-dependent
  Homolog annotation: Hit_ID=Q9FWQ5; Match level="QueryCoverage=97%, HitCoverage=33%, E-value=0.0, Identity=63%"; Hit description=Histone acetyltransferase HAC12
  Pfam annotation: Domain name=C1_3; Domain location=322-352; Score =10.7; E_value=0.029; Accession=PF07649.3; Description=C1-like domain
  Pfam annotation: Domain name=DUF906; Domain location=1-203; Score =272.4; E_value=9.4e-79; Accession=PF06010.3; Description=Domain of Unknown Function (DUF906)
  Pfam annotation: Domain name=ZZ; Domain location=318-364; Score=29.6; E_value=1.2e-05; Accession=PF00569.8; Description=Zinc finger, ZZ type
  Pfam annotation: Domain name=zf-TAZ; Domain location=380-459; Score =49.0; E_value=1.6e-11; Accession=PF02135.7; Description=TAZ zinc finger
  Pfam module annotation: Pfam domain module=C1_3::DUF906::ZZ::zf-TAZ; Domain location=322-352::1-203::318-364::380-459
MGKNGETIKKDIEIPGADALVVRVVSSVDKKLEVKPRFLEIFQEENYPTEFPYKSKVVLLFQKIEGVEVCLFGMYVQEFGSECQFPNQRRVYLSYLDSVKYFRPEVKAVTGEALRTFVYHEILGEDYILYCHPEIQKTPKSDKLREWYLAMLRKASKENVVVDLTNLYDHFFVSTGECRAKVTAARLPYFDGDYWPGAAEDLIYQLRQEEDGRKQNKKGTTKKTITKRALKASAELKREERERHPINHREKHTLYPVEITDVPSDTKDKDDILESEFFDTRQAFLSLCQGNHYQYDTLRRAKHSSMMVLYHLHNPTAPAFVTTCNICYLDIETGQGWRCEVCPEYDVCNACYQKDGGIDHPHKLTNHPSMVDRDAQNTEAREVRVVQLRKMLDLLVHASQCRSAHCQYPNCRKVKGLFRHGMHCKTRASGGCVLCKKMWYLLQLHARACKESECHVPRCRDLKEHLRRLQQQSDSRRRAAVMEMMRQRAAEVANNAG

SEQ ID NO: 98662 - protein, 552 aa, Glycine max
  Coding DNA Sequence Number=SeqID_6977
  Gene Ontology: Mol. function=transcription repressor activity; Biological process=regulation of nitrogen utilization
  Homolog annotation: Hit_ID=A7Q4K0; Match level="QueryCoverage=69%, HitCoverage=68%, E-value=1e-158, Identity=76%"; Hit description =Chromosome chr9 scaffold_49, whole genome shotgun sequence
  Pfam annotation: Domain name=CIA30; Domain location=304-495; Score =8.9; E_value=5.5e-07; Accession=PF08547.3; Description=Complex I intermediate-associated pro
  Pfam annotation: Domain name=Epimerase; Domain location=146-384; Score=-61.0; E_value=0.013; Accession=PF01370.12; Description=NAD dependent epimerasedehydratase family
  Pfam annotation: Domain name=KR; Domain location=144-280; Score= -88.5; E_value=0.033; Accession=PF08659.1; Description=KR domain
  Pfam annotation: Domain name=NmrA; Domain location=146-326; Score= -103.1; E_value=0.026; Accession=PF05368.4; Description=NmrA-like family
  Pfam annotation: Domain name=adh_short; Domain location=144-261; Score=-30.8; E_value=0.0013; Accession=PF00106.16; Description=short chain dehydrogenase
  Pfam module annotation: Pfam domain module=CIA30::Epimerase::KR::NmrA: :adh_short; Domain location=304-495::146-384::144-280::146-326::144 -261
  Subcellular localization annotation: CTP_CleavageSite=42; ConfidenceScore=5.31e-01
MMNAATAANSSVYSQTQCRLLSSDLRSSIPFLNERKSRLVVRAGGRPPQNMGKDEDEKQQQRVIQQQQQQEQQAPPPVSLSLDDVNPVGLGRRSRQLFDEVWRKFSGLGQISRTIRSDDQEALDALLVREGPMCEFAIPGAQNTTVLVVGATSRIGRIVVRKLMLRGYAVKALVRRADQEVLELLPRSVEIVIGDVGDPATVKAAVEGCNKIIYCATARSAITGDLFRVDHRGVYNLTKAFQVSPSLSLHTFTRNLYLLRLLHFQDHSNKLAQSRAGKSSKSKLSIAKFKSASSLNGWEVRQGTYFQDVVATKYDGGMDAKFDFTETGDAVFSGYVFNRGGYVELSKKLSLPLGYTLDRKFFHAFKHNKFINNDRYEGLVLSVGGNGRSYVLILEAGPSADPSQSRLYFARISTKVGFCRVRVPFSSFRPVKPDDPVLDPFLVHTLTIRFEPRRQVLRPLLGADKGWGSGFPTSIAKTCLNYPVFHALQLKRAVGHHLVEAELHQELQLDPIIYLPAKVFAESVVTRKEEKIPQVLNKWQGKTKEEATWEDV

SEQ ID NO: 98663 - protein, 39 aa, Glycine max
  Coding DNA Sequence Number=SeqID_6978
MESGNWSCLHACDVGVIVILYGYLHAQPHREDAETCLDE

SEQ ID NO: 98664 - protein, 60 aa, Glycine max
  Coding DNA Sequence Number=SeqID_6979
MGGLTSHYHERLTNTKRKQDEWKRIKKMEEWVPNIIMFFDINYALSLHMCTERTCKVQLT

SEQ ID NO: 98665 - protein, 420 aa, Glycine max
  Coding DNA Sequence Number=SeqID_6980
  Gene Ontology: Mol. function=transcription factor activity; Cellular component=nucleus; Biological process=regulation of transcription, DNA-dependent
  Homolog annotation: Hit_ID=Q2EPY6; Match level="QueryCoverage=76%, HitCoverage=77%, E-value=2e-90, Identity=52%"; Hit description =AP2/EREBP transcription factor
  Pfam annotation: Domain name=AP2; Domain location=151-203; Score =62.8; E_value=1.1e-15; Accession=PF00847.11; Description=AP2 domain
  Pfam annotation: Domain name=AP2; Domain location=52-109; Score=52.8; E_value=1.2e-12; Accession=PF00847.11; Description=AP2 domain
  Pfam module annotation: Pfam domain module=AP2::AP2; Domain location =151-203::52-109
  Subcellular localization annotation: CTP_CleavageSite=30; ConfidenceScore=5.43e-01
SPASSCSSSTSSVGFEVHHPIEKRRPKHPRRNNLKSQKCKQNQTTTGGRRSSIYRGVTRHRWTGRFEAHLWDKSSWNNIQSKKGKQGAYDTEESAARTYDLAALKYWGKDATLNFPIETYTKDLEEMDKVSREEYLASLRRQSSGFSRGISKYRGVARHHHNGRWEARIGRVCGNKYLYLGTYKTQEEAAVAYDMAAIEYRGVNAVTNFDISNYMDKIKKKNDQTLQQQQTEVQTETVPNSSDSEEAEVEQQHTTTITTPPPSENLHMLPQEHQVQYTHHVTPRDEESSSLVTIMEHVLEQDLPWSFMYTGLSQFQDPNLALSKGDDDLAGMFDGAGFEEDIDFLFSTQPGDHETESDVNNMSAVLDSVECGDTNGAGGRSMVYHHVDNNNKQKKMLSFASSSSPSSTTTTVSCDYALDL

SEQ ID NO: 98666 - protein, 134 aa, Glycine max
  Coding DNA Sequence Number=SeqID_6981
MAQVVFGILIGLRAGYRFVRSLGWGNDTWSNYFLPFLMIYARKFKMHVHLHMHDNVLDLLTWEPCLAGNYTTNPGYSSSDPTCKMISDRHISISSPCPRCNHGEEASLLECEDAPASMRLVLDSNDKDVSYLRV

SEQ ID NO: 98667 - protein, 70 aa, Glycine max
  Coding DNA Sequence Number=SeqID_6982
MTLNTNYLCGTMNAKEEEQEIGLVAPFVKELAVGEAIGGSFEVIGVEGHGYTKGEELQSLPLQKAGASRK

SEQ ID NO: 98668 - protein, 110 aa, Glycine max
  Coding DNA Sequence Number=SeqID_6983
MILKFHDDPTVNGFEIVVFLRLVWWAAGKIQQQQQQRLIPLGGVGLKTSYPIAQRLFAMRRYGGGMLYAALPLHMQRGCFRIRTHDQQVTKAQLYRCTRARPQNGRHRTH

SEQ ID NO: 98669 - protein, 158 aa, Glycine max
  Coding DNA Sequence Number=SeqID_6984
  Homolog annotation: Hit_ID=A5C2C0; Match level="QueryCoverage=85%, HitCoverage=20%, E-value=2e-09, Identity=35%"; Hit description =Putative uncharacterized protein
  Subcellular localization annotation: CTP_CleavageSite=48; ConfidenceScore=5.84e-01
MAVAAFKSSSRRGTQSSAHSNAPPNTTSSSGRSSTRAPNPTRRSRSVSAFSRGSFDISTITEFLNKRDNPLFFDETQSTKALLTETSTPANSARSAGPGRRETGRVLSIADSGRRARSASQCPVSRRHLNYSTSEHFECLETRICVEKISGSYYKKFT

SEQ ID NO: 98670 - protein, 222 aa, Glycine max
  Coding DNA Sequence Number=SeqID_6985
  Gene Ontology: Mol. function=protein binding; Cellular component =spindle; Biological process=ubiquitin-dependent protein catabolic process
  Homolog annotation: Hit_ID=A7PBF4; Match level="QueryCoverage=83%, HitCoverage=40%, E-value=3e-56, Identity=60%"; Hit description =Chromosome chr16 scaffold_10, whole genome shotgun sequence
  Pfam annotation: Domain name=WD40; Domain location=178-216; Score =27.1; E_value=6.3e-05; Accession=PF00400.23; Description=WD domain, G-beta repeat
MGGDNNVSNPPAKERKTPAYHYRYRHCKTTIVRGLRLDRFIPNRSAMDFDYAHYMLTEGNKKGKEEKKNPLVMSPSREAYQKQLADAFNMNRTRILAFKSKPRTRRVELIPNSIFSPPPPPISSKHRRHIPQSSERVLDAPDILDDFYLNLLDWGNNNVLSIALGNTVYIWDASYSSTAELVTVDEEEGPVTSVAWAPDGCHVAIGLNNSHVLLWDSNVSRL

SEQ ID NO: 98671 - protein, 126 aa, Glycine max
  Coding DNA Sequence Number=SeqID_6986
  Gene Ontology: Mol. function=nutrient reservoir activity; Cellular component=extracellular region; Biological process=cell wall organization and biogenesis
  Homolog annotation: Hit_ID=Q9SC38; Match level="QueryCoverage=61%, HitCoverage=39%, E-value=1e-25, Identity=75%"; Hit description =Germin-like protein
  Pfam annotation: Domain name=Cupin_1; Domain location=5-115; Score= -4.2; E_value=0.0013; Accession=PF00190.13; Description=Cupin
MVPHQNHLRGRKTKVVYFLVAILALTSSVVSAYDPVLCKFVWQPKKKMVGDVFVFPIGLIHFQLNVGYDKAVAIPALSSQNAGTTTIANALFKANPPISPEVLTKAFQVDQKVIDELQKKSWCDTN

SEQ ID NO: 98672 - protein, 115 aa, Glycine max
  Coding DNA Sequence Number=SeqID_6987
MNGICRTHVESLTHALRDCDWVVEVWKKIDMECAYSSRIYESRSGFVIAIANCYLKPCWKIGGRVKLQIPLLDVQCSGILHQMDRVVKINCGGAVHLGNQKAFCGAVFRDSKDSF

SEQ ID NO: 98673 - protein, 312 aa, Glycine max
  Coding DNA Sequence Number=SeqID_6988
  Gene Ontology: Mol. function=monooxygenase activity; Biological process=electron transport
  Homolog annotation: Hit_ID=A7PF87; Match level="QueryCoverage=66%, HitCoverage=75%, E-value=4e-59, Identity=56%"; Hit description =Chromosome chr11 scaffold_13, whole genome shotgun sequence
  Subcellular localization annotation: CTP_CleavageSite=27; ConfidenceScore=5.07e-01
MSAAVCGSKRSFFEELPPSPPLSKRLRCSSSPIRFPPPSPVDQLRPLFPHMDDLFLLILSNLLPFFPFFVSFGSIPNCMSSNGSLLTVSPFMESGVNGALGTCEGQVLERALQECGNDIDAAIKRLNELCLGTADRNGIAEELEVVINLDAGNLEGDGNASVSEEQPALNNHLPADGAEWIDFFVREMMVATSVEDARARAARMLEVLEKSISERAKAEATDVLQKENLMLKEQIEALIKEKNSFKNAFRIQHERSADYEVKNQELQHLKQLVSQYQEQIKTLEVNNYALAMHLKQAQQSNPFPGRFPPDVF

SEQ ID NO: 98674 - protein, 73 aa, Glycine max
  Coding DNA Sequence Number=SeqID_6989
  Subcellular localization annotation: CTP_CleavageSite=49; ConfidenceScore=5.01e-01
MSIGFNDEICAISASRPRAKRGISALSTTGVFSQAQRTTGAKPKSTYPRAHHSAYFGERALEAARRAAFAEIP

SEQ ID NO: 98675 - protein, 94 aa, Glycine max
  Coding DNA Sequence Number=SeqID_6990
MSWCLMKGIGFGSILGMIDFLLREIKKLAQRLDLPEEYGVSNTFNITDLVPFACVVDLHDEGSAYLRINPHQDGGDDAILPRRGPITKAMARRL

SEQ ID NO: 98676 - protein, 219 aa, Glycine max
  Coding DNA Sequence Number=SeqID_6991
  Homolog annotation: Hit_ID=A5B6K0; Match level="QueryCoverage=95%, HitCoverage=27%, E-value=1e-15, Identity=27%"; Hit description =Putative uncharacterized protein
  Pfam annotation: Domain name=zf-C2HC_plant; Domain location=19-74; Score=48.5; E_value=2.4e-11; Accession=PF07567.3; Description =Protein of unknown function, DUF1544
MSLEGSSTGMFKPVDDKVDVFWKWNSLKDKNNRKSVTCDFCHKTSTGGISRAKRHQLQIKGDVDSCKKVPENVKLEMIANYEKKIVEIAVYMEATQEEDEEEEDGILEISRLKSGKRRPTTSNEASSTASKKRITNKKGPLDFLFSKEPEESIKLGKTMRQKSVNESYNKASRDRAVQYISRFFFRNGIAFNVAKSKSFKLMIEAIGNLWFSFKASKLS

SEQ ID NO: 98677 - protein, 112 aa, Glycine max
  Coding DNA Sequence Number=SeqID_6992
MVCNDQADMTGRLLARSFTFDCRIKHYIIVHILLPRSTNLAQASKEDLILLWALQTGRQIDWAHLFNTECIRHYGPMHLYHILTLLPSFFIISKFPWMMNHLSSLCLALVLV

SEQ ID NO: 98678 - protein, 273 aa, Glycine max
  Coding DNA Sequence Number=SeqID_6993
  Homolog annotation: Hit_ID=Q9AVH2; Match level="QueryCoverage=61%, HitCoverage=71%, E-value=1e-62, Identity=62%"; Hit description =Putative senescence-associated protein
RQNEREPTNGSLFWPNIVEEERDTGLIGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADI

SEQ ID NO: 98679 - protein, 137 aa, Glycine max
  Coding DNA Sequence Number=SeqID_6994
CTICSEAHESSHCIPIEEHTQEVHYMGNQQRQGYNQGGFSRFQQGPYNQQGQWRSHPSNQFNKDQALKNLEIQVGQLAKQLAEKSSSSFGANTEKNPKEECKVVIIRSRKLVVAEDEDVVALKEQVSLKDTTYKKEE

SEQ ID NO: 98680 - protein, 206 aa, Glycine max
  Coding DNA Sequence Number=SeqID_6995
  Homolog annotation: Hit_ID=Q6WAY6; Match level="QueryCoverage=57%, HitCoverage=20%, E-value=1e-10, Identity=30%"; Hit description =Putative uncharacterized protein
AIDAFLAYHHSKERPVVAILADLFDTFDRRVDWDQYLAGIGGRTINWFPRWKEGKEGVLFSCGDYPKIPLIGTRGCINYNLALAIRQLGYPMRGAPTEESLSPFLVRDFGAQSFKIVQRVHKAWERPLRKDKELRGIRNGIIGGYHEWLKVHTRGLDWLSKLKIINEENFEASEEDEDVRALKIELGKARLAKEKFKLVATDVRNY

SEQ ID NO: 98681 - protein, 103 aa, Glycine max
  Coding DNA Sequence Number=SeqID_6996
MPFRVCFMRSKPLVESLTTVAILLKEGRHPEERYGFLPPRGHPRISPELVLIGDSMWSWVRFPQRAEALPKRFRNVFREEFRKGFNRSSTFFIRSSSFFDLQR

SEQ ID NO: 98682 - protein, 127 aa, Glycine max
  Coding DNA Sequence Number=SeqID_6997
  Homolog annotation: Hit_ID=Q1RSH0; Match level="QueryCoverage=100%, HitCoverage=66%, E-value=8e-13, Identity=33%"; Hit description=H+ -transporting two-sector ATPase, alpha/beta subunit, central region, related
MGIFGENGWEWKFSWRRHLFDSELGEATAFIDQTSAISPVADLKDDWVWGAQPTGMFSTNSAYNCLRSEQPLHQPNSGFRQLWEIKIPPAALSFAWRLLWDRLPSKDNLISRQIVLQNDLCPFCQSQ

SEQ ID NO: 98683 - protein, 237 aa, Glycine max
  Coding DNA Sequence Number=SeqID_6998
  Subcellular localization annotation: CTP_CleavageSite=56; ConfidenceScore=5.39e-01
MAPHTLKTSNPHIFFISSPNRFKQSAKYFSSNPPQKPLIEIFRNFTKWHNRQRGARAHHPPPPLSATTTVLLVTLRHHPIHLFPHRALSLYFPLMSNVRVGFMTKKFPYYPELVRVSYNNLKIHEEVIFSEMNKITIVVDQSLFYSLTKLSSQGVPFEGTLVDDWKPIYYSLDAHKMVCVANADMSRCLLVGSFTFECRIMHYILCYVLLPHSTNLAQATEEDLILMWTLQTGRQIE

SEQ ID NO: 98684 - protein, 333 aa, Glycine max
  Coding DNA Sequence Number=SeqID_6999
  Homolog annotation: Hit_ID=Q6WAY6; Match level="QueryCoverage=58%, HitCoverage=39%, E-value=3e-19, Identity=30%"; Hit description =Putative uncharacterized protein
EILGCPLAGRKPYLFSGFLPSLSKIAVMVRDSARELDHKWVPFMDLLALLIFGVVLFPNVDGLVDLAAMDAFLAYHHSKESPVVAVLANLFDAFDRRCDKSSARIICCLPALCEVEQSAGFLDGREGVLFLCGEYPNIPLIGMRGCINYNPALAIRQLGYLMRGALTEESLSPFLVRDFGAQSFKIIQRVHKAWESPLRKDKELRGFRNGIIGGYHEWLKVRTQELDWLSKLKIINEENLKAPEEDEETSGKSVLSYDKKIQLPQEPLNKKPRGLARKSMAETNSVELCGTATVSSSFEGKRETKDGTTEHVQKGGTDLSKNTPKDVETWQLK

SEQ ID NO: 98685 - protein, 349 aa, Glycine max
  Coding DNA Sequence Number=SeqID_7000
  Homolog annotation: Hit_ID=Q6WAY4; Match level="QueryCoverage=36%, HitCoverage=23%, E-value=5e-10, Identity=33%"; Hit description =Putative uncharacterized protein
STLEDPLGKRFYQVKIKGLDVTSLKELGQLMGQLQRQAFRKTYDKIWDLAMIEVSTEAISSLDQYYDQLLRCFTFGDFQLSPMVEEFEEILGCPLGGRRPYLFSGFYPSLARISKIVQISAQELDHGKQVRNGVVGIPRKCLEEKARTLAGFPNVPLIGTRGCFSYNPVLAIRQLGYPMRGAPLEEELAPVISRGFNKTNGETLQKVVESPRARFGLAPLPSLRTAKREEVEALEEDEEVQALRAELEQAQIVKERFKSTALKIRKENAELRDTNIATTKALEQETKRARREEHGWNKFQGALWGSNSELKLRREERDQSRVHGMVLKEELAACSRSKKSLAQHLEAPE

SEQ ID NO: 98686 - protein, 98 aa, Glycine max
  Coding DNA Sequence Number=SeqID_7001
LTHKKQSPVESPTVATCPFAGERGEAHGCAFQRRKDAQSRHQRLFVENVGKTEGNRSKRIFQVLELYLRLRKVDKSGALAPTYPPSKRKSHLRSSFLR

SEQ ID NO: 98687 - protein, 147 aa, Glycine max
  Coding DNA Sequence Number=SeqID_7002
MAASDIAILRDRAHIPTKKSLLELTSQDALLAQNKLLSKQLEALTETLRCAICGGAHNSGYCIPNEEPAHEVNYMGNQPRQNFNAEEHGVCHKEFGSPSGTASKTADESRAEEKVEGYKQQLVAKPALEPVSDSIELEEVVEDEDDQ

SEQ ID NO: 98688 - protein, 42 aa, Glycine max
  Coding DNA Sequence Number=SeqID_7003
MDKSLKIGENEWREKERRSTKFYAPNEPTNPRSIPRFSTKCA

SEQ ID NO: 98689 - protein, 119 aa, Glycine max
  Coding DNA Sequence Number=SeqID_7004
  Homolog annotation: Hit_ID=Q94BM2; Match level="QueryCoverage=53%, HitCoverage=3%, E-value=2e-07, Identity=40%"; Hit description=Gag -pol polyprotein
MAGAGGDNGGVYHQLDGFQRLLLDAMTTQMQRLLKRNNEELYRRIEGLEHQMNPNAGRPYGGNRRVNDGSNRIEGQDRIEGVKLNVSSFKGRSDPNAYLTWEMKIQHAFSYNDYPEEQK

SEQ ID NO: 98690 - protein, 203 aa, Glycine max
  Coding DNA Sequence Number=SeqID_7005
MLRADKPISPIEFWFYRHYRAVHGVRIAIAFVLCFLHLAADHAGGGDGTDLHLGQCFAARGAAYQRYLCRADIRADRAEAGAAVTAAVAGVVLYRDDRLRLSDAGANTRIWPLLIGITLVRGGRRATAISPWRCGAGGDVILGSLIGGCCSAPSWAQRAILTGAFSCRTPLSTWRRFITLAFLPIWWRSQERLNPRFEAVSPA

SEQ ID NO: 98691 - protein, 144 aa, Glycine max
  Coding DNA Sequence Number=SeqID_7006
MTLTIPELFLRPYQVTWDATVFGVFHPDFTLYIKHEDLFEIAHGGQCLSISVLQLWILHLTETSMRARNSDIYGFLKPQSIHRSGQSQFEAESLDNAPQPKSKAAARWIVVKCNRQKGSTDCGYYVMHWISTIILGSFTNNWEA

SEQ ID NO: 98692 - protein, 39 aa, Glycine max
  Coding DNA Sequence Number=SeqID_7007
KNLHGFAHGNVSQALRQHLGLDFHHGNTFFHPKQLKCAK

SEQ ID NO: 98693 - protein, 91 aa, Glycine max
  Coding DNA Sequence Number=SeqID_7008
MTNTNCLQESLHSVSNGNLRPRIFFINGFLCFLEDEWQRNDERKRERRHHFKEKMSLEEAHHHRRPWIRAWRKKERKRRARNFVLYMSFEI

SEQ ID NO: 98694 - protein, 35 aa, Glycine max
  Coding DNA Sequence Number=SeqID_7009
MATIELSSRYGSKSAWDTGIGVVFVIGSAVDRLCG

SEQ ID NO: 98695 - protein, 73 aa, Glycine max
  Coding DNA Sequence Number=SeqID_7010
MHVHLVILGDEDMTKNKGKDPLKGLGGPMTRARARKEKEALQQVLSILFEYKCKFQGEKSKVVSCIMAQMEED

SEQ ID NO: 98696 - protein, 350 aa, Glycine max
  Coding DNA Sequence Number=SeqID_7011
  Gene Ontology: Mol. function=metal ion binding; Cellular component =cytoplasm; Biological process=cell redox homeostasis
  Homolog annotation: Hit_ID=O22197; Match level="QueryCoverage=84%, HitCoverage=95%, E-value=7e-85, Identity=54%"; Hit description =Expressed protein
  Pfam annotation: Domain name=zf-C3HC4; Domain location=227-267; Score= 44.5; E_value=3.9e-10; Accession=PF00097.16; Description=Zinc finger, C3HC4 type (RING finger)
  Pfam annotation: Domain name=zf-MIZ; Domain location=223-270; Score= -12.0; E_value=0.049; Accession=PF02891.11; Description=MIZ zinc finger
  Pfam module annotation: Pfam domain module=zf-C3HC4::zf-MIZ; Domain location=227-267::223-270
  Subcellular localization annotation: CTP_CleavageSite=25; ConfidenceScore=5.46e-01
MKHAVPAKLYVGSSSIIVFPCPMPSSSATRPFLHIFQCAVLRFGEMGLEEASRNWRPVWLGRRDAVCPSCNEGFVHELNDMVHVNPFDLFEMDNNEERDQRLGLMETFSAFMRHQMADRGRSHDIRAQTDSNPEHSAGFAPLLIFGGQIPFRLSGHGGFEALFNGAPGIGLTRGNTGDYFIGPGLEELFEQLSANNRQGPPPASRSSIDAMPTIKITQRHLRSDSHCPVCKDKFEVGSEARQMPCNHLYHSDCIVPWLVQHNSCPVCRQELLPQGLSSSNRSTNGRSRSASLSSSGRESHGRRNPFSFLWPFRSSHSSSNDEATGSSSPTPTIPENSHHHHAGYSGWPFE

SEQ ID NO: 98697 - protein, 131 aa, Glycine max
  Coding DNA Sequence Number=SeqID_7012
MKRPWEFIRDRWKEYSRRKEEINIGWEPPTVGWICLNTDGATKFHYDVSGYGVKAIKGNRIRSTGGWRLVQAIQRILVANPNFSVMSIFHEGNRCADTLADYVCTIERVILKMQQQPSFLRQQLRRDNLGV

SEQ ID NO: 98698 - protein, 515 aa, Glycine max
  Coding DNA Sequence Number=SeqID_7013
  Homolog annotation: Hit_ID=Q2HUT4; Match level="QueryCoverage=67%, HitCoverage=59%, E-value=5e-87, Identity=55%"; Hit description =Putative RING zinc finger protein-related
MGKPGEDHLSLPSAEDPRRNAAAASGCAVGLRCLVVLLFSVAVFLSALFWLPPFAHFADPKDLYLNSKYKENNIVRENVEYIGKGIQTNPEFGWEVGYLFQFGIGTMVHYYFPVSFDIVECDHDIVASFYVQKPVSLLEDNILQLSNDIFEEIGAPSTKVIILSLDPLPRSNTTKVVFAVDPDGKYSEMSAAAISLIRASFKYLVIRQSYLQLTTFLFGVPSVFEVLKFKGGITIIPQQSVFPLQTVQTLFNFTLNFSIYEIQSNFDELTSQLKSGLHLAPYENLYVILSNSEGSTVVAPTVVQSSVLLAVGIPPSKERLKQLAQTIMGHHSWNLGLNNTQFGRAKQVRLSSILQHSLHGSGGSGSPSPSPLPYPHHHYHHHHHHQSHHHNTHVFPETSPAPTPTTGEGATLHNFGAPAPARSVPAPGRSSYAQPPNCRFAHVTPAAPPTTAPHYPVASPWVGPPAHGFDSSVPALSPLPNVAFAHAEPPPKNEAAAEHLNSHFHGPSPSSCKYF

SEQ ID NO: 98699 - protein, 107 aa, Glycine max
  Coding DNA Sequence Number=SeqID_7014
MGCPHPGTTRPFKQRVIHLTGGGLFAQDKRPLGHRWHEHRRIHKALFDPSECHLIVVVPPDGLILAQKLKETLIMAHFKDGLHLVGIHLYPFLAYDEAEQFSRLDPE

SEQ ID NO: 98700 - protein, 51 aa, Glycine max
  Coding DNA Sequence Number=SeqID_7015
MFPHGKMPRKWIFRPYCVEGKSPEFQKPLDLRSNPFQRGGNDAILPPNGIG

SEQ ID NO: 98701 - protein, 77 aa, Glycine max
  Coding DNA Sequence Number=SeqID_7016
MTNRLRYLLFPLTKIQRTNRLRILCPNTLEGTSTWVFILRTREENKGGYIPCGSLACKGFYKVERNLKNHWLLGDWM

SEQ ID NO: 98702 - protein, 166 aa, Glycine max
  Coding DNA Sequence Number=SeqID_7017
MNILTAHDQGWEQDLSPYNQYKEERTPNLESVFEEFRAYHASSKANQNSMKNHEIHFGKSYSIENYQGRPELQPYYQNEAERGSNLDKLLMQFKEKTKSTQQALQSVEIQVGELAEAVTQYMSRQEKYFVEVEAQEESPVKEHESREKDEEQAQQQGVKYSTVENQ

SEQ ID NO: 98703 - protein, 124 aa, Glycine max
  Coding DNA Sequence Number=SeqID_7018
  Homolog annotation: Hit_ID=Q6WAY6; Match level="QueryCoverage=69%, HitCoverage=15%, E-value=3e-10, Identity=40%"; Hit description =Putative uncharacterized protein
MGTRGCISYNPVLTIRQLGYPMRGAPLEEELAPIIARGFNKTNMEALQKVRKAWEMVQKKDTKLRGNNNGPIGSYRRWLKARMQSLDWLPSLRTTKGVEVEAREEDEEVQAHRAEFEQAQSVKE

SEQ ID NO: 98704 - protein, 101 aa, Glycine max
  Coding DNA Sequence Number=SeqID_7019
MVSLTRHEESIKHDFGTWYILCGTSRRYIYLGCNTENKRGYISCGSVQVEGTSTWLFKESKGGYIPCGSLLVKDFTRLLEISRTGGCLGTGCRARVMAEPV

SEQ ID NO: 98705 - protein, 147 aa, Glycine max
  Coding DNA Sequence Number=SeqID_7020
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=2e-12, Identity=30%"; Hit description= UPI00006A17C9 related cluster
  Subcellular localization annotation: CTP_CleavageSite=35; ConfidenceScore=5.55e-01
ARACSPLKARACSPLKVRACSPLKVKACSILKVRTCSLLKSRMCSPLKARTYSPLKVRACSPLMARTCSPLKVKSCSPLMARHARTCRPLKVRVRGTLMARMCGPLKVWVCDPLMATTCSPLKASACRPLKVRVCDPLMARMCSSLK

SEQ ID NO: 98706 - protein, 94 aa, Glycine max
  Coding DNA Sequence Number=SeqID_7021
MTEARQNGVQKANENENKNTQNKWGPPRREREKCLRGLTLFIFTSPSIYSKIGEKLAAQLAQASKVASSRSNSLLEESSGGPKSAWLLFAPPVY

SEQ ID NO: 98707 - protein, 161 aa, Glycine max
  Coding DNA Sequence Number=SeqID_7022
METLQMVRKAWEIVREKDKELRGGNNGPICGFRKWLRAHVQGLDWLPSMRTTKREEVEAPEEDEEVQALRTELEQAQTVKERFKSAALKIRKENAELRDINTATTKALEQETKRAHREEHGRNKFRRALWGSNNELKLRREERDQSRVDNFILKDELKACS

SEQ ID NO: 98708 - protein, 209 aa, Glycine max
  Coding DNA Sequence Number=SeqID_7023
  Subcellular localization annotation: CTP_CleavageSite=41; ConfidenceScore=5.65e-01
MAEPSKKRKGSSSTATAAAHRRHGPSGAPTTPIPPSLSSPRSSTLFSSDDQRLRYLSQFSSRIILDPKYLDVEFFNDETFDCYQVFQNSGLVDFMSFKLPYYPELVKVFYCNLKIQDGIIMSEVHGTSMVIDQSLFFSLTHLPSQGAPFEGTIVDDWKFDYSSHDARRMVCNDQADMTGRLLAGSTGPIWFGTECIRHYGPMHLFLIHI

SEQ ID NO: 98709 - protein, 96 aa, Glycine max
  Coding DNA Sequence Number=SeqID_7024
IAHRDRPRGMLRRPQMCRHLIRLAQLDHLIRSSIYGIWFASRRPTTGRMAEVAWLGDWPEARAGEAPAEAPNKADEAREDEEMTDLLDFLGGSGAT

SEQ ID NO: 98710 - protein, 284 aa, Glycine max
  Coding DNA Sequence Number=SeqID_7025
  Gene Ontology: Mol. function=O-sialoglycoprotein endopeptidase activity; Cellular component=outer membrane; Biological process =proteolysis
  Homolog annotation: Hit_ID=A8GFH2; Match level="QueryCoverage=53%, HitCoverage=77%, E-value=7e-70, Identity=86%"; Hit description=Outer membrane lipoprotein, Slp family precursor
  Pfam annotation: Domain name=Peptidase_M22; Domain location=1-178; Score=-2.7; E_value=3.9e-06; Accession=PF00814.16; Description =Glycoprotease family
  Pfam annotation: Domain name=Slp; Domain location=155-284; Score =160.7; E_value=3.9e-45; Accession=PF03843.4; Description=Outer membrane lipoprotein Slp family
  Pfam module annotation: Pfam domain module=Peptidase_M22::Slp; Domain location=1-178::155-284
FTGVRIGIGIAQGLALGADLPMLGISTLQTMAQGAWRVCGAERVLAAIDARMGEVYWGQFERQADGSWLESESEAVLSPAQALEHAVAAGARHAAAGVARLATGAGGGGRAMKACNLNDETRSKLQPFQEIATMLIRTASKKLSLLAVACGALVLSGCVTVPDAIKGSTPSPVTQLSSVQNAPNLFTGAEARFGGTVVNVANEQGRTVLEIAAVPLDSGARPILGEPSRGRLLATVNGFLEPVDFKGQLVTVVGPITGLKEGRIGMTPYRFVTMNVTGFKRWHL

SEQ ID NO: 98711 - protein, 66 aa, Glycine max
  Coding DNA Sequence Number=SeqID_7026
MTDLVSAEDDVNLHVSTGLSAAIDEGRRITIICLCVPLDTTMSEWQKGVRNDHNLSPHVIGPAASG

SEQ ID NO: 98712 - protein, 138 aa, Glycine max
  Coding DNA Sequence Number=SeqID_7027
  Gene Ontology: Biological process=transposition, DNA-mediated
  Homolog annotation: Hit_ID=Q1J7G7; Match level="QueryCoverage=21%, HitCoverage=42%, E-value=2e-10, Identity=100%"; Hit description =Transposase
MPLGYINGGISIGTSYVPINVSFSPKVGPGLSRYQQGHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTL

SEQ ID NO: 98713 - protein, 31 aa, Glycine max
  Coding DNA Sequence Number=SeqID_7028
MTGRQREEGIDGVKVKIPTFKGTRDPKVYLE

SEQ ID NO: 98714 - protein, 54 aa, Glycine max
  Coding DNA Sequence Number=SeqID_7029
MDKSLKVEEDERREKERRSTKLCASKELWFSLLIQDQVQDSPLSVLRCHETCKA

SEQ ID NO: 98715 - protein, 211 aa, Glycine max
  Coding DNA Sequence Number=SeqID_7030
  Homolog annotation: Hit_ID=A5B2I6; Match level="QueryCoverage=38%, HitCoverage=3%, E-value=2e-07, Identity=36%"; Hit description =Putative uncharacterized protein
FKNVVIQWFQPSMNQSPYELLLSLKHEGTVEEYREKFELYAGPLRGTKPEYLKGIFLNGLKEVVRAELKLHPVNTLPELMDYAQRIEEKNSLIEKGNVGGNRGGLTRSYSSTRTVTWDPRNKGTTTKTRETSSSSESNSVKSTGAYRGQDEEDEKEGAINEKQLQSIQLCPYIAYCGASHNFISAAIVKQQQIPITPTKPYTVEVGDGRKI

SEQ ID NO: 98716 - protein, 246 aa, Glycine max
  Coding DNA Sequence Number=SeqID_7031
MADEQQRASFAELAQEAHALLHEDGIAHGQRFVDDQDVRIDVRDDRERQSHVHAAGVGLHRPVDEIADVGEGDDVVEAGVDLLAGQAEDRGAQVDVLAPAEFRVEPRAELQQGRHAPLDLDRSRGGLQGAADDLQQRRLARPVAADDADRVAAPHFEIDALQRPELVVVAARRKARGTKQARQHGLLQPLVRLVIDLEALGDAADPDGDIAGGIRGHRQTPGAFSGTSRNRTTRQARRLLRTCPTL

SEQ ID NO: 98717 - protein, 135 aa, Glycine max
  Coding DNA Sequence Number=SeqID_7032
MAPRKLASKRSKKDKAAEGTSSAPEYDSHRFRSTVHQQRFEAIKGWASTVDITVTPMAKFDPEIVLEFYANAWPTEEGVRDMRSWVRGQWIPFDADAIGQLLGYPLVLEEGQECEYGQRRNRSDGFDEEAIAQLL

SEQ ID NO: 98718 - protein, 183 aa, Glycine max
  Coding DNA Sequence Number=SeqID_7033
LQKGNWEIVETSGNRLPVCVIDYTEEWVTGNRLPESTPFLSFLWIVMAAQLIHDRVETECLEGAWETLEGNARCRFWGTIRFTATSLVHPDEPAAHASAYCGVDTTHAYTIPSSGASPSDRDPEEDPEELPPEPAVDALDFLEGDEDPLPEVDSPEEVMSASEADSTEDSGPREMATSGGSSS

SEQ ID NO: 98719 - protein, 256 aa, Glycine max
  Coding DNA Sequence Number=SeqID_7034
RTTCPRLERTTRPHLRRATALTLRGLHVLANRGLHALALGTSTPRIRELHVLTFRGLHALAIRGLHILTLRGLHALAIRGLHVLTLRGYTPSPWRTTRPRQQRAARPHLQRTTRPRLEKGLHVLANRGLHALTLRGLHVLANRGLQALTLKRTTRPRQQRSSHPHLRGATRPALCLTEDLHSPWASSFLLTVPSHALDIEATGDTTKEGGCQTAIMHILTFVGLHALTFGGLHVLANRGLHALTFRGLHVLAFKGS

SEQ ID NO: 98720 - protein, 283 aa, Glycine max
  Coding DNA Sequence Number=SeqID_7035
  Homolog annotation: Hit_ID=UPI00016621D1; Match level="QueryCoverage =91%, HitCoverage=39%, E-value=4e-17, Identity=31%"; Hit description =UPI00016621D1 related cluster
GPHALAFKGLHALAFRGLYVFAFRGLYTLTFRELHILAFRGLNVLVFRGLHVLAFRGLHVLTFRGLQVLTFGGQNALTFRGLHVLTFRELHALAFRGLHALAFRGLHTLTFRGLDALAFRGLHGFTCRGLHALTFRGLHVLTFRGLHALAVRELHILTFRGLHALAFRGLRVLGLRGLHALAFKGLLVLAFRGPHALAFRGLHVLTFKGLQVLAIRGLHVLTFRGLHALAFRGLHFLTFKGLHALAFRGLHTLAFRELHAFTFKGLHVLTFGGLLFLTFRGLH

SEQ ID NO: 98721 - protein, 135 aa, Glycine max
  Coding DNA Sequence Number=SeqID_7036
MEVGSYWKLEVGNESYWKLKVENGGWKLEGEVVVIIKKGENVNHEDFDDIKKSLLEKGGNVNHASFDGVEKKSSFVVAPNLQVVVIIKKGENVNHEDFDDIKKSLLEKGGNVNHASFDGVEKKSHVCHHQKGGEC

SEQ ID NO: 98722 - protein, 66 aa, Glycine max
  Coding DNA Sequence Number=SeqID_7037
MMTKVMNKKLKRSKNNSSESRTSQEFKNQEEFKTQEESLQSRIKIQDSRSQESRSRFKNEEKTQSR

SEQ ID NO: 98723 - protein, 177 aa, Glycine max
  Coding DNA Sequence Number=SeqID_7038
  Gene Ontology: Mol. function=RNA-directed DNA polymerase activity; Biological process=regulation of transcription, DNA-dependent
  Homolog annotation: Hit_ID=A7R018; Match level="QueryCoverage=97%, HitCoverage=23%, E-value=2e-32, Identity=38%"; Hit description =Chromosome undetermined scaffold_295, whole genome shotgun sequence
  Pfam annotation: Domain name=MP; Domain location=4-137; Score=-30.3; E_value=0.012; Accession=PF01107.9; Description=Viral movement protein (MP)
MDDWSIPEIPQDTLYVPETIKDKNNVAIKPLIYMCIDVAVLMCLRDIRHNKFEDSLIGTVETSLAQGPIYFNCYPNKTMSLMDRNILDSMFLNIHFHGLDMKEGSIPAALIYRIPYKVMNTCASRVLLKPRRGETTLFITDMTKANVSLPRTIKWDEITLPEKWVMDKATPSVPDPL

SEQ ID NO: 98724 - protein, 102 aa, Glycine max
  Coding DNA Sequence Number=SeqID_7039
MMGDASFTYISPKNSGHVTYGDIDNGIILGVRKLVKMMILGDACQKGKQVYIFMVKSTKAKEREMMQTFKLMKQKQVQIFQENEELQDTILLITSSVTYLKG

SEQ ID NO: 98725 - protein, 118 aa, Glycine max
  Coding DNA Sequence Number=SeqID_7040
  Homolog annotation: Hit_ID=A5AM73; Match level="QueryCoverage=86%, HitCoverage=10%, E-value=2e-08, Identity=34%"; Hit description =Putative uncharacterized protein
MPPDTPKTTEARQKWKLLENELASSVQGNLTIVEYFLKIKNLSTKLSELDLSEKISEARWTNQPSLEELQNFLTNQEAFLQQSLSSPAQETGFVLLFKGKTHSQDNEEAELKRKSVKC

SEQ ID NO: 98726 - protein, 71 aa, Glycine max
  Coding DNA Sequence Number=SeqID_7041
MSSKVILMMPKNQELSKVSSKDSRIKFQDSRFKIEESRFKNNQDQDSRLKIQESREDSIKISIKKVFQNIE

SEQ ID NO: 98727 - protein, 85 aa, Glycine max
  Coding DNA Sequence Number=SeqID_7042
  Gene Ontology: Mol. function=protein dimerization activity
  Homolog annotation: Hit_ID=Q2HTW7; Match level="QueryCoverage=57%, HitCoverage=14%, E-value=1e-13, Identity=73%"; Hit description=HAT dimerisation, putative
LHELNARFDEENTELLQCVSCLSPSSSFKAFDVKNLLRMVELYPNDFVDVPEVVVRHQLQNHASEVDFSLVGSNYKRGMCFFSYE

SEQ ID NO: 98728 - protein, 282 aa, Glycine max
  Coding DNA Sequence Number=SeqID_7043
  Gene Ontology: Mol. function=transcription factor activity; Cellular component=cytoplasm; Biological process=regulation of transcription, DNA-dependent
  Homolog annotation: Hit_ID=A8GG55; Match level="QueryCoverage=52%, HitCoverage=47%, E-value=6e-61, Identity=81%"; Hit description =Transcriptional regulator, LysR family
  Pfam annotation: Domain name=HTH_1; Domain location=8-67; Score=84.1; E_value=4.5e-22; Accession=PF00126.18; Description=Bacterial regulatory helix-turn-helix protein, lysR family
  Subcellular localization annotation: CTP_CleavageSite=55; ConfidenceScore=5.13e-01
MNLANVDLNLLVVFEALYQTRNVTAAGRRLNRAQPSVSNALARLRTLLNDPLFVRSGGGMAPTPRAHQLMPQIQQVLEQIHLALAPPARFDPATAGQRRFTLAAGDYADILLLPAIISRLRQTAPGIDIRVSRLDRHNIYRQLDRGEVDIALGGHLSGAESHYPFTPTVGGWPLGSGTLPQPAAWAVRTGRRRLCQGIGRPAPGGNRRSTARRRNLFTYCRSAGCGRRQRSDRHPGRQRGPAFFRSATRTHSPAARRVGIAPFPIELIAGSWRNATGVNLAL

SEQ ID NO: 98729 - protein, 519 aa, Glycine max
  Coding DNA Sequence Number=SeqID_7044
  Gene Ontology: Mol. function=motor activity; Cellular component=cell projection
  Homolog annotation: Hit_ID=P15305; Match level="QueryCoverage=99%, HitCoverage=99%, E-value=1e-27, Identity=21%"; Hit description =Dynein heavy chain
GQHALSFRGLHVLAIRWLHVLPFTGLHVLAFRGLHALSFRGLHVHAIRGLRVLTFRGLHVLAFRGPHALAFRGLHVLAIRGLHVLSFRWLHALTFRGLHVLSFRGPHVLAIVGLHVLAFNGLHVLAFSGLHVLAFRGVHALSFRGLHVLAFRGLHVLAFKGLHVLAMRGLHVLAFIGLHILTFRELHIPPIRGLHTLPSEDYASSLSEDYTSSPSEGYTSSPSKDYTSSPLEKYTSYPSEDYTSSASEGYTPSPSEDYTSSPSEDYMCYPFSGLHVLTITGLHTLTFGGLHAITFRGLHVLANKGLHALTLRGLHVLSFRGLHIAAFIGLYVLAIRGLHLLAFIGLHALTIRGLHILTFRGLHVLAFRGLHTLEFRGLHVLAFSGVHVLPFQGLHILAFRGLHALTSRGLHVLAIRGLHVLPFRVLHVLLFRGLHALAFRGLHVLPFRGLHVLTFRGLHVLAFRGLHAHKGLHVLAFKGLHLLAIRGLHILTFRGRRVLACRGLHALNFRGLNVLSFRG

SEQ ID NO: 98730 - protein, 81 aa, Glycine max
  Coding DNA Sequence Number=SeqID_7045
MGAKYLEVFKRGSHPNNGWSPDEIRAYENPRAFFSSSGPIYLESSIQCPWGVGLHHPLPLEMDLTSNLEVLETLGFFPRHL

SEQ ID NO: 98731 - protein, 138 aa, Glycine max
  Coding DNA Sequence Number=SeqID_7046
MSRGSGDLGDVRLRNEGSRLWRPLVIDYTEEWVTGNRLPDEPARTLQRTVEWILPTPTPYRLVEPVHVIEVTSSEEDPEEDPEELPPEPAVDALDFLEGDEDPLPEVDSPEDVMLASEADSMEDSGSGEMAISGGSSS

SEQ ID NO: 98732 - protein, 177 aa, Glycine max
  Coding DNA Sequence Number=SeqID_7047
  Homolog annotation: Hit_ID=A5BTM1; Match level="QueryCoverage=64%, HitCoverage=4%, E-value=4e-12, Identity=35%"; Hit description =Putative uncharacterized protein
MTRGNPSDLQPFDPEIDRTFHRLVRHHFIPFDHSEHSITGESVHSVIGDFEHPDLEHYNFEHSDSEHSDFAHSENMAQPPPRERTLREMAAPDFTYESLCIQYPDEDVPYVLKTGLIHLLPKFHGLAGEDPHKHLKEFHIVCSTMKPPDVQEDHIFLKAFPHSLEGVAKDWLYYLAP

SEQ ID NO: 98733 - protein, 42 aa, Glycine max
  Coding DNA Sequence Number=SeqID_7048
MWVTVFCKNAPTIWDQHRLKGTLKPGDPQGPHSEESVRASPS

SEQ ID NO: 98734 - protein, 84 aa, Glycine max
  Coding DNA Sequence Number=SeqID_7049
  Homolog annotation: Hit_ID=A4EB57; Match level="QueryCoverage=65%, HitCoverage=34%, E-value=4e-16, Identity=70%"; Hit description =Putative uncharacterized protein
MPRILLKREGSLRERGHRWCMAVVSSCLWNPEQTAGDKPEEGEDDVKSSCPLCPGRHTCYNGRDKGSRSREGELTPKTRPQFGL

SEQ ID NO: 98735 - protein, 98 aa, Glycine max
  Coding DNA Sequence Number=SeqID_7050
MSGRRNVPSRFWVDRVWPGRISQCFTNAGMVSKEEVVAVGEEFPQDPTNFVQPCHPDSQVGNWRVISQSEVYAADSIYKGRFFEDPNNKGLTIDFDQD

SEQ ID NO: 98736 - protein, 106 aa, Glycine max
  Coding DNA Sequence Number=SeqID_7051
MEVGEFATFMALGLHFVVLQRRVKLTLIVLPFTKPLNFYFQHRKRMVGGEKAIFHAQNSSIHQLDNNDFGGNSIPESYGNISKLSKLLHAVLVYRSFNWRKTFAGD

SEQ ID NO: 98737 - protein, 25 aa, Glycine max
  Coding DNA Sequence Number=SeqID_7052
MMTGTGGSKYGQSVTLSLTATVRLT

SEQ ID NO: 98738 - protein, 59 aa, Glycine max
  Coding DNA Sequence Number=SeqID_7053
  Subcellular localization annotation: CTP_CleavageSite=21; ConfidenceScore=5.38e-01
MASIIVAICSFMASMSAFIFSCTSSASPITLALARVRNGFMIPTWLAHGTLTHATKNAS

SEQ ID NO: 98739 - protein, 31 aa, Glycine max
  Coding DNA Sequence Number=SeqID_7054
MEHKLEKVYCKCLQHKLRAAQLLQVAAWKGK

SEQ ID NO: 98740 - protein, 205 aa, Glycine max
  Coding DNA Sequence Number=SeqID_7055
MASNSQQFSARNDAIAIRGVHEVATNSAASSETKKLEGKLDALVNLVTQLALNQKSVPVARQPGAIEQPEAYAANIYNRPPQPQQQNQPQQNNYDLSSNRYNPGWRNHPNLRWSSPQQQQQQPAPSFQNAAGPSRPYIPPPIQQQQQPQKQPTVKAPPQPSLEELVRQMTMQNMHGINDMLAVEDPMKMAHTMRKEQTNEVTRLY

SEQ ID NO: 98741 - protein, 92 aa, Glycine max
  Coding DNA Sequence Number=SeqID_7056
MDTSLVISPKGSQNPRSTLGESYRLILQRLVKPKVHPWLVKPKVCPWQLSPKPRIDNSLVDSPNGSQNPRSSLSESYKSILQMLVKSNVCPW

SEQ ID NO: 98742 - protein, 188 aa, Glycine max
  Coding DNA Sequence Number=SeqID_7057
  Homolog annotation: Hit_ID=A5ASH8; Match level="QueryCoverage=31%, HitCoverage=9%, E-value=5e-10, Identity=54%"; Hit description =Putative uncharacterized protein
MCNPQKGFPHENWHRKRIQPDPDAFFGQGKTTFITKDANFCYKHILTHGRPGKCTFEVDEGKFLGFMITHRGIEANLGKHTAILEIHSPTKSSQFRGGNGSNGIRRGEGEDREVRWQRFQLLEDANRGLSILEEVVSALIRAKNVAFNIINEKTAVGLMKALLDMYEKPLATNKVYLMRRLFNLKMGE

SEQ ID NO: 98743 - protein, 65 aa, Glycine max
  Coding DNA Sequence Number=SeqID_7058
MVISHHGDAAEDKEEEESDWAAQCTRQDKMSNEELKLQDPRCRIQCPGHPARKYWTHKSVISLTD

SEQ ID NO: 98744 - protein, 143 aa, Glycine max
  Coding DNA Sequence Number=SeqID_7059
SAEHQQRFEAIKGRLFLRERRVQLRDNEYTDFQEEIVRQRWASLVTPMAKFDPDIVLEFYANAWPTEEGMQDMRSWVRGQWIPFDANALSQFLGYPLVLEEGQKCEYGQRRNQADEFDEKVIAQLLCIPGQDFARCNIPIFVN

SEQ ID NO: 98745 - protein, 85 aa, Glycine max
  Coding DNA Sequence Number=SeqID_7060
MLILHIEVAWKTPCNSGMHRKWPRGNLPQRDPGRIKRPKELVPLPSMIVTALGALNTSSASRPSRDGHFSGSDASSLGTTECGIL

SEQ ID NO: 98746 - protein, 193 aa, Glycine max
  Coding DNA Sequence Number=SeqID_7061
  Gene Ontology: Mol. function=nucleotidyltransferase activity; Cellular component=membrane; Biological process=lipopolysaccharide biosynthetic process
  Homolog annotation: Hit_ID=A6F742; Match level="QueryCoverage=91%, HitCoverage=81%, E-value=8e-40, Identity=47%"; Hit description =Probable acylneuraminate cytidylyltransferase
  Pfam annotation: Domain name=CTP_transf_3; Domain location=4-178; Score=-45.8; E_value=0.0067; Accession=PF02348.10; Description =Cytidylyltransferase
MSNLAIIPARGGSKDCEDIAAVAREYGAEVPFMRPAHLANDTAATEPALLHTLEWLAEHESYHPEYTVLLQATSPVRKDDAIDSAIRKILEKKADSLLSVCEFWHFLWENEDNPKAYYDYLNRPRRQDIKPENIKLKENGSIYVTKSEILLSTGNRLGGKVVAHKMSEEESFEIDTMLDWAVVEVILKNWSGR

SEQ ID NO: 98747 - protein, 106 aa, Glycine max
  Coding DNA Sequence Number=SeqID_7062
  Subcellular localization annotation: CTP_CleavageSite=50; ConfidenceScore=5.18e-01
MQNYQHAKRCDSAKARINQKRIMQQKRHAYAQSSSQPTVNCTSEYNMIVSDSSKSENSESTQGSCSNFMTPFKDCQSPTNQPIINTEGNDYNSDFQFQMLLYMLLN

SEQ ID NO: 98748 - protein, 59 aa, Glycine max
  Coding DNA Sequence Number=SeqID_7063
MEKDASHIRPWNGGFNPFFFSLTFEKPNRATGGGALESTKNATIDNGERLSDYIELMSQ

SEQ ID NO: 98749 - protein, 90 aa, Glycine max
  Coding DNA Sequence Number=SeqID_7064
  Subcellular localization annotation: CTP_CleavageSite=56; ConfidenceScore=5.47e-01
VDSRGSPGRVALSRRGCVVLFKVRACSPLLARTCSPLKVRACSPLLERTCSPLKVRACSPTKVRTCSPLMARACSPLKVRTCSPLMDEGV

SEQ ID NO: 98750 - protein, 176 aa, Glycine max
  Coding DNA Sequence Number=SeqID_7065
RRSRLFRFFRRFPQINVGGDSARIPFVEHASRESRVALPPKGRLRQLPYERGATRKELAPVISRGFNKTNMETLRKVHKAWEAVQKKDKELRGSNNGPIDGYYKWLKAHVQGLDWLPSLRTAKGEEVEAPEEDEEVQTLRAELEQAQTVKERARREELGRNKFRGALWGSNNELKL

SEQ ID NO: 98751 - protein, 356 aa, Glycine max
  Coding DNA Sequence Number=SeqID_7066
  Homolog annotation: Hit_ID=UPI00006A2D9E; Match level="QueryCoverage =34%, HitCoverage=79%, E-value=1e-08, Identity=18%"; Hit description =UPI00006A2D9E related cluster
GYTPSPWVLVTLTVERTTRRHLERTTRPHHQRAAHPHLQRTTCPRLERATRPHLGELHVLTFVGLHALTFRGLHVLANRGLHTLTLRGLHVLANRGLHALTLRGLHVLANRGLHALTLRGLHVLTNRGLHALTLRGIHVLAIRGLHALTSRGLHVLANRGLHALTFRGLRVLIFSVLHIRTLKNLRSSILKFLTETCTPGWASSFLLHVPGPPPDIGGGPTVRAQSEREAITQLLCIPGQDFTRAAAKRQQRSAQRPQCRSPPADVSVGLCHPDIGIVPARHPVDPEKSNRVLGFPALITDFCQFYEVSVTPDKVIRSPINQAFIKKYCAPRQAQGETPQQPEMAGSGQQTHRHHL

SEQ ID NO: 98752 - protein, 185 aa, Glycine max
  Coding DNA Sequence Number=SeqID_7067
  Subcellular localization annotation: CTP_CleavageSite=17; ConfidenceScore=5.19e-01
MAESSKKRRGSSSTTVVAGHRRHGPSEAPTAPIHPSLSSPRSSTLFSSYDQCLRYLSQFSSRIILDPKYLDIDFFNDETFDCYQVFQNSGLIDFMSLKLPYYPELVKVFYNNLKIQDGIISSEVHGISMIIDQSLFFSLTKLPSQGAPFEGTIVDDWKFDYSSHDARRMVRNDQAEIPVDCWPDH

SEQ ID NO: 98753 - protein, 106 aa, Glycine max
  Coding DNA Sequence Number=SeqID_7068
MVKVGTSYVPINVSFCQKLAQLFPVQLLTGIVIRVTIGTKHTAGHQRGKCKPGASELTHHTAVNCCRYRLPAFQFEPCRCATVEEGRSSAGFRVLRQAKGRSVQRR

SEQ ID NO: 98754 - protein, 71 aa, Glycine max
  Coding DNA Sequence Number=SeqID_7069
MIMRTATDRLSQAALRRHHIGVKTKGLRFRGELYVFRYNAGHYDVFRNSEWVMSLATSNVLEAMQQFKQSQ

SEQ ID NO: 98755 - protein, 117 aa, Glycine max
  Coding DNA Sequence Number=SeqID_7070
MAVQLIHDRVVMECLEGVWETLEGNERCRFRGTIRLTVTSLVESVQVIEVSSSKEDPEEDPEELPPEPAEDALDLPKDDEDPLLDVDFPEDIMSASEADSTEESGPGGTANSEDSSS

SEQ ID NO: 98756 - protein, 20 aa, Glycine max
  Coding DNA Sequence Number=SeqID_7071
GVLFYSGYKFFTRGKGKNEE

SEQ ID NO: 98757 - protein, 245 aa, Glycine max
  Coding DNA Sequence Number=SeqID_7072
  Gene Ontology: Mol. function=protein tyrosine phosphatase activity; Cellular component=excinuclease repair complex; Biological process =protein amino acid dephosphorylation
  Homolog annotation: Hit_ID=Q7W8V5; Match level="QueryCoverage=58%, HitCoverage=81%, E-value=1e-65, Identity=83%"; Hit description=Low molecular weight protein-tyrosine-phosphatase
  Pfam annotation: Domain name=LMWPc; Domain location=101-234; Score =89.3; E_value=1.3e-23; Accession=PF01451.12; Description=Low molecular weight phosphotyrosine protein phosphatase
  Pfam annotation: Domain name=UVR; Domain location=61-96; Score=41.8; E_value=2.4e-09; Accession=PF02151.10; Description=UvrBuvrC motif
  Pfam module annotation: Pfam domain module=LMWPc::UVR; Domain location=101-234::61-96
MEETSRRRAKQLQFNADHGITARGVQKAVRELIDGIVAPVQHDALEAAVPAELLKDEKALAREIKRLEKLMMDHARNLEFEQAAAARDALTALKQRVLLDGAGVFRHLVNDAGLGDVVRIDSAGTHAFHIGEAPDARAQAAARKRGYEITHCEARQVTAEDFRDFDLILAMDWDNLSAMQQQCPKAYQHKLMLLMRFANEFEEATVPDPYYGGADGFGKVLDYLEDACQGVLELVRKRATQYQAA

SEQ ID NO: 98758 - protein, 52 aa, Glycine max
  Coding DNA Sequence Number=SeqID_7073
MVAAQLAQASSARPGEPGVEERIHEFQEPLDLRSNPFQGGGNDAILPPKGIG

SEQ ID NO: 98759 - protein, 40 aa, Glycine max
  Coding DNA Sequence Number=SeqID_7074
QVSVKHLRANDLLKARACSPLQARMCSPLMARTYSPLKVI

SEQ ID NO: 98760 - protein, 56 aa, Glycine max
  Coding DNA Sequence Number=SeqID_7075
MRKVMRKRYVPVEAKLHDDDKGDDKKLKDQSKNNSSESKINQRTTQVNQEQFKSSR

SEQ ID NO: 98761 - protein, 378 aa, Glycine max
  Coding DNA Sequence Number=SeqID_7076
  Homolog annotation: Hit_ID=A6ELW3; Match level="QueryCoverage=97%, HitCoverage=89%, E-value=5e-67, Identity=37%"; Hit description =Putative uncharacterized protein
MRTKLLLTSMLALAVHQTVLAQTDVNGYTTVNLTTGPNYQNRVFFDFSTNNIISQPADSWDIAFFRNSSMSFGTRINDAQNIEVYQASAVPADWDNINIANIASWGSPLYNPDQTTSLQEGAFEQGSATYGWGDYNGGTHHIDGKVIFVLKYLSSNTYVKFMITDYFGGYTFKYSKWNGSSWEATQTKTIANGTDDAYFNYFSFTTGDKVANLEPPKANWDLMFTRYWTFYMNIMMYRMSGVIQSPTTKVAKVQPETQEVATSNIPVSTAFSSNITSIGHSWKPTSGIYNDVVYYVKQGSEYYRMYFTSNGGASTGNMYFKYKNISSTLGIKEVGTKASFGLYPNPTTADKKVTVLFDVKEKANNKGSIEVYDLSGKQ

SEQ ID NO: 98762 - protein, 428 aa, Glycine max
  Coding DNA Sequence Number=SeqID_7077
  Gene Ontology: Mol. function=aldehyde-lyase activity; Cellular component=cytosol; Biological process=metabolic process
  Homolog annotation: Hit_ID=B0ISU4; Match level="QueryCoverage=97%, HitCoverage=52%, E-value=0.0, Identity=73%"; Hit description =Phosphoketolase
  Pfam annotation: Domain name=XFP_N; Domain location=4-383; Score =922.0; E_value=2.6e-274; Accession=PF09364.1; Description=XFP N -terminal domain
MTNPSAADELALIDRYWRAANYLSVGQIYLMANPLLREPLQPGHIKPRLLGHWGTTPGLNFIYAHLNRIIRQREVDLLYVCGPGHGGPGMVANSWLEGSYSEIYPHVSEDAAGMQRLFKQFSFPGGIPSHAAPETPGSINEGGELGYSLSHAFGAVFDHPQLIVPCVIGDGEAETGPLAASWHGIKFLNPQRDGAVLPILHLNGYKIANPTLLGRSSDDDLQQLFSGYGYEPLFVCGHEPADMHQQMAAALDNAFDKIAAYQQQARSGQTEQAIPRWPMIVLRSPKGWTGPKEVDGKKVEDFWRAHQVPVAACREDASHRQVLEQWLRSYQPEDLFDEAGKLRPELRALAPQGDKRMSASPYANGGRLRRTLNTPDIREFALDTGAPGSQRGEATKQFGHYLSAIFQRNADNFRLFGPDETASNRLTP

SEQ ID NO: 98763 - protein, 507 aa, Glycine max
  Coding DNA Sequence Number=SeqID_7078
  Gene Ontology: Mol. function=4 iron, 4 sulfur cluster binding; Cellular component=nitrate reductase complex; Biological process =nitrate metabolic process
  Homolog annotation: Hit_ID=P09152; Match level="QueryCoverage=45%, HitCoverage=18%, E-value=1e-133, Identity=94%"; Hit description =Respiratory nitrate reductase 1 alpha chain
  Pfam annotation: Domain name=Molybdop_Fe4S4; Domain location=166-228; Score=12.6; E_value=0.00033; Accession=PF04879.7; Description =Molybdopterin oxidoreductase Fe4S4 domain
  Pfam annotation: Domain name=Molybdopterin; Domain location=231-488; Score=-83.5; E_value=0.00027; Accession=PF00384.13; Description =Molybdopterin oxidoreductase
  Pfam module annotation: Pfam domain module=Molybdop_Fe4S4::Molybdopter in; Domain location=166-228::231-488
MVLFLTAGLGSASTFQMISVIFRKLTMDRVKAQGGSEEQAMREAATDTAAALGFISAIGAIGGFFIPKAFGISLDLTGSPAGAMKVFLVFYIACVVITWLSVTFAANQQCRFREPQAPHRRYPMSKFLDRFRYFKQKGETFADGHGQVLDTNRDWEDGYRQRWQHDKVVRSTHGVNCTGSCSWKIFVKNGLVTWEMQQTDYPRTRPDMPNHEPRGCPRGASYSWYLYSANRLKYPLMRKRLMKMWREAKVQHSDPVDAWASIIEDADKAKSFKQARGRGGFVRSSWKEVNELIAASNVYTVKTYGPDRVAGFSPIPAMSMVSYASGARYLSLIGGTCLSFYDWYCDLPPASPQTGANRPTCRNRPTDPHPGRPLLHRGPLQGHQDGGRVQRLRRNGQVRRHLAGAQAGHRRRAGDGHGPRHPQGIPPVGRLGLFPRLRAALHRHAYAGAAQGARRLLRARPLPARLAAGTARWANRTIPDWKTLVFDEPSGDLVAPTAASPIAGARA

SEQ ID NO: 98764 - protein, 428 aa, Glycine max
  Coding DNA Sequence Number=SeqID_7079
  Homolog annotation: Hit_ID=Q6WAY6; Match level="QueryCoverage=98%, HitCoverage=65%, E-value=1e-13, Identity=23%"; Hit description =Putative uncharacterized protein
SNVDGLVDLAAIDAFLAYHHSKESPIVAVLVDAYDTFDRRCEKSGARIFYCTPALYVWLVFHVFRHESRLVCPLQGHRMCAKKGKANWEQLLAGMGGTSVNWFRRWKEGGARVLSSCEGFPNIPLMGMRGCINYNPVLAIRQLGCPIRRAPSEESITPFIARGFSDPNARMLQRVQKAWNARTQEITWLPKLKVSSEEEVETPEESEEVQALKAELERTQVVKEKFKMISIRVRKECDKLRDANMATDEALERETKRARKVEWGRNKFRGALWGSNSELKLRRAERDQSRVEVMILEDKLKACQRSKRSLSEQLSRTEENMWAIIDQYREKLSLVAGHEQRLEDEHEKVSALQAETEVREKVIDSLHGEAMMWMDRFAFTLNGSQELPRLLAKAKATVDVYLLLEEVRRLFDYCQHMIDLMAHIIRSC

SEQ ID NO: 98765 - protein, 450 aa, Glycine max
  Coding DNA Sequence Number=SeqID_7080
  Gene Ontology: Mol. function=hydrolase activity, acting on acid anhydrides, catalyzing transmembrane movement of substances; Cellular component=integral to membrane; Biological process =potassium ion transport
  Homolog annotation: Hit_ID=A7MQU9; Match level="QueryCoverage=68%, HitCoverage=44%, E-value=1e-139, Identity=82%"; Hit description =Putative uncharacterized protein
  Pfam annotation: Domain name=Hydrolase; Domain location=14-170; Score= 71.5; E_value=2.8e-18; Accession=PF00702.17; Description=haloacid dehalogenase-like hydrolase
  Pfam annotation: Domain name=KdpC; Domain location=282-450; Score =196.6; E_value=5.9e-56; Accession=PF02669.6; Description=K+ -transporting ATPase, c chain
  Pfam module annotation: Pfam domain module=Hydrolase::KdpC; Domain location=14-170::282-450
MGASFIPFSAQTRMSGVNVQDRLIRKGAVDAVRRHIEASHGSFPAEVNARVEEVARAGGTPLVVAEGAQVLGVVALKDIVKGGIKERFAELRKMGIKTVMITGDNPLTAAAIAAEAGVDDFLSEATPEAKLALIRQYQAEGRLVAMTGDGTNDAPALAQADVAVAMNSGTQAAKEAGNMVDLDSNPTKLLEVVHIGKQMLMTRGSLTTFSIANDVAKYFAIIPAAFAVTYPQLNMLNVMALHSPASAILSAVIFNALVIVFLIPLALKGVSYRPMSAAALLRRNLWIYGVGGLVVPFIGIKAIDLLLTLSGLANGSLIERDGAVRGSEQIGQAFSQPGHFWGRPSATSDVPYNAQASGGSNLAASNPALDKAVAERVAALRAANPQAPAAVPVELVTASGSGLDPDISPEAALWQAPRVAAARNMTLKDVEALIARNTERPLLPFIGEET

SEQ ID NO: 98766 - protein, 89 aa, Glycine max
  Coding DNA Sequence Number=SeqID_7081
MVKPRNILLTLKEHNANSYTTIKQIYNAGSAYCSSIRGSDTEMQQLMKLLERDQCIYWHRLKDEDVIVPAKQRGTGSCYLTLLVLHQRG

SEQ ID NO: 98767 - protein, 170 aa, Glycine max
  Coding DNA Sequence Number=SeqID_7082
  Homolog annotation: Hit_ID=Q84VH5; Match level="QueryCoverage=100%, HitCoverage=23%, E-value=7e-57, Identity=68%"; Hit description =Envelope-like protein
MATSPKETSAPGSPSVPSSPHQEQPEFNIQPIQIIPGQAFVPEKLVPRRQQGVKIAENPSLATSPREVDTEMDKKIRSIVSSILKDASVPDAEKDVPTSSTPDVAVPEADEDVPTSSTPNVSVPNVEKDVPTSSGPNAEVLSSPSADASTEEEDQASEETHAPRAPEPAP

SEQ ID NO: 98768 - protein, 103 aa, Glycine max
  Coding DNA Sequence Number=SeqID_7083
MHSVFCIFSGKHNELAQLAYRAQQDHLYLLHISVFQKTSLSMPITLSECINMALRKRVRTEDIPSSSNLPPPTTTMEPDAQQAHPIIPMLQSVFRGQLMIVYN

SEQ ID NO: 98769 - protein, 103 aa, Glycine max
  Coding DNA Sequence Number=SeqID_7084
  Gene Ontology: Mol. function=nucleic acid binding
  Homolog annotation: Hit_ID=A5AYU6; Match level="QueryCoverage=76%, HitCoverage=14%, E-value=2e-12, Identity=41%"; Hit description =Putative uncharacterized protein
MASLNSLFFKSNFKNRSNLKSFQDHDEDKANLCLMTKSHENNEEESVRKKWYIDSGCSKHMTGDVSMFTIISPNKSGHVTYDDKNKGKIIRVGKNRYEFLYSH

SEQ ID NO: 98770 - protein, 212 aa, Glycine max
  Coding DNA Sequence Number=SeqID_7085
  Homolog annotation: Hit_ID=Q2HVW1; Match level="QueryCoverage=46%, HitCoverage=41%, E-value=7e-12, Identity=33%"; Hit description =Putative uncharacterized protein
MNPMEPKQARVHSTTSTSMKSYAEAVKHDHKMKKKEITMPLMGKKGPEVSDVSVVIQTGKGMFEKAVDEVEEMVGMDVKVSYWGDDTIILQDMDEAKADKLNRREQSNGESTIFSIQKWTPEMKTEFRLIWIHIWGVPLEIWDTEHFQTLLSTFGEIVELDEETADRSRLDVARILIRTKLKPIFSKSMMAMVNDNEHHLFLREEVARPIGK

SEQ ID NO: 98771 - protein, 132 aa, Glycine max
  Coding DNA Sequence Number=SeqID_7086
MPLRGRIASADGFDEEAIAQLLCIPGQDFARTATRRRVRIMRTSMTTLAQTWMTLLLSNILPSDHNSDLPLLKCMPPTKHPLDPDKSNRALGFPALITSLYQSFGVPVTPSKVIRPPITRAFIEKYCTPRQA

SEQ ID NO: 98772 - protein, 159 aa, Glycine max
  Coding DNA Sequence Number=SeqID_7087
GEVGIMIGGQDVADQQSHPYLSQGGHVGAHDPHPSPGSSPGKILPRYTQQLGNGLLIEPIGPELADSICIERDPLTPHPGPHITHALLCWPSIGLKFEDYFWIKLGHGGNQRCPPPATYLLLEISVLVLPELDAAPKAVTVILGSGTSSFARLILPGSL

SEQ ID NO: 98773 - protein, 137 aa, Glycine max
  Coding DNA Sequence Number=SeqID_7088
MSSGSPDGKKEEPGFLFRAEDFQMFPYNLVLAIRQLGYPMRGAPLEEELTPIIARGFNNTKVEALQKVHKAWEMVQKKDKELRGSNNGPISGYRRWLKAHMQGLDWLPSLKTTKGVEAEAPEEDKEVQALRAELEKA

SEQ ID NO: 98774 - protein, 101 aa, Glycine max
  Coding DNA Sequence Number=SeqID_7089
MALKKFSTKRSRRDATGEGSSVAPEFDSHRFQSAEHQQHFEAIKGWSFHKERRDQLREDEYMDFQEEIARRHWTPLVTHMAKFDPEIVLEFYANAWPTEEG

SEQ ID NO: 98775 - protein, 36 aa, Glycine max
  Coding DNA Sequence Number=SeqID_7090
MGTSTGEELATQLGQASQVASSRSNRLLEEESGRPK

SEQ ID NO: 98776 - protein, 84 aa, Glycine max
  Coding DNA Sequence Number=SeqID_7091
MSSRICRMLVSSFVTGSQKVHITFLIAHMGHCAPNAHVRRDDFPGSRVHNCIHIMHRISISLWHHDEHIVPAFFHYHIPTSHFA

SEQ ID NO: 98777 - protein, 56 aa, Glycine max
  Coding DNA Sequence Number=SeqID_7092
MAILIANTSTTFHRDERLGNMLCMENVMMRLRCPKKHHFLVNHALEENTRIMHKQT

SEQ ID NO: 98778 - protein, 184 aa, Glycine max
  Coding DNA Sequence Number=SeqID_7093
  Gene Ontology: Mol. function=helicase activity; Biological process =viral genome replication
  Homolog annotation: Hit_ID=Q2HUT8; Match level="QueryCoverage=99%, HitCoverage=46%, E-value=6e-45, Identity=48%"; Hit description =Putative uncharacterized protein
  Pfam annotation: Domain name=DUF889; Domain location=2-183; Score =176.5; E_value=6.7e-50; Accession=PF05970.5; Description=Eukaryotic protein of unknown function (DUF889)
IDDAKLGEPNDGYDEITIPDEFLIKDFQDPIQAIVEATYPDLLQNYSNGNFLQKRVVLASTKDVIDKINDYVLSLIPSEEKEYCSADSVDKSYELLSPAFGVLTPEFLNSLKTSGIPNHKLKIKVGTPIILLRNLDQADGLCNGTRLIVTRLGSNVVEAEIITGPNICHRTYIPRMNLSPSDSP

SEQ ID NO: 98779 - protein, 140 aa, Glycine max
  Coding DNA Sequence Number=SeqID_7094
  Pfam annotation: Domain name=Transposase_23; Domain location=1-71; Score=-0.3; E_value=0.0013; Accession=PF03017.5; Description =TNP1ENSPM transposase
MGDSEKCGLYIEENPPRLVALGKLYEGSATVHNIPLCHYQVKVGVEEVTDADAPIPVPTEEVQLVGQTLNTFVAWETHLELWDWQNLQIDRIMMSIIPLYLMTLTIPQFFLKPLQVMWDVAVFGVFNDNLHLYIKHEDLI

SEQ ID NO: 98780 - protein, 100 aa, Glycine max
  Coding DNA Sequence Number=SeqID_7095
MGLAISLIAGTFGRTKALFAGKTYVLHNKPAAGREWLAIQECYRDNAPARWLSTLSMGALLVLPQRYSVHQVRAPTHLRPRTNLPALPLSVVIIPQYYNA

SEQ ID NO: 98781 - protein, 99 aa, Glycine max
  Coding DNA Sequence Number=SeqID_7096
MAVIIYGRHSVRVIPLWEKRLVDLPGRYHGHLVGDEGRQEVFVRHWDQGEFWNWPRGKVPLCVGTGAKVGIAGRASCCWSRSLRDLPLDGGGRSRLYGC

SEQ ID NO: 98782 - protein, 184 aa, Glycine max
  Coding DNA Sequence Number=SeqID_7097
MELTSLDEGESLPAYSRYCKMPTDIRLIEAALCIPSRGVLSYSNLAPTSHTSDLTTDRARLIFGLGSQLDMNVGALISGQITSMAQSNSSRLGFPAFITTLCRSRGVASDSLVFKRLSPVINLAYIRKNYWNPADLAFTIGGARRARARPVEAPSTSAAPLPARTSAALSTPSFVDFQCLEAML

SEQ ID NO: 98783 - protein, 150 aa, Glycine max
  Coding DNA Sequence Number=SeqID_7098
MEITRTKGKDSHKLGALSADSTEVSWERNQTMCTNLIPSGYLSSTIPPSSLPIPFDTKEEFHEQLTKERQEKETWKRRCQELEQENETLKGKIAQQSRELFIQNQRMIEKDDLLRRKDVLLHQDARRKRKFMDLFSRAHSDSEDPSTPGV

SEQ ID NO: 98784 - protein, 120 aa, Glycine max
  Coding DNA Sequence Number=SeqID_7099
  Pfam annotation: Domain name=G-patch; Domain location=38-70; Score =6.7; E_value=0.029; Accession=PF01585.14; Description=G-patch domain
MSYVEAAEESMETIFQSFEVVSIASVDSLSRQPCLSDAAMMVARVMLGHGYKPGMGLGKNNGDRAGLERKNKGQGPRSGQQAKEVLPCHISRSFVSASLRREGQVAMICDEDSLRRSDLV

SEQ ID NO: 98785 - protein, 171 aa, Glycine max
  Coding DNA Sequence Number=SeqID_7100
  Homolog annotation: Hit_ID=A0ST23; Match level="QueryCoverage=15%, HitCoverage=55%, E-value=2e-08, Identity=100%"; Hit description =Putative reverse transcriptase
  Pfam annotation: Domain name=Ins_element1; Domain location=3-71; Score=-8.7; E_value=0.00082; Accession=PF03811.4; Description =Insertion element protein
  Subcellular localization annotation: CTP_CleavageSite=32; ConfidenceScore=5.50e-01
APVASVSISCPSCSATDGVVRNGKSTRRTSALASVAAAQLLGRAIGAGLFAITPAGERGMCCKAIKLGNARVFPEGSIKLIDTVDLEGGPVGKPVVPAALMNRPTRGERRFAYWALAECILAYYVGTDEGDIFRFLRSLTRYARRSTAASGNGLRTGRRFPEDARKILNRE

SEQ ID NO: 98786 - protein, 143 aa, Glycine max
  Coding DNA Sequence Number=SeqID_7101
  Gene Ontology: Mol. function=chloramphenicol O-acetyltransferase activity; Biological process=response to antibiotic
  Homolog annotation: Hit_ID=P62577; Match level="QueryCoverage=58%, HitCoverage=38%, E-value=2e-42, Identity=98%"; Hit description =Chloramphenicol acetyltransferase
  Pfam annotation: Domain name=CAT; Domain location=6-117; Score=76.8; E_value=7e-20; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELPIPGVSFTSFDLNVGQYGTTFFAPVFHHGKYYYARRQGADAAGDFRFIMPFVMASIVGRNA

SEQ ID NO: 98787 - protein, 182 aa, Glycine max
  Coding DNA Sequence Number=SeqID_7102
MVPTRHPLDPDKSNRALGFPALITGLCQSFGVPVAPSKVIRPPITQAFIEKYCTQRQAQGDAPQAADAPPPHQAGPAESFDTEQYLRHLVRQQAANHRAHVQTRDCLYQMSLRLQSQGFTSFPCPTPDQFRAEVAWPGDWPEARAGEAPAEAPAEAPDEADEAREDEEMTDLLDFLGVSGAT

SEQ ID NO: 98788 - protein, 180 aa, Glycine max
  Coding DNA Sequence Number=SeqID_7103
MCQSFFFKDYQGEPESQFYYQNEAKRSFNLDILLMQFKDTIGSIQRAFKSAKIQVGKLVEEVTQAMNRREQEIVEVDTQEESPVNKHDLEEEDEEKAQQWEQCLQTHTQQEDNFQVNTCSHQLSIKEERHEEHEGSIILGQPCLPFTSCVFDMGKDDSEDWFEAKISKQEMELIASAMIL

SEQ ID NO: 98789 - protein, 107 aa, Glycine max
  Coding DNA Sequence Number=SeqID_7104
MTFSASFAYLEGECLNNVVWALQRFQGLFMKVDALVGVIVTDRDLVLMNAVKTGSLVDCPCESYFDEYLKNFEMACSSWPMFVNYVCQTWVIPHKEKFVKAWTNKVD

SEQ ID NO: 98790 - protein, 229 aa, Glycine max
  Coding DNA Sequence Number=SeqID_7105
MGEVEEVQDKMKADMEAMKEQMAAMMEAMMSMKKIMEANAVAVAATSIVAKVNPKSPLGLNQMNHPTLDMVGKDLGSRDGLHDVQNPNKHAFLPQGLPPNYTPPNVAYTLNEDVNNSTPIPIESRQPQTVHAHVSQPMGETHEIPHHNLADFEPWLGYATEGQAVGGIPLKNTSEAVSPTTTPLAFHDKPSCYGRNGKVELRKDVSSGISISYLHFPCIACVFSSLSSL

SEQ ID NO: 98791 - protein, 220 aa, Glycine max
  Coding DNA Sequence Number=SeqID_7106
NTGVRTDDIGFTLVDLKKLGYHNDPFIMAEQARQGKTIGVNVEDDDSYMDTYVSPLTAQITPNVVGEEEADDVHANRNDNDEGELINIVGADPSSETSNKSKNYKEEAQKKTQKHKPKRVESVNADAEAFGHQSVSLENKTGDSTMLKIGDSTKVVIKQDMKGRRHKYGFNNNKREKAQNKRVVDDETGDKHQLDEQQEQLRKKLAPEEGRIFAANEQLF

SEQ ID NO: 98792 - protein, 51 aa, Glycine max
  Coding DNA Sequence Number=SeqID_7107
MGETEEVQERIKADIEAMKEKMATMMEAMMSIKKIMKVNAATVAAASAVAR

SEQ ID NO: 98793 - protein, 195 aa, Glycine max
  Coding DNA Sequence Number=SeqID_7108
  Gene Ontology: Mol. function=unfolded protein binding; Cellular component=cytoplasm; Biological process=response to stress
  Homolog annotation: Hit_ID=O65069; Match level="QueryCoverage=48%, HitCoverage=45%, E-value=4e-39, Identity=81%"; Hit description=Heat shock protein
MDEDQWIYESIMSKEVNMNEANGEEPSVFENIDCSDAFNTSQVFATRDDVLHWARSVAYDIGFITMIMRHDAIPQVIITDKDSALMNAMKTIFPGHPHVDHEFMEALVVGANISIIGQFGVGFYSTYVVGEKVIVTSKHNDDEQYVWESQAGGSFTVTRDNSSEVLGRGTKTTLFLKEDQLEYLEERRLKDLIKK

SEQ ID NO: 98794 - protein, 251 aa, Glycine max
  Coding DNA Sequence Number=SeqID_7109
MDLIENMVASDIAILRDRAHIPTKKSLLELTLQDALLAQNKLLSKQLEALAETLRCTICGGAYESGCCIPNEKQVTHEVNYMGNQSRNHFNAGGFFGFQHGQQYNQQQGQWRNHPGNQFNRDQGSSIRLQPQGSSLYDRTMKLEETLAQFMQVSMSNQKSTESAIKNLEVQVGQLAKQLADRPSRSFSANTKENPKEECKAIMTRSRMTTHVDERKVEKKMEEHKQQLADELALEPVDDLVELEEIVEEAE

SEQ ID NO: 98795 - protein, 213 aa, Glycine max
  Coding DNA Sequence Number=SeqID_7110
MAPRKLPSKRSRKDATEEGSSAAQPADTDFGRHRFRSAEHQQCFETIKGWSFLRERQVQLSDDKFLDFQEEIGRRCWAPLVTPVAKFNPEIVMEFYANAWPTEEGAQDMRSWVRGQWIPFDTDALSQFLGHPLILEEGQQCEFFQRRSQFSSFDEEAIAKLLCILGQDFTWTAARRRVRIMHTNMTTLTQIWMTLLLSNILPSDHTSDLPLPK

SEQ ID NO: 98796 - protein, 249 aa, Glycine max
  Coding DNA Sequence Number=SeqID_7111
MTSVHAIELDRALHVIGLDCLWMTKGFCFYVSSICDEEIRPTQFIMGVTKSPAHIILVGNQWEMTTSSCGRGWKFASWVKVYGNAPAFVDELRWTLEVAAVRLSPAAGRPQATVGPDDLVGGDGHFVELTKACNQSWKPQGPVGLLWDHWVSWGHDPFKQRRSELLSLGRMLLSSNIIHVLVRMIHTRLPVAVWEKSCPSMHSSYAITSSSGCARTVSPPPRSGGTLSSLKARMCSPLKARTYNPLKAR

SEQ ID NO: 98797 - protein, 197 aa, Glycine max
  Coding DNA Sequence Number=SeqID_7112
MSASSGGDFFKSHPSYPELRRSEFLIGGYVGARASLLSTTPPFCHPKAAGPMTCADKIWSFRTPLPFRHNRVRWHAETNYGHSAPFCHPEAAGPMTCGDKIWSFRTPLPFRHSRVRWHAETKFGHSAPFCHLEAAGPMTCGDKIWSFRTPLPFRHSRVRWHAETKFGHSAPICHPEAAGPMTRGDLHYPPHSQDLSY

SEQ ID NO: 98798 - protein, 105 aa, Glycine max
  Coding DNA Sequence Number=SeqID_7113
MNHHSSSVNGEGRNRSHLRPHSHRREKEKKPQEANINLSYFHGKDNVEAYLDWKIRVEQQLKRKSTSKSYGSHSYPKKDQGQGILVATPSKPKDDKKEDNRKVTP

SEQ ID NO: 98799 - protein, 78 aa, Glycine max
  Coding DNA Sequence Number=SeqID_7114
MWFNFSFRLKDEEEEGGADIGEEELTYLRSNPLQGGGDDAILPRKGPVTRAMSKRLQEDWARAAEEGPRVLMNLRVDF

SEQ ID NO: 98800 - protein, 223 aa, Glycine max
  Coding DNA Sequence Number=SeqID_7115
YIMNSIITMLYFNGRVYEDNDGVIFEGSKNAIQIKRGISFNGLKKKLEIRFLVSGKYVALQICDDEDVETMIESFQQQQQMSVLELYVEKDVAGGSMFHAANSVTSCGHDDDDDYLASNSYVEESFDEDDSDDGISDTDDEVTDIVEPVSIVHPTEGVPQIQNPFWNDAMHYNNINWSHPDEEDICGLDMPTTFNVGQELYVGMDFDSKDAVKNALKQYVMKA

SEQ ID NO: 98801 - protein, 419 aa, Glycine max
  Coding DNA Sequence Number=SeqID_7116
EHFLQVVQEAPAQGRGPQPGGIGVQQALGGRCLQLVRNGGQRQAGALVEQGGGHPVLEPQGIEHELERQFVRADLAALGQVAAVARGGGPQPGLRAAQARLAHDAVVERQLAVRARPQAEVVAEFPVIQVVAAARAGPRVRRDLVARQAGRGKFGLDRVLHRGAGVVVRQVFGGKLGEYRVRLHRQVIERQVLGAEADGLAQIVHAGRQGLPGQREHHVQIDARRGALGHLDGGAGLGRIVDAAQLLQLGVVEALDAQRKARHAAGGVVAEPAGLGGAGIGLHGDFGVGPYVQTGAQHRQQLVQAGGREQAGRAAADEYRNHLAAPDRRQRLLQVAAQCVQVGAFGNLAAGRRMRVEITVRTLAHAPWHVHIDRQRRQAGQRGAGRGDQARTGRARFGADGDGDGHSVFLGATAPVSSL

SEQ ID NO: 98802 - protein, 54 aa, Glycine max
  Coding DNA Sequence Number=SeqID_7117
MATIDGGHDEHEEDNGSQCGYNLPLLALLLRESSSFPPKKRTAESPQGRANNES

SEQ ID NO: 98803 - protein, 182 aa, Glycine max
  Coding DNA Sequence Number=SeqID_7118
  Homolog annotation: Hit_ID=A5C993; Match level="QueryCoverage=87%, HitCoverage=15%, E-value=6e-07, Identity=24%"; Hit description =Putative uncharacterized protein
MREVVEMLAPAKKPNTFQKQFILWGERNLSWRRPLFDNEVASAVGFLEHISHTALQQHAADIWVWKPESNGYYSSRSAYILLQGNLEEGNMDDIFKDLWKVKIPAKASIFAGSIKEETASHLFFDCSKTQHFWWESLSWIGTSGAYPINPRLHFLQHNNGMKGGKKYNRWKCWWVALNWSIW

SEQ ID NO: 98804 - protein, 118 aa, Glycine max
  Coding DNA Sequence Number=SeqID_7119
MTSPATSRTPGRGIIPTLDGRILHNNSNNNNNLIFKMLLAQADHTFLHQSNNNKNSNNPINNKQLRLLRNLSLKNLLSSQSVQNPKNVSAITLRSGKQCQGPQPATSSSSTNEPAQLD

SEQ ID NO: 98805 - protein, 249 aa, Glycine max
  Coding DNA Sequence Number=SeqID_7120
MEHALRHPYRTRARARVMGEAEEVQEKMKADMEAMKEQMATMMEAMMSIKKIMEANVVAIAATSVVAKVNPMPPSDESSNLRYGGQRFGKYGQPHDVQIQNEHAFPPYGLPPNYTSPNVAYTPNEDVNNSTPILIESRQPHHVHVSQTIGETHEIPHHNLADFEPCLGYATEGKAISGILLQNTLEGPLYHPQPHLLHSTMGKNPHAMAEMGERVVPSTQTWVIPKFKVSDFDKYKGTTCPKNHLKMYC

SEQ ID NO: 98806 - protein, 79 aa, Glycine max
  Coding DNA Sequence Number=SeqID_7121
MNTKEGLSLCGSDLVKGFCKIVELSSGFLGDWTEKGDTKEFKRLVLCSFGKVRRETQKEFKRLVLVEFFLAKGEENEKI

SEQ ID NO: 98807 - protein, 46 aa, Glycine max
  Coding DNA Sequence Number=SeqID_7122
MIMKADEEITSESEISGEEEVEEELEEEAIQGDMLMEAMPMLQVLR

SEQ ID NO: 98808 - protein, 97 aa, Glycine max
  Coding DNA Sequence Number=SeqID_7123
MIDVLYHKNKKWSTMRKIEANLHDESRLIQRCFDDNKGDDKKLKGQSKNEFKMFKIESRTLQDSRGKLISRIKNQDSRIKLPRIKIQDSRFKNQEKT

SEQ ID NO: 98809 - protein, 80 aa, Glycine max
  Coding DNA Sequence Number=SeqID_7124
MSTDVTFFEDTPFFSSSVDHSSSLQEVLPIPCPLGHNQLILQYLKPLLVILILLQLVLQPWILLPYLSLITLSQTDPLPS

SEQ ID NO: 98810 - protein, 62 aa, Glycine max
  Coding DNA Sequence Number=SeqID_7125
MSRNLTYYATKGAKYLKVVMQAPLELVGLGSSSSMDSFASWKMNGSGMEKGRERGDATSRRR

SEQ ID NO: 98811 - protein, 70 aa, Glycine max
  Coding DNA Sequence Number=SeqID_7126
MQSQGFAPFSCPTPDQFRAEVAWPGDWPKAQAGEAPPEAPGDGEEAHEDEEMVDLLDFLGGSGDTAYIFV

SEQ ID NO: 98812 - protein, 248 aa, Glycine max
  Coding DNA Sequence Number=SeqID_7127
MKLPFYLELVRAFYSNLEIQENSLISEVYGIKMVIDQSFLFELTQLSNDGIPFEGTLDDEWKFDFFVSNARRMVCTNQADMTGRLLASSLAFKCRIMHYLIVRILLPRSSNLAHVSKEDLIIMWVFLTGRQIDWAHLRSFSIGANVVSSFGYRKERDGSWVKKDAPVQAVEDHSPSPPPQRDDSSSLMHNILDRLDGLDTFVSERFDSLDSRIDAMDAQFAGMDTHITKLEEDVSYVRRCFDLPPPSS

SEQ ID NO: 98813 - protein, 52 aa, Glycine max
  Coding DNA Sequence Number=SeqID_7128
MKSGDMRGYRMVIRTFRQPRRMNSTVYSSCPKIFKPNDARDSSLLGGDDQVR

SEQ ID NO: 98814 - protein, 358 aa, Glycine max
  Coding DNA Sequence Number=SeqID_7129
MNALSPAVVLSAFIFFVELSVELAKHDCALSEYYAWDRYANNVLGRKILLERNVKLYITEFDEFIREIERRNWHKELTNFSEGSIDVAIVKEFYANLYDLEDQSPKQGKACPPTPAKCRWAAFEDLEEEPDYSRLVSAKLIYELVMTMDINLGCLISGQISLIAQHDTSRLDFPTLITSLCKARGVTSNSLTFESLSPAINLAYIKKNCWNLNDPSVTFRGTQKSRARRSEVPPSSALAPAYASTSAPSASTPIYFYSSSSSNSYTFSRSEFRGFLVYTTEPALRSAPDHAELAECGPPAAEATKPTPPEPFTLESDPVADPAISPQPESFAPVLDLPLSQDPSSAPTLDLNELAQDD

SEQ ID NO: 98815 - protein, 94 aa, Glycine max
  Coding DNA Sequence Number=SeqID_7130
MPVPPARSCHRDIVIAPARHPVDPEKSNRALGFLAPITGLCQFYGVPVASSKVIRLPTNRAFIKKYCTLGRRRARHHSSLGMAGSGQQTQDHHL

SEQ ID NO: 98816 - protein, 135 aa, Glycine max
  Coding DNA Sequence Number=SeqID_7131
MGVKYFKVVKQRLQAIKQWSSDEIRVRITIRYPHMSSDLPSLDFKGADDDALSLTDSKRMFIRITTGVVCTEDDVNPHVSRGLLMQAPLELVGLGSSSSIDSFASWKINGSGMEKEEREETPLQGEDESRRSSPP

SEQ ID NO: 98817 - protein, 80 aa, Glycine max
  Coding DNA Sequence Number=SeqID_7132
MQLTECKLNQLLLISDLQKSHNFTSGVAIFISPFLFYNKVEPLTGKNLRDSQSGFIEEKEILDILVKSNHGIDPYQRGCT

SEQ ID NO: 98818 - protein, 67 aa, Glycine max
  Coding DNA Sequence Number=SeqID_7133
  Subcellular localization annotation: CTP_CleavageSite=17; ConfidenceScore=5.07e-01
MGPKSALRLMRTLRPSLASLTQSSWSLLSNALGGFCAKCEIIVLSAEVVFSQAQLMTGAKLKSTYLR

SEQ ID NO: 98819 - protein, 195 aa, Glycine max
  Coding DNA Sequence Number=SeqID_7134
  Subcellular localization annotation: CTP_CleavageSite=41; ConfidenceScore=5.59e-01
MMNALSAPAALSLFIATKASKKRKSFASSSTQARFDRSRFHSQEAWERYNDIIVPRKLLSERNVVVYYIEFDEFKEELEKRKWHEESTSFTEGSINVAIVKEFYANLYDPEDKSPKQVKVKGHLMKFDEDTLNTFLKTPMILEEGENLCAYSQFAFLRPDPQELAAKLCIPRRGFELNTDGQPLKILRKNMTTLS

SEQ ID NO: 98820 - protein, 77 aa, Glycine max
  Coding DNA Sequence Number=SeqID_7135
  Subcellular localization annotation: CTP_CleavageSite=46; ConfidenceScore=5.04e-01
MLTSPETVQMTTLVFACQSDLGSPNDKVQITVTIGCLRMPPKSWVTVAKGSVVDNNRAFAPTYPQFVMRNSDLRSSC

SEQ ID NO: 98821 - protein, 78 aa, Glycine max
  Coding DNA Sequence Number=SeqID_7136
PVVWIPPTPTPYRLVEPVQLIEVSSSEEDPEELPPEPAMDAPNLPEDDEDPLPDVDSPEDIMSASEADSTEESGPGRT

SEQ ID NO: 98822 - protein, 151 aa, Glycine max
  Coding DNA Sequence Number=SeqID_7137
MAKFDPEIVLEFYANAWPTEEGVRDMRSWVRGQWIPFDADALSQFLGDALVLEEGQQCEFSQRRNRADGFDEEAIAQLLCTLGQDFARTVVRRRVRIMRTSMTTLTQTWMTLLLSNVLPSDHNSDLPLPKCQLVCHPPGTLWTQINLTGPW

SEQ ID NO: 98823 - protein, 89 aa, Glycine max
  Coding DNA Sequence Number=SeqID_7138
  Gene Ontology: Mol. function=helicase activity; Biological process =protein amino acid phosphorylation
  Homolog annotation: Hit_ID=Q94LS3; Match level="QueryCoverage=87%, HitCoverage=5%, E-value=1e-18, Identity=58%"; Hit description =Putative helicase
  Pfam annotation: Domain name=DUF889; Domain location=2-89; Score= -76.5; E_value=2.7e-06; Accession=PF05970.5; Description=Eukaryotic protein of unknown function (DUF889)
VDSRGSPHEKEYCSADSIDKSDELLNPVFALLPPEFLYSLQTSGIPNHKLKLKVGTPIMLLRNLDQTDGLCNGTRLIITKLGSNVIEVE

SEQ ID NO: 98824 - protein, 81 aa, Glycine max
  Coding DNA Sequence Number=SeqID_7139
MVQLISDTIYCLRESHPQRHPVDPEKANRALGFPALVTGLCLSYRVPVPPDKVTSSGHRDHARKTPNGPEEVQQGLGVVKL

SEQ ID NO: 98825 - protein, 95 aa, Glycine max
  Coding DNA Sequence Number=SeqID_7140
MDLMENMVASDIAILRDRAHIPTKKSLLELTSQDALLAQNKLMSKQLEALTKTLKKNPKEECKAVMTRSRRAIHVGESETEKKMEKHKHQLAPTL

SEQ ID NO: 98826 - protein, 134 aa, Glycine max
  Coding DNA Sequence Number=SeqID_7141
  Gene Ontology: Mol. function=nucleic acid binding
  Homolog annotation: Hit_ID=A5C3F7; Match level="QueryCoverage=78%, HitCoverage=11%, E-value=9e-19, Identity=43%"; Hit description =Putative uncharacterized protein
MEKSEKKNFSEKKLKKAYITWDDNDMKSSEDSENEEINLCLMAKSYESDEKVSLRKEWYIDSGCSKHMTRDASKFTHISPKKSGHVTYDDNNKGRILGVGRIGTNSSNSIEMFYLLKVLSTTCLVLVNYVTKAI

SEQ ID NO: 98827 - protein, 234 aa, Glycine max
  Coding DNA Sequence Number=SeqID_7142
  Homolog annotation: Hit_ID=UPI00006A2939; Match level="QueryCoverage =55%, HitCoverage=74%, E-value=3e-08, Identity=27%"; Hit description =UPI00006A2939 related cluster
HVLAFRGLHVLAFRGLHVLAIRGLQALTFRGLHVLALRGLHVLAFSGLHALAFRGLHVLAIRGLRVHAFRGLHILTFRGLHTFAFVGLHTFAFVGLHTLTFRGLHNLTLRGLHALAFKGLHGYRPSPSEDYPSLPSEDYTSSPSEDYTSSPSRGLHVLAIEDYSSSHIRGCTPSPLEEYMSSLSRTTVLAIRTTREGYMPSPSMDTVQVEEYIHLVVRDTRPQGGHTSLVDVCL

SEQ ID NO: 98828 - protein, 260 aa, Glycine max
  Coding DNA Sequence Number=SeqID_7143
  Homolog annotation: Hit_ID=A5B939; Match level="QueryCoverage=25%, HitCoverage=54%, E-value=4e-19, Identity=61%"; Hit description =Putative uncharacterized protein
LVPSEVSLRIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHLETAQPEVGSSGWKSTARRVVSGAPPAALENPEDRVPPTPGRTHNRIRSPRAGHGGPSPEPVGCRWTARAASAARAGRRVPVGGRIGNGPFGASSPGVEQSTQNCALNVKVKKFNQARVNGGSNYDSLK

SEQ ID NO: 98829 - protein, 213 aa, Glycine max
  Coding DNA Sequence Number=SeqID_7144
HEGSSPTKDTEVVEAVNDVVIDDPLRELIKSLVDIYEKPVELVWDVTKFGIPNATASLFVTCADVNEIISGVQCLNIAILQLWTMYMDQLSQRDGVGSVYGFLEPQAILNANDKRGQCQEYIEKWLKESNRDVYLGAYLNHAFKTLETKSEGKFGHSTLRWIEVKSHVQSGTYECGYYVMHWMWNIIVGQLKTNWTRENFVFIFCLQFLALRN

SEQ ID NO: 98830 - protein, 347 aa, Glycine max
  Coding DNA Sequence Number=SeqID_7145
  Gene Ontology: Mol. function=aspartate kinase activity; Cellular component=chloroplast; Biological process=amino acid biosynthetic process
  Homolog annotation: Hit_ID=A8GKD3; Match level="QueryCoverage=99%, HitCoverage=75%, E-value=1e-137, Identity=74%"; Hit description =Aspartokinase
  Pfam annotation: Domain name=AA_kinase; Domain location=4-279; Score =197.7; E_value=2.8e-56; Accession=PF00696.19; Description=Amino acid kinase family
  Subcellular localization annotation: CTP_CleavageSite=40; ConfidenceScore=5.26e-01
MSQSLIVAKFGGTSVADFDAMNRSADVVLSDANTRLVVLSASAGVTNLLVSLAEGQELEQRAYLLDQIRTIQYAIIDRLQSPDVIRQEIDRMLENIIMLAEAAALARSTALTDELVSHGELMSSLLFVEILRERQVNAEWFDVRKVMRTSDRFGRAEPDVAELKTLAAAQLQPRTAEALVITQGFIGSEGKGRTTTLGRGGSDYTAALLGEALQATRVDIWTDVAGIYTTDPRVVPQAKRIEEITFEEAAEMAIFGAKVLHPATLLPAVRSDIPVFVGSSKDPAAGGTRVCNETKNPPLFRALALRRKQTLLTLHSLNMLHAHGFLAEVFAILARHSISVDLVTTSE

SEQ ID NO: 98831 - protein, 32 aa, Glycine max
  Coding DNA Sequence Number=SeqID_7146
MTDDKSKKGKKDRKQKNIVKSGQKKRLPNPLG

SEQ ID NO: 98832 - protein, 337 aa, Glycine max
  Coding DNA Sequence Number=SeqID_7147
KFRGALWGSNNELKLRRKERDRSQVHDMILKEELAACARSKRSLAQHLEATEQSMLAIIGQYKEKLNQSVTHEQKLVEDFAQVYAEKEARGRVIDALHQEVTMWMDRFALTLNGSQDLPRLLAKAKAMAELEFTITKKAQRLPYNTRSRKMDNEEGVQEQMKADLSALKDQMASITEAMLKLQKTLEDNATATASNAVREAEPVLQPTINLGRDRNPTVFGRRYSPQAYPYGLPPDFTPRAAPEDVSQAPTFEGQLPPYVDYPMQEDDEEDTYLGPLLPLKDPSPHELPQPNIVRHVPSSPAPVKESVPFTEDKGKIDALEERLRAAEGLTITHSRI

SEQ ID NO: 98833 - protein, 93 aa, Glycine max
  Coding DNA Sequence Number=SeqID_7148
MAIALDGAHVRYIGCCVCSWGAKCIGLVEWPICGGQTWLKNLSIYEGILRRFNWSMVIGTCLWLRSYIVCSVCSWKGSALTLSDGPFVGDKRG

SEQ ID NO: 98834 - protein, 133 aa, Glycine max
  Coding DNA Sequence Number=SeqID_7149
YIYLGLTENKRGYISCGSVLVEGTSTRFKENKGGYIPCGSLLVKGFLQGYILRGTSRGYINLGLAENKRGYSSCGSVLVEDQELEEDSLAPTVTLRWCRGPWSMNEKNCLAAERLHALDLEEEEVSDIEGGWR

SEQ ID NO: 98835 - protein, 119 aa, Glycine max
  Coding DNA Sequence Number=SeqID_7150
MLVKKDMKEKIHLFCRRLWKGLTVFKPLLEKEVVIIKKGEIVEAKLHGDDKKLKDQSKNNSSESRTIQEFKIRIKKYSRTQEESLETRIKIQGSRSQESRSRFKTQDSRIKRRLNQDKY

SEQ ID NO: 98836 - protein, 67 aa, Glycine max
  Coding DNA Sequence Number=SeqID_7151
MEKTMKNKELVGLGYHITKMKMLLIPHDVAPFRACRPWIFFINGFLCFLNINGNRMEKEERLLETPL

SEQ ID NO: 98837 - protein, 158 aa, Glycine max
  Coding DNA Sequence Number=SeqID_7152
  Gene Ontology: Mol. function=transferase activity, transferring glycosyl groups; Cellular component=chloroplast; Biological process =biosynthetic process
  Homolog annotation: Hit_ID=Q6DW75; Match level="QueryCoverage=52%, HitCoverage=17%, E-value=5e-40, Identity=93%"; Hit description =Digalactosyldiacylglycerol synthase 2, chloroplast
MVIYQYAFIDKRSSLAVGDISEIIPDKVADIAVLEEPEHLTWYHHGKRWKTKFRLVIGIIHTNYLEYVKREKNGTMQAFLLKYLNSWVVDFYIGCPNNQCRMSKFNIGHLTIVVFQRLRVTTTRDNRCRKAPITDVESLFSSSDYYNMYLEFCILIMM

SEQ ID NO: 98838 - protein, 84 aa, Glycine max
  Coding DNA Sequence Number=SeqID_7153
MDPKSILRLMRTLRPSLASLAQSSWSLLSNALAGPWIFFINGVLCFLKFDGSGMENEKDDWRRHFKEKMSLEEFHHHRKPWIRA

SEQ ID NO: 98839 - protein, 199 aa, Glycine max
  Coding DNA Sequence Number=SeqID_7154
LSEELRDYYEESHRSHLRPHSHRREKERKPQEANINLPYFHGKDNVEANLDWEIRVEQQLKKKSTSKSYGSHSYPKKDQGQGILGVTPSKTQDDKGKTIEKEPLKASMQEKTSSMNSQDEATTSPSYSESEEEKWKESSEEIYPQEEGQPLMVKEECKETHVSTAIPLGLEVIPQVKNLLDEGLVRKSLNPYALLVPKI

SEQ ID NO: 98840 - protein, 127 aa, Glycine max
  Coding DNA Sequence Number=SeqID_7155
  Subcellular localization annotation: CTP_CleavageSite=45; ConfidenceScore=5.31e-01
MVSSAYYKMLIFIPSFPTNNPLYLFAFSAFSIKPVKPSVTILNKRGASGSPPPQYYHSLAQIIDEDMTKSKGKDPLEGLGGPMTRARTRKAKEALQRVMSILFDYKPKFQGEKSKVVSCIMAQMEED

SEQ ID NO: 98841 - protein, 149 aa, Glycine max
  Coding DNA Sequence Number=SeqID_7156
  Gene Ontology: Mol. function=chitin binding; Cellular component =extracellular region; Biological process=chitin metabolic process
  Homolog annotation: Hit_ID=UPI00006A17C9; Match level="QueryCoverage =75%, HitCoverage=100%, E-value=9e-17, Identity=32%"; Hit description= UPI00006A17C9 related cluster
  Subcellular localization annotation: CTP_CleavageSite=41; ConfidenceScore=5.47e-01
MVRTCSPLKARACSPLKARTCGPLKVRTCSPLKARTCGPLKARTCSPLKARTCGPLKARTCSPLKARTCSPLKARTCSPLKARACSPLKVRTCSPLMARTCSPLKVRACNPLKIDCPFERGVNSCNLILSFANLSGNSLRVYVLFDLVT

SEQ ID NO: 98842 - protein, 59 aa, Glycine max
  Coding DNA Sequence Number=SeqID_7157
  Gene Ontology: Mol. function=oxidoreductase activity
  Homolog annotation: Hit_ID=A2Q5B6; Match level="QueryCoverage=79%, HitCoverage=15%, E-value=9e-11, Identity=64%"; Hit description =Aldo/keto reductase
MKLGSQGLEVSMHGLHSMVLQSQNDMIALIHHAIESGVTFLDTSDVYSKGFEGRGEREG

SEQ ID NO: 98843 - protein, 131 aa, Glycine max
  Coding DNA Sequence Number=SeqID_7158
YCTQRQIQGDAPQAADAPPPHQAGPAGLFDTEQYLRHLVRQQAANHRAHVQTHDCLYQMSLSLQSQGFTSFLCPTPDQFRAEVTWPGDWPEAQAGEAPAGAPAEAPNEADEAREDEEMTDLLDFLGGSGAT

SEQ ID NO: 98844 - protein, 29 aa, Glycine max
  Coding DNA Sequence Number=SeqID_7159
MSMTLYAKSTTLARRNGSNYVRAIETLRG

SEQ ID NO: 98845 - protein, 48 aa, Glycine max
  Coding DNA Sequence Number=SeqID_7160
MTGDAFTHISPKKSGHVTYGDNNKGRILGVGKIAKMMIHGYGINGLLT

SEQ ID NO: 98846 - protein, 147 aa, Glycine max
  Coding DNA Sequence Number=SeqID_7161
  Homolog annotation: Hit_ID=Q9SJS1; Match level="QueryCoverage=38%, HitCoverage=7%, E-value=3e-08, Identity=51%"; Hit description =Putative Athila retroelement ORF1 protein
MRLRTASGDVVPINLEIEATCRRNNAARRRREQDTEGSSHTSPPLSPHHTEMDGEQARRVTLEDFSNTATPQFFTSIARPEVQAANISYPHSLIQLIQGNLFHGLPSEDPYAHLASYIEICNTVKIAGVPEDAERQNDGCTPSKATA

SEQ ID NO: 98847 - protein, 137 aa, Glycine max
  Coding DNA Sequence Number=SeqID_7162
  Subcellular localization annotation: CTP_CleavageSite=67; ConfidenceScore=5.33e-01
PGRIKRLKEPVPLPNMTVTALGALNTSSASRPSRDGHFSGSDASSSKTTNIVLEFNANAWPTEEGVRDMRSWVRGQWIPFDADAIGQLLGYPLVLEEGQECEYGQRRNRSDGFDEEAIAQLLCIPGQDFARTAAGRR

SEQ ID NO: 98848 - protein, 232 aa, Glycine max
  Coding DNA Sequence Number=SeqID_7163
  Homolog annotation: Hit_ID=UPI00016621D1; Match level="QueryCoverage =74%, HitCoverage=41%, E-value=1e-12, Identity=29%"; Hit description =UPI00016621D1 related cluster
GLHALAYRGLEALTFRGLHVLALRTTRPHLQRATCPHLQRTTRPRLEDYIGQHVLTFKALDAIAFRGLHVLTFKRLHALTFRRLHVLALRGLHALAFRRLHVLAFRGLHVLDFRGLHAFSFRELHVLAFRGIHVLAIRGLHALTLRRLHVLTFRGLHALTFRGLNTLTIRGLHVLTIRGCTPSPLKGYMSLPIDGCTPSPLEGYAPSPLEDYMSSPTEGCTPSPSEGRTPSH

SEQ ID NO: 98849 - protein, 53 aa, Glycine max
  Coding DNA Sequence Number=SeqID_7164
MVVLVIGSSNEKASGIAMVVGDEDACKVQCCRRWWMTNVKKWKATKCSGGEET

SEQ ID NO: 98850 - protein, 211 aa, Glycine max
  Coding DNA Sequence Number=SeqID_7165
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=78%, HitCoverage=46%, E-value=9e-12, Identity=30%"; Hit description=CTV.20
  Pfam annotation: Domain name=zf-CCHC; Domain location=12-29; Score =30.0; E_value=8.9e-06; Accession=PF00098.14; Description=Zinc knuckle
MENPKQKTKSKITCYNCGKQGHISKYCRLKKKLRNLNLEPAIEEQINNLLIETSEEETKTSSSVLSDENLNLIQHDDQLSSTDDDDGQINTLTREQDLLFEAINSIPDPQEKKVFLEKLKKTLEVKPRQKDFITNNKFDVSNILKRLENSSTKPTTIQDLQTEINNLKREVKELRQQQEIHQIILSQLEEDSDSESTNNSEENQPENLEDD

SEQ ID NO: 98851 - protein, 74 aa, Glycine max
  Coding DNA Sequence Number=SeqID_7166
KDKVLNAQVKIERAIEKALLSDGCSLGLAGLIAVGGCGGNEGQAGVSSNNNEARPRNGAGKEKWACGSPSLDYL

SEQ ID NO: 98852 - protein, 132 aa, Glycine max
  Coding DNA Sequence Number=SeqID_7167
MAAQLIHDRVVMECLEGVWETLEGNERCRFRGTIRLTATSLQPVEWILPTPTPYRLVEPVQVIEVSSSEEDLEEDPEELPPEPAMDALDLPEDDEDPLPDVDSLEDIMSSSEADSIEESGPGGTANSDDSSS

SEQ ID NO: 98853 - protein, 80 aa, Glycine max
  Coding DNA Sequence Number=SeqID_7168
MESPTVATCPFVGERGEAHGCAFQRRKDTRSRHQCLFVENVGKNRRKPATTKFLSSGVVFMFEEGISTSHICLKGQQPIF

SEQ ID NO: 98854 - protein, 146 aa, Glycine max
  Coding DNA Sequence Number=SeqID_7169
MNSLSEFINTHCMKVELYHTELDDFKDELERRNFHKRLTNLVDGSIDLTLGKEFYANLYSYEDRPPKQSKVRGHLVKIDADSLNAFLETHVVLAEGETLPAYSRYCMLPMDFREIEVALCIPSRGFILNSEAHPGKILMKDLTTLA

SEQ ID NO: 98855 - protein, 87 aa, Glycine max
  Coding DNA Sequence Number=SeqID_7170
  Subcellular localization annotation: CTP_CleavageSite=65; ConfidenceScore=5.22e-01
MDHFKVQRLKRTTFQVLIPSSNVNTTPESGIFFMTGFLRFFRRFPQINVGGDSAHFPPLEDAPVSFASLARKRVGCDSWRLHWGLFL

SEQ ID NO: 98856 - protein, 211 aa, Glycine max
  Coding DNA Sequence Number=SeqID_7171
  Homolog annotation: Hit_ID=UPI00016621D1; Match level="QueryCoverage =67%, HitCoverage=40%, E-value=3e-14, Identity=35%"; Hit description =UPI00016621D1 related cluster
MPCFSEGYTPSLEDYTRPRLKRATRPRLQRATRPRHQRLHVLASSPTEGYTPSPLEDYTSSPSEDYTSSAFRRLHALAFRGLYVLAFRGVHALAFIGLHALAFRRLHTLAFRGLHALTFTGLHALTFRGLHVLAFRGLHALVFRGLHALTFRGLHVLSFRGLHVLAFRGLHPLTFRGLHVLSFKGLHVLAFRRLHALAFRGLYVLTFRGVQ

SEQ ID NO: 98857 - protein, 216 aa, Glycine max
  Coding DNA Sequence Number=SeqID_7172
  Subcellular localization annotation: CTP_CleavageSite=41; ConfidenceScore=5.26e-01
MTYLRLLSNPQAIIAEVRLFRGLGRKTLTSPRRVQMTTLVSACQRARLPLVDESETFLRSRPEDANISGKGADDHIGADSHKVSLYATGPLSHDSRSETFSRSWPEDADISRKGADDHIGADNHKVSLHATGPSSRNSRSETFTWSRPEDADIFGKGADDHIGMDNHKVSPHAIGTSSRDSRSETFTRSWPEDADIFGKGADNHIGLCVSTGSLAS

SEQ ID NO: 98858 - protein, 244 aa, Glycine max
  Coding DNA Sequence Number=SeqID_7173
  Homolog annotation: Hit_ID=UPI00016621D1; Match level="QueryCoverage =81%, HitCoverage=46%, E-value=2e-12, Identity=31%"; Hit description =UPI00016621D1 related cluster
MIGPLNESISCFLTRVDLWVLEPIAFKGPSVLAIRGLHALTFRGLHVLPFRGLHALTFRGLHVLAFRGLHVLAIRWLHALTCRGLHVLAFRGLHVLAIRGLHVLTFRGQHTLAFIGLHALTFRELRVLALRGLRVLTFRGLHVLAIRGPHVLTYRGLHVLAFRGLHVLTFRGLHVVTFRGLHALTLRGLHVLAIRGSHALTLEGRTPSLQRAALPHLQRTTRGDPLRVDLQACKLGTGRRFTTS

SEQ ID NO: 98859 - protein, 102 aa, Glycine max
  Coding DNA Sequence Number=SeqID_7174
  Gene Ontology: Mol. function=aspartic-type endopeptidase activity; Biological process=RNA-dependent DNA replication
  Homolog annotation: Hit_ID=A5BFN6; Match level="QueryCoverage=82%, HitCoverage=14%, E-value=6e-11, Identity=39%"; Hit description =Putative uncharacterized protein
MSSSCRDRAQSLLDSYENSKFYKEKTKKFHDSLIAKKDFVVGQKFLLYNFRLGLMSVEIKSESTDKSFKVNGHRLKPFLTNPSLVNVVVEETSLLHPTSLLP

SEQ ID NO: 98860 - protein, 71 aa, Glycine max
  Coding DNA Sequence Number=SeqID_7175
MTTNDCHELSFLAAGARHRDEHFNQSRIFKIHLKDWFLREKYLYLGACHSVWNFLETQVDHHRGKLPGFPN

SEQ ID NO: 98861 - protein, 80 aa, Glycine max
  Coding DNA Sequence Number=SeqID_7176
MSEKRERCGLRTLSVKGSGVVFTHGEGKRGRRLPPSSRRRAGLLPLEAILLQKYSGRPKFKISKIAICTPYFDKFTPLLS

SEQ ID NO: 98862 - protein, 238 aa, Glycine max
  Coding DNA Sequence Number=SeqID_7177
  Gene Ontology: Mol. function=RNA-directed DNA polymerase activity; Biological process=RNA-dependent DNA replication
  Homolog annotation: Hit_ID=A5YPB7; Match level="QueryCoverage=21%, HitCoverage=28%, E-value=3e-11, Identity=61%"; Hit description =Putative gag protein
  Pfam annotation: Domain name=zf-CCHC; Domain location=108-125; Score =18.3; E_value=0.0026; Accession=PF00098.14; Description=Zinc knuckle
  Subcellular localization annotation: CTP_CleavageSite=27; ConfidenceScore=5.14e-01
MHVFTSLSLSLSLNSSPKTLTPPRPPPTTTGSYHEHPLLVVIPPYKDERFNQSEIFIIYLKDSIKNKALNPFFVVSSRSAGPMKNKKNGPQNQGKPYQTPPKQYDKDMTCFNCKQKGHIQRDHPYPKNEHNGGGLNDQTRRLKATRRVFTLDGVKASKSKDIIQGSTQELIKEHKVEKDKIASKREKLKIPNFQMKRNLEAYLKWEMKVDQIFACHEYSEEKKIRLAILGFDDKALTW

SEQ ID NO: 98863 - protein, 97 aa, Glycine max
  Coding DNA Sequence Number=SeqID_7178
MVTKKNRYIHSDKIVVEEEDANITLILGRLFMSTASCVVDMGNKILQMGIEDQKINFDLFHQDKDPPSQNVCLKVHVMEEKRPEKKVLEVGTLLDPE

SEQ ID NO: 98864 - protein, 199 aa, Glycine max
  Coding DNA Sequence Number=SeqID_7179
IPAAVRIRKKNAELRDVNIATTKALEQETKRASKEEHGRNKFRGAQWGSNNELKLQREERDQLRLDGIILKDKLKTCLRSKRSLSQQLCETETNMLAIISQYKEELNLATAHEHKVADEYAQVYAEKEARGRVIDSLHQEATMWMDRFALTLNGSHKLPRLLAKAKAMADVYSAPEEIHGLLSYCQHMIDLMVHIIRSR

SEQ ID NO: 98865 - protein, 177 aa, Glycine max
  Coding DNA Sequence Number=SeqID_7180
MASRKRKSIGSRPTAQYDTRKFSSLDAWTRYTDNVLGRNILPERKVEIYHYELDEFKAELERHNFHKCLTNFVDGSIDLTLVKEFYANLYSFEDHPPKQSRVRGHLVKIDADSLNTFLETPMVLAKGETLPAYSRYCRLPTDYREKKVALCIPGRGFILNSEGHPGKILRKDMTTLA

SEQ ID NO: 98866 - protein, 101 aa, Glycine max
  Coding DNA Sequence Number=SeqID_7181
MGGEVTLLDILGGGNIMVKEFEASLEWDDLESLIIHGQCIDGAHVSYFILHGNSTNFVSYFLGDGTMWLVPVMIASPSSWEHNDNSRVQEARFFCGAAEPM

SEQ ID NO: 98867 - protein, 68 aa, Glycine max
  Coding DNA Sequence Number=SeqID_7182
MMAHQDYQRQLSSKRKTLDEVSLSIKASRRTQHDHRFTSISYVPTDPGIGPFFNSPCVQKVLVFLCIK

SEQ ID NO: 98868 - protein, 69 aa, Glycine max
  Coding DNA Sequence Number=SeqID_7183
MRLPQEPLNKKPRGLTRKSMAEINSEELCGAATMSSSSEERSKRSLAQHLEATEQSMLAIIGQYKEELN

SEQ ID NO: 98869 - protein, 93 aa, Glycine max
  Coding DNA Sequence Number=SeqID_7184
  Subcellular localization annotation: CTP_CleavageSite=45; ConfidenceScore=5.20e-01
MLIIPNLAINLPKIRLGSAFVKTSATCGLFLRTPRKKDISQKDTKARSGSSGINTAGPISIRKGSEAERVLSREKQTLSRSRFDILQKMMNSM

SEQ ID NO: 98870 - protein, 103 aa, Glycine max
  Coding DNA Sequence Number=SeqID_7185
MDRVTSLLRLLPNTFRTFDVLVTSSFTLTKMSWTIKEHVLWHPYRTRARARVTGEAEEVQEQMKADMEAMKEQMATMMEAMMSMKKIMEANAIAVVATSVVAK

SEQ ID NO: 98871 - protein, 122 aa, Glycine max
  Coding DNA Sequence Number=SeqID_7186
  Subcellular localization annotation: CTP_CleavageSite=36; ConfidenceScore=5.06e-01
MAFLGETSRQTVVNSTLGFIFPNGSIVHNDSGVSFQASTPVPIRMPNKCDFQTLKTRIHNTLKLTNKQFLDEIYYRQPFTYAGKNPKKFDIPTGCTMDELKDLIKQVAPPGIPPYGIDEIQM

SEQ ID NO: 98872 - protein, 40 aa, Glycine max
  Coding DNA Sequence Number=SeqID_7187
METSAGLRRAAMAKTPKTETGETFNGKTETKHTLNKIPGH

SEQ ID NO: 98873 - protein, 170 aa, Glycine max
  Coding DNA Sequence Number=SeqID_7188
MQMLQFLYPLMSLADTSGQVFITAVVSPTKPPPKPDPEVNDPLYLMRLTIPELFLRPYQVRWDASVFGVFNPDFPLYIKHEDLSEIAHGGQCLSISVHLTKTCMRVGNSDIYRFLEPQFIQRSGQSQFESESYIKSWMQSSQCDVYLGAYLNGFHCSGHWQMVVILPRNT

SEQ ID NO: 98874 - protein, 221 aa, Glycine max
  Coding DNA Sequence Number=SeqID_7189
MAKFDPEIVLEFYANAWPMEEGDQQCEFSQKSYQASGFDEETIAQLLCIPGQDFARTAVGRRVWIMRTSMTTLIQIWMTLLLSNILPNDHNSDLPLPKCQLVYAILTQMTVHVAQIIADAIYLFAGTAPTRHPLDPKKSNRALGFPALITGLCQFYIVPVTPSKVIRPPITRAFIEKYCTPRQAQGGAQQAANHRGQGPDSTPFVCPTPEQFGAEVAWPGD

SEQ ID NO: 98875 - protein, 137 aa, Glycine max
  Coding DNA Sequence Number=SeqID_7190
  Gene Ontology: Cellular component=integral to membrane
  Homolog annotation: Hit_ID=A3KBV8; Match level="QueryCoverage=50%, HitCoverage=11%, E-value=3e-29, Identity=95%"; Hit description=IGN1
  Pfam annotation: Domain name=Ank; Domain location=31-63; Score=23.1; E_value=0.0011; Accession=PF00023.21; Description=Ankyrin repeat
MTMITNSSSVPEIVKALLSKDPQLARRTDKKGQTALHMAVKGQSCDVVKLLLEADAAIVMLPDKFGNTALHVATRKKRVESRPAGMQAWHWPSFYNVVTGKTLALPNLIALQHIPLSPAGVIAKRPAPIALPNSCAA

SEQ ID NO: 98876 - protein, 55 aa, Glycine max
  Coding DNA Sequence Number=SeqID_7191
MGAKYLEAVKQRLHAIKQWSPDEIRLVLKLPNGFMSAEARPSRRFLGSSPNSGYK

SEQ ID NO: 98877 - protein, 619 aa, Glycine max
  Coding DNA Sequence Number=SeqID_7192
  Gene Ontology: Mol. function=protein transporter activity; Cellular component=membrane; Biological process=protein secretion
  Homolog annotation: Hit_ID=A5KWA6; Match level="QueryCoverage=52%, HitCoverage=92%, E-value=2e-76, Identity=46%"; Hit description =Multidrug resistance protein A
  Pfam annotation: Domain name=ADH_zinc_N; Domain location=149-299; Score=58.5; E_value=2.2e-14; Accession=PF00107.17; Description=Zinc -binding dehydrogenase
  Pfam annotation: Domain name=HlyD; Domain location=325-615; Score =125.6; E_value=1.4e-34; Accession=PF00529.11; Description=HlyD family secretion protein
  Pfam module annotation: Pfam domain module=ADH_zinc_N::HlyD; Domain location=149-299::325-615
MSQFENASIVLNSHPDGAATLENFRLETSSLRPLDPGEFLVENKWLSIDLYLRPRLNKSTKYVSPIKLGEVIQGEAIGEIVASRNPLFNVGDRVFTFSGWQKYYIGDAQNFTVHRLPETTLPPSIFLGAVGTPGRSAYFGLNKIAKPKPGETLVVSAASGSVGSVVGQLGKLAGCRVVGLAGSEDKCRYVVEELGFDSCLNYKTADLNRDLRAACPQGIDIYFENVGGRVSLFVAKLLNEGARVPICGNAANYNKGTDVDASGPADFFSALPDAPLNRFFLVTEWFKDYAESDAFLLNAAENGFLYWLLYWRYFQTTDNAYVQADITNVSARISAVVVNSMIRDNHRVNKGDLLAQLDDREFVVALQKAEATLAQSRAALTNAQASYQMQKSAIDEFRSDVNSAAATLQYAHQQYLRFQILQKKNYVSKGDMDNATSSYRVAEAKYHQTQASLKTQSDKLQVLQSEIEQSQANVEQAQANLEQAKLTLSYTRIIAPIDGVISNRSLQVGMMVQAGQSIASIVSGAAPWISANFKETQKARMRKGLPVEVKVDAYPGKIFHARVDSISPATGATFALLPPDNATGNFTKIVQRVPVKIVFDSPQQIDSGLSASVTVDTRG

SEQ ID NO: 98878 - protein, 90 aa, Glycine max
  Coding DNA Sequence Number=SeqID_7193
  Gene Ontology: Mol. function=DNA binding; Cellular component=nucleus; Biological process=regulation of transcription
  Homolog annotation: Hit_ID=O49746; Match level="QueryCoverage=33%, HitCoverage=9%, E-value=2e-09, Identity=93%"; Hit description=R2R3 -MYB transcription factor
MGRAPCCDKANVKKGPWSPEEDAKLKSGTELEFVIMVIAVSCGLRIGRSSASSLTDSLRSVVRLRRAVSAHSKAVIRLSTESGDNAGKNM

SEQ ID NO: 98879 - protein, 143 aa, Glycine max
  Coding DNA Sequence Number=SeqID_7194
  Homolog annotation: Hit_ID=A5AIK9; Match level="QueryCoverage=76%, HitCoverage=7%, E-value=2e-12, Identity=37%"; Hit description =Putative uncharacterized protein
MTRGNPSDLQPFDLEIDRTFHRLVRQHFIPFEHPDFEHSENMAQPPPRERTLREMAAPDFTYESLCIQYPDEGVPYVLKTGLIHLLPKFHGLAGEDPYKHLNEFHIVCFTMKPPDVQEDHIFLKAFPHSLEGVAKDWLYYLAP

SEQ ID NO: 98880 - protein, 144 aa, Glycine max
  Coding DNA Sequence Number=SeqID_7195
MAPRKLVSKRSRKDKAAEGTSSAPEYDSHCFRSAENQQCFEAIKGWSFLRERRVQLRDDEYTDFQEKIVRRQWASLVTPMAKFDPDIVLEFYANAWPTEEGVRDMRSWVRGQWIPFDADALSQFLGYPLVLEEGQECEYGQRRN

SEQ ID NO: 98881 - protein, 59 aa, Glycine max
  Coding DNA Sequence Number=SeqID_7196
MMKDTYRFDGLQTYVGERFDSLECQVDTRFEEMNSRIAKVEEDVTIIRDCLDLPPPPSI

SEQ ID NO: 98882 - protein, 78 aa, Glycine max
  Coding DNA Sequence Number=SeqID_7197
  Homolog annotation: Hit_ID=Q2IUN4; Match level="QueryCoverage=87%, HitCoverage=84%, E-value=3e-18, Identity=72%"; Hit description =Putative uncharacterized protein precursor
  Pfam annotation: Domain name=DUF1535; Domain location=29-77; Score =36.0; E_value=1.4e-07; Accession=PF07553.2; Description=Domain of Unknown Function (DUF1535)
MKKTIARACLSLITLATLGTTSAWAQELTIPQKNAVRSAKQYLSFSGFSRSGLIQQLSSDAGDGYKVADATIAVDSLK

SEQ ID NO: 98883 - protein, 95 aa, Glycine max
  Coding DNA Sequence Number=SeqID_7198
MGVYLVKKGVQIATRPTWAFQGVPTKGGAFWWKQPSSLGGKRAEYIRSSLLKNCFREENPRRSTFITFPRRFRERFREDSSPFFIVLRRSSVFNR

SEQ ID NO: 98884 - protein, 114 aa, Glycine max
  Coding DNA Sequence Number=SeqID_7199
MECLEGLWETLEGNARGTRTHASANCGVDITYTYSISTSRARQVIEVSSSEEDPEEDPEELPPEPAVDALDFPEGDEDPLPDVDSPEDVMSASEADSTEESGAGGIATSGDSSS

SEQ ID NO: 98885 - protein, 72 aa, Glycine max
  Coding DNA Sequence Number=SeqID_7200
  Subcellular localization annotation: CTP_CleavageSite=59; ConfidenceScore=5.17e-01
GLVGACALSATLARLARISEFRLSARLFAQRMDSSGALSRISPRSANIHSSSFFHMLPRARPKECCTQRMAC

SEQ ID NO: 98886 - protein, 126 aa, Glycine max
  Coding DNA Sequence Number=SeqID_7201
MARAQENGSLWRGLKTVNFREHRAEQGAKFSSFREISEFLRDCEIPRGGGVIPTPLGYIYLGCNTENKRGYISCGSVQVEGTSTWLFKENKGGYIPCGSLLVKDFTRDFSIGKCTISLEHDRAGTE

SEQ ID NO: 98887 - protein, 253 aa, Glycine max
  Coding DNA Sequence Number=SeqID_7202
  Subcellular localization annotation: CTP_CleavageSite=68; ConfidenceScore=5.15e-01
MQTINNKECSAKQKEKTHKVPKQKNSEALPLSHAAFFFSSSSTIVAQQSSNLWPSFLLQIAKGGHFQEAKMVSGLKTRSGSHEGFWLRKGTGTLWRPLRDGSLVIDYQIVMAAQLIHDRVEMECLEGAWETLEGNTRCRFRGTIRFTATSLVHPDEPARTLQRTVEWILPMPTPYRLVEPVQVIEVTSSEEDPEEDLEELPPEPAVDALDFLEGDEDPLLEVDSPEEVMSASKADSTEDSGPGEMAISGGSSS

SEQ ID NO: 98888 - protein, 167 aa, Glycine max
  Coding DNA Sequence Number=SeqID_7203
PWDFPALITGLCQSFGVPVAPSKVIRPPITRAFIEKYCTQRQVQGDAPQATDASPPHQAGPAESFDMERYLRHLVRQQAANHRAHVQTHDCLYQMSLSLQSQGFTSFPCPTPDQFMAEVAWPGDWLEAQAGEAPAGAPAEAPDEADEAHEDEEMTDLLDFLGGSGAT

SEQ ID NO: 98889 - protein, 107 aa, Glycine max
  Coding DNA Sequence Number=SeqID_7204
MGAKYLEVVKRGLHPNNGWSPDEIRVVQMRAHSVYSRQSTRGSCRLLPCLGIGPVSRPCDLSPKLLRGRAYKRGRALPLLTEAEPVETLMYLYLPTVVGRLLANQIL

SEQ ID NO: 98890 - protein, 36 aa, Glycine max
  Coding DNA Sequence Number=SeqID_7205
AGMEKPRHHAYLNSSGSPIQETQGYHCSRLVRTICT

SEQ ID NO: 98891 - protein, 268 aa, Glycine max
  Coding DNA Sequence Number=SeqID_7206
  Gene Ontology: Mol. function=catalytic activity; Cellular component =phosphopyruvate hydratase complex; Biological process=metabolic process
  Homolog annotation: Hit_ID=A3TPB5; Match level="QueryCoverage=98%, HitCoverage=63%, E-value=1e-115, Identity=75%"; Hit description =Probable starvation sensing protein
  Pfam annotation: Domain name=MR_MLE; Domain location=6-145; Score =50.1; E_value=7.7e-12; Accession=PF01188.12; Description=Mandelate racemase  muconate lactonizing enzyme, C-terminal domain
RRARSCRKLVDSIRAHQAQGYRAIRVQTGVPTLKAIYGIAAQGADVGDATVRYDHEPARRGARPVEEDWDTRAYLNHLPGVFEAVRNEFGPDIPLLHDGHHRMTPIQAARLGKDLEPYDLFWLEDCTPAENQEALRLVRQHTTTPLAIGEIFNTVWDFKDIIRDQLIDYVRGAVTHMGGITALKKTLDYAAMYQIKSGMHGPTDISPVGMAAAMHLGLAIHNFGIQEYMQHGARTDQVFQQSFTWTDGYLHPGNNPGLGVDLDIDEAG

SEQ ID NO: 98892 - protein, 81 aa, Glycine max
  Coding DNA Sequence Number=SeqID_7207
  Subcellular localization annotation: CTP_CleavageSite=25; ConfidenceScore=5.46e-01
MYPLLFSVKTTQVDVPSTCTTKDVPSNVLRQNFQAVSPLNPCKGKQKISQAISPLKSFVYGKGKNQKNSQAVSSLNYLGML

SEQ ID NO: 98893 - protein, 62 aa, Glycine max
  Coding DNA Sequence Number=SeqID_7208
LKIVSQHGLFIVRARFGYLGQDKSCDAILPRKGPITRTMSKRLQEDWARAAEEGPRVLMNLR

SEQ ID NO: 98894 - protein, 56 aa, Glycine max
  Coding DNA Sequence Number=SeqID_7209
MDPKRIKVIPDWPTPPSVEERSLEYEEPLDLRSNPFQGGGDLVDGAFSHLFSFVFR

SEQ ID NO: 98895 - protein, 163 aa, Glycine max
  Coding DNA Sequence Number=SeqID_7210
MKRCLCDARYECIYGLEGPKNYLFLLAHLGVQCPMRAIKKVIWTFWLLVTKDKTNIQRMRDNMMQMRKSATGDAHSMAISSNNHTTKAYMTFRFTSTPYGPVATYPLAGGRRVTRGMRVPRKEYARSRHQRLFEENVGKTGKDAIYELLSERFGSCIYARGRY

SEQ ID NO: 98896 - protein, 101 aa, Glycine max
  Coding DNA Sequence Number=SeqID_7211
MSQNFTDCLTMGVKYLKAVKQKLQAIKQWSPDEIRGKGRIKRILRLCRFEFFDKGEGRHNKIQAVSPSFFWKREKRDTKKFRRLVLGEFFLAKGEWNEKEE

SEQ ID NO: 98897 - protein, 134 aa, Glycine max
  Coding DNA Sequence Number=SeqID_7212
  Homolog annotation: Hit_ID=A2Q4N7; Match level="QueryCoverage=30%, HitCoverage=8%, E-value=4e-07, Identity=60%"; Hit description =Polynucleotidyl transferase, Ribonuclease H fold
MILEEGQRSNLSIHPGATKMYQDLKMMFWGLNMKREVVVIIKKGENVNHEDFDDIKKNLLEKGGDVNHASFDGVEKKSHVCHHQKGGECESLFQDSLKTKPCLKTKCFQDMQGSGNRLPGSVIDYQKTGLRNSC

SEQ ID NO: 98898 - protein, 80 aa, Glycine max
  Coding DNA Sequence Number=SeqID_7213
MQSQGFAPFSCPTPDQFRAEVAWPGDWPEAQAGEAPPEAPGDGEEAHEDEEMADLLDFLGGSGDTVNAVKIFPDAQNGLG

SEQ ID NO: 98899 - protein, 194 aa, Glycine max
  Coding DNA Sequence Number=SeqID_7214
MGDQEEVQEQIKADMSTLKEQMASMMDAMLGMRQLMEKNAATAAAVSSAAEADPTLPAIVHHPIPDVVGQERSTLGHISNPHLEYNRVAYPYGLTPNYTPPVICDDAGRVPPPILEGEPPRQSDEVHEDRREHAQGDINSHSPFPAEEPALNALPQPNLMGKPRNPSAQPIFFSAYEPPPVAKKGGSSISSKRD

SEQ ID NO: 98900 - protein, 35 aa, Glycine max
  Coding DNA Sequence Number=SeqID_7215
MKHSSKLEGGGHMNSAIMKHSSKLEGGGHMNNARQ

SEQ ID NO: 98901 - protein, 109 aa, Glycine max
  Coding DNA Sequence Number=SeqID_7216
MATKGTRNGTVATYPSAGRRHEGSRCIFQGRKARGVTTNDYSRKTSEKPERCGLRTLIVKGSGVVFTHGEGCFPRSYVSSIAKRKSNLCSSFRTKHWLSCFDLFPQDRF

SEQ ID NO: 98902 - protein, 92 aa, Glycine max
  Coding DNA Sequence Number=SeqID_7217
MDFNSDDFMDKLREALRNVDMRDERWRPRRGEPRPNVDEFKITELPEFNGSADPEVYLEWERKIDRMFDFKDLDDEKRCKYAILKLSKSASL

SEQ ID NO: 98903 - protein, 103 aa, Glycine max
  Coding DNA Sequence Number=SeqID_7218
DFLSVVSLVTIFQRNERGFEAFSPHGQDHLGLPSGMETKHERQKPIKVLKDERKRGWGHDRPIVTLLCAKQAGNVAARQPPPNSDLSKFKLGKMLIPEKGGDM

SEQ ID NO: 98904 - protein, 128 aa, Glycine max
  Coding DNA Sequence Number=SeqID_7219
GSHPQDTQWTRWSPTGPWGFQLWLRASINPTGCPSPLARSCHRDIGITPARHPMDPEKSNRVLGFPTLIMGLCQFYGVPVAPSKGETPQQPGDGRQGATDAPPPPPEPLSSSTKVGALPTTRGRPVGD

SEQ ID NO: 98905 - protein, 131 aa, Glycine max
  Coding DNA Sequence Number=SeqID_7220
IIPFEKHITAAGTTSNNMLSKRKTLDEGSLLSSKSETQHDHRFTSTPYVPMDTSIGPLFNLPCVQKGVGVVKKETDERENTTFEQKINRPNSLKTIPSGVTNYVNLPFAGRATRGLTGASSKGGRHAESPP

SEQ ID NO: 98906 - protein, 273 aa, Glycine max
  Coding DNA Sequence Number=SeqID_7221
  Gene Ontology: Mol. function=ligase activity
  Homolog annotation: Hit_ID=A7NZE6; Match level="QueryCoverage=22%, HitCoverage=5%, E-value=2e-27, Identity=93%"; Hit description =Chromosome chr6 scaffold_3, whole genome shotgun sequence
MELVTAVLGDHGQRPQEDYAVVTAVTELGNGKPKFYSTPEIIAFCRKWRLPTNHVWLFSTRVASEVVDISTYVCKKRFVTPAFIYITLLSSLPMMPYVRRVLQLLYARLLMKLQTSLYQSLVSILVSSFMASASIPPPPPPPLNGGTLLGSAVVVTAKEYLHSISQKLTNSNYLLWCQQVEPVLKGHHLYHLLAGLQIPPRHLTIADCNAGITSSFGSNKISFFCRGYSPLFLVKFFHDSSDAKLLGIFGISFIHISTPLFSTTVPFLTIFLG

SEQ ID NO: 98907 - protein, 686 aa, Glycine max
  Coding DNA Sequence Number=SeqID_7222
  Homolog annotation: Hit_ID=A5BKG3; Match level="QueryCoverage=99%, HitCoverage=98%, E-value=0.0, Identity=62%"; Hit description =Putative uncharacterized protein
  Subcellular localization annotation: CTP_CleavageSite=43; ConfidenceScore=5.81e-01
MASPSPPKSKFSVYQNPSFSAVLTSNSLQPSNSTILSILSFFSASAFVFLAAFFRENGFVHILCFGTLSPVTAYWLAKTLQAIVGFIFIGTVSALFNVVFLRRARYAGGGAAVAAKSLSDSNSVHRNEILLTKHQLGLLGVKPKVDLVQPDSAKKPPKSKPQLPSSGLLVPLHQPIPSPTRGSSSRIDADGSNSNRGGAARSIGTPSRSPGLASLYLSPGVVSPPRSLAGVDSVVSSPWSNRRVSSANKITSEEKLERFLAEVDERINESAGKMSTPPPTVPGFGIVSPSTVTGSANTSGTARRTPLRPVRMSPGSQKFNTPPKKGEGEFPAPMSMEEFVQAFEHLGIYPQIERWHDRLRQWFASVLLNPLLNKIETSHIQVMQAAAKLGISITISQVGSDMLSTGIPSALPTIDKNQEWQPALSLNEDGLLHQLHSTLVQAIDSSKSKLLVSNMQQSPQQTSLVSIMQDCVDAITEHQRLQALVKGEWVKGLLPQSSVRADYTVQRIRELAEGTCLKNYEYLGSGEVYDKTNKKWTLELPSDSHLLLYLFCAFLEHPKWMLHVDAMSYAGAQSGKNPLFLGVLPPKERFPEKYIAVVSAVPSVLHPGACILAVGKQGPPIFALYWDKKLQFSLQLWICQGRTALWDSILLLCHKIKIGYGGVIRGMHLGASALSILPVMEAEYED

SEQ ID NO: 98908 - protein, 139 aa, Glycine max
  Coding DNA Sequence Number=SeqID_7223
  Gene Ontology: Mol. function=structural constituent of ribosome; Cellular component=intracellular; Biological process=translation
  Homolog annotation: Hit_ID=Q9SV23; Match level="QueryCoverage=48%, HitCoverage=31%, E-value=2e-18, Identity=62%"; Hit description =Putative uncharacterized protein F3L17.30
MEKLAQIRFQSRLHSFPSFPLSQNTPSDGLTVAALGGDGGATLFSDLTSINDMAFRGKEMLKKVLKTVGENGLSRREKESLERCLPRSKIVMNRAKRGLFAGKHIQFGNRVSEDGGNNNGGMFHAVATGVRSVFTASVV

SEQ ID NO: 98909 - protein, 177 aa, Glycine max
  Coding DNA Sequence Number=SeqID_7224
MTFSVCGKRIVRGAVDIEKGAVGLRQDAEGRRELRRDDGNVVLDAAVPVILCPRNIFNKYKNKHILNIIQRQLDLMDTENPMYSPQGIPLKGYQNIFAIIPSLCKEEGYIGSKYAIDHLNCRHVYALCTDASKVNLYTVKSTSLQSGIRPIRVIQKTHISHVTVYAINAILILLRKC

SEQ ID NO: 98910 - protein, 74 aa, Glycine max
  Coding DNA Sequence Number=SeqID_7225
MSNKAFKDGYLLLTVLENKWQRNGERKREKRRHFKEKMSLEEAHHHRRPWIIAWRKKEMNEGRGREEHEILCSK

SEQ ID NO: 98911 - protein, 309 aa, Glycine max
  Coding DNA Sequence Number=SeqID_7226
  Gene Ontology: Mol. function=oxidoreductase activity, acting on the CH-OH group of donors, NAD or NADP as acceptor; Cellular component =mitochondrial inner membrane; Biological process=isocitrate metabolic process
  Homolog annotation: Hit_ID=A7QX64; Match level="QueryCoverage=16%, HitCoverage=17%, E-value=1e-14, Identity=76%"; Hit description =Chromosome undetermined scaffold_213, whole genome shotgun sequence
  Pfam annotation: Domain name=Mito_carr; Domain location=103-185; Score=26.5; E_value=1.1e-05; Accession=PF00153.18; Description =Mitochondrial carrier protein
MEVRKTKGKHSTLTIYTSFLLLLRVDVMTELALLKGRYKERLDKCTNFLNIVSISNPLYSHVQEVYEERYEHRLIDEMLAYAVKSEGRYVWACKNYDGHVESDLLAEGVVTGAVTTPLDVVIKTRLMVQGSQNHYKGISDCVRTIVKEEGSHALFKGIGSETSVYPELANFFTFALSMLYYFGFMCKIYKHNYFILGSCCRESACYYIGAYLTNNVENSSYNISALATTDVENPGYYIGAYLANDVKNPSYNIGASATTVVENPGYYIGAYLAKDVENLGYNIGASATTVVETKVSTSNKWVAPYSKTM

SEQ ID NO: 98912 - protein, 85 aa, Glycine max
  Coding DNA Sequence Number=SeqID_7227
MCEVSRFGKALKRIGEASFQLLKMFQTPHNRLPKVVIDYMFRQRKLMQSYPARALGRRLQVDWARDPREGPRVLMSLRVYFEPMG

SEQ ID NO: 98913 - protein, 529 aa, Glycine max
  Coding DNA Sequence Number=SeqID_7228
MENLPFDLSHTIYINILRNLKGLGGLDDIYYAALINKMLCDQGMYHVFNKMDNDYKHTLIAKGSVVAKQQKFGKTNLKVMKVALEQSQNKAPQVDLDAINKRKQKRLTKAITNKDQGLNSFGISKKIQKIMVKANPRKPFIDAQRFLLAFINGNSMFETPYSEFISIAPVQRETISVQATTWTKCDYEHSPSEAFKALPTYAIIHLPFPQWTCPVQLNIIKMQPHWLAPGTQQRVHPSIEKKVHLWTLITKLLLVPPTDLNLSQEDRLSLSNLHAQMYVRDQSPAYPVGLHISRATDVKIVVDKVCPRLPIWDATKKKGFKLYNNKEIPLRKMKVETVNHLHNWDSLFSGKRLVYAPGAYEARTFWNQIVWMDTQKASTFGYDVSGNVEHHDIIQTLHPVRKKCFLRPEASTKVMDDTIVHGVIINLINIGIMDVTPKTSDAAIVDEVEHNALEPRSKDQVKDMIGQAMESFTKFQRQENKQFRLSMKNAITTQFSNLVVVAPAPVLVPPPPPPPSSPSPSQPQPPPHA

SEQ ID NO: 98914 - protein, 175 aa, Glycine max
  Coding DNA Sequence Number=SeqID_7229
MGCTHGPEIYPKAHENPKAFSCISGPIFLLSSIQCPWGAGLHQYVYLAARWRQFKSTLATKFVYADTEGQLQQQDPSVKYGLDQQTWEEFAASRKTANWQNCLQGQTTQGTFVPHGRDDILTTTIGRPEHPGRVRATGSGMTISHYYGRASHGSSSSSTSITQQQLADIIGNLKE

SEQ ID NO: 98915 - protein, 186 aa, Glycine max
  Coding DNA Sequence Number=SeqID_7230
  Subcellular localization annotation: CTP_CleavageSite=28; ConfidenceScore=5.01e-01
MDWSGVLSEMALCSANMHISSFFQILPRAQPRSVALSGWLAKLTGWLSKRVKINTIQTRLINLKNLTITHRLISCSPDGFLFKLSSLPVFGQQKLSKLSGTWTFLSLEISKNTEAQGKAQTPSPFLISGLNRWPSHPSSKFFLALSRKSGALSGWLAKPADWLSEQIKISTSQTCLINLKLKGNDY

SEQ ID NO: 98916 - protein, 51 aa, Glycine max
  Coding DNA Sequence Number=SeqID_7231
MTLRQHRLSLGSSSSMDSFASWRMNDSGMEKEEREEMPLQGEDESRRSSPP

SEQ ID NO: 98917 - protein, 665 aa, Glycine max
  Coding DNA Sequence Number=SeqID_7232
  Gene Ontology: Mol. function=protein dimerization activity; Cellular component=nucleus; Biological process=regulation of transcription, DNA-dependent
  Homolog annotation: Hit_ID=Q2HSV9; Match level="QueryCoverage=99%, HitCoverage=85%, E-value=0.0, Identity=67%"; Hit description =Transcriptional factor B3; Auxin response factor; Aux/IAA_ARF _dimerisation
  Pfam annotation: Domain name=Auxin_resp; Domain location=291-374; Score=169.3; E_value=1e-47; Accession=PF06507.4; Description=Auxin response factor
  Pfam annotation: Domain name=B3; Domain location=164-269; Score =108.7; E_value=1.8e-29; Accession=PF02362.12; Description=B3 DNA binding domain
  Pfam module annotation: Pfam domain module=Auxin_resp::B3; Domain location=291-374::164-269
MEIDLNHEVTEVEKNAFCDRECEKGVGVTCWSSSTCSSSTSSSSALVSSSYLELWHACAGPLTSLPKKGNVVVYFPQGHLEQVASFSPFTPLEIPTYDLQPQIFCRVVNVQLLANKENDEVYTQVTLLPQAELEGMYLEGKELEELGAEEEGDDRSPTKSTPHMFCKTLTASDTSTHGGFSVPRRAAEDCFPPLDYKQQRPSQELVAKDLHDVEWKFRHIYRGQPRRHLLTTGWSIFVSQKNLVSGDAVLFLRGENGELRLGIRRAVRPRNDLPESVIGSQNCYPNVLSSVANAISTKSKFHVFYSPRASQADFVVPYQKYVKSIKNPVSIGTRFKMRFEMDESQERRCCSGMLIGTSDLDPYRWPKSKWRCLMVRWDEDIETNHKDRVSPWEIDPSAPLPPLSIQSSPRLKKLRTARGRGLIDFEESVRSPKVLQGQENAGFGSLYYGCDTVTKPPGFEMSSQSHPNLGSAEVRKITSSELSSVHPFSYAGFVETNRFPRVLQGQEICPLKSLTGKVDMNLGAWGMPNLSCTTFNLHQATKPSFQLSLFPYGDIHQASQASLFCSKSTTFQRENVPFNKPSTQAGIIVNEVGRSDLPNDHKLQGNNISAAGNMGVSIDNNVQGKVNACKLFGFSLSGETTTQNLQNSAKRSCTKVRDDNNKIML

SEQ ID NO: 98918 - protein, 191 aa, Glycine max
  Coding DNA Sequence Number=SeqID_7233
MNGTRSYTHSEKKNLTGMVSNTGFRDPDQIHDREEESNGGAGGTIAVELAEDVERGDEADEAEAHDEHHRGGDLEAWSVVSIEPQHVASSGAGASTDGGGACSSAEATTAHAGGGGSGAARSHHARSRGGMGRCGLRLGGASRHVEDHEGKGGVVGERNSVGSMGSIEAQNYLCCQKLCLFNIICLTYPLV

SEQ ID NO: 98919 - protein, 275 aa, Glycine max
  Coding DNA Sequence Number=SeqID_7234
  Gene Ontology: Cellular component=anchored to membrane
  Homolog annotation: Hit_ID=A5B492; Match level="QueryCoverage=50%, HitCoverage=64%, E-value=1e-35, Identity=55%"; Hit description =Putative uncharacterized protein
  Pfam annotation: Domain name=Fasciclin; Domain location=83-218; Score= 97.0; E_value=6e-26; Accession=PF02469.13; Description=Fasciclin domain
MDFFTVAKAPAKAPSLAPEAPKEDKEKSLSPDSSESSEINSTNDNSGTVKSICMEMSPNGAPTPATAKAPTIDIAQILSKAKRFSVLIRLLKTTQLINQLNSQLLTSGSGGLTIFSPPDSAFSKLKAGFLNSLNDKQKVELLQFHTLSSFVSISNFDTLTNPVQTQAGDDAQRLQLNVTTYGGNQVSMATGVVNATITSTVYLDNKLAIYEVDKVLLPLDVVLPKPKAPAPSPFKGESPKTKSYTEESGDGNKNSDDDGAVTVNASAGSVNLINN

SEQ ID NO: 98920 - protein, 172 aa, Glycine max
  Coding DNA Sequence Number=SeqID_7235
MAIYWKKPFWGKGSSPRRAGCLGTKPFHGLGKPDASLGELGAKGVIALSELNAFSAHQQLSPAPACLASKGESGKTYVTQIRAERVISSLSESSRENGAERDVKIKKPFLSLICTELRGSEENYSILKCLKSVNFRERRAEQGAKFSSFREISEFLSDCEIPRGGGDIPTPL

SEQ ID NO: 98921 - protein, 395 aa, Glycine max
  Coding DNA Sequence Number=SeqID_7236
  Gene Ontology: Mol. function=aspartic-type endopeptidase activity; Biological process=DNA integration
  Homolog annotation: Hit_ID=A5ARL5; Match level="QueryCoverage=42%, HitCoverage=11%, E-value=9e-22, Identity=32%"; Hit description =Putative uncharacterized protein
MEWLLDPESHRNCISDPLEKLPDASLLLDAPTVSSNLMSASDHFSRVAAAQAENASRKRDSNGMASSTVRSKVPRANLPHSRNVPETSGSMLVPPQISGSIIIQVSESQFGIIAGQSRSAWFPLPAIVSSHRPPPMFIWQTPDLECLSERGRTQVVTGPISFPRAAFVHHLAPGPFLGPDSSFLPCLVCGFECNPFLVLGLIFLTMPNKRITRKDHIECTFCKRNWAYLEKCLNLFGIPNKTTDASKLKRAEPKFSDEEYQEYLRLKASRQAQPPLTSSISTACISQSMDIQGPWVIDKGAFDHISGDASLFTSMSSQKFPHLINFANGSNEGGTGLTIGVGRESRGLYYLETSSFVSCVAAPSPKLLHDRLCHPNLSKLKQMVHDLIRLQVLRV

SEQ ID NO: 98922 - protein, 232 aa, Glycine max
  Coding DNA Sequence Number=SeqID_7237
  Gene Ontology: Mol. function=protein dimerization activity; Cellular component=nucleus; Biological process=regulation of transcription, DNA-dependent
  Homolog annotation: Hit_ID=A7R7T9; Match level="QueryCoverage=91%, HitCoverage=88%, E-value=2e-48, Identity=48%"; Hit description =Chromosome undetermined scaffold_2023, whole genome shotgun sequence
  Pfam annotation: Domain name=bZIP_1; Domain location=72-138; Score =22.1; E_value=0.0015; Accession=PF00170.12; Description=bZIP transcription factor
  Pfam annotation: Domain name=bZIP_2; Domain location=72-129; Score =57.8; E_value=3.7e-14; Accession=PF07716.6; Description=Basic region leucine zipper
  Pfam module annotation: Pfam domain module=bZIP_1::bZIP_2; Domain location=72-138::72-129
MDDGNAELSDKLSDNNVLFLNPESCSSFQASSSSRTCTHTHTCNPPGPDAAHTHTCYHTHTQVFAPEDDGRKHSNSKQKRPSGNREAVRKYREKKKAHTAYLEEEVKKLHMVNQQLVRKLQGQALLEAELARLRSILARLKGKIDSELGAWPFQKQYCNTSYIFKEGDAGLECQKNNLPCFHPHVGSSSQVNICACGKSMIPLDGNCQPEMPDKNVFLVSFYPIAITDDLFV

SEQ ID NO: 98923 - protein, 139 aa, Glycine max
  Coding DNA Sequence Number=SeqID_7238
MPRDGGIYNSCSAPNDGEGNDHNDNRHFTCVLLQEDGGIYALEFCRSVLAWPKSPQTPHNPMYQYPPHQYNYSANIGSPPCPTPFRPRMPNQPQRPPQHHPQNPFPTQPKPSANPNLNTNTNPRRNFPKRKPVEFTLIP

SEQ ID NO: 98924 - protein, 55 aa, Glycine max
  Coding DNA Sequence Number=SeqID_7239
MQEQIEEAKEHHLDEDALIPHNVAPCRACRTWIFFINGILCFLKISGSKMEKEER

SEQ ID NO: 98925 - protein, 538 aa, Glycine max
  Coding DNA Sequence Number=SeqID_7240
MVEPQHVQGLQVCQDPPAWTSVVQVALYGVLMLVVLQENSECALKRDILFLFVASGFAWTFLVKHVGLPGDDVPPSTVEPLVGKMGQLATRFGPDDDEAVEHDDGVGVSEPKKSSVEAMPSKNKRGYISYGSVQVEGTSTWLFKENKGGYITCGSLACKGFYKVEKKSQKSPFDPTSRAPFSLQDLKLVTGLMSGLTRSPSVSLVIQATIAALTPSTPSSLPTQEVSVSLSTMVAALVPLAAPIMAPPSITVTPLLSVGVVTMSTLVVPPPSSSTSPVSTSFVLSLVLPSFSSCPVSPYIMVSSLETKVAEWRATTRTIWRVKHPKVVNVTVTLDEATRHYKDLLREKNDLTDKVESTIVEKEELVVESIKVITGLRAQLKESESKQEEFELKASKGRKASKELKEELLEFKKEAMEPHKKGFYKAVRQVGFFTKDLNLGLFDPFKDFQRSKLTKGMPWVSIGILTKDGPWVSCVPTKIKVDNKEACQGWTLHTLDSRKQGSPRPDLGFDEPLEKLDSPRGDLGFDEPMDNPPGMHQS

SEQ ID NO: 98926 - protein, 378 aa, Glycine max
  Coding DNA Sequence Number=SeqID_7241
  Gene Ontology: Mol. function=protein kinase activity; Cellular component=integral to membrane; Biological process=protein amino acid phosphorylation
  Homolog annotation: Hit_ID=A7Q7E7; Match level="QueryCoverage=58%, HitCoverage=21%, E-value=2e-75, Identity=63%"; Hit description =Chromosome chr18 scaffold_59, whole genome shotgun sequence
MQRNLTVVTNNWFNDLPQPNHLLPYGTFVFSSDGERRNCLLIWYIGDHNPALCFKPIRELTEISALTQLLLANNPLLSGEIPKFSEHVEVVSSETGLGISISGSSHCNVLVGLVILLIVSVSRHYYRVNDEHLPSREDHQHPQVIQSNLLTPNGIHRSSIDFYKAMEAVVEALKDVTLKTRFSTYYKVIMPSKSIYFVKKLNCSDKILSVGSHDKFVKELEVLAHLNNLNVMTPLAYVLSIDTAYILYEYISKGSLFDVLHGSMENSLDWASRYSIDVGVAQILPLLHEFASSPIMLLDLTSKSIMLKSLKEPLVGDIEQYKVTDPSKSTRNFYAVVGSVDYIPPNQKLFNLIFLPISLSYMFIHQRLYKFLGAMGVK

SEQ ID NO: 98927 - protein, 143 aa, Glycine max
  Coding DNA Sequence Number=SeqID_7242
  Subcellular localization annotation: CTP_CleavageSite=40; ConfidenceScore=5.11e-01
MFLLPFVFKPPTRKNHNLGTNMSFHSSSSVNELNSLCFVGAQNRYYEAPNPYDRWYNECVSGATLFCKITHASSIFMIHMHRNSLGSDQGVPTNPKRIKVIPEWPTPPSVEGRSPEFQEPIDLRSNPFQGGGNGAILPPKGIG

SEQ ID NO: 98928 - protein, 218 aa, Glycine max
  Coding DNA Sequence Number=SeqID_7243
MEWREVRRREMRRRSFSKHQSTWRQSNKVVGRWMGHKDEDGEYLKLYKRGVEVDDREFSTNHGKRDEENKWVIYQYSEKAGHRGAHAHLGISYTNSTRKIIPKFDTHGRREFLYVEEPIESRECLNFARFFNRMNMKDLVNTMIRVHITKDIFEIKLVEEEVEDCANRLLCRKCAVSLVMNVDTNDMEDDFDESFINGDIQRFLAKDLKLNSNLNFKS

SEQ ID NO: 98929 - protein, 116 aa, Glycine max
  Coding DNA Sequence Number=SeqID_7244
MQGCWKTRGDAPGTGKLEELASVGENYDSNLGVTENGKFLSLLEQPCSPLRERDLSAASIVDSFDLDFPSTHWLYFLALSEMRKHAQLNEELIRGGGGALGGEANSGLKIRTKTLS

SEQ ID NO: 98930 - protein, 870 aa, Glycine max
  Coding DNA Sequence Number=SeqID_7245
  Gene Ontology: Mol. function=nucleic acid binding; Cellular component= cytosol; Biological process=regulation of transcription, DNA-dependent
  Homolog annotation: Hit_ID=A7NZC1; Match level="QueryCoverage=100%, HitCoverage=100%, E-value=0.0, Identity=53%"; Hit description =Chromosome chr6 scaffold_3, whole genome shotgun sequence
MSDEGERTCPLCAEEMDLTDQQLKPCKCGYEICVWCWHHIMDMAEKDDTEGRCPACRSPYDKEKIVGTAANCDRLVNGVNIEKRMKTQKTKSKSTDGRKQLSSVRVIQRNLVYIVGLPLNLADEDQNSVSTVRGSPPNGIYGKNMALPTSAAWGTQVTNCQPPAGGLSYPNGPSKPKPDTGSSTLVFSAAVTGSIQASDVTKRPPSSNGSHSMTPRVKSELLKPVKQYNNSVDSLVSEGEKTLASDVSPMLVNLNRQLSPLPLSRDSDGNCTTANTINSTNMIGQSCNFGLEEAMTATNEEIQNLSNELSSINIDRNAEHCGITKPNNSPPTDHALIKSPQIQGSQYNVDRFRDEITTDVAGKATSDFLVCNSTEQCDWKLDSQSLVVSDNAEIDDDVTSFDNQRLKDPEVVCRSYFPKSTRFLQASNHSSPCLLQHGEPCTAINAGSVSADDRVRDESMLHASNILCNGHPEKLVSSSSYGLLHDERNGHIIQRLVGEAVNSGHDIARDKGESSIISNILSMDFDTWDDSLTSPHNLAKLLGDNTDNQPGPLNKSSSWKGHSNNQSRFSFARQEESKIQMFDPHASYGVSHQRPNRTVFLNCAERDLYMDKLGIANGFSTSNFEEAENMVSGHSIASSNKFSAISRAQVSAPPGFSIPSRLPPPGFSSHERVEQAFDSISGNSLLDHSSLLRNSYQTPSAGNLGSAGDIEFMDPAIMAVGKGRLQGALNSPALDIRSNFMPQLNYFENDARLQLLMQRSLVPQQNLRFSEIGNTFSQLGDSYAVSSRLDQSQVSNLGPFQQLSLQQSTNAVLSNGQWDGWNEVQSGNGLGVAELLRNERLGFNKFYSGYDDSKFRMPNSGDLYNRTFGM

SEQ ID NO: 98931 - protein, 113 aa, Glycine max
  Coding DNA Sequence Number=SeqID_7246
MVKPKGPMAASGGGRTEAKEEVEVAEADVGVDGDHEEAKTGEGEADVGGGGGLAHATLAGGDDGDAGGGAGELRLAIPLEEGGEMTLGRGEREREREKKKMNDDEEEAQWWSE

SEQ ID NO: 98932 - protein, 222 aa, Glycine max
  Coding DNA Sequence Number=SeqID_7247
  Gene Ontology: Mol. function=N-acetyltransferase activity; Cellular component=cytoplasm; Biological process=metabolic process
  Homolog annotation: Hit_ID=A5BAL6; Match level="QueryCoverage=96%, HitCoverage=92%, E-value=8e-80, Identity=72%"; Hit description =Putative uncharacterized protein
  Pfam annotation: Domain name=Acetyltransf_1; Domain location=45-161; Score=55.9; E_value=1.4e-13; Accession=PF00583.15; Description =Acetyltransferase (GNAT) family
MVCIRKATVKDLLAMQACNLFCLPENYQMKYYLYHILSWPQLLYVAEDYNGRIVGYVLAKMEEETTDCHGHITSLAVLRTHRKLGLATKLMTAAQNAMEQACHSPYPPFFSFSFHSFFLSCIRDRGCSPTHWVFGAEYVSLHVRKSNRAAFNLYTETLGYKIHDVEAKYYADGEDAYDMRKQLKGKQHHHHHHNHHHHHHHHHEHSGGCCSGEAKGNPAKAT

SEQ ID NO: 98933 - protein, 32 aa, Glycine max
  Coding DNA Sequence Number=SeqID_7248
MEKCILVEMNYGSGGHEGLNLFVVGSRSELVE

SEQ ID NO: 98934 - protein, 212 aa, Glycine max
  Coding DNA Sequence Number=SeqID_7249
MPINTPHFPTCEKCGIVHGHENARQGQDFGKNQNQGMYRPPPMQNQWPRQEERQPTFQEIMLQQSGNRLAQFELNPKNEDDDTSLKAINDILIEEDQAPKKDKTPTDGNQVHDKEEDKKKEILMSPKADEDVPTILGRTFLSTGLDAFPSLGMPDPPETVLTDEDQDRELNLDMEETVTLLQTHPSPRTSYFERLEYGNGPKEKPSIEEPPE

SEQ ID NO: 98935 - protein, 327 aa, Glycine max
  Coding DNA Sequence Number=SeqID_7250
MAKFDPDIVLEFYANAWPTQEGVRDMRSWLRGQWIPFDADALSQFLGYPLVLEEGQECKYGQRRNRADGFDEEAIAQLLCIPGQDFARTAAGRRVRIMRTNMTTLTQIWMTLLLSNIQPNDHNSDLPLPKCQLVYAILTRMSIHGAQLIVDAIYLFAGMPPTRHPLDPDKSNGALGFPALITGLCQSFGVPVAPSKVIRPSITRTFIEKYCTARQAQGGDPQAPDAPPPPPQADPAESFDTERYLGASRVASRRPTTGRTCRPMTPYISLASACRARVLLLFHALLRISSGQRSHGLEIGLRPRLQRQGRHPQRLLARQMRPARTRR

SEQ ID NO: 98936 - protein, 114 aa, Glycine max
  Coding DNA Sequence Number=SeqID_7251
MSTKPQKESNGDKDNESEEDDISMISTGSWVRFPKEERCADSPPTFICEKRRKNRRKPVKTKILSSGVVFTLEEGISTSHVDKSGALAPTYPPSKRKSDLRSSSLRVNQAILFT

SEQ ID NO: 98937 - protein, 183 aa, Glycine max
  Coding DNA Sequence Number=SeqID_7252
  Subcellular localization annotation: CTP_CleavageSite=55; ConfidenceScore=5.13e-01
MNNMISLQHTTIKASFETSTHMGGHVFKATSDKRLLGMVSRLSFSNQGLLEPEVSITEDMKTISKRFEELDICGKVTLKKKVKTICAQKKPMSKQQRLTKRDSSYWEYVDALHSSQNNLWSLVFNHLLKELTKWSNEYINLVGGIDRFEELKQSLLVDGLSMVTMDKWMNITDMGYVIASRYF

SEQ ID NO: 98938 - protein, 31 aa, Glycine max
  Coding DNA Sequence Number=SeqID_7253
MSGGRDESAMFELGREEDESSMGDCDGAGDF

SEQ ID NO: 98939 - protein, 434 aa, Glycine max
  Coding DNA Sequence Number=SeqID_7254
  Gene Ontology: Mol. function=receptor activity; Cellular component =integral to membrane; Biological process=translation
  Homolog annotation: Hit_ID=A2Q492; Match level="QueryCoverage=76%, HitCoverage=65%, E-value=1e-130, Identity=69%"; Hit description=Lung seven transmembrane receptor
  Pfam annotation: Domain name=Lung_7-TM_R; Domain location=180-416; Score=113.4; E_value=6.6e-31; Accession=PF06814.4; Description=Lung seven transmembrane receptor
MSSRRACSTSPSLNPTHTKCPFETLKFLLTLLDFPSTTFASIHIYDHEPFRELGNSYLLAGGSEGIVASQANSIHDDGRSYIRFENITFRRTKASTKARGSVSLHIIIFEAVDRNDIGGSAYGGQREICCSSDLAKMRVCKQWEIIRRPFATNINWAVILDVQFKGRSKTASLNSQKVSITKTGMYNLFFVACEPKLKGIVMSGKTAWKNPYAYLPSRMAPLMSGKTAWKNPYVCLNIIWFFQYVRFWDDVLQLQHCIITVIALGLFEMILWYFEYVNFNNTGMRPIVLTTWVVTVGAIKKSISRLLILSVSMGYGVVRPTLGGLTSKVLLLGITYFLASEKFSNALAVTVISSVAWIGYEVDPSNNLPLECVIRRVFKSSERDECICCSALLTLLDYEMIMICFKCIPVQILKSTKADGWWIWSGQLEYCMRI

SEQ ID NO: 98940 - protein, 141 aa, Glycine max
  Coding DNA Sequence Number=SeqID_7255
  Gene Ontology: Mol. function=cysteine-type endopeptidase activity; Cellular component=extracellular space; Biological process =proteolysis
  Homolog annotation: Hit_ID=Q3Y6U7; Match level="QueryCoverage=43%, HitCoverage=24%, E-value=1e-12, Identity=57%"; Hit description =Papain-like protein SPE31
MEIKQPVSVSIDATDLQFYVAGVYGGENCSKNSTKVTLVCLIVGYGSMGGKDYWIMKNSWGEEVPRRYTFFIVGKRFQSRLLMEINYMLAYGSGEASLRLLWRFRLLDILLPFQATYFVRGGFRRRDKRTNFGNPILLYEV

SEQ ID NO: 98941 - protein, 185 aa, Glycine max
  Coding DNA Sequence Number=SeqID_7256
MVVCGSYWWLWVVKKKLGTLGKGFGRKKEKGMVVFQGYTKNNVRNTLVLLLSRKEAFLTHKKTYRRSQRSDCGHVPMNLQTKFREDPTWVKRASIAKCSFSALSATEESARLYAQLALSSNPLTRAKREGGAKGNGTMPRAQNSTAHHSVYFRKRALEAARGAAFVEIPRFCKLIIVRVSSVMAG

SEQ ID NO: 98942 - protein, 353 aa, Glycine max
  Coding DNA Sequence Number=SeqID_7257
MTLQDVSQACLYILNNTQEAYSAHFCSASDNNSIEALMPYFGVIEEIWELDYIQFRVPIFKYPCNSTLSVVLQGRPIGINHQNDDSILDICEMPAFSTKIPSITEENEVDEVYANCNDHDEGLWENTHMIMGTPPRSPPHSDGHSEPTSRKSKQSTRLRRQFKSTLTTKFVYDDIDGQDKQDPSIKYGLDQQTWEEFAASRKTPNWQNSLQEQTTQGTFVPHGRGDILNTIIRRPKHPGRVRATGSSMTISHYYGRTSRGSSSSSTSITQQQLAEIIGSLKEEWRNELEKEKKRSLEKMKQELKEGSNVDIVVNSSGEEHVDYMMLTMDDVVRVSVEKVVEGEAQVPFLTSEI

SEQ ID NO: 98943 - protein, 133 aa, Glycine max
  Coding DNA Sequence Number=SeqID_7258
MARKDKLWSFCAFPSRPDRVRWHAETNYGHSAPCVNQEERIRQYQDDVGRSVLIIFKIFAGSAGGEIDRPNGTICLLGCDPCLTTLRYLTPIVRQSVKFRNIPEAKEGMIAGVQIAIRPTWTFQDLPTEGGAF

SEQ ID NO: 98944 - protein, 125 aa, Glycine max
  Coding DNA Sequence Number=SeqID_7259
MAVAYFIDIQKLMLCSDVNFVLPSLLALSLILCDGSSTPLYFSHPDFDSRSRSHSNSLWRCLNCSLLALSPSLSLSAAMLLNSHSQLYVVAMRLQKVTLLSWSDRGLSKEEDFGLGGINMDGPIT

SEQ ID NO: 98945 - protein, 211 aa, Glycine max
  Coding DNA Sequence Number=SeqID_7260
MAEVEQTMAELATGPGTDVRPLISPNTKDNQINFPSWVHNNLNHKEENPKGHCKAIISTIECDVGGEEEEEVEESTMLEEEMKTQTNPSTQSMQPSLNPPFFKFSKLSIHKQGDDVRIVKFKKYVKMLQRKKEEPPIEKLTWDMLHRDIKEDKHIPIILGKSFMRTAHVTINAHKGVYTLREGKKQMFYYIQVIEDFPNESAHQQHHHTTS

SEQ ID NO: 98946 - protein, 456 aa, Glycine max
  Coding DNA Sequence Number=SeqID_7261
EKNQEKGNYLINPPHPTPQVMHPKTISSKKIPWKPLEKKTTIQVLRDLSETKDEAPLIPRKVKGSDQYILMQSYPARALGRRLQVDWARDPREGPRVLMSLRLSSSFFRNLLKEASQGGELSYKRASSLSFLSKAHLGGEAPSSMAYSLVDGASSHLFSFVFRCISMTTCPSSESREEPKKKKLTSSDDSFKKTFNAIPQQIIRMDPSQKNLSLWVQWSRNVNIFTFITRFLPSNFVDLNPSKIELDMIDDSHDAHASWNQTIWFDTKKSSISNSGDVPIDDHKDSIEVLCPTKVYHFDDTFACFIKNPEDGFISRLAKLPIIFNKTIFDQNKMGEEEFTACDMHVINELDTFSDQHGEETPLASNVDKATEQHPPASTQLEPSNEATLAHMKQSKDIAPINYIALAVVTKEQIQEMMAQALLKQQEETKQELLKERKKTKLYLQAFAEQQQFENK

SEQ ID NO: 98947 - protein, 112 aa, Glycine max
  Coding DNA Sequence Number=SeqID_7262
GTSTWLFKENKGGYILCGSLLVKDFYKERKSQEAWQRQVARKVVEVMAHKGGWLTIQERWWLMEAQVQVMTGGAGVWVTIRGGWFARWVVGVEGCAGLEVIIGGGVGVVGVR

SEQ ID NO: 98948 - protein, 211 aa, Glycine max
  Coding DNA Sequence Number=SeqID_7263
MVHENYENLEASKHNLWVECEQYKKSLKFSNGKLEQYENLKKQPQDVVTLHQEIEFLRETLSKFVGSIEKLNKMLRYNKFPTDKSGNGYKGKKYVGKISIDLYPLIDNVCFVKGLKHHLLNISLICDSGLNVSFSKEGCVVQDKNRTQLFTTKRKEKREELESEKRYTNRGKILAFQRSDFFSLFVAEYGSPSKEKVGPFGSTQMETCGIA

SEQ ID NO: 98949 - protein, 571 aa, Glycine max
  Coding DNA Sequence Number=SeqID_7264
MYTYSLVEATTRADDVGVALELELKIAGAVEVEVLTPVASIIHSPLSQKHAMTEPISSNATNLTKHSSPNAEAVTLETATVDDLFEKENPVPKEAVVAVLPTPNPVKDDPPLAAEDAAPVEATGVAEALAAAEDAAPVAPNAGTEGAKVVLPVDTVEAVVVVVTVENSGAEDVVNEKVEPEEGLEAAGVPEAVEAAEEAEAEAALGNPKEGVDGFANPENDVVEAADEEAPVLANAPENKGELFAAEEEAFNAPNGVVAAEEDAPKAELESEAEAVLLLLLLPPNGVVAEAVPLNPNSVDEDDVPANAVNEADDGAPNGVVEAEDAAPDGVVEAEDATPNGVAEAEDAPPNRVVDVVVVGVEEAVPNGAVGAEGVPPNAVNEAEGAPPNGVVEAEDTPPNRVVEAEDPAPNRLVETEDAAAPNGVVLAEGVPPPKGDAAAEEAAAPNDGVIADEEEAPDGAVAGEENKGEAEVAAPKIEEAAAAADAGAGEAEEAKEKVRGEGEEDAAEVGFVVKREEDPNEKAGVELSENGEEEEEEGFVKENAEDWEEEDPKEKPDIVVVRYLCFACLE

SEQ ID NO: 98950 - protein, 171 aa, Glycine max
  Coding DNA Sequence Number=SeqID_7265
MVHRGHLEAEGEKTSVMLAGDASRIMCVNFMCQGPARGRVRQCFELVGHMDNVAVFSNGNGSGSLASDTKAGNMARCVATCRNSWALKCCLVRKGSAHRSMTMLVMGSLDGKVIGIPMVYSGAVVEKCTRIGEKSSEKGKVSRKVHRKTGDKKKGPQWSTGFRYSSLSRRT

SEQ ID NO: 98951 - protein, 115 aa, Glycine max
  Coding DNA Sequence Number=SeqID_7266
  Subcellular localization annotation: CTP_CleavageSite=51; ConfidenceScore=5.14e-01
MAPSYDTSMGLGTHDPMPNYMCVLPYSPSRSLSSATSMVDIAMLDRVNDVSDEEENPSEDMSDIRESLGIEEYPAIEGGVLESTRKATIANGERLSDYIEVRDELLTLGDKKEHV

SEQ ID NO: 98952 - protein, 50 aa, Glycine max
  Coding DNA Sequence Number=SeqID_7267
  Gene Ontology: Mol. function=hydrolase activity, acting on glycosyl bonds; Biological process=cell wall organization and biogenesis
  Homolog annotation: Hit_ID=Q2KMJ6; Match level="QueryCoverage=100%, HitCoverage=42%, E-value=2e-20, Identity=96%"; Hit description =Truncated PGN
MKFLFAVLAIFVVALPCAWTKLELDAGPSFNVIDYGATGNGQTDDSQILL

SEQ ID NO: 98953 - protein, 150 aa, Glycine max
  Coding DNA Sequence Number=SeqID_7268
MGAWELFMHGEGDEDTTKGKDHEAHEGPMTRDILKRAQHSDEDTTKGKDHEALEGPMTRGILKRAQHSDEETTKGKDHEALEGPMTRGRLKQAQHVTETRLVPVEPNSDLSRLIPCGVTVTYLPSLEVVSLSVNNPVSNVPPRKIHVRRY

SEQ ID NO: 98954 - protein, 96 aa, Glycine max
  Coding DNA Sequence Number=SeqID_7269
  Gene Ontology: Mol. function=translation elongation factor activity; Cellular component=mitochondrion; Biological process=translational elongation
  Homolog annotation: Hit_ID=A7PKH3; Match level="QueryCoverage=85%, HitCoverage=10%, E-value=8e-36, Identity=86%"; Hit description =Chromosome chr15 scaffold_19, whole genome shotgun sequence
  Pfam annotation: Domain name=EFG_IV; Domain location=2-96; Score =61.3; E_value=3.2e-15; Accession=PF03764.9; Description=Elongation factor G, domain IV
MSLGVPVCKQTVNWYIEPLPAGSSTKFEFENLLVGQAIPSNFIPAIEKGFKEAANSGALIGHPVENLRVVLIDGAAHAVDSSELAFKLASIYAFRQ

SEQ ID NO: 98955 - protein, 116 aa, Glycine max
  Coding DNA Sequence Number=SeqID_7270
  Gene Ontology: Mol. function=translation elongation factor activity; Cellular component=mitochondrion; Biological process=translational elongation
  Homolog annotation: Hit_ID=A7PKH3; Match level="QueryCoverage=48%, HitCoverage=7%, E-value=4e-19, Identity=80%"; Hit description =Chromosome chr15 scaffold_19, whole genome shotgun sequence
  Pfam annotation: Domain name=EFG_C; Domain location=8-73; Score=3.4; E_value=0.00017; Accession=PF00679.15; Description=Elongation factor G C-terminus
MEKQQNSLIPLDEASTLQGNTTLVLDVTLEDPVPLNNMFGYSTALRSMTQGKGEFTMEYKEHSPVSHDVQTQLINTYKGNKEGRVVKWFWVPSVSYTCSYLSMKMTLRLVIKSSSE

SEQ ID NO: 98956 - protein, 152 aa, Glycine max
  Coding DNA Sequence Number=SeqID_7271
  Gene Ontology: Mol. function=aspartic-type endopeptidase activity; Biological process=RNA-dependent DNA replication
  Homolog annotation: Hit_ID=Q69F85; Match level="QueryCoverage=71%, HitCoverage=8%, E-value=3e-12, Identity=27%"; Hit description=Gag -pol polyprotein
MEADLPLSWKPLNLERYDGTTNENEHPNAFLTLENLYTNDNTILCRVFLTSLKRATLIWFGRIVVQIRNLNPEVALHSMLLVLRPGKFVDSLCKQKASQQHGRVTRTSQRLHLNGGDVKVQKRGPTGRTEAGQKRRTHQDRLTQVRQKAQAR

SEQ ID NO: 98957 - protein, 195 aa, Glycine max
  Coding DNA Sequence Number=SeqID_7272
MVIDVVVWKEVVGLDMGGVCKFDETADGYNKMQTYRGMLLDPARNLRNHLGVDGLAVEDIMLVYITTYILTLRSSSHAQVTDDDLQIVYGLILGIKMNWVLLIEDIMLKSHRLVDYEFPYVVLASRFIDYFNVDVSNDTVDFTKASNEITERHLKKLRMRFVDHEWIMAGETTTRNIEQMEEDVEAEASQEPRHQ

SEQ ID NO: 98958 - protein, 541 aa, Glycine max
  Coding DNA Sequence Number=SeqID_7273
MGDFSWRPLGKQDRISSGTVPPSAIDPPIREGGQPAARADPNDDEVVKVSPNVPSSIFAKMKCDDDTRFAGSAFGFIGRPGYCCCSCSFNSSFPAFLEGFYLSSFFGYYTDLFGRPCHSSTFHCCCTRAEGGVTAAGASEILPLSSSTFPISTSDVLASAPPSPFSRPSVSLDHNLIRSVGVQNATNSAKVFLQRSLVIQEENGQRRQEALSNVAFIEAKSPKVANATVAFIEAVKSNHQLSSKVENTATEKDKLAKVITDSEAWLQESESKLEKSELRVSKEKKANKQLEEELLVFKKEVGFFAKLLDEEEITVVEEDAGEEQGDGANFDFHLVEGLANQSGGTSYLRISSLIWAFGYTRCSSKGEGLQGRALGETWQRRGSPRADLRFDELWTRDAFVLGFGEDLGFVEPLEKRDSPRVNLGFDEPLEKRDSPRADLGFDDPLEKRYSPRADLGADLGFVNPLKKQDSPWADLGGSPRADLSFNKPLDKQDSPRADLGFDEPLEKQDSLRVDLGFDEPLENRPVTCLSWVLSRLTKGRP

SEQ ID NO: 98959 - protein, 130 aa, Glycine max
  Coding DNA Sequence Number=SeqID_7274
MIGTNNQGFSPKTDNNTKSNGPIFEHKPSERKIYPPGATIWRNLEADSFEKNKMHLSFMCSQFSCVVTSNSKFHLVVHKPIFHKKANYYKGKEPMAEDNEGALPTRFIKAHPGRLFKHEVKALQEKAKLS

SEQ ID NO: 98960 - protein, 488 aa, Glycine max
  Coding DNA Sequence Number=SeqID_7275
MASGNERCRFGTLVTRILRDEARGCCGFTKNHPTVGGHARKKVFSVEQFILPEEPFFGEIIGRSSSGNFSGRRVGDWATPDLVVRRVTFGTLQNCCSAMPFLLLSCFFRRCCHRSQSLVSIVTQSWFVLDFSFVVIIVRIRGLGWTLSRVIGRALCRKVSRDADEGPKRRRPTTSAHRQRKAAPAHVVEDVEHVDHVSKEDFPSGPHDTSVLMDYVHHVVVTIWNGEILPSYGKKVEKFGRLAPKIEGLVTATRLSHLIACSMDTGDRGLMLSFAERWHKETSSFHLPVAEELRRYNTTRHMFVYPGCETYIKNVTDVHVVFVDTFRDLKQSESYAWGVVALIMMRGNHVLVVESLGRHYQCRHITGDLPRHPPTVRDDTFVEAYVPQQPVAATTMDKALADAHADAEQPQHTADAQFGDDAWEALLPLEPDVAVVEAKELEDNRDLIDDFFLREGIGAERVEEVVDEDGKVVGEECNVSIYSTNYPF

SEQ ID NO: 98961 - protein, 42 aa, Glycine max
  Coding DNA Sequence Number=SeqID_7276
MDKSLNVGEDEWREKDRMSTKFSASNEPTNTRSSPRFSTKCV

SEQ ID NO: 98962 - protein, 133 aa, Glycine max
  Coding DNA Sequence Number=SeqID_7277
  Homolog annotation: Hit_ID=Q2HTA0; Match level="QueryCoverage=63%, HitCoverage=13%, E-value=9e-12, Identity=47%"; Hit description=IMP dehydrogenase/GMP reductase, related
  Pfam annotation: Domain name=DUF1723; Domain location=65-114; Score =61.8; E_value=2.4e-15; Accession=PF08330.1; Description=Protein of unknown function (DUF1723)
MVRTRGLGRALNRVIGRVIGREERPELKLSSYGRKVEKFGRPAPDIEGLVAATRLSPLITCSLDTSDRGLISAFVERWHKETSSFHLSVGEVTITLNDVAFLLHLPITGVFHNFEALHMDEVMLLLVELLEVS

SEQ ID NO: 98963 - protein, 180 aa, Glycine max
  Coding DNA Sequence Number=SeqID_7278
  Gene Ontology: Mol. function=structural molecule activity; Cellular component=chloroplast
  Homolog annotation: Hit_ID=A7PKG2; Match level="QueryCoverage=83%, HitCoverage=67%, E-value=2e-44, Identity=63%"; Hit description =Chromosome chr15 scaffold_19, whole genome shotgun sequence
  Pfam annotation: Domain name=PAP_fibrillin; Domain location=34-175; Score=85.9; E_value=1.3e-22; Accession=PF04755.3; Description=PAP _fibrillin
  Subcellular localization annotation: CTP_CleavageSite=30; ConfidenceScore=5.08e-01
MATLLLPNPFSTKLPAQRYSHRRFTCSSITAQSRSAKEQLLALIADQDRGIKTQSDPAKHAAIVEAINAMAAAGEGSVTTGDALSATWRLLWTTEKEQLFIVEKAPLFGTQAGDVLQVIDVRNRTLNNVITFPPDGVFIVRSTIEVASPQRVNFRFACSGRHLWRGRLGSLISVALILGV

SEQ ID NO: 98964 - protein, 104 aa, Glycine max
  Coding DNA Sequence Number=SeqID_7279
  Subcellular localization annotation: CTP_CleavageSite=62; ConfidenceScore=5.65e-01
MEAQTRTPQTRTRQCGCSHRSAAQFATNTNSGRRRNNNKALGRTSMDKCQRRSPQTRSPQCGCSHGSTGDFDTRRKKKNDMVQAQGERRRTIGFKRAGCAISEL

SEQ ID NO: 98965 - protein, 31 aa, Glycine max
  Coding DNA Sequence Number=SeqID_7280
MTDIGCLDLQVQYYVGRTGKYHCHHLDRVAV

SEQ ID NO: 98966 - protein, 202 aa, Glycine max
  Coding DNA Sequence Number=SeqID_7281
MTDRLLAGSLTFDCRIMHYIIIRILLPRSSNLVQASEEDLIFMWAFLTDRQIDWAHLVRYRMHKALRANAPLHYPQLVTLFLPHFQIPLDNEPFVQVKHSFAIGVGAVTSFGYCKDRDGQWLKKDALPQQDEHTSSLPPQRDDSSALMNEVLSELRGLRTYVGERFDSLDGRFEGMDTRITQLEEDVTYLCRCFDLPPPSKS

SEQ ID NO: 98967 - protein, 60 aa, Glycine max
  Coding DNA Sequence Number=SeqID_7282
MLYAALPLHMQRGRFRIRTHDQQVTKAQLYRCTRADVIVVIHKQSSQQLSHSGIFVLHRK

SEQ ID NO: 98968 - protein, 61 aa, Glycine max
  Coding DNA Sequence Number=SeqID_7283
MVKTVNENPSCKTRLNINNIIDAILPRKGPVIRAMSKRLQEDWARVDKEGLRVLMNLRVDF

SEQ ID NO: 98969 - protein, 115 aa, Glycine max
  Coding DNA Sequence Number=SeqID_7284
MSAEKHHQLTSVEKTLHITTQKIALTKVGRENHSQCHLKNSIDRCQTLWAKRTLWAQHESTAKRNFSAISMTRESGRAQGSRLRAKREINSLSEMFVSCQAQCTTGAKLKSTNLH

SEQ ID NO: 98970 - protein, 68 aa, Glycine max
  Coding DNA Sequence Number=SeqID_7285
MNGPKHLSPREKMSGVATNVYLRKTLEKPKRRRSADFENEGSGVVYARGRVLPSLLCILKFDEEIRPT

SEQ ID NO: 98971 - protein, 78 aa, Glycine max
  Coding DNA Sequence Number=SeqID_7286
MKSFNGDFPPWRCSRRQRRRGERRRHPLGNKPWKKELHHQECALDKNLGEDASMEEKKEIEKERRGSTKLKEEKRKRS

SEQ ID NO: 98972 - protein, 132 aa, Glycine max
  Coding DNA Sequence Number=SeqID_7287
MSASELIKEFENIYFWHCSISKTPTLALQIVLLKTSWSYSKNLPSKDSQVLVSGDIWGYADLAVSIHMQVTPHSYTDLIHWYIPARWTLQAKWVGPRWWQCDGGTMVAWWWYNEKDRSSVVRRSECELWWEE

SEQ ID NO: 98973 - protein, 182 aa, Glycine max
  Coding DNA Sequence Number=SeqID_7288
MAFGNMAARPGELMLTPEVTGSPRRAGSLSLKQFGDPGEPEASLGELGSRKLIEKTLLPLPFGIFRILDQNIERSFVLCTIRLSLSKLSLRLALTSNSFTRAKRKNGVKCNVEIKRPFLSLICRKPGAKSEENGSLLRGLKSVNFREHRAEQGAKFSSFREISEFLSDCEIPRGGGDIPTPL

SEQ ID NO: 98974 - protein, 290 aa, Glycine max
  Coding DNA Sequence Number=SeqID_7289
  Subcellular localization annotation: CTP_CleavageSite=48; ConfidenceScore=5.37e-01
MHQREELSKKRKGLTSTTTTASQRRHDTSSDSPAPPNPSISSPRSLTLFSSKKQHQRYYSSFSNRVILDPKYLDLEFFEGENFDCCQVHKIPIVVDQSLFYSLTKLSSQGVPFEGTLFGDWKHLYSNHDARKMVCIENANMTGRLLVANPAQASKKDLILLWVLQIGRQIDWAYLVYYCMHKALRANAPLPYPQLVTLFLQHFHVPLDDEPFVKVKRSLAIGAAVIASFGYQKDMNGQWVQKQDLPPTVPDERTPSPPPQKDSSSSLLHDVLTELRELWAFVGDCFDAMD

SEQ ID NO: 98975 - protein, 175 aa, Glycine max
  Coding DNA Sequence Number=SeqID_7290
MGIVSDIVATRQVITYIMHHHVEIEAKAKQQQEKLEFDEQFNNLHAHLEPPLFDITSQPPQVMEDTLPPLALPNTLESLLKSFNDSILYNVKLMMQQRLPPNLVPLHQSIVQHQYAPIPQPPLPPPTTVVKPHPGVPVPMVPTSEAAIPNDPMPEPPPTPPKSPPPIPQPLSTEG

SEQ ID NO: 98976 - protein, 65 aa, Glycine max
  Coding DNA Sequence Number=SeqID_7291
  Subcellular localization annotation: CTP_CleavageSite=35; ConfidenceScore=5.22e-01
MKAWAMVVCFKVAWLVFGVVVWWTVKVKVRFATVVCSGEMGSTTKVTLCRMTLLGLDATERVATK

SEQ ID NO: 98977 - protein, 298 aa, Glycine max
  Coding DNA Sequence Number=SeqID_7292
  Homolog annotation: Hit_ID=A5APL5; Match level="QueryCoverage=74%, HitCoverage=81%, E-value=8e-19, Identity=27%"; Hit description =Putative uncharacterized protein
MASASQGFASHSFPTSIAEKLDDSNYLHWRQHVEPVIKSHKLQRFVDQTLLIWLQSTLLKSVLTCFRLESLLSVSLEGKSMDEYLHKIKGYVDELADLQTLGLILIPSLLLSQPINQPSAMLTNSDSHGNDQVRSTWIPDSGASFHVTVLVPHPLCLLMTHIIFKLDKLLHLPSISKNLLSVSQFARDNSVFFELHPHFCLVKSQATNKVLLQGVVGADGLYSFHNFKFQDHSPQLLSTSTFASITSPTLDVNNAFLNGLLEESGFMTQPPGFEVGDKSLVGKLNWALGLETSSKAMV

SEQ ID NO: 98978 - protein, 210 aa, Glycine max
  Coding DNA Sequence Number=SeqID_7293
  Gene Ontology: Mol. function=aspartic-type endopeptidase activity; Cellular component=small subunit processome; Biological process=DNA integration
  Homolog annotation: Hit_ID=A5B1K9; Match level="QueryCoverage=97%, HitCoverage=15%, E-value=4e-28, Identity=33%"; Hit description =Putative uncharacterized protein
  Pfam annotation: Domain name=zf-CCHC; Domain location=184-201; Score =13.8; E_value=0.012; Accession=PF00098.14; Description=Zinc knuckle
MASSGPLWFLGQGHHDHLEKGVDAVPNDRKLEWEKLDYQLCVAQEILANDIQSLFDATMKVTALKQTGHDMIAHVGKARAAVEELKKFLVADSLEEMNRKLDKFYMVLILRSLHSDFDHVRDQVLAGDQVPSMDSLITRLLCVPHALKEENPADVVETSTMVASRGREGGRNSRGGRNGKGGRPQCTYCKRMGHTQENCYSLHGFPEKVP

SEQ ID NO: 98979 - protein, 137 aa, Glycine max
  Coding DNA Sequence Number=SeqID_7294
MKTLSWKNTLKIRKEDEWGRMKFEISKHGSKGISEKGDKNSKSPHPTWDNTRPCFGAQETHHPPAFQNYYPRHQTIFNTGQPLSPTSWLRAWGPYVLSRVNKIHVASYMALLDTCPPSMLALAQEHGRPTLSSRVPP

SEQ ID NO: 98980 - protein, 285 aa, Glycine max
  Coding DNA Sequence Number=SeqID_7295
  Gene Ontology: Mol. function=heat shock protein binding
  Homolog annotation: Hit_ID=A7PLM4; Match level="QueryCoverage=71%, HitCoverage=38%, E-value=6e-48, Identity=51%"; Hit description =Chromosome chr7 scaffold_20, whole genome shotgun sequence
MVVGTGYFDVFERDFYSAIHAAYYGPKVQSTKLLPDFFEAEERSFYETLEVLHLVSERDLFGMVCLANKVPEISITNNEKLTSFRSFHSGLCQSITNLNIHKNAKRLDDFETHQGHSSKTSSIVSDAYRHLELHIFGIVIATTSKTLPRCCSDEMQTKYIEDHIHVFLNLYEDPKHISSDVWKDYLANGAVGRRIHLGSIDGLSFWVLILMKAGVAAHDVQRYVKESDRAAQCTRQDKMSNEELKLQDPRCRIQCPGHPARKYWTHKSVISLTDCAGSTMSDTMS

SEQ ID NO: 98981 - protein, 547 aa, Glycine max
  Coding DNA Sequence Number=SeqID_7296
  Subcellular localization annotation: CTP_CleavageSite=28; ConfidenceScore=5.05e-01
MDREVISIGGSSLKDNHHGTSRLHGKVRPSAASPTRDQGKMDDVPKYKSSLTSMASVVDLQRQVKLANLEDSCKMVVQACRSDDFPFLRHLNVAPSQLHSNSWAMVKAFEILCLFFNIQPGVPVFLFFFQMKLIGKIGWVSLNNVSKKLFEFDSNIFHHFKDQFFKQFDPTRFKSFDKDLLTLVERVNKAILEQLSASLDMRAILSLPSVNNPLAALDSKMPNLVGPKDGTVPPFIVTPATVEKGQPAGEVGLVVVVVEVTPTAGVDIPATSANAVTASTSTIATPLLSASVTTTNAPMISSPPSPASTVLVVVSPSSSSSPHVSLDHLYTSSDADSLWGANYKLKQKTSVDFVSAFDRNLIRSRGENGQRHQEALGKVSSLETEVAKWRATACTIWRQERPKVAIATITFVEAVRSNHQLSSKEEKKNLAGKVEGIAVKRDELAKASKEREANKELEEELTMYKKEAMEQHEKGFQKAIRKVEFFTKDLDLGLFDPFKDAKEGVLLKEEEIVVKEEATDDKQGEIFDGTGSKTLLMWRQDFGGLVK

SEQ ID NO: 98982 - protein, 67 aa, Glycine max
  Coding DNA Sequence Number=SeqID_7297
MEALSRSNCILGYILPDVCQKKDYIKRYSAKITENNKYYYKEWTKPGMPSVRQSPEALIMGERGFGS

SEQ ID NO: 98983 - protein, 68 aa, Glycine max
  Coding DNA Sequence Number=SeqID_7298
MKMLLIPHDVSSIGASKWRRKRERRRHFKEKMSLEEAHHHRRPWIRAWRKKELNGSVHYSKINSKILH

SEQ ID NO: 98984 - protein, 79 aa, Glycine max
  Coding DNA Sequence Number=SeqID_7299
MFVFNSALKGLDDTPQRKSKAAAKWIIVKCNRQKGSTECGYYDMHWMLTIILGSFNNNWETYFNDARPLKPERLKMFHI

SEQ ID NO: 98985 - protein, 84 aa, Glycine max
  Coding DNA Sequence Number=SeqID_7300
  Homolog annotation: Hit_ID=Q84VH5; Match level="QueryCoverage=79%, HitCoverage=9%, E-value=1e-20, Identity=74%"; Hit description =Envelope-like protein
MLSQHPNILNYTDSVMKRESPLSLHYKLFEGTHVPDIVSTSGKAAASGAVSKDALIAELKDTCKLIEDAAARAWRQGEQNADVT

SEQ ID NO: 98986 - protein, 68 aa, Glycine max
  Coding DNA Sequence Number=SeqID_7301
MAWYQDQGLYEAEVTITKEMEIISMQFEQLDVCGKDSIENIIDVKADGGCGYCAIATLLGMGEDLLSL

SEQ ID NO: 98987 - protein, 98 aa, Glycine max
  Coding DNA Sequence Number=SeqID_7302
MQNFAVKIGAAGFELGAENACVWLAVERVVQNEFWMLLVDPNGHNLERIDGDPVLRETRIWATWEYVSSVGGGQQGMVGLCAHCGCGKLVVHHRPTAT

SEQ ID NO: 98988 - protein, 225 aa, Glycine max
  Coding DNA Sequence Number=SeqID_7303
MEAVSITPHEEMGPCIRSGRCGGHCLMCAKRHNPSRRRTLHPTFCLVGTKKKLEEAVQSGSIDGVIGPPSPVKRHVKWKMARTKKTGEMTTKAAKEIAAKIDSFEEQATQRSFVPQRCQDFLTAAIGHPEHPGHVRAAGAGVTIKQYFGSAPWMSRISSSLPPEELQQLTQQIRDQLKESIIEKVTRQLMHPSARCSPRFSPRCNLRDLNCLPSLWLVPQVLESA

SEQ ID NO: 98989 - protein, 248 aa, Glycine max
  Coding DNA Sequence Number=SeqID_7304
  Homolog annotation: Hit_ID=A5CA85; Match level="QueryCoverage=48%, HitCoverage=19%, E-value=6e-13, Identity=37%"; Hit description =Putative uncharacterized protein
MAQPPPRERTLREMAAPDFTYESLCIQYPDEDVLYVLKTRLIHLLPKFHGLAGEDPHKHLKEFHIVCSTMKPPDVQEDHIFLKAFPHSLKGVAKDWLYYLAPRWLQTSSNDAIVIRGVHKVATNSSSSGETKKLEAYAANIYNKLPQPQQQNQPQQNNYDLSSNRYNPGWRNHPNLRWSSPTQQQQQQQPYFQNAASSSRPYVPLPIQQQQPQKQQTAEVPLQSSLEELVRQMTMQNMQFQQETSGIL

SEQ ID NO: 98990 - protein, 159 aa, Glycine max
  Coding DNA Sequence Number=SeqID_7305
VTGCTIYGEAHETGQCIPIEENTQEVHYMGNQQRQRYTQGGFSGQWRSHLGNQFNKDQGGPSNRPIQQGPNIFQRTTKLEETLTQFMKVTMSNHKLKNLEVQVGQLAKQIADKSSNNFVANTEKNPKEECKAVMTRSKRFVEAEDEESVVHKKKAAEKK

SEQ ID NO: 98991 - protein, 129 aa, Glycine max
  Coding DNA Sequence Number=SeqID_7306
YGKSENNKQYPPLQRHAFVKWWSQFDTSKAAPDQVENWFQSNPEFLKPADPETSLFLNQKSQLAAFLASSKSKESLAHNLKEVLQLLQQEEDEELPKKEVESSENNDDQDDDPFYQNEDDCFGISLDDD

SEQ ID NO: 98992 - protein, 86 aa, Glycine max
  Coding DNA Sequence Number=SeqID_7307
MTPRKLSAKRSRRDTAAEGTSATPEFDNHHFRSAEHQQRFEAIKRWSFHRERRVQLRDDEYTDFQEEIARRRWTSLVTPWLSLTQI

SEQ ID NO: 98993 - protein, 148 aa, Glycine max
  Coding DNA Sequence Number=SeqID_7308
  Homolog annotation: Hit_ID=A5B4G8; Match level="QueryCoverage=56%, HitCoverage=10%, E-value=3e-07, Identity=35%"; Hit description =Putative uncharacterized protein
MTRGNPSDLQPFDPEIDRTFHRLVRHHFIPFEHPEHPVTGESVHSVIGDCELPDFEHSDFEHSENMSQPPPRERTLREMTAPNFTYESLCIQYPDEDVPCVLKTGLIHLLPKFHGLAGEDPNKHLKEFHIVCSTMKPPDVQENHIFLK

SEQ ID NO: 98994 - protein, 84 aa, Glycine max
  Coding DNA Sequence Number=SeqID_7309
MKTKGMQFVEQKERYVHYDAMKRCLCDAQYECIYGHESPENHLFLLVHSGTQCPMCAVKKVIWTFWLPVTKDETNMQRVRDDMM

SEQ ID NO: 98995 - protein, 128 aa, Glycine max
  Coding DNA Sequence Number=SeqID_7310
  Subcellular localization annotation: CTP_CleavageSite=75; ConfidenceScore=5.37e-01
MPNFYAGHGVNQFRFSTWSHDIFVNVKLEVTRISTILNVFGSRRSNDVTRSIFCPNFCKMVTSMLQLDSMNLFVKARAWFNPITQGMTILIANTSTTFHRDERLENTHAMHGKCNYEIEMPEETSFLN

SEQ ID NO: 98996 - protein, 259 aa, Glycine max
  Coding DNA Sequence Number=SeqID_7311
  Homolog annotation: Hit_ID=Q84VH5; Match level="QueryCoverage=100%, HitCoverage=43%, E-value=5e-89, Identity=61%"; Hit description =Envelope-like protein
  Subcellular localization annotation: CTP_CleavageSite=39; ConfidenceScore=5.65e-01
FPNTSQRFTKPLQRLCFSMATSPKETSSPGSPSVPSSPSSTKAPSNQEQPEFNIQPIQMIPGQAPIPEKLVPKRQQGVKISENPSLATSPREVDTEMDKKIRSIVSSILKNASVPDADKDVPNIFRTPNAEVLSPPAKRDQQRKDDQATEETPAPRAPRTCSRKRLQSRKGKTPIKRSGRIKHMAQKKSTPITPTTSRRSKVAIPSKKRKEISSSDSDDDVELDVPDIKKAKTSGKKVPGNVPDAPLDNISFHSIGNVE

SEQ ID NO: 98997 - protein, 475 aa, Glycine max
  Coding DNA Sequence Number=SeqID_7312
  Gene Ontology: Mol. function=oxidoreductase activity; Cellular component=mitochondrial matrix; Biological process=metabolic process
  Homolog annotation: Hit_ID=A9IIY5; Match level="QueryCoverage=100%, HitCoverage=100%, E-value=0.0, Identity=87%"; Hit description =Aldehyde dehydrogenase family protein
  Pfam annotation: Domain name=Aldedh; Domain location=13-472; Score =714.8; E_value=6e-212; Accession=PF00171.13; Description=Aldehyde dehydrogenase family
MYEQLALYIDGEFVAGEGRRTQDVINPATLEVLGQLPHATEADLDRALAAAQRAFESWKKSSPMDRSAILRKVATLSRERAKEIGRNMTLDQGKPLAEAIGEVTSCAEHADWHAEECRRIYGRVIPPRNPDVRQIVVREPIGVCAAFTPWNFPYNQAIRKIAAALGAGCTVVLKGPEDSPSAVMAIARMFHDAGLPKGCLNIVWGEPAKISDYLIRSPIVRKVSFTGSVPVGKQLAALAGAHMKRVTMELGGHSPVLVFDDADIDRAATMLAKFKVRNAGQVCVSPTRFYVQNGAYEQFLARFSDVLKNIKVGDGLEAGTDMGPLAHERRVPAMSAFIDDAKKHGGKVVVGGGPLDRKGFFFAPTVVTDLPDNSMLMTEEPFGPVAPVVRFTDTDEVLARANSLPFGLSSYVFTNSLQTATKVSNGLEAGMVNINHFGSALAETPFGGIKDSGIGSEGGLETFDGYLVTKFITHI

SEQ ID NO: 98998 - protein, 113 aa, Glycine max
  Coding DNA Sequence Number=SeqID_7313
PTGPWGFQLWLRAFCSPIGCPFPPARSRHHDIGIAPARHPLDPKKSNKFYGVLVTSGKGIRPPANRAFIKKYCVPRQAQDAPPSPLEFTSAHPQKAIKRPAQDVKEALLGGNL

SEQ ID NO: 98999 - protein, 139 aa, Glycine max
  Coding DNA Sequence Number=SeqID_7314
MQSQGVAVPPEPVVGPSPSGPRVSVEEVRDADAPVPVPTDEVSLVGQTLHTFLAWPTHLVAVSPPKPPPKPDPEVDDPLYLMTLTILELFLRPYQVRWDATVFGVVNPDFPLYIKHEDLSEIAHGGQCLSISVLQLWIL

SEQ ID NO: 99000 - protein, 264 aa, Glycine max
  Coding DNA Sequence Number=SeqID_7315
MRGAPTEESLSPFLVRDFGVQSFKIVQRVHKASESPLRKDKELRGIRNGIIGGYHEWLKVHTRGLDWLSKLKIINKENFEALEEDKEVRALKTELGKARLAKEKFKLVATDVQKECAELREENAATARALEQETKRAHKEEHDRDKFQGALWGSNNELKLRREERDQSRVHVMVLKEELAACSRSKRSLAQHLEATEENMLDIIGQYKEELNQSLTHEQKLVEDFAQAYTEKEAIGRVIDALHQEVTMWMDRFALTLNGSQDLP

SEQ ID NO: 99001 - protein, 110 aa, Glycine max
  Coding DNA Sequence Number=SeqID_7316
STLEDPTLIGAAVIASFGYRKERDGSWVKKGVPPADDEGHIPVEDNSTLLQRLMDKFDGLQTFVGDKFDAMELQVDMRFDAMESRITRVEEDVSFIRTCFDPPPPPPSSS

SEQ ID NO: 99002 - protein, 84 aa, Glycine max
  Coding DNA Sequence Number=SeqID_7317
MTIFKVPNKTLIILRENCLKLLHAVAIYPSARGRRGAHGYVFQERKMPRVATNVYSRKTSENPKRCGLRTLIVKGSGVVFTHRE

SEQ ID NO: 99003 - protein, 24 aa, Glycine max
  Coding DNA Sequence Number=SeqID_7318
GIGKEDWCHILKNLSQEARGEGIH

SEQ ID NO: 99004 - protein, 433 aa, Glycine max
  Coding DNA Sequence Number=SeqID_7319
  Homolog annotation: Hit_ID=A7P1W9; Match level="QueryCoverage=92%, HitCoverage=72%, E-value=5e-28, Identity=30%"; Hit description =Chromosome chr19 scaffold_4, whole genome shotgun sequence
MGEEDETPKYNRIGGGGRRPIGRPCKIPYPKLVPQRGLGVAQLEKFRLEQEQKEKAAIIATSASSSNSDIPYDKHLQFLKFHNSNQPSPNSFPLSTASIANNGGSDAGRHEALVLGHVSGPQLRAPHDFKFVKKKIGMNTGMTFASTLPCASNTIMPFPNCVQKTQQHQQQHPSSSMVSVSSRTSSTIVPHSSLEPYSTETYVSKRLEKMIGIKRPNPFSLKITPVSSSNFKPFESNPIRPSPNWMHRTQQHPSSSMLGVNPRTSSTIVPQSLLEPPSNQNYIGSYVSKRKEEKMIWTKQPKPFSMDIPPVSSSNSKPLTFPNPPMSSSNFKPLTFPNPPMSSSNFKPLTFLAPMKASESNSCISGRRFNLDFGNSTIREIPSVSATNSELISKKNKKGKKNIGGDFLTVAPPTECSCSKLKSPSGFVPFRHQ

SEQ ID NO: 99005 - protein, 100 aa, Glycine max
  Coding DNA Sequence Number=SeqID_7320
MILATQLKHCACHPYWRLKKAFSGSQEHDTAPILLTREEVLERVDDVYTVFGKDPKEGKKLLSFVPTTWKRQNLLVFWSLTMAIEWEIRVQEDCMLSLQV

SEQ ID NO: 99006 - protein, 95 aa, Glycine max
  Coding DNA Sequence Number=SeqID_7321
MEFHVQVSQPSLLRVSEARLTSASSKGGKCAESPPTFIERKTIEKPKETGHEEYSRFGSCIYVRGRWSFKAFDLKMIHFYLVRKAEALDLKTFFQ

SEQ ID NO: 99007 - protein, 111 aa, Glycine max
  Coding DNA Sequence Number=SeqID_7322
MFAHSIKGCRPLGRACGVLIPSPLRQGDITTIWLAMRDGKRSSYVIGIGVNVVLGGKFLIVLEPAPKWALPAGRVGVGAVAWGVSLWMGTGALACMGVELEESPARAEKLG

SEQ ID NO: 99008 - protein, 226 aa, Glycine max
  Coding DNA Sequence Number=SeqID_7323
  Gene Ontology: Mol. function=aspartic-type endopeptidase activity; Biological process=proteolysis
  Homolog annotation: Hit_ID=Q53KJ4; Match level="QueryCoverage=40%, HitCoverage=14%, E-value=1e-08, Identity=39%"; Hit description =Transposable element protein, putative
  Pfam annotation: Domain name=Retrotrans_gag; Domain location=1-88; Score=12.9; E_value=0.003; Accession=PF03732.8; Description =Retrotransposon gag protein
AKRWLHSFKGNSLKTWDEVVEKFLKKYFPESKTMEGKAAISSFHQFPYESLSEALERLCGYSPSSCLDTSTGGKIKLKTPEEAMDLIENMAARCVISGGAHDSRCCLSNEEPITHEGQWRNHPGNPFYKDQDGPSTRPQQQGPSLYDRATKLEETLAQFMQVSMSNQKSTESAIKNLEVQNGNPCCEGKAEKKVEEHKQQLVAEPTLEPVSDLVELEEVVEDEDDQ

SEQ ID NO: 99009 - protein, 43 aa, Glycine max
  Coding DNA Sequence Number=SeqID_7324
MATPMSTACYLDKDEISQSIDVKQYRDFNQIPNNHILVVLKES

SEQ ID NO: 99010 - protein, 134 aa, Glycine max
  Coding DNA Sequence Number=SeqID_7325
  Homolog annotation: Hit_ID=A0ST23; Match level="QueryCoverage=33%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPAGTELEFVIMVIAVSFGKPVVPAALMNRPTRGERRFAYWALFRFLAH

SEQ ID NO: 99011 - protein, 481 aa, Glycine max
  Coding DNA Sequence Number=SeqID_7326
  Gene Ontology: Mol. function=ribonuclease activity; Cellular component=cytoplasm; Biological process=RNA processing
  Homolog annotation: Hit_ID=Q5GXK2; Match level="QueryCoverage=61%, HitCoverage=58%, E-value=1e-122, Identity=78%"; Hit description =Ribonuclease G
DIAYLSRVWNVVERRGREAASCSNIYEDLSLPLRSVRDLIRKDVDKVKVDSKETFAQLQAFVAKYMPVLAEKIELYSGDRPIFDMFGVEDEIGRALDKQVPLKSGGYLVIDQTEAMTTIDVNTGSFLGQRNLEETVFRTNLEAAQAVARQLRLRNLGGIIIIDFIDMDDAEHRRQVLRTLEKALARDHAKTTVYDFSPLGLVEMTRKRTVESLERQLSETCPQCSGRGSIKTTETVTYEIFREITRAVRQFDAARLLVIASTNVVARITDEESAAVAELEEFLGKSIRFQADEQPAVADERAAAPATAKDPPSFHWANCGAVGRWAALRRGWGPSIPRCPHRRAPAGQWRPPACRRARLGPDRSAAVDGSAGRGPRARHAQAWLGADPVDFHAWSRCWRPAVCCVSKARANSTLWLTCRFRAAPAAVADACAGSAGRWLGIARDRGPPGRACAGVPRLRLKTEEREQQLDGLQLQLGKQLA

SEQ ID NO: 99012 - protein, 108 aa, Glycine max
  Coding DNA Sequence Number=SeqID_7327
MTRGNPSDLQPFDPEIDRAFDRLVRHSVHPTFPEHFVPFEHPEHFVIGQSEHFVVGNFEHPDFEHYIFEHSENMAQPPPHERTLREMATPDFTYESLCIQYPDEDVPY

SEQ ID NO: 99013 - protein, 95 aa, Glycine max
  Coding DNA Sequence Number=SeqID_7328
ALLSPRGGEPDDMWRQIMVIPHTFSPFRHDRVRWKAETNYGHSAPFVIQRRGGEPDDMQRQIMVILDTFSPFRHDRVRWHAETNYGHSAPFVIQR

SEQ ID NO: 99014 - protein, 86 aa, Glycine max
  Coding DNA Sequence Number=SeqID_7329
MGSKIYPRVHENPKAFFSSFSPILLESSIQYPWGVGLHQRVSQVCRMTCEERVACGIDRQVMMKGSSLWVMARRLQWKLLELLDYS

SEQ ID NO: 99015 - protein, 69 aa, Glycine max
  Coding DNA Sequence Number=SeqID_7330
MLQNFTDYAIILFLTVGMLLNFTDYLTMGVMYLEAVKRRLHATKQWSPDEIRVCQLPLFTYLLSKIGGK

SEQ ID NO: 99016 - protein, 71 aa, Glycine max
  Coding DNA Sequence Number=SeqID_7331
  Subcellular localization annotation: CTP_CleavageSite=42; ConfidenceScore=5.08e-01
MQTASPIGAFVVAVTHGEDATATGGFHGVASPIGNFTMQGGVASQTSEFQAQGAGFSAFSSFSVDRGRGTG

SEQ ID NO: 99017 - protein, 211 aa, Glycine max
  Coding DNA Sequence Number=SeqID_7332
MAEPMKKRKGSSSRSQRHSEAQDTPIPSSISSSSLFSLEEQCTWYTNLFSSRSIIDPKFIDMDFFYDERFECIQAIHNSYLIPFISLKLPMYYELVKAFYSNLEIQENTLVYEVFGIKMVIDPSLFYDLTHLSSEGVPFEGHLPAGEDSSLLQSILDRFDGLQTNVGERFDSLEHQVDTRFKEMDSRIKKVEGDVTFIRDCFDLPPLPPSV

SEQ ID NO: 99018 - protein, 240 aa, Glycine max
  Coding DNA Sequence Number=SeqID_7333
MSWKRPLLLNAPPSKTMIMRGQDIYSSQDEATTSPSSSESEEAKGEGSSEEIYPQEDGQPLVVKEKCKEVSVSSKRLAKKETHFTIKIDIKETFPLRQPPHLLLCKKTLVSTATPLGLEVIPQVKELLDEGLVRKSLNPCALLVPKIGIIRHQIPTISDMMNVLSIATRFCKISHAPNVFMIHVHRDSLGRNNQHKNTEKGTLYYITFLNFLNSDQGVPTDPKRIKVIPEWPTPPSIREI

SEQ ID NO: 99019 - protein, 81 aa, Glycine max
  Coding DNA Sequence Number=SeqID_7334
MSLSKHKGLRGVATYPSAGGRRETRGMRVPRKEYARSRHQRLFEENVGKTGKDAIYELLSERVFPFAPTYSSICDEEIRPT

SEQ ID NO: 99020 - protein, 139 aa, Glycine max
  Coding DNA Sequence Number=SeqID_7335
MEIRFLVSRKYVALQICDDEDVETMIESFQQQQQMSVLELYVEKDVVGGSMFHAANSVTSCGRNVSHHESELPRNISNLHDDEDDDDDYIASNSYVEESFDEDDSDDGISDTDDEVTDIVEPVSIVHRRCTTNSKSILE

SEQ ID NO: 99021 - protein, 253 aa, Glycine max
  Coding DNA Sequence Number=SeqID_7336
MVEPSKKCKGSSSRSQRHSEVQDTPIPSSISSSSLFSSEEQHIRYTNLFSSRSIIDPKFIDMDFFSDESFKCIQTQLSSDSVPFEGALDNDWKFDFFVHDARRLVCTNQADMTERLLAGSLALESRILHYLIDRILLPRSSNLAQVSEEDLIVMWAFHTNRQIDWAHLVRSFLIGAVVVASFGYRKERDGSWVKKGTQPNDDEGQLSVEGDSSLLQSILDRFDGLQTYVGERFDALEQQVAMRFDAMDSRITK

SEQ ID NO: 99022 - protein, 98 aa, Glycine max
  Coding DNA Sequence Number=SeqID_7337
MAFRKRKSIDSRPTTQYDTRRFHSVDAWNRYTDNVLGRNILLERKVELYHTELDDFKTELERHNFHKCVTNLANGSIDLALVKEFYANLYNSEGPSPK

SEQ ID NO: 99023 - protein, 80 aa, Glycine max
  Coding DNA Sequence Number=SeqID_7338
MAFMGLLKKGEVGELQEVVATYPSAGGRRVTRGMRVPRKEHWRSRHQRLFEENVEKTGEDAIYELLSERFGSCIYARGRH

SEQ ID NO: 99024 - protein, 148 aa, Glycine max
  Coding DNA Sequence Number=SeqID_7339
MARIAKVVEISEQELDRVKQNRNGAAGVPRKHLEEKAEALTSQGEWATFIDVLALIVFGTVLFPNVDGRQDKEIKGSSNGVIGGYHKWLKSRPQGMTWLPKLKSLSGKKAEILEESEEVQALKAELEKTRVAKEKLKTTVTRVTKECD

SEQ ID NO: 99025 - protein, 162 aa, Glycine max
  Coding DNA Sequence Number=SeqID_7340
WVSSKHPQVKGAPLYHINESFVSVGWMCEGQIAMIHDEVSQEPSDWVWPCPPEFKLGNWQIIEQPRISVGSLITTPNDPYLTWLFSRGIITQDNNIAAARLTGASSKGGKCAESPPTFICGKHRKNQRKLVIKNIPDSGVVFTFEEGISTSHVDKSGALAPT

SEQ ID NO: 99026 - protein, 26 aa, Glycine max
  Coding DNA Sequence Number=SeqID_7341
AYENPGAFSCISGSIFMESSIQFPWG

SEQ ID NO: 99027 - protein, 207 aa, Glycine max
  Coding DNA Sequence Number=SeqID_7342
  Homolog annotation: Hit_ID=Q6WAY4; Match level="QueryCoverage=39%, HitCoverage=15%, E-value=5e-07, Identity=36%"; Hit description =Putative uncharacterized protein
MGSNQAPLFKKRFYQVKIKSLEVASLQELGQLMDQLQCQAFCKTYGKIWDLAMIEVSIEAIVSLTQYYDQPLRCFTFGDFQLVPIVEKFEEILGCLLGGRKPYLFSGFYPSMEWGGRNTKEALGGESEDLAAIDAFLAYHCWISPAVTFCSSFSSFKYIQGKSGLPESAPDRQPKITKPRPPGRPNQSKLRPLDPSWLDRPILDDPL

SEQ ID NO: 99028 - protein, 122 aa, Glycine max
  Coding DNA Sequence Number=SeqID_7343
MSRWHAKRSCTLSAPYEFQFLKSRVRGTWVATLAPKPLHSLIPEHFCFCCVLICPSAFPCFFTLYITQSKVRYFRTLGVKTPEYLLGFAMNALSVPAALSLFIATVKIFQISDDRAKRAMSR

SEQ ID NO: 99029 - protein, 360 aa, Glycine max
  Coding DNA Sequence Number=SeqID_7344
  Homolog annotation: Hit_ID=Q2HTA0; Match level="QueryCoverage=50%, HitCoverage=25%, E-value=1e-06, Identity=27%"; Hit description=IMP dehydrogenase/GMP reductase, related
  Pfam annotation: Domain name=DUF1723; Domain location=62-116; Score =29.3; E_value=1.5e-05; Accession=PF08330.1; Description=Protein of unknown function (DUF1723)
MVMILKVLPNAEGRPHWHAGNKYLSLLAMIDADAQDTGVEANAHDTGADDVTDKAEAFPSGPRDPSVLMGYADHVAASVWSGETSSFHLPIGEVLITLDDVTSLLHLSIAGDLHAFQPLHIDEAVLMLVELLMVSPEHFPSVAECNADPDYDEDSRCLLDAICGASTGLGVSLISCYSGQLCWGHVAVRYRPERVMRQFGYVQAIPAPPVDSWVSFNDIDDWWMHYSNHLAPAGEMCVVSGQCALDYIDWFFRISHPFTTTQPLDSPVDAPAAQPKHVPQVLESDIPQVLDDPARSDVDEPRHIVEACDAIAERLECHLSLGVVTPGTSTHEVIEECLRIARSVIEDRIVYVRSRHRPKL

SEQ ID NO: 99030 - protein, 201 aa, Glycine max
  Coding DNA Sequence Number=SeqID_7345
  Gene Ontology: Mol. function=oxidoreductase activity; Cellular component=membrane; Biological process=protein complex assembly
  Homolog annotation: Hit_ID=A6X1W1; Match level="QueryCoverage=68%, HitCoverage=38%, E-value=3e-72, Identity=94%"; Hit description =Cytochrome oxidase assembly
MTAATAQRVGQGRSSKEDRDRRLVRYWLYAVFVVLIAIVMVGGATRMTGSGLSITEWKPIHGVIPPLNHAEWVEEFDKYRQIPQYQQINKGMSLEEFQYIFWWEWAHRLLARFVGFLVAVPLAFFWVTGRLRGGLKYSHAGSARARRPAGRHRLVDGGLRPERADERQPVSPGDPSDDGLRHHNGDLPGWARGRAACRSDL

SEQ ID NO: 99031 - protein, 148 aa, Glycine max
  Coding DNA Sequence Number=SeqID_7346
MMMKDNCRLKETLLSFKVFWTSSMDSKLMLVKGLMLWNNKCTHDSTRWTQGSQRLKKMSPSFTRALIYHHHRLRDCHHQKGGDCGSNVFQGYFDDAKESRVKQSFKQRLKIQESSFKFQDSRFKNPDLRIKIKIQDSRLKNQEKTRSR

SEQ ID NO: 99032 - protein, 85 aa, Glycine max
  Coding DNA Sequence Number=SeqID_7347
MNKKSVPVAKLYGLCSFADHHTDLCPSVQQSEAIEQLEAYAANIYNRPPQPQQQNQPQHNNYDFSSNRSYVPPPIQQQQQQQPQK

SEQ ID NO: 99033 - protein, 31 aa, Glycine max
  Coding DNA Sequence Number=SeqID_7348
MGDNWKSPKVKHLNGRLVTGADPSTALTLSD

SEQ ID NO: 99034 - protein, 232 aa, Glycine max
  Coding DNA Sequence Number=SeqID_7349
  Gene Ontology: Mol. function=chloramphenicol O-acetyltransferase activity; Biological process=response to antibiotic
  Homolog annotation: Hit_ID=P62577; Match level="QueryCoverage=93%, HitCoverage=99%, E-value=1e-130, Identity=99%"; Hit description =Chloramphenicol acetyltransferase
  Pfam annotation: Domain name=CAT; Domain location=6-209; Score=528.7; E_value=6.6e-156; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQAGRNFFKAVIGARIFI

SEQ ID NO: 99035 - protein, 307 aa, Glycine max
  Coding DNA Sequence Number=SeqID_7350
  Gene Ontology: Biological process=transposition, DNA-mediated
  Homolog annotation: Hit_ID=Q6UUU1; Match level="QueryCoverage=28%, HitCoverage=55%, E-value=3e-18, Identity=61%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIKNSNLPPYMKLRANQRFEAATVACRKAKHDYENARIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSVPAFRFTGVIP

SEQ ID NO: 99036 - protein, 343 aa, Glycine max
  Coding DNA Sequence Number=SeqID_7351
MAPRKLASKRSRKDKAAEGISSAPEYDSHRFRSAVHQQRFEAIKGWSFLRERRVQLRDDEYTDFQEEIGRRRWASLVTPMAKFDPEVVIEFYANAWPTEEGVRDMRSWVRGQWIPFDADAIGQLLGYPLVLEEGQECEYGQRRNRSDGFDEEAIAQLLCIPGQDFARTAVGRRVRIMRTNMTTLTQIWMTLLLSNIQPNDHNSDLPLPKCMAPTKHPLDSDKSNRALGFPALITGLCQSFGVPVAPSKVIWPPITRDFFEKYCTQRQAQRDAPQAADAPPPHQAGPAGSFDTEQYWRHLVRQQAANHRAHVQTHDCLYQMSLSLQSQGFTSFPCPTPDQFRAK

SEQ ID NO: 99037 - protein, 130 aa, Glycine max
  Coding DNA Sequence Number=SeqID_7352
MATARWALKHPVYGIVILRLGIYTSRPNVSKLCSPINSMNSSILISDDVPKGKLYKISEQTLSTNNECLSHRNKINDGTYEFGDPTVMWLRMPPDSWVTVTKGGVVDKSRAFAPTYPQFVMRNSDLRSSC

SEQ ID NO: 99038 - protein, 71 aa, Glycine max
  Coding DNA Sequence Number=SeqID_7353
MERSHNFNNGKRSQEVSPILKCYKMRKKAIKKEDPRTYIAWDDNDSSDGSEKEINLLSKDYESDENISQKV

SEQ ID NO: 99039 - protein, 263 aa, Glycine max
  Coding DNA Sequence Number=SeqID_7354
  Gene Ontology: Mol. function=RNA-directed DNA polymerase activity; Biological process=regulation of transcription, DNA-dependent
  Homolog annotation: Hit_ID=A7QSG9; Match level="QueryCoverage=60%, HitCoverage=24%, E-value=2e-35, Identity=44%"; Hit description =Chromosome chr12 scaffold_159, whole genome shotgun sequence
MAISFKTKDVNEEVTSKDMKSLMEQANYTNKYLQALGETIKTKVVPKQKSIEEASPSIPIEKPLFKPFKVSEKAKRKIRELRKTKSLIEGVGHSRYSPNLEKYFQNGNKNAVKTYLNRKVITNDDDKEIPDAVNTLIFTIAQHFIGDPSLWIDRSAELLSNLKCRTLADFRWYRDTFLTRVYTREDSQQPFWKENFLVGLPRSLGDKVRDKIRSQSVNGDIPYESLSYGQLIPYVQKVALKICQDDQIQRQLAKEKAQTKNDQ

SEQ ID NO: 99040 - protein, 56 aa, Glycine max
  Coding DNA Sequence Number=SeqID_7355
MDTSEPYTGAMKGTMHKPQPYTRAMRGTVHEPQVNLGADQKFSPIDVFKQKKGYKP

SEQ ID NO: 99041 - protein, 80 aa, Glycine max
  Coding DNA Sequence Number=SeqID_7356
MTSEAAKEIAEKIEQASQGSFVPHRRQDVLTAAIGRPEHPGRVHAAGAGVTIKQYFGPAPRTSRTFLHGSRRTKAADSKN

SEQ ID NO: 99042 - protein, 65 aa, Glycine max
  Coding DNA Sequence Number=SeqID_7357
MQQKRHPHAQSSSQPTINCTSEYDIIASDSLESVNSESTQGSCSNFLTAYEDCQSPTNRPIINTE

SEQ ID NO: 99043 - protein, 95 aa, Glycine max
  Coding DNA Sequence Number=SeqID_7358
MEDWGNYHHRILEEDSEDSALIKVFLLVWGFDDKQRLLAVATSGHWWWRRRYRLVSSSRKAGVHFSCLARQFGLSTTSSALGLAQRNSLSGWNCA

SEQ ID NO: 99044 - protein, 265 aa, Glycine max
  Coding DNA Sequence Number=SeqID_7359
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=93%, HitCoverage=66%, E-value=1e-108, Identity=85%"; Hit description=ATP synthase subunit alpha
  Pfam annotation: Domain name=ATP-synt_ab; Domain location=1-206; Score=356.1; E_value=5.9e-104; Accession=PF00006.16; Description=ATP synthase alphabeta family, nucleotide-binding domain
MIPIGRGQRELIIGDRQTGKTAVATDTILNQQGQNVICVYVAIGQKASSVAQVVNTLQERGAMEYTIVVAETADSPATLQYLAPYTGAALAEYFMYRERHTLIIYDDLSKQAQAYRQMSLLLRRPPGREAYPGDVFYLHSRLLERAAKLSSQLGEGSMTALPIVETQSGDVSAYIPTNVISITDGQIFLSADLFNAGIRPAINVEIGQVRKFLVELRAYLNTNKPQFKEIISSTKTFTGEAEVLLKEAIQEQMELFLLQEQVEKN

SEQ ID NO: 99045 - protein, 60 aa, Glycine max
  Coding DNA Sequence Number=SeqID_7360
LPTKKKKVPARQARAPERAGWVDIDMQDRLTLQGLDFSRKTRGKDAAAAVDCAKEKRRNK

SEQ ID NO: 99046 - protein, 97 aa, Glycine max
  Coding DNA Sequence Number=SeqID_7361
MQDKIDCNNINEIKEERDVNSIYTGSTTSRSKFKFKTLFNITRALDVLEILCFEFVNDAILARKEPVTRAMSKRPQEDWTRTAEEGPRVLMNLKVDF

SEQ ID NO: 99047 - protein, 173 aa, Glycine max
  Coding DNA Sequence Number=SeqID_7362
  Gene Ontology: Cellular component=integral to membrane
  Homolog annotation: Hit_ID=A6ZVW6; Match level="QueryCoverage=91%, HitCoverage=80%, E-value=1e-10, Identity=25%"; Hit description =Conserved protein
NPCGVYPDLSSFTGSGVYPDLSSFIGSGVYPDLSSLTGSGVYPDLSSLTGSGVYPDLSSFIGSGVYPDLSSFTGSGVIQISVTCIKRSAPTQTYQGNPCGVYPDLSSFTGSGVYPDLSSFIGSGVYPDLSSLTGSGVYPDLSSFIGSGVYHDLSSFTGSGVIQTFVACIKRSA

SEQ ID NO: 99048 - protein, 85 aa, Glycine max
  Coding DNA Sequence Number=SeqID_7363
AATIPKEEPLSSEASSSFPIAEHSHLDPSEDYIMAEEPRRVTLEDYSSSNIPQFFTSIAEPEENQGGFIHYKANGLNHEMAGRNF

SEQ ID NO: 99049 - protein, 93 aa, Glycine max
  Coding DNA Sequence Number=SeqID_7364
MPSKVILMMPKNQELSKVSSKDSRIKFQDSRFKTQESSFKNQDSRIIKIKIQDSRFKNQEDTVKITQEVFTKSFIKEFYSLVIDYQKVVIDYQ

SEQ ID NO: 99050 - protein, 52 aa, Glycine max
  Coding DNA Sequence Number=SeqID_7365
  Gene Ontology: Mol. function=helicase activity
  Homolog annotation: Hit_ID=Q9ZQR0; Match level="QueryCoverage=88%, HitCoverage=3%, E-value=2e-09, Identity=67%"; Hit description =Putative helicase
MAHKFCFEALDHSLRHIIKHNSKDNTIFGGKVMVFGGDFRQIPPVIPRGMQS

SEQ ID NO: 99051 - protein, 74 aa, Glycine max
  Coding DNA Sequence Number=SeqID_7366
MMPITNTNGHYPFPLDLRDKAEKPIGDTRKSTRNTRSKFLQLESVLTSDIRLSPIIYHGSSKVEIECRHKFGWP

SEQ ID NO: 99052 - protein, 36 aa, Glycine max
  Coding DNA Sequence Number=SeqID_7367
MFRFFRCFPQINVGGDSTRLPPLEDAPMSPRRPPAE

SEQ ID NO: 99053 - protein, 100 aa, Glycine max
  Coding DNA Sequence Number=SeqID_7368
MEENMWAIIDQYKEKLSLAATHEQRLEDEYAKVSVLQAEREARERVIDSLHREAMIWMHRFIFTLNGSQELPRLLAKAKAMADVYSAPRKFMGSLIIVST

SEQ ID NO: 99054 - protein, 102 aa, Glycine max
  Coding DNA Sequence Number=SeqID_7369
MTKGADNHKVPHMSSDSSSLDDKGAEDDVPITTRYPDMYRTRRLWMTKGADNHKVPPHVIVLAVSGLQKVQITISGLACPLLTKGADDDVSLCVLPDSESDG

SEQ ID NO: 99055 - protein, 112 aa, Glycine max
  Coding DNA Sequence Number=SeqID_7370
MTGFLRFFRYFPQINVGGDSAHFPPLEDAPVSLASLARKREIRSGGCTVAHLGELLASSKSNLARPGVLVTSSLSFLVGLGAEKCSKSDHFSLLLNILHISFLKRHKTLRIT

SEQ ID NO: 99056 - protein, 239 aa, Glycine max
  Coding DNA Sequence Number=SeqID_7371
MAATSIVSLGALLDKSLEVMIFFCFSFAATRDGCMVLVGYSKPLWHLEAEPHKQEIECGHDHTSSIGLDLLPQGWMHGSCGTIRHPLRTYLDQGYSEPLWHLEAEPHKQQIECGHDHTSSIGVGVGVTSLSDEIKSPEDGILMGSFGVMDLHPARVFFFFGKKGWDDWLIKLLFLLDSVTTYPSVGRRRETHGCVFQGRKTHGVATNVYLRKMLEKPKSGSMNFKYERFGSLFYTRGRY

SEQ ID NO: 99057 - protein, 70 aa, Glycine max
  Coding DNA Sequence Number=SeqID_7372
MTKSKGKDPLEGLGGPMTRARARKAKEALQQLRHQPLGDQMVIGSMAFGVTFGCHNFNYTQPLSSSNSLG

SEQ ID NO: 99058 - protein, 516 aa, Glycine max
  Coding DNA Sequence Number=SeqID_7373
ASQPVDTQRLTSSSAPLSSRDDESDDMRGYLMVIRIFCHPETVSPMSYGGASEPVDKQRLTSSSAPLSSRDDESEDMRGYLMVIRTFCHPETARPMTCKETNIVICTFCQPRASEPADTQRLTSSSAPFSSRDEEFDDMRGYFVGYLTVIRTFCQPEESELVDTQGQTSSSAPFVNLGQASPLTYYESDDIWGYPMVICAFCQLEASERIDRQRLTLSSADDESNDIWGYLSVIGTFCQLEASESIDTQRLTSDDESDDMRLYLMVIRIFCHPERSSPMTYGETASPMRCGVTNIVICTYCQQGVSKPADTQRLTSSSVPLSSREDESDDMQGYLIVIRTFCYPETASPMTCGDGESDDMRGYLMVIRTFCQPEESEPVDTQRLTLSSAPFVIQGQASPLTRRAKRHLLHLCHQEATRPMTCGVPYGVCTFCHPETASPMRCGGASELVDTQRVMSSSAPLSPREDESNDIWVYLMVIRTFCHPEIASSMTFGVPYGYPHLLSSRDDESDDMRRYL

SEQ ID NO: 99059 - protein, 145 aa, Glycine max
  Coding DNA Sequence Number=SeqID_7374
  Gene Ontology: Mol. function=motor activity; Cellular component=cell projection
  Homolog annotation: Hit_ID=UPI00016621D1; Match level="QueryCoverage =96%, HitCoverage=40%, E-value=9e-14, Identity=34%"; Hit description =UPI00016621D1 related cluster
MRGLHVLAIRGLPALTFKGLQVLAFRGLHVLTFGGLHILPFKGLHILTFRGLHILRFRGIHVRLFRGLHALPFRGLHVLAFRGLHALTIRGLHVLTLRGLHVLAFRGLHVLAFRGLHVLAFRRLHTLTFRGLHVLAFRWLHALTF

SEQ ID NO: 99060 - protein, 109 aa, Glycine max
  Coding DNA Sequence Number=SeqID_7375
GDLSYWEYVDTFHSVQSSNSSVKHSASSFPDSPKPPKPTRIIPMLDQFESFIQGFIDDIVDVKVDGKCGYQSIAGLLGMGEDSWSLVRHELMKELGKWSDDYIKLFGGT

SEQ ID NO: 99061 - protein, 139 aa, Glycine max
  Coding DNA Sequence Number=SeqID_7376
MAHSISASCPYSRDLQGRELKGLLVIFPKVVISLLMVSRGIILFEEHIAAVGTTSNNMLSERKTIDEGSLNFWHLIKFGESFSLSSLLNQSQTYQGNPCGIYPDLSSFTGSGIIQTSVACIKRSAPTQVHIIWYQSFGS

SEQ ID NO: 99062 - protein, 73 aa, Glycine max
  Coding DNA Sequence Number=SeqID_7377
  Gene Ontology: Biological process=transposition, DNA-mediated
  Homolog annotation: Hit_ID=Q1J7G7; Match level="QueryCoverage=49%, HitCoverage=51%, E-value=3e-12, Identity=94%"; Hit description =Transposase
MVKVGTSYVPINVSFSPKVGPGLPEVLQWLLFLSAVPPVQLLTGWCVTAKAPPDISAGKCSGHAARNHHTRRA

SEQ ID NO: 99063 - protein, 286 aa, Glycine max
  Coding DNA Sequence Number=SeqID_7378
  Homolog annotation: Hit_ID=Q6WAY6; Match level="QueryCoverage=94%, HitCoverage=45%, E-value=1e-34, Identity=34%"; Hit description =Putative uncharacterized protein
MEPIASLAQYYDQPLRCFIFGDFQLSPMVEEFEEILGCPLGGRKPYLFSGFYPSLARISKKVQISAQELDRQRQVENGVVGIPRKYLEVKARILADKGEWTPFIDILTLLIFEGVLFPNVDGLVDLAAIDVFLAYHNHKESPVVTMLADLYDTFDRRCEESNARIVCCTPALYVGLVSHLFLQEGRPVYPLQGYRSCVEKGKANWDQLLASMGGRLLIGSLAKKEGRIKILSSCEGCPNVPLMGTRGCINYNPVLAIRQLGYPMRGAPLDESITPFIARGFSDHNA

SEQ ID NO: 99064 - protein, 97 aa, Glycine max
  Coding DNA Sequence Number=SeqID_7379
NGHCSTPGDGQQEEEAHYLQNQARPQQNFQGRYQGYRGGLGSNQPYGRRPHNNTYSGPNNTSFAGPSNNTYGGSSIKGTQQQQAQPDRMSKMEDTLT

SEQ ID NO: 99065 - protein, 227 aa, Glycine max
  Coding DNA Sequence Number=SeqID_7380
  Homolog annotation: Hit_ID=Q2HW90; Match level="QueryCoverage=80%, HitCoverage=36%, E-value=1e-22, Identity=33%"; Hit description =Putative uncharacterized protein
MAEVSTEAIASLAQYYDQLLRCFTFGDFQLSPTVEEFEEILGCPLGERKPYLFSGFYPSLARISKIVQISMQELDHRKQVENGVVGVPRKCLEAKARVLAGKGEWAPFTDILVLLIFGGVLFPNVDGLVDLAATDAFLAFHDRKESPVIAILADLYDTFDRRCEKSSTRIVCCTLALYVWLVSHLFHQEVRHACPLEGHRSSTEKKEASWDQLLASKEGASVNRFPR

SEQ ID NO: 99066 - protein, 76 aa, Glycine max
  Coding DNA Sequence Number=SeqID_7381
MKNVEERSKTFAKFLTETLRKRLGLDFLHGNNFSKQIRKRKKKLGEKLATQLAQASSAPPGELSSPRRAGLLPLID

SEQ ID NO: 99067 - protein, 127 aa, Glycine max
  Coding DNA Sequence Number=SeqID_7382
PPKQVRVRGHLIKFDADSLNTFLETPVVLEPGETLPGYSRFCRLRPGPEELAAQLCIPGRGFFLNAEGLPWKLLRKDLTTLAHTWSVLSYFNLAPTSHTSDQNLDRARLVYGLVMKMGMNVGALISG

SEQ ID NO: 99068 - protein, 159 aa, Glycine max
  Coding DNA Sequence Number=SeqID_7383
MYNHHEKGRAPDLESVLADFMTYQASSKANCYSTQQQGTQFGKDYSFEDYQWESEWQPCYHNEAEGLFNLDDLLMQFKGTIDSMQQAFKRAETQIAKLVDKMIQVVVRREEESTTGYVVDRDKGRLELSVEDQKISFDLFEAMKHPDMSDVCFEEEEVE

SEQ ID NO: 99069 - protein, 125 aa, Glycine max
  Coding DNA Sequence Number=SeqID_7384
MVHDIFFKVKLEVTRTSTVLNVFGSRQSSDRKTQGSCMSKHENKKEYDNGQMQEQYVHYDAIKRRLCDALYECIYGHERPKNRIFLLVHLGAQCPMCTVKKVIWTFWPPMTKDESNIQRMRDDMM

SEQ ID NO: 99070 - protein, 190 aa, Glycine max
  Coding DNA Sequence Number=SeqID_7385
MSHHSSSVNGKGTSHKDPLSRILDELSSLKLWKEKLERKVKGKERVKINQDEREQIREEERRKILKELRKEKHASYSSHNSCKSLSEELRDYYEGRHRSHLRPHSHMREKERNPQEANINLPYFHGKDNVEANLDWEIRVEQQLKRKSTSKSYGSHSYPKKDHGQGILGVTPSKPKDDKGKTIERQPLKA

SEQ ID NO: 99071 - protein, 96 aa, Glycine max
  Coding DNA Sequence Number=SeqID_7386
  Subcellular localization annotation: CTP_CleavageSite=29; ConfidenceScore=5.03e-01
MRNALRNGSFAHTSNIFSKIPMVSQPTLRQGCKKAKIDGPNAWTCHQRLFKENVRKTKKARSADFESEGSGVVYARGRVLPSLQRILRCDEEFKPT

SEQ ID NO: 99072 - protein, 287 aa, Glycine max
  Coding DNA Sequence Number=SeqID_7387
DFQLVPTVKEFEEILGCPLGGRKPYLFSGFYPSTTRVAKYQGSVWRKGQRPWQIKANGLSFSDILALLIFGVVLFPNMEGLVDLAVIDAFLAFHHGKESPVVAILTMYDTFDRGCEKSSRELFVVHWLSMCGWFHTFFLQEGRPVYPLQGHRSCIEKGKANWDQLLANMEGRLGCINYNPVLAIRQLGYPMREVPSDESITPFIARGFSDHNARDRKLRGSSNGIIGGYHKRLRVRTQGLDWLPNLKTVRDDEVKASEESDEVQALKAKLERARVVKEKFKSIAIKV

SEQ ID NO: 99073 - protein, 71 aa, Glycine max
  Coding DNA Sequence Number=SeqID_7388
MTLSSWQNKLDKYFTCKTLVMKGGAWFCRAKQLRQRSPKQMASLGLHTAHVCRQFHHPPPLHSLASHVYCC

SEQ ID NO: 99074 - protein, 180 aa, Glycine max
  Coding DNA Sequence Number=SeqID_7389
MVREKKPTVNSSRNIPTIALPWRNSRQPIYQQPAMAVRDINAIVLRVATQYIAEGLLAWPHSRRMLTHQFPALVEEAGAAAVGVVHWSAQIVPRYRPVSFVVAKAGERRVPACYRIIFQALPARIGFKGGIAQKRGNDNDAQKDTTSEHHATATHTVQAEQNEGGEQAADQADRSPAGIN

SEQ ID NO: 99075 - protein, 85 aa, Glycine max
  Coding DNA Sequence Number=SeqID_7390
MGNFMCLPHGLRDMCMISLGLLALKGYRSGVIDILIGSVRHIGWRIVERQAIWREGVGWFIDAGWGRRVHLSNNAGSGNCNRIVK

SEQ ID NO: 99076 - protein, 177 aa, Glycine max
  Coding DNA Sequence Number=SeqID_7391
  Subcellular localization annotation: CTP_CleavageSite=34; ConfidenceScore=5.30e-01
MASFSQMQSLIQSQMQSQGLALPPEPLVGPSGTRVSTKGSCVDPSRNDSETGDSDRCGLYIEVDPARLVALGRVCEGSTIVHNTPLLPGQVKVSTSHLPCLADTSGQVFITTVVSPAKPPPKPDPQVDDPLYLMTLTIPRLFLRPYQVTWDATVFGVFNPHFPLYIKHEDLSEIAHG

SEQ ID NO: 99077 - protein, 134 aa, Glycine max
  Coding DNA Sequence Number=SeqID_7392
DGDVDLNASPQALDKLLGYELAFKIKVQPKFRNYVVLKCSADSSLINVVMDMLADAEVMFNTSSKMDIPVSDSNHSSQHESQSLSVTADHDPLLGLPLTPTKRQTFQDCDDEARTSQISPAQLSSNKLKKHDAI

SEQ ID NO: 99078 - protein, 166 aa, Glycine max
  Coding DNA Sequence Number=SeqID_7393
MLRSQDYLREATKGRIEGFFFSTKSLRWILRISLRLKCSSWCGGSAASNGGSWWSPMVEGGVEEGSGVAEIDGCNSRKIARPWRLMVLVQRLCYKNPEVGVGPEGSIACLVAKVYREKPLGFVAHGKSRLVCYLCRYAFCSETNHSIFYRYLSQFPSSGYLFNCLS

SEQ ID NO: 99079 - protein, 157 aa, Glycine max
  Coding DNA Sequence Number=SeqID_7394
MIYVVKNVRIPKYLDLEWFSKQGFNFPNLMEALGLSKLLDMKATFCSELVKVFYTYARTDLEGNLFSTVNGVEMVTGTEVWKEVVGVKMNWVLLIKDIMLKSRRLMDYKFLYVVLASRFIDYFNVNASNEIVDFTKASSEITERHLKKLGMRFANHE

SEQ ID NO: 99080 - protein, 67 aa, Glycine max
  Coding DNA Sequence Number=SeqID_7395
MSFLMAVVLDVGNNFSNNTLLSVEAKLHDDDKGDDKKLKDQSKNNSSESKINQRTTQVNQEQFKSSR

SEQ ID NO: 99081 - protein, 267 aa, Glycine max
  Coding DNA Sequence Number=SeqID_7396
  Homolog annotation: Hit_ID=A5AZ88; Match level="QueryCoverage=50%, HitCoverage=14%, E-value=1e-10, Identity=31%"; Hit description =Putative uncharacterized protein
MYNYHEKGRAPDLESILADFMTYQASSKGDFYSMQQQGTQFERDYSFADYQWESEWKPYYHNEAKGLFNLDDLLMQFKDTVDSMQQAFKRIETQIGKLVDGVTKVVVKREEEYPEIETHQESILQVNTIHHQLITKDEKDEVSIIPEYPYMATTGYVVGKDKGRLELSVEEQKISFDLFEAMKHPDMGDACFAEEEVEQEIALSASTMVLQFPLEEEPNCVTDCLVCDEELDDPQDNSVGHVVFEELEKIRPKEKPKVELKTLPAQL

SEQ ID NO: 99082 - protein, 105 aa, Glycine max
  Coding DNA Sequence Number=SeqID_7397
  Subcellular localization annotation: CTP_CleavageSite=40; ConfidenceScore=5.53e-01
MSPPPLEPHNHSQPHLKLSRRLPLQAPVYVGGFVCASALSATMDRSTRISRFRLSTCFSRSVDGLKWCAKRDELLTQCTCTVHLSSRFFLSLSRGVSRSADGSLS

SEQ ID NO: 99083 - protein, 151 aa, Glycine max
  Coding DNA Sequence Number=SeqID_7398
SEETIKKIKVKVRGVNSLPRELRIIVNFDDQGQAIGEAQALLAGFLGTLAADCKLFPMDYDRWSGPSGVPKAYFDDCFETILKINEAGAKRYCKLSMGRKWVENRQSLWNEFNDPTKTRDEIIKNVPIGIDKDQWARFVHYRHKPSTLLII

SEQ ID NO: 99084 - protein, 86 aa, Glycine max
  Coding DNA Sequence Number=SeqID_7399
MATARWALKHPFYGIVTLRMTFLNGKLHTTPEFQKHTIDNNEGSHGHVAPHAPGLLGHGNKKCGGRQKQGFCSYVSSICDEELRPT

SEQ ID NO: 99085 - protein, 270 aa, Glycine max
  Coding DNA Sequence Number=SeqID_7400
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=81%, HitCoverage=77%, E-value=1e-109, Identity=90%"; Hit description=Beta- lactamase TEM precursor
  Pfam annotation: Domain name=Beta-lactamase; Domain location=60-270; Score=107.4; E_value=4.3e-29; Accession=PF00144.15; Description=Beta- lactamase
MAPDAVFSPYASVRYFTPHMTSCDRLRELHVSEVFTVITETRETKGPRDTPIFIETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSR

SEQ ID NO: 99086 - protein, 352 aa, Glycine max
  Coding DNA Sequence Number=SeqID_7401
  Homolog annotation: Hit_ID=Q6UUU1; Match level="QueryCoverage=17%, HitCoverage=40%, E-value=5e-18, Identity=78%"; Hit description =Putative uncharacterized protein
MAPRKLASKRSRKDKAAEGTSSAPEYDSHRFRSAIHQQRFEAIKGWSFLRERRVQLRDDEYTDFQEEIRRRWWTSLVTPMAKFDPEIVLEFYANAWPTEEGVRDMRSWVRGQWIPFDADAIGQLLGYPLVLEEGQECKYGQRRNRSDGFDEEAIAQLLCIPGNILPTDHNSDLPLPKCQLVYAILTRMSVHVAQLIADAIYIFAGLCQSFGDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 99087 - protein, 113 aa, Glycine max
  Coding DNA Sequence Number=SeqID_7402
MSRRNIAERRRKLLQERIVASILEEETHFSDSSSPDSPSSRESATYFPEFVSMENEHQQRVTLEDYSSSSGNLFQGLPNEDPYAHLATFIEICNTVKIVGVLDEAKRWLHSFK

SEQ ID NO: 99088 - protein, 50 aa, Glycine max
  Coding DNA Sequence Number=SeqID_7403
MTKARQKGVRKEKEGDACHPARPGELRCFLQKQPPSGGTSWKAQVGQVAI

SEQ ID NO: 99089 - protein, 216 aa, Glycine max
  Coding DNA Sequence Number=SeqID_7404
MTLLLSNIVPTDHNSDLPLPKCQLVYAILTRMSIHVAQLIADAIYIFAGMAPTRHPLDPDKSNRALGFPALITGLYQSFGVPVTPSKVIRPPITRAFIEKYCTQRQVQGDAPQAADALPPHQAAPAGSFDTEQYLRHLVRQQAANHRAHSQGFTSFPCPTPDQFGAEVAWPGDWPEAQAGEAPAGAPAEAPDEAEEAREDEEMTDLLDFLGGSGAT

SEQ ID NO: 99090 - protein, 214 aa, Glycine max
  Coding DNA Sequence Number=SeqID_7405
MAKFDPDIVLEFYANAWPTEEGVRDMRSWVRGQWIPFDADAIGQLLGYPLVLEEGQECEHGQRRNRSDGFDEEAIAQLLCIPGQDFAQTAAGRRVRIMRTNMTTLTQIWMTLLLSNILPSDHNSDLPLPKCQLVYAVMTRMSVHVALLIADAIYIFAGMAPTRHPLDPDKSNRALGFPALITGLCQSFGVPVTPSKVIRPPITRAFIEKYCMQR

SEQ ID NO: 99091 - protein, 80 aa, Glycine max
  Coding DNA Sequence Number=SeqID_7406
GQVQTHECLYQLSPSLQSQGFAAFACPTPDQFRAEVAWPGDWPEAQAGEAPAEAPDDSEEGRMDKEMTDLLDILGGSGAT

SEQ ID NO: 99092 - protein, 90 aa, Glycine max
  Coding DNA Sequence Number=SeqID_7407
  Subcellular localization annotation: CTP_CleavageSite=55; ConfidenceScore=5.34e-01
ETSNVLLKGVVGTDGLYSFHNLKLQESPSLLMSAVSSVASPSPALTINNNSSTVMSDSISSSLSIANLWHARLGHPNDHVYLDISYKVQS

SEQ ID NO: 99093 - protein, 210 aa, Glycine max
  Coding DNA Sequence Number=SeqID_7408
  Homolog annotation: Hit_ID=Q6WAY4; Match level="QueryCoverage=73%, HitCoverage=28%, E-value=2e-18, Identity=36%"; Hit description =Putative uncharacterized protein
MGTNQNGKRFYQVKVKSLDVTSLKELGRLMGPLQRQAFRKVYGKILDLAAAEVFTEAVVSLAQYYDQPLRCFTFGDFQMVPTIEEFEEILGCPLGGRKPYLFSGFLPSLSRIAVVIADSAKELDRMKQTRNGIVGLPRKYLEGKARDMASQEKWGPFADILALLIFGVVLFPNIDDLVDLAAIDAFLAYHHSKESPVVAILADLFDTFDR

SEQ ID NO: 99094 - protein, 274 aa, Glycine max
  Coding DNA Sequence Number=SeqID_7409
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMLHLPMCMTEDEEGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 99095 - protein, 141 aa, Glycine max
  Coding DNA Sequence Number=SeqID_7410
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=71%, E-value=1e-24, Identity=69%"; Hit description=LacZ protein
MQCNLLHLQSCTLGDATSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 99096 - protein, 76 aa, Glycine max
  Coding DNA Sequence Number=SeqID_7411
MGAKYLEAIKQRLHAVKQWSPDEIRAINSWGSGLDGGGCMNDNQFMGLRIRFDGGGCTNSARQSIRGAPDSMVEDA

SEQ ID NO: 99097 - protein, 268 aa, Glycine max
  Coding DNA Sequence Number=SeqID_7412
MSLVTPMAKFDPEIVLEFYANAWPTEEGVKASSVSSARGGTGLTGLSTRQLPSCYAHRGRISPGPQQGGGNVYAILTRMSVHVAQVIVEAIYLFVGMPPTRHPLDPDKSNRALGFPALITSLYHSFGVPVTPRKVIRPPITRAFIEKVMPPPHQATDALPPPHQADPAGSLGMEHYLQHLVRQQAANHRGQVQIHECLYRFSLIQQGQGFAPFACPTPEQFGAEVAWPGDWLEAQAREEPAGSPGEAEEAHMDEEMNDLLDFLGGSGA

SEQ ID NO: 99098 - protein, 72 aa, Glycine max
  Coding DNA Sequence Number=SeqID_7413
  Gene Ontology: Biological process=transposition, DNA-mediated
  Homolog annotation: Hit_ID=Q1J7G7; Match level="QueryCoverage=47%, HitCoverage=48%, E-value=7e-12, Identity=97%"; Hit description =Transposase
MVKVGTSYGRSTSHFRQKLAQGFPVLQWLLFLSAVPPVQLLTGWCVTAKAPPDISAGKCSGHAARNHHTRRA

SEQ ID NO: 99099 - protein, 143 aa, Glycine max
  Coding DNA Sequence Number=SeqID_7414
MAAQLIHDRVEMECLEGVWETLEGNARCRFRGTIRLTATSLVHPEEPARTLQRTVEWILPTPTPYRLVEPVQVIEVTSSEEDPEEDPEELPPEPAVDALDFPKGDEDPFPEVDSPEDVMSASEADSTEESGLEGIVTSGGSSS

SEQ ID NO: 99100 - protein, 65 aa, Glycine max
  Coding DNA Sequence Number=SeqID_7415
MTLGAEFNVESLTCRDWNTSSKVSQKECVRFCARKKRTTYISMKFSRFKKLRLGFDMLMKDRDTG

SEQ ID NO: 99101 - protein, 46 aa, Glycine max
  Coding DNA Sequence Number=SeqID_7416
MDRVLAKFSPTRGIYGRCLIRIRLDYHEESGFSISGDTIERISIIK

SEQ ID NO: 99102 - protein, 107 aa, Glycine max
  Coding DNA Sequence Number=SeqID_7417
MAPRKLASKRSRKDKAAEGTSSAPEYDSHRFRSAEEIGHRRWTSLVTPMAKFNPEIVLEFYANAWPTEEGVRDMRSWVRGQWIPFDADAIGQLLGISVSAGRGLEVR

SEQ ID NO: 99103 - protein, 347 aa, Glycine max
  Coding DNA Sequence Number=SeqID_7418
  Gene Ontology: Mol. function=oxidoreductase activity, acting on the CH-OH group of donors, NAD or NADP as acceptor; Cellular component =cytoplasm; Biological process=metabolic process
  Homolog annotation: Hit_ID=Q9ZFV8; Match level="QueryCoverage=100%, HitCoverage=45%, E-value=1e-163, Identity=83%"; Hit description=NADP- dependent malic enzyme
  Pfam annotation: Domain name=Malic_M; Domain location=1-125; Score =49.0; E_value=9.5e-14; Accession=PF03949.6; Description=Malic enzyme, NAD binding domain
  Pfam annotation: Domain name=PTA_PTB; Domain location=153-347; Score =21.4; E_value=1.1e-12; Accession=PF01515.10; Description=Phosphate acetylbutaryl transferase
  Pfam module annotation: Pfam domain module=Malic_M::PTA_PTB; Domain location=1-125::153-347
MARSPLILALANPEPEILPPLAKEVRDDVIICTGRSDYPNQVNNVLCFPFIFRGALDVGATAINEEMKLAAVHAIAELAHAEQSEVVASAYGDQDLSFGPEYIIPKPFDPRLIVKIAPAVAKAAMESGVATRPIADFDAYIEKLSEFVYKTNLFMKPIFSQARKEPKRVVLAEGEETRVLHATQELVSLGLAKPILIGRPSVIEMRIQKLGLQIKAGVDFEIVNNESDPRFKEYWSEYYQLMKRRGITQEQAQRAVISNTSVIGAIMVHRGEADAMICGTIGDYHEHYRVVQPLFGFRDGVSTAGAMNALLLPSGNTFIADTYVNHDPSPEELAEITLMAAESVRRF

SEQ ID NO: 99104 - protein, 90 aa, Glycine max
  Coding DNA Sequence Number=SeqID_7419
MGVGPVAAPQFAGERMGVLQRHFATVGLTDMGNDGTGFNGIILYQFGYWRLKARLRIFKCATPFPFVKGNTPAVFMRPGAAPALNQPGRS

SEQ ID NO: 99105 - protein, 73 aa, Glycine max
  Coding DNA Sequence Number=SeqID_7420
MDSFASWKMNDSGMEKEERETRCHFKEKMSLEDAHHHRRPWIRAWRKKRKMNEGRGSEEHEILCSKRAMKSEV

SEQ ID NO: 99106 - protein, 300 aa, Glycine max
  Coding DNA Sequence Number=SeqID_7421
  Subcellular localization annotation: CTP_CleavageSite=38; ConfidenceScore=5.65e-01
MAESSKKHKGSSTSAAAYRTSCFGATGASPTPIPTSLSSSTLFSSNEQRIRYSSLFQSCQILDPKYLDLEFFDGETFDCYPVFQNTGLTPFMSLKLPYYLELVRVFYSNLKIQDGTLISEVHGIPMIIDESLFFSLTQLPSQGAPFEGTLVDDWKFDYSVMMPAAWSTLTRILMPHSSNLAQASEEDFILMWAFLTGAGAVTSFGYCKDMDGQWMKKDAQPPQDKRTPSPPPQRDDSSALMNEVLLELQGLRTYVGERFDSLDGRIDAIDARFEGMNTRITQLEEDVSYLRRCFDLPPPS

SEQ ID NO: 99107 - protein, 179 aa, Glycine max
  Coding DNA Sequence Number=SeqID_7422
  Homolog annotation: Hit_ID=A7UQU7; Match level="QueryCoverage=62%, HitCoverage=20%, E-value=2e-16, Identity=41%"; Hit description=IMP dehydrogenase/GMP reductase, putative
  Pfam annotation: Domain name=DUF1723; Domain location=97-146; Score =59.3; E_value=1.3e-14; Accession=PF08330.1; Description=Protein of unknown function (DUF1723)
MEAPAAVEDILADIPAGAGAEAAEDQPQGFPCGSSDPSVLTAYADHVACSVWTGERPELKLSSHGWKVHSLGRHVPAIEGLIAGTGLSPLIACSVDTGDRGLLSAFVERWHRETSSFHLPVGELTITLDDVSSLLHLPVIGDLHAFDPLHVDDTVQMLVDLLMVVDAIAFGVLMMIMMI

SEQ ID NO: 99108 - protein, 93 aa, Glycine max
  Coding DNA Sequence Number=SeqID_7423
MGTGVERNEDMGYVGVRELSWRWATGDGGFMRALWMWKTCCAPSPDRHLVPHVMEWYLEICRGGQETLGTSGGVLLPKTKLDQSRTNPGIVGQ

SEQ ID NO: 99109 - protein, 99 aa, Glycine max
  Coding DNA Sequence Number=SeqID_7424
MGSDQRRPMSTSYLFLKVGVLIVPEMDASLSVERPSFDGLKTLLMLGAPETVPIKLGSSTGPFQSRASLLDLFRGKLFQSHFLLEMNNSAKRNQKLEKW

SEQ ID NO: 99110 - protein, 212 aa, Glycine max
  Coding DNA Sequence Number=SeqID_7425
AEFDIPKASEGRTKKKILQTVGERDPLWEDVRKKAQAIQKQNTTPHVLSRGGYEYLEHKLMAKKTKKKLEEAAQSRNTKGVIDPPSPIKRHMKWKMARTKKTGQMTSEATKEIADKIEQASHGSFVPHGRQDLLTAAIGQPEHPSRGPAGGVDYRKSDSAADVILQPDVVPVEITDPIIGLALPPKPEVGPSAARVSTKGSCVDPSPTNLDI

SEQ ID NO: 99111 - protein, 105 aa, Glycine max
  Coding DNA Sequence Number=SeqID_7426
MTCLSRDMRWKLACEASMEVGSLSFNGDFPPWRCSGRQRRRGEGRHHPQGNKPWKKELHHQECALDKKLEDDALMEEKKEGRGEHEIEGIKEGEKWNFEVCLIRL

SEQ ID NO: 99112 - protein, 105 aa, Glycine max
  Coding DNA Sequence Number=SeqID_7427
GTWRYVAGVRRPWGRQASSWQSTDKRTKTTKQGGLCGGWPAVNFECYMGYGLWQHVVEASGNRLLGCVIDYIEEHAAVPRGNLGDPRRQCEVPISGHNSIHGYFI

SEQ ID NO: 99113 - protein, 406 aa, Glycine max
  Coding DNA Sequence Number=SeqID_7428
  Gene Ontology: Mol. function=motor activity; Cellular component=cell projection
  Homolog annotation: Hit_ID=P15305; Match level="QueryCoverage=99%, HitCoverage=88%, E-value=2e-26, Identity=23%"; Hit description =Dynein heavy chain
RLVEDPRLKALTIRGLHALTFRGLHVLAFRGLHVLTFRGLHVITFRGLHVLTFRGLHVLAIRGLHSLNFRGLHVLTFRGLHALAFIGLHAITFRGLHALAFRGLHVLSFRGLHVLAFRGLHVLAFRGQHAFIFRGLDVLTFRGLHVFAIRGLHILAFRGLHVPTFRGLHVLTFGGLHILTFRGSHVLTVRGLLALAFRGLHVLTFRGLHVLTFRGLHALDIRGLRVLEFVGLNAFTFRGFHALAFVGLHVLTFRGLHVLTFRGGLHALAIRGLHVLAFIGLHALTFRGLHVLAIRGLHVLAFVGLHAVTTKGLHVLAIRGLDAFTISGLRVLAFRGLHVLTFSGLHVLTFRGIHVLAFIGLHVLTFRGLHVLVFIGLHILAFIGLHVLTFLGLHTLAFRGLHVLIF

SEQ ID NO: 99114 - protein, 145 aa, Glycine max
  Coding DNA Sequence Number=SeqID_7429
MHTQGILATENCTHAHSGISNTYTYTNFVRNLGYPHNKPIADCWPKRVASPNMHPLLRSLASKNKLRFLGLGCMWGNHSSPYETEYMLQRQQTRTNQIVPLVVSLQNHAQMPLRHFTEHLVGARLGINSKRMGAMWHAPLLQNAL

SEQ ID NO: 99115 - protein, 106 aa, Glycine max
  Coding DNA Sequence Number=SeqID_7430
MARNVFAPCPYFRDLQGRELKGLLVIFPKVVISLLMVSRVESPTVATYPSAGGRRVTRGMRVPRKEYARSRHQRLFEENVGKTGKDAIYELLSERLGSCIYARGRY

SEQ ID NO: 99116 - protein, 52 aa, Glycine max
  Coding DNA Sequence Number=SeqID_7431
FEYAKSIPVEVVDSWVSFEEIDDSWMHYSDHLALAGDICLVPGQCVPEYMDW

SEQ ID NO: 99117 - protein, 274 aa, Glycine max
  Coding DNA Sequence Number=SeqID_7432
  Homolog annotation: Hit_ID=Q1H214; Match level="QueryCoverage=88%, HitCoverage=97%, E-value=8e-58, Identity=48%"; Hit description =Putative uncharacterized protein
MLKVTQCICPVFKQSELHRKRTERIFRMKLKSWVITGLLGTAVFSQAQAAELIQNGGFEVQGADSYDIPGWQVAEQGFLGSVLSQSGNVSEVTGNATVGAYQGTYYGLLDNYGLAGNVLYQSFTTAAVSQATLSFQMFINNQNATTEIDAAGLDYSVDATDHPNQHVRVDVLKAGSDPFSTNSADVLQSLYIGGENGGLAINNYVSYQFDLSSSLANGGSYLLRFATVANQSSLQLGIDNVSLQTVSSVPEADSYALMLAGLGVIAAVMRRRYA

SEQ ID NO: 99118 - protein, 83 aa, Glycine max
  Coding DNA Sequence Number=SeqID_7433
  Subcellular localization annotation: CTP_CleavageSite=70; ConfidenceScore=5.04e-01
MKDCKNTSGEDVFFTSRISQPLTNSSQALRLLPLQALVSTDLHIAKSLKTLSNLDLSLSRITRHAKLQLSAQTPFTKSDFRLK

SEQ ID NO: 99119 - protein, 259 aa, Glycine max
  Coding DNA Sequence Number=SeqID_7434
  Homolog annotation: Hit_ID=Q2HW90; Match level="QueryCoverage=28%, HitCoverage=14%, E-value=3e-07, Identity=40%"; Hit description =Putative uncharacterized protein
MGSSQKPSLKKRFYQVKIKSLEVTSLGELGQLMGQLQRTSQLVPTVKRVGRNPLGCPTGRKEAISFLWVLSLHDKSCQGSENLSTRVGTVKQNRNGVVGVPRKCLEVKARILADKGEWTPFIDIFTLLIFEGVLFPNVDGLVDLAAIDVFLAYHNHKESPVVAMPADLYDTFDRRCEESNARIVCCTPALYVGLVSHLFLQEGRPVYPLQGYRSCVEKGKANWDQLLASMEGRLLICSLARRKEESGFYLHAKDVQMFP

SEQ ID NO: 99120 - protein, 93 aa, Glycine max
  Coding DNA Sequence Number=SeqID_7435
MDLPASRDKRRDQHIMHARNVFASCPYLRDLHGRKLKGLLVIIPKVVISLLMVSRGIIPFEEDIAVVGTTSNNMLSKRKTLDEGSLLSSKSET

SEQ ID NO: 99121 - protein, 194 aa, Glycine max
  Coding DNA Sequence Number=SeqID_7436
MDSRKRKSIGTRPTSQYDTRRFSSLDAWTKYTDNVLGRNILPERKVELYHTELDDFKAEMERRNFHKRLTNLADGSIDLALVKEFYANLLSSEDHPPKQSRVRGHLVKTDADSLNAFLETPVVLAEGETLPAYSRYCRLPTDFREIEATLCIPSRGFILNSEGHPGRILRKDLTTLAQVSSVLILQLGPHITYL

SEQ ID NO: 99122 - protein, 349 aa, Glycine max
  Coding DNA Sequence Number=SeqID_7437
  Gene Ontology: Mol. function=peptidyl-prolyl cis-trans isomerase activity; Cellular component=integral to membrane; Biological process=protein folding
  Homolog annotation: Hit_ID=A8GAR3; Match level="QueryCoverage=99%, HitCoverage=55%, E-value=1e-171, Identity=89%"; Hit description=PpiC- type peptidyl-prolyl cis-trans isomerase
  Pfam annotation: Domain name=Rotamase; Domain location=2-79; Score =50.5; E_value=5.7e-12; Accession=PF00639.12; Description=PPIC-type PPIASE domain
ETEAEANAALDELKKGADFATLAKEKSTDIISRRTGGELGWLEPETTADELKQANLTEKGQLSGVVKSSVGYLIVRLNDIEPEKVKPLSEVHDAIAKQVQQEKAVDAYYALQQKVSEAATSDNESLASAEEAAGVKAAQSDWFTRDNIPAALNFKPVVQAIFDGSLIGENGAPGSNSDVITVDGDRAFVVRVSGHKPEGIEPFDQVKDRVAELVKRNKALQAAKLQGEKLLVELKQGKGDEAMKAAGLSFGAVQKMARAPEDSQLVESVFALPHPQDGKPVYGMSQDRQDNVVLIALDAVKPGTLPEDEMKTFVGKMEEGATGVSFDSLLASLRKEAEIKMGAAEQQPQ

SEQ ID NO: 99123 - protein, 237 aa, Glycine max
  Coding DNA Sequence Number=SeqID_7438
  Gene Ontology: Mol. function=nucleotide binding; Cellular component =intracellular
  Homolog annotation: Hit_ID=A6UDS5; Match level="QueryCoverage=86%, HitCoverage=33%, E-value=3e-96, Identity=86%"; Hit description=GTP -binding protein TypA
  Pfam annotation: Domain name=GTP_EFTU; Domain location=1-92; Score= -45.6; E_value=0.0001; Accession=PF00009.18; Description=Elongation factor Tu GTP binding domain
  Pfam annotation: Domain name=GTP_EFTU_D2; Domain location=114-185; Score=53.4; E_value=8e-13; Accession=PF03144.16; Description =Elongation factor Tu domain 2
  Pfam module annotation: Pfam domain module=GTP_EFTU::GTP_EFTU_D2; Domain location=1-92::114-185
MPQTKFVVGKALKVGLRPIVAINKIDRPDARHEEVVNEVFDLFAALDATDEQLDFPILYGSGRSGWMNVNPEGPTDEGLAPLLDLVVKHVPEPKVEEGPFRMIGTILEANNFLGRIITGRIASGSIKPNQAVKVLGQDGKLIENGRISKILAFRGIERTSIEEAHAGDIVAIAGLSKGTVADTFCDPAVMEPMQAQPIDPPTVTMSFHRQRFAARRHRRRQGDEPRHPRPSVQGSWR

SEQ ID NO: 99124 - protein, 152 aa, Glycine max
  Coding DNA Sequence Number=SeqID_7439
  Homolog annotation: Hit_ID=A2Z3N8; Match level="QueryCoverage=89%, HitCoverage=14%, E-value=1e-07, Identity=29%"; Hit description =Putative uncharacterized protein
MGNFSQDNWRWDLKWRRNLFDYESDLAVNFMEEITFIPIQRHVKDIMIWKADPSGVYSTNSAYRLLINPSTPASDDTVCPLCGQEQEEVGHLFFNCKRIVGLWWESMRWILAVGPFPASPVNHFLQYCDGLGAEINHSSWCGWWVALTSTVW

SEQ ID NO: 99125 - protein, 339 aa, Glycine max
  Coding DNA Sequence Number=SeqID_7440
MVKESVVVVEGFPPKGDTIEDIISPNSTIIVEDEEALNGIVVTLKIEEPVVSNAGAREEEESKEKKGIEEEEVKEKYRGHGEEDDKCRVCGEESMHGNSGGQDMRVRLIKGEKSITGRLWRFDIYIACFRKLAPTDAEKREKLESEKRHANRGRILAFQSFKQSFNLWPPFLPQIAKGEHFRSREVRGYEWDFENPGLGGLLSPLNFVGMGCKSSLNKSKWMLWTGVRIDGDPVLRETRIWATWEYVSSVGGGQQGMVGLCAHCGCGKLVVHHRPTATYGTWRYVAGVRRPWGRQASSWQSTDKRKTRPQSKEACGGWPAEAKMVSGNRLPRGVIDYQA

SEQ ID NO: 99126 - protein, 219 aa, Glycine max
  Coding DNA Sequence Number=SeqID_7441
  Gene Ontology: Mol. function=protein phosphatase type 2A regulator activity; Cellular component=protein phosphatase type 2A complex; Biological process=signal transduction
  Homolog annotation: Hit_ID=Q9FVD4; Match level="QueryCoverage=29%, HitCoverage=12%, E-value=8e-24, Identity=85%"; Hit description =Ser/Thr specific protein phosphatase 2A B regulatory subunit beta isoform
  Pfam annotation: Domain name=Ribosomal_S13; Domain location=48-120; Score=-26.9; E_value=0.018; Accession=PF00416.13; Description =Ribosomal protein S13S18
DVLDIVSDIVDPALCALCSNSSIFGQDVLDIVSDISLVVNEYFQHILRVLNTNVDGKQKIMFALTSIKGIGRQFTNICSKIANVDMNKSYMFHFIGGTLLIKDCLSSKVSTPSIPPTPRTEGEILKSSNMKSFNFSELKTATRNFRPDSVVGVKRRQVPTPSRPSRSLGNNITRVVRHGAESVGVDANGNSFDITTKLLHLACHPAENSIACAGADSLK

SEQ ID NO: 99127 - protein, 55 aa, Glycine max
  Coding DNA Sequence Number=SeqID_7442
MRHPMANPHTCPQDEVDKNKWTYQPCSNRDSVEVVPLRRTTINKSRFPSITYILS

SEQ ID NO: 99128 - protein, 96 aa, Glycine max
  Coding DNA Sequence Number=SeqID_7443
  Subcellular localization annotation: CTP_CleavageSite=62; ConfidenceScore=5.04e-01
TYQGNPCGVYPDLSSFTGSGVYPDLSSFTGSGVYPDLSSFIGSGVYPDLSSLTGSGVYPDLSSFTGSGVYPDLSSFIGSGVIQTFVACIKRSAPTQ

SEQ ID NO: 99129 - protein, 102 aa, Glycine max
  Coding DNA Sequence Number=SeqID_7444
MNCIFVHVSSTFEFGAMRSDCLVKFSILTLLQSLMNCVFVHASSTFEIGAMRTDCLVQFSILTLFRRPMNCIFVHVSSTFEFGAMRSDCLVQFSILNLFGAP

SEQ ID NO: 99130 - protein, 296 aa, Glycine max
  Coding DNA Sequence Number=SeqID_7445
  Homolog annotation: Hit_ID=Q6UUU1; Match level="QueryCoverage=20%, HitCoverage=40%, E-value=4e-18, Identity=78%"; Hit description =Putative uncharacterized protein
  Subcellular localization annotation: CTP_CleavageSite=42; ConfidenceScore=5.16e-01
WNSYVPINVSFSPKVGPGLPAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMDCATISVKQLNSDGKNPDKDHPHPPYMKALTATIDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 99131 - protein, 117 aa, Glycine max
  Coding DNA Sequence Number=SeqID_7446
RAQLAQASQVASSRSNSLLEEYSGGPNTSQGPKKGRMSSSKGPRTKLGYDIILSQKGIEVDPEKVKAILGMPELRTERQDQTVSHEASRAYATGARKTSHLVYDDFGRVDGVYVGAT

SEQ ID NO: 99132 - protein, 310 aa, Glycine max
  Coding DNA Sequence Number=SeqID_7447
MAKFDPDIVLEFYANAWPTEEGVRNMRSWVRGQWIPFDVDAIGQLLGYPLVLEEGQECEYGQRRNRSDGFDEEVIAQLLCIPGQDFARTAAGRWVRIMRTIMTTLTQIWMTLLLSNILPTDHNSDLPLPKCQLVYAILTRMSIHVAQLIADAVYIFAGMAPTRHPLDPDKSNRALGFPTLITGLCQSFGVPVTPSKAADAPPPHQAGPAGLFDTEQYLRHLVRQQAANHRAHVQTHDCLYQMSLSLQSQGFTSFPCPTPDQFRAEVAWPGDWPEAQAGKAPAEAPDEADEAREDEEMTDLLDFFPGSGAT

SEQ ID NO: 99133 - protein, 152 aa, Glycine max
  Coding DNA Sequence Number=SeqID_7448
MTQELVARGDTLRLSAPRHSVTPSVIDEQSPIWSSAPFPEMSAFSDGDFSSLTSYPELRRSEFLIGGYRRAGPMIRGDTLRLSAPFCYPEATGPMTSRDQVWSFCTLVSSRGGGPDDTRRYLTVIRILLSSRGGGPDDKQRPSLVILHPCII

SEQ ID NO: 99134 - protein, 41 aa, Glycine max
  Coding DNA Sequence Number=SeqID_7449
MAAPRSLSLSKIIGRPVRVTMFCENAPTIWDQHRLKGALKP

SEQ ID NO: 99135 - protein, 153 aa, Glycine max
  Coding DNA Sequence Number=SeqID_7450
  Homolog annotation: Hit_ID=A7UQU7; Match level="QueryCoverage=96%, HitCoverage=24%, E-value=5e-20, Identity=34%"; Hit description=IMP dehydrogenase/GMP reductase, putative
MGCTLFANKSATNVHVVYLEALRDLSQTGRYAWGVATLVHMYNQLNDASISSNRQLGSFITLLQCWIYEHFPSVAESTADQDYDEDSPRACRWIATKKTVKSIRTPVYNERLDQLWILNVCWIPYGEHRPVQDFHLISCYSGLLRWGPVVYYT

SEQ ID NO: 99136 - protein, 408 aa, Glycine max
  Coding DNA Sequence Number=SeqID_7451
  Pfam annotation: Domain name=FG-GAP; Domain location=252-278; Score =3.6; E_value=2.9; Accession=PF01839.14; Description=FG-GAP repeat
  Pfam annotation: Domain name=FG-GAP; Domain location=371-399; Score =21.5; E_value=0.0031; Accession=PF01839.14; Description=FG-GAP repeat
  Pfam module annotation: Pfam domain module=FG-GAP::FG-GAP; Domain location=252-278::371-399
MGYNLVKWMDAQGNYITYEYEKNQYLTSQPVPGGDDKLLNEVVVSTNGNQFRRYALEYTDNGTSYQFVNKITEYNSNNEAANPIAIEYEPAQTAGEETTKEYNITTTNTKKYGDFDMDGITDYLEYVPTPGTAGSTQVGVLNFKSSVYKDVPVMPLQYELNRFTAAEFGKAASVTFKKDGYVKNKAGIVIPHTVATGDPKKPNYELLVYSVDISDFRFKLEYSKLITYDQYAIGDPGDDDLPMTGCNYSVVSLSELTTSYDYDGDGITELLFNFRRTRTCINGGFDPEPIGKTISNPVALDETTPPTLPYIEPSVNSSNTEEYGVPPIDNGEVNIIPGSTLTSFYSSILFDLSENLPVAESIYKYDEGTGAAKKIQFADFNGDGIQDIIWLNSSNGQALGGFFNGALY

SEQ ID NO: 99137 - protein, 109 aa, Glycine max
  Coding DNA Sequence Number=SeqID_7452
MRSFNGDFPPWRCSGRQTRRGERRRHPLGNKPWKKELHHQDEPWIRSLEGCLEGCFNGGKERGRERERGEHEIEGIKEGEKWNFEVASLRSFLEKTSLRSFFEKTSLRS

SEQ ID NO: 99138 - protein, 361 aa, Glycine max
  Coding DNA Sequence Number=SeqID_7453
  Homolog annotation: Hit_ID=Q6WAY6; Match level="QueryCoverage=65%, HitCoverage=44%, E-value=2e-17, Identity=29%"; Hit description =Putative uncharacterized protein
PIDAFLAYHHSKESPVVAVLADLFDTFDRRCEKSSARSICCLPALCVWLVSHLFQQDTRHPCPLLSHRSCTEKRRIDWDQLLAGIGGRTISWFPKWKEGKEGVIFSCGGYPNILLVGTRGCINYNPALAIRQLGYPMRGAPTEESMSPLLVRDFGAQNFKAIQRINKAWETPLSKDQELRGIRNGIIGGYHEWLKVHIRGLDWLAKLKVISEESFEAPEEDGEVQALKSELRKAKLAKEKFKARKEECGRNKFRGALWGSNSELKLRREERDQSRAHSMVLKEELVACSRIADEYAQVYAEKEARGRVIDSLHQEATMWMDRFALTLNGSQELPRLLAKAKGDWRDTYSAPRRRFMGLLGY

SEQ ID NO: 99139 - protein, 257 aa, Glycine max
  Coding DNA Sequence Number=SeqID_7454
  Homolog annotation: Hit_ID=Q6UUU1; Match level="QueryCoverage=42%, HitCoverage=91%, E-value=1e-21, Identity=50%"; Hit description =Putative uncharacterized protein
  Subcellular localization annotation: CTP_CleavageSite=67; ConfidenceScore=5.22e-01
MVKVGTSYVPINVSFSPKVGPGLPGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKIPAFPLAAPRALSCSCLSVTGVIPLLWPRLSHSTPDTQFRVGSSLQAGLYARTPRSVRPLRLIRHAPVKAKLKGQVLVTALLQASYLGSKSW

SEQ ID NO: 99140 - protein, 303 aa, Glycine max
  Coding DNA Sequence Number=SeqID_7455
REEETLQAGHYTNDVSSLNNGAGMVEVGEQVEGSSADGAAASAARAAADATDAVADDAAAAVEAASPLWFSAQRRSLHRPAAAAPTRAVRVRALPGGTQRLLVGLCRGSVERHQHDAHRLCMAALPRQCFRHCDLRGLVQGIAIHAAADRRERDRLHAQRLGQLQRFPVAVGQQCRFVALAVVPDRAHRVQYMLRRQCISVCGAHFAGRATHARAQLRQLLALGQQRRARGTMDRTVDTAATEQCFIGRVDDRIHRQGRDVALPNFDLHASVSCLASILRHDRLTRCDPTAFTHDGGRRLHAG

SEQ ID NO: 99141 - protein, 96 aa, Glycine max
  Coding DNA Sequence Number=SeqID_7456
  Gene Ontology: Mol. function=protein kinase C binding; Cellular component=cell projection
  Homolog annotation: Hit_ID=Q9JKS4-3; Match level="QueryCoverage=96%, HitCoverage=9%, E-value=2e-09, Identity=35%"; Hit description =Isoform 3 of Q9JKS4
MTSPSEGYIPSPSEDYTPSPLQGYTSSPSEDYTSSPSEGYTSSPSEGYTPSPLEGYMPSPSKDYTSSPSEGCTPSPSEGCTPSPSEGYMPSPSEDY

SEQ ID NO: 99142 - protein, 215 aa, Glycine max
  Coding DNA Sequence Number=SeqID_7457
  Homolog annotation: Hit_ID=Q6L477; Match level="QueryCoverage=29%, HitCoverage=10%, E-value=7e-09, Identity=37%"; Hit description =Putative uncharacterized protein OSJNBa0009L15.8
  Subcellular localization annotation: CTP_CleavageSite=28; ConfidenceScore=5.78e-01
MGSPPVSTPPPPSPPRPPPTSDASASTSAVKRTRKASRLRSLSTRPPGVERPVVDITYENWKEVPTAQKDLIWEDIQAEFDIPEASDSRTKRKLLQTVGERWRQFKSDLTRKMGPCSPIRTVSRTLSVTNTASARKSGPSFARLAKTLLGRHRPSRNRILPPTFCLVGEAAQSGSVDGVIDPPSPVRRHVKWKMARTKKTGEMTTEAAKEIVEKI

SEQ ID NO: 99143 - protein, 140 aa, Glycine max
  Coding DNA Sequence Number=SeqID_7458
  Homolog annotation: Hit_ID=O52175; Match level="QueryCoverage=58%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQKHHWQQPLVIDLEELVLKSCAG

SEQ ID NO: 99144 - protein, 111 aa, Glycine max
  Coding DNA Sequence Number=SeqID_7459
  Subcellular localization annotation: CTP_CleavageSite=17; ConfidenceScore=5.05e-01
MRNTNASGTFPPVWRQSCSQRHGPFGFASELSDVGRNRQRPAGAGIIAPEMSDCSGRCAAPEQSGSFVVFLRCAVRDRGVDRTEFTFPLGTCGMPLLFVLTFRTTGLLPQF

SEQ ID NO: 99145 - protein, 95 aa, Glycine max
  Coding DNA Sequence Number=SeqID_7460
  Homolog annotation: Hit_ID=A5B715; Match level="QueryCoverage=100%, HitCoverage=20%, E-value=4e-27, Identity=58%"; Hit description =Putative uncharacterized protein
MDINYDIRKDEPPAITDERSLADVALYERWERSNWLSVMFIKTKILAGIRGSVDQHEKFITSDKTLANIMIMKFSSLQLTRVKGVREYIKKMRDI

SEQ ID NO: 99146 - protein, 69 aa, Glycine max
  Coding DNA Sequence Number=SeqID_7461
MKQDVNKNANNRTRTKTQTWTEYKEKDLDRIKTVSRAEALIPDDVILTRSGSLDTGYEDLDNATSSEGR

SEQ ID NO: 99147 - protein, 72 aa, Glycine max
  Coding DNA Sequence Number=SeqID_7462
  Subcellular localization annotation: CTP_CleavageSite=39; ConfidenceScore=5.47e-01
MATSRVLLPWKTHPLRHTAKRSFSALSATKESGRASIPRLCAKREISALTTTVVFTQAQRMTGAKFKFTYSC

SEQ ID NO: 99148 - protein, 367 aa, Glycine max
  Coding DNA Sequence Number=SeqID_7463
  Homolog annotation: Hit_ID=A5C8I0; Match level="QueryCoverage=29%, HitCoverage=25%, E-value=5e-08, Identity=29%"; Hit description =Putative uncharacterized protein
MIAFSEFTHIDMWDVVEKDNHIALDVEKKEISRDKWMNDHKSIFLLNSCARNALSCVLSQVEYSKVHSFRSVKHMWDTLAITYEGSFEVKHNKLSLLTPLRAIKNIDSMTLEELVRILKLHEQELSQDEGSKKGNSLALTVQRPKREANIYLMADASTSKDEPTLYASSNVEDLQLDDTVNSDGEELGDLKKIHQAHLVDFVLKTTSPGDVQDTFICQEVKELLDEKLKGPEVLKKLPSEIEKLYKEIETLRDNLGKFVGGHQDLSKIIKVQRNPKEKFGHGFKGKKVVHGEEVIVFYFCGKVGHETYKCKDLPEKGNPLKGSSSAYHHPQANKEKGSKKIWVPKNKIILIAYLLDGRKETLVMEPE

SEQ ID NO: 99149 - protein, 68 aa, Glycine max
  Coding DNA Sequence Number=SeqID_7464
MERYLQHLVRQQATNHRGQFRAEVTWPGDWPEAQAGEAPAKAPGDAEEARMDEEMTDLLGFLGGSGAT

SEQ ID NO: 99150 - protein, 147 aa, Glycine max
  Coding DNA Sequence Number=SeqID_7465
TIKEVQGIFESKPTALRGSGNADSLLHFLFLVVLIRRTTDMAFQNSNLIPFMSLKLSVYSELVKAFYSNLEIQESTLIFEVYGIKMVIDQSLFYDLTQLSSEGVPFEGALNDDWKFDFSVHDAHRLVCTNQADITERLIAGSLAFES

SEQ ID NO: 99151 - protein, 143 aa, Glycine max
  Coding DNA Sequence Number=SeqID_7466
PPITRAFIEKYCTQRQVQGDAPQAADAPPPHQAGPAESFDKEQYLRHLVCQQAANHRAHVQTHDCLYQMSLSLQSQGFTSFPCPTPDQFRAEVAWPGDWPEAQSGEAPTEAPAEAPDEADEAHEDEEMTDLLDFLGGSFLFPF

SEQ ID NO: 99152 - protein, 88 aa, Glycine max
  Coding DNA Sequence Number=SeqID_7467
MSILTLGSEKEKKEISNQKKREGKFPIKEKAKKERRKISNQRKKGSKEIPNQRVGESEKERKGNSKSKKKEWEKVKRRSSWSKNQKNV

SEQ ID NO: 99153 - protein, 113 aa, Glycine max
  Coding DNA Sequence Number=SeqID_7468
MYNLHEKGRAPDLESVLADFMTYKASSKGNCYTTQQQRTQFGKDYSFEDYQWELEWQPCYHNEAKSLFNLDDLLMQFKGTVDSMQQAFKRAETQIGKSVDDMTKVVVKRVCRD

SEQ ID NO: 99154 - protein, 238 aa, Glycine max
  Coding DNA Sequence Number=SeqID_7469
MTSIAQSNTSRLVFPALIIALCRARGVVYDSLTFERLSPIINLAYIRKNCWNPEDLIVSIRGARRARARPAELPSTFAAPTPASTSAALSVPVQTDSQRFEVMLQSIHRGQIILLQSLQVVAPLGYIPSVEEDEGPTTQVPQQVKDESSEATIPEPFFIREEAEKTQVRQVAAATPERSIKATSEPSAQREDIPSPQPAIDPSTPLLERPEDLNTSVLAMDTSPPTTPVLHLTDEEDL

SEQ ID NO: 99155 - protein, 122 aa, Glycine max
  Coding DNA Sequence Number=SeqID_7470
MTFLGETSSQTIVNCRFAFIFPNGSIIHNKSSVYFQSSTLIHIRVLDDCGFEILKSRMQNTLQLTNNQYLDEIYYRQPFTDSGKNPKRFDIPSGCSIDGLKDVIKQVAPQGIPPYGIHESQT

SEQ ID NO: 99156 - protein, 85 aa, Glycine max
  Coding DNA Sequence Number=SeqID_7471
MGDFISRLSFPACLHFSEENTETFSSLTSYQELRRSEFLIGGYVGARALLLSTTPPFVTMPQELVARGDTLRLSAPFVIQRWRAR

SEQ ID NO: 99157 - protein, 170 aa, Glycine max
  Coding DNA Sequence Number=SeqID_7472
MSWKRTHYFSMPHHKNHDYEGPRHLDESEEAKGEESSEEIYPQEDGQPLVVKEKCKEVSVSYKRLAKKEAHFTIKTNIKKTFPLRQPPHFLFCKKTLATIATPLGLEFIPQVKKLLDEGLVRKSLNPCALLVPKIGVKGRSPEYEEPQDLRSNPFQGGGDDAILPPKGIG

SEQ ID NO: 99158 - protein, 641 aa, Glycine max
  Coding DNA Sequence Number=SeqID_7473
  Gene Ontology: Mol. function=zinc ion binding; Cellular component =intracellular; Biological process=thiamin biosynthetic process
  Homolog annotation: Hit_ID=A8AKS9; Match level="QueryCoverage=80%, HitCoverage=81%, E-value=0.0, Identity=95%"; Hit description =Thiamine biosynthesis protein thiC
  Pfam annotation: Domain name=TMP-TENI; Domain location=469-637; Score= 103.0; E_value=9e-28; Accession=PF02581.8; Description=Thiamine monophosphate synthaseTENI
  Pfam annotation: Domain name=ThiC; Domain location=37-487; Score =1054.0; E_value=0; Accession=PF01964.9; Description=ThiC family
  Pfam module annotation: Pfam domain module=TMP-TENI::ThiC; Domain location=469-637::37-487
ERSSAYTKARLADDGLDELRFGGLLTPKRAVAGKCVTQLHYARQGIVTPEMEFIAIRENMGRERIRSEVLRQQHAGEGFGARLPDNITAEFVRDEVAAGRAIIPANINHPESEPMIIGRNFLVKVNANIGNSAVTSSIEEEVEKLVWSTRWGADTVMDLSTGRYIHETREWILRNSPVPIGTVPIYQALEKVNGIAENLTWEAFRDTLLEQAEQGVDYFTIHAGVLLRYVPMTAKRLTGIVSRGGSIMAKWCLSHHQENFLYQHFREICEICAAYDVSLSLGDGLRPGSIQDANDEAQFAELHTLGELTKIAWEYDVQVMIEGPGHVPMQMIRRNMTEELEHCHEAPFYTLGPLTTDIAPGYDHFTSGIGAAMIGWFGCAMLCYVTPKEHLGLPNKEDVKQGLITYKIAAHAADLAKGHPGAQIRDNAMSKARFEFRWEDQFNLALDPFTARAYHDETLPQESGKVAHFCSMCGPKFCSMKITQEVRDYAAKQNIEAGMADMSNNFRARGAGVRTIQLRIKDQRDSDVEDDVIAAIALGRRYRARLFINDYWQLAIKHRAYGVHLGQEDLETTDLSAIRQAGLRLGVSTHDDMEIDVALAARPSYIALGHVFPTQTKQMPSAPQGLEQLAGHIQRLADYPT

SEQ ID NO: 99159 - protein, 67 aa, Glycine max
  Coding DNA Sequence Number=SeqID_7474
  Gene Ontology: Mol. function=phosphoprotein phosphatase activity
  Homolog annotation: Hit_ID=Q9LNG5; Match level="QueryCoverage=89%, HitCoverage=4%, E-value=5e-14, Identity=51%"; Hit description =Serine/threonine protein phosphatase 7 long form homolog
MASDRDEFLWVPYSEEVQALLSHLCFAGSAIWRCVVSMICFNVVEWHQPDRVMRQFGLQQPIPGPPL

SEQ ID NO: 99160 - protein, 90 aa, Glycine max
  Coding DNA Sequence Number=SeqID_7475
MGCQLFDKIIHHDHLSEADSRRYFQHLIQAEWRRRRVKRRRHFKEKMSQEEVHHHRKSWIRAWRYEKKKGGRRREGARNLCLKRGLNFEV

SEQ ID NO: 99161 - protein, 70 aa, Glycine max
  Coding DNA Sequence Number=SeqID_7476
MGEGEEVKEQMKADMEAMKRANGHNDGGHDEHEKDNGIHAVIVAATSTVAKVNPMPPSGLNQMNHPTSDM

SEQ ID NO: 99162 - protein, 96 aa, Glycine max
  Coding DNA Sequence Number=SeqID_7477
  Subcellular localization annotation: CTP_CleavageSite=53; ConfidenceScore=5.10e-01
MYRGPRGSFGVEGRSKVGPSNQAYRYRRPRGGARIYSASSLTDSLRSVVRLRRAEMAYERGGDFLEDARKILNREVRGPRQAVFHRLRPPDKHHEI

SEQ ID NO: 99163 - protein, 245 aa, Glycine max
  Coding DNA Sequence Number=SeqID_7478
  Gene Ontology: Mol. function=metallopeptidase activity; Cellular component=membrane; Biological process=proteolysis
  Homolog annotation: Hit_ID=A1FXV7; Match level="QueryCoverage=100%, HitCoverage=32%, E-value=1e-137, Identity=95%"; Hit description =Endothelin-converting enzyme 1
  Pfam annotation: Domain name=Peptidase_M13; Domain location=42-242; Score=252.0; E_value=1.3e-72; Accession=PF01431.12; Description =Peptidase family M13
TQRDSYLGNVRAASEFNYKFNLSKIGKPVDKTEWGMTPQTVNAYYNPLQNEIVFPAAILQPPFFDPKADDALNYGGIGAVIGHEMTHGYDDQGARFGPTGNMEDWWTAADKKNFEGLTGKLVKQFDQYKVDGQAVNGHLTLGENIADLGGLATAYDALQKASAGKEDAKVDGFTRDQRFFFNWATVWRTKYTPENAKVRLATDPHVPAQFRAMGEQSNKLTFAAAFQFKAGSPMARTGEQQVVIW

SEQ ID NO: 99164 - protein, 146 aa, Glycine max
  Coding DNA Sequence Number=SeqID_7479
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MYRGPRGSFGVEGRSKVGPSGQAEGIYPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSGPLHLPALMSGGAFCRYAPPRQ

SEQ ID NO: 99165 - protein, 168 aa, Glycine max
  Coding DNA Sequence Number=SeqID_7480
  Homolog annotation: Hit_ID=Q6WAY4; Match level="QueryCoverage=49%, HitCoverage=15%, E-value=2e-09, Identity=39%"; Hit description =Putative uncharacterized protein
MGSSQKPSLKKRFYQVKIKSLEVTSLRELGQLMGQLQRQAFRKAYGKIWDLARVEVSMEPIASLSQYYDQPLRCFTFEDFQLVPTVKEFEEIHGTDCIPFVFMFAHPCCRNLPFGGRATRDSRDACSTNGIRAESPPTFIEENVEKTGKDAIYELLVKGSGVVFTHGE

SEQ ID NO: 99166 - protein, 213 aa, Glycine max
  Coding DNA Sequence Number=SeqID_7481
  Homolog annotation: Hit_ID=Q6WAY6; Match level="QueryCoverage=96%, HitCoverage=41%, E-value=9e-25, Identity=34%"; Hit description =Putative uncharacterized protein
MVEVSTEAIASLAQYYDQPLRCFTFRDFQLSPMVEEFEEILGCPLGELDHRKQVKNGVVGIPRKYLEAKARILAGKGEWAPFIDILALLIFGGVLFPNVDGLVDLAAIDAFLAYHNHKESPVVTMLADLYDTFDRRCEKSNTRIVRHACPLESHRSCMEKGGANWDRLLASKEGASVNWFPRWKEGRTGVLNSCGGFPNVPLMGMRGCISYNP

SEQ ID NO: 99167 - protein, 75 aa, Glycine max
  Coding DNA Sequence Number=SeqID_7482
MKVARPGELLLHSEATLLAQASWLLHHEVILVAQASQRLAWGSKDKDTNFVRAILLSDPQLAKTKEGKPRKHEEI

SEQ ID NO: 99168 - protein, 127 aa, Glycine max
  Coding DNA Sequence Number=SeqID_7483
  Subcellular localization annotation: CTP_CleavageSite=52; ConfidenceScore=5.07e-01
MVLLPKVLTTPQKHMPNMHRQTQFLNQQGARNISTTSTINDQIAYIVFYVASCMKNMFTLLLITSDEDMARIKGKEPLEGLGGPMARARTKKAKESLQQVLTMLFVFRPKLRVKKLQIVNCTMFQEE

SEQ ID NO: 99169 - protein, 68 aa, Glycine max
  Coding DNA Sequence Number=SeqID_7484
MEVGSWKWKLLEVEVGNGSYWKLKVENGSWKLEGEVVVIIKKEENMNFDDAKEESNKAASKDKHLLQD

SEQ ID NO: 99170 - protein, 222 aa, Glycine max
  Coding DNA Sequence Number=SeqID_7485
VVFVRITTRGISAYHLTHGSGLTDVVFVRITTWGISAFHLMHGLGLTDVVFVRITTRGISAFHLMHESRRQQKACLPLVDKGADNPWVSPHVIELAITFGYLRMSSDLRSWMTKAHLPLVDKGADNPWVRITLGYLRMPLDSRVGVVELWVWGEKVASAQDLGWQSKGEDHFKSWFPFFPYLVVTIPYCLDICLGEDGHFYPGSRFKVSLGLGSKGLQNDWT

SEQ ID NO: 99171 - protein, 179 aa, Glycine max
  Coding DNA Sequence Number=SeqID_7486
MGDSCLMYPGSQHNKEACLAVEDLLQQVIDQGCLEIGNEGGEEPHICMQSTDEEGLRKPKPLVIYFTRDAALQMPQYPSVVRPVPFPYKNSHAVPWRYAPPSEREEEATDISSLSAKVTNITGPSGVTQSDRVFAPLDLPAPPANVKGKTKVAEEQSDKVIPAPEQLEYEYKSIINKGV

SEQ ID NO: 99172 - protein, 137 aa, Glycine max
  Coding DNA Sequence Number=SeqID_7487
MGKVEEVQEQMKADMEAMKEKMATMMEAMMSMKKIMEANAVAVAATSAIAKVNPMPPSGLKQMNHPTSDMVGKDLGSTNGPMMCKFKTSTPSRHMARLPRRMSITPLPYSLKANNLNLIMHMSLNPWGRHMKCPTTI

SEQ ID NO: 99173 - protein, 302 aa, Glycine max
  Coding DNA Sequence Number=SeqID_7488
MRGAPTEESLSPFLVRDLGAQGLKVIQRIHKAWRSPLRKDKELRGIRNGVIGGYHGWLRIHTRGLDWLSKLKVINEENFEAPEEDEEVRALKLKLGKARLAKEKFKSAATHIQKECTELQEENAATARALEQETKRARKEEHGREKFRGALWGSNNELKLRREERDQSRVHGMILKEELVACARSKRSLAQHLEATEQSMLAIIGQYKEELNQSMAHEQKLVEDFAQVYAEKEARGRVIDATEATMWIDRFALTLNGSQDLPRLLAKAKAMAEVCTAPEEIHGLINYCQHMIDLMAHIIRNR

SEQ ID NO: 99174 - protein, 82 aa, Glycine max
  Coding DNA Sequence Number=SeqID_7489
  Homolog annotation: Hit_ID=A5AL37; Match level="QueryCoverage=95%, HitCoverage=5%, E-value=2e-09, Identity=45%"; Hit description =Putative uncharacterized protein
MPLYAKFLKNMLTKKNWYIHSDRIVMEGKALIDLGASINLMSLSMCRRLGEIKIMPTRMTLQLDDNSIIKPYGVIEDVRLNT

SEQ ID NO: 99175 - protein, 62 aa, Glycine max
  Coding DNA Sequence Number=SeqID_7490
MEFPEESLVRAEEGNSELNHQVNLPIVYASNKGRDWLGVQWKEGGKEWPSLMAVEQLARGAQ

SEQ ID NO: 99176 - protein, 79 aa, Glycine max
  Coding DNA Sequence Number=SeqID_7491
MDKFDIFVPHPLVITSLLPLECECKPLVCLLKRPALLSLMMQSYPPRALDRRLQEDWARDAREGPKVLMSLRVDFGPMG

SEQ ID NO: 99177 - protein, 77 aa, Glycine max
  Coding DNA Sequence Number=SeqID_7492
MVVSFFLTHLLLEVVSPIIFLPSPLCCHDFQEAKDSIDEEDPRPTSSTWSYIMWYQEHLRLGDVLLLPLSFCSVNSL

SEQ ID NO: 99178 - protein, 119 aa, Glycine max
  Coding DNA Sequence Number=SeqID_7493
YILCGTSRGYIYLGLTENKRGYISCGSVLVEGTSIRFKENKGGYIPCGSLLVKGFFTRLKEIPRTAGCLGTGGRHGLFQDHDEDQVNLCLMTKSDENNKEDSVRKKCYIDSGCSKHMDG

SEQ ID NO: 99179 - protein, 94 aa, Glycine max
  Coding DNA Sequence Number=SeqID_7494
MTNHLRYLWFPLTKIQGTNCLIILCLNTSEGTSFVVQVEHTSTWVLILRTREGTSLVDQFKWSVHPLGCSKRTREGFYKVIGNLKNRWLLGDWM

SEQ ID NO: 99180 - protein, 72 aa, Glycine max
  Coding DNA Sequence Number=SeqID_7495
MEFNIHLGSTFQPAIQSPKLKFTIDTIIRKPKSSRKGNKPRKKELHHQELPWKLEEDALMEEKKERRGGARN

SEQ ID NO: 99181 - protein, 65 aa, Glycine max
  Coding DNA Sequence Number=SeqID_7496
MKEKNEKDRVMQSYPLRALDRRLQEDWARDAREGHTVLMSLKVGYPGNVGFFSPCILGHLDKFLY

SEQ ID NO: 99182 - protein, 98 aa, Glycine max
  Coding DNA Sequence Number=SeqID_7497
MGIAPTKTPSGPKEVQQALGFPALGSCPKTPSGPEEGQQGLGVASPKYGSLSVQGSACRPQQGHQAPLLIELSSRSTAPPGRRRAKHHNSIGMAGSGQ

SEQ ID NO: 99183 - protein, 122 aa, Glycine max
  Coding DNA Sequence Number=SeqID_7498
  Subcellular localization annotation: CTP_CleavageSite=95; ConfidenceScore=5.55e-01
MLVRMIRTRLFAAARVKSFPGMHSSRVIASLSGCARTVGPPPISGGGPGTVRMWSTLKMRTRSPLKVRACSPLMARMCSPLEVRACSPLLARTCSPMKVRTCSPLMARTCSPLQARTCSPLK

SEQ ID NO: 99184 - protein, 67 aa, Glycine max
  Coding DNA Sequence Number=SeqID_7499
MGETRYFNEIYYLTKMAVSPSACHDHNYQDSTVFCFAAATPFLTSGLGVTAYTSSGSLSVADLIHGY

SEQ ID NO: 99185 - protein, 56 aa, Glycine max
  Coding DNA Sequence Number=SeqID_7500
MARIAKVVKVSTQDLDRVKQNRNGVIRLPRKHLEEKVKALVDQGEWASFIDVLALL

SEQ ID NO: 99186 - protein, 167 aa, Glycine max
  Coding DNA Sequence Number=SeqID_7501
  Subcellular localization annotation: CTP_CleavageSite=23; ConfidenceScore=5.58e-01
MTSIAQSNTSRLGFPTLITALCRARRVVSPSLTFERLSPSLQVVTPPGSIPSVEQFREMAAWPGTQPSLHREDEGPTTQAKETQVRQVATATPERSLEAISEPSTPVVNLPSPQLAANPSTPLLEMPEDPTTPVLAMDTSPPATPVLHLTDEEDVQTQDTQDQSQEF

SEQ ID NO: 99187 - protein, 49 aa, Glycine max
  Coding DNA Sequence Number=SeqID_7502
KQSQKEGQNGLFTKVSDPKFAQARNQLAWAKDLTSILSKQLAWASGCVH

SEQ ID NO: 99188 - protein, 173 aa, Glycine max
  Coding DNA Sequence Number=SeqID_7503
MGKIEEAQEQMKADMEAMKEQMATMMEAMTSMKKIMEANAVIVAATSAIAKVNPMPPSGLNQMNHPTSDMTHGMPHHNLADFEPCLGYATERQVVGGIPMPNTLKGPQFRPQPQPLHFTVGRALPAMAEKGKLNHIEERLKDIEGGEYYTFANLEELFLVPEHGHSQVQGAGL

SEQ ID NO: 99189 - protein, 260 aa, Glycine max
  Coding DNA Sequence Number=SeqID_7504
  Gene Ontology: Mol. function=aspartic-type endopeptidase activity; Cellular component=small subunit processome; Biological process=DNA integration
  Homolog annotation: Hit_ID=A5B1U1; Match level="QueryCoverage=89%, HitCoverage=9%, E-value=1e-22, Identity=28%"; Hit description =Putative uncharacterized protein
AHENPRAFSCISGSIYLESSIQCSCGAQSVFANDIQQLYDAAQKLATLKQTDHDMVAYVSKAQSAVEELKLSLEADKLEDIKTKLDNLYMVLVLRGMHPDFDHIRDQVLIGKEEDKLKEEVALNVLTSETSEIKFLKADYQEYLQLKAAKESQTSSSISGHNSIACIAQSSNNQSPWMIDSGTYDHIAATGISHVSPTSSLSLNSVLLIPVTFDANSFVIQERGTGRTIGVGHESYGLYYLKPNLSWVCSAATSPKLLHE

SEQ ID NO: 99190 - protein, 111 aa, Glycine max
  Coding DNA Sequence Number=SeqID_7505
MLTSENGLVQYNNAICWKAPAPERRFPRHNDTWHCTIGSAAHEGTLVRAPDIGASVRAQGPGALASAPAVGATASARQLGASSSVKGQLVPPSPLPPSPPSPPAPHLFPSW

SEQ ID NO: 99191 - protein, 152 aa, Glycine max
  Coding DNA Sequence Number=SeqID_7506
MPHKMYICCMCLVNLATKRSKKDAIGEGSSAAQPPNTDYDSHRFRSAEHQQRFETIKGWSFLRERRVQLRDDEFPDFHEEIPFDRDALNQFLGQPLILEEGQQCEYDERRSQVSGFDEDAIAQLLGIPGQDFARTAARRRMRIVRTSMTTLT

SEQ ID NO: 99192 - protein, 32 aa, Glycine max
  Coding DNA Sequence Number=SeqID_7507
MARGTLPTTKGKGYGYGWGVPPNACPSVAHPS

SEQ ID NO: 99193 - protein, 138 aa, Glycine max
  Coding DNA Sequence Number=SeqID_7508
MEAMKEKMATMMEAMMSMKRMMRVNAATVIAISTATKVDPTHPSGLNQVNPPVSDMVEQEGATLGSTDDPHFVQVQNKHSFPPYGLPPNYTPPDVAHAPDENVNNSTPILIESQQPQSNHPNVSQPMGGHMKRSETTL

SEQ ID NO: 99194 - protein, 139 aa, Glycine max
  Coding DNA Sequence Number=SeqID_7509
MSLNPWGKHMKFPKTTLWLSSGSIQDIPLKGRHFWHPYVKRSRISQCRPLSQPLHFVRERGLPQYLKRKGLSIWRIGYVPLKDEEIMPLLAWQSCAWYPTWKMRAYAKDEKLLMHFFQESLVGETITWYTNPELSQVHS

SEQ ID NO: 99195 - protein, 125 aa, Glycine max
  Coding DNA Sequence Number=SeqID_7510
  Homolog annotation: Hit_ID=A5C4D7; Match level="QueryCoverage=67%, HitCoverage=14%, E-value=9e-14, Identity=40%"; Hit description =Putative uncharacterized protein
MQIFIEAIDLNIWETIEIGPYIPTMVAGNTTMEKPRKQWDEEERKMVQYNLKAKNIITYALGMDEYFRVSNCKNAKEMWDTLQLQEHEMELMRLNQHEENDKKKKGIVLKASSSIQEGSDKEDLN

SEQ ID NO: 99196 - protein, 182 aa, Glycine max
  Coding DNA Sequence Number=SeqID_7511
  Gene Ontology: Mol. function=hydrolase activity, acting on carbon -nitrogen (but not peptide) bonds, in linear amides; Cellular component=intracellular; Biological process=metabolic process
  Homolog annotation: Hit_ID=A2SLW4; Match level="QueryCoverage=98%, HitCoverage=37%, E-value=4e-89, Identity=88%"; Hit description =Putative uncharacterized protein
MVNSIPPSYTGGNIDNWRIGKGATLYYPVSVAGALFSVGDPHASQGDSELCGTAIECSLTGTFQLILHKKASLPGTALESLKHPLLETQDEWLLHGFSYPNYLAELGPDAQNSIFTKSSVDLALRDAYRKMRDFLMGTQGLSEDEAISLMSIAVDFGITQVVDGNWGVHAVVKKSIFPPRKT

SEQ ID NO: 99197 - protein, 215 aa, Glycine max
  Coding DNA Sequence Number=SeqID_7512
  Gene Ontology: Mol. function=protein kinase activity; Biological process=protein amino acid phosphorylation
  Homolog annotation: Hit_ID=A2Q378; Match level="QueryCoverage=72%, HitCoverage=13%, E-value=1e-34, Identity=37%"; Hit description =Putative uncharacterized protein
  Pfam annotation: Domain name=DUF889; Domain location=130-215; Score= -112.1; E_value=0.00071; Accession=PF05970.5; Description=Eukaryotic protein of unknown function (DUF889)
MCGNRHGNGWQMISYSIIEKKLQFTFSMDMVELAKHLFGQPYHLLLQVELLHYYCLGRTTHSKFAIPVLATENSTCNIHQGSELAELLKVTKLIVWDEAPMCHKFAFEALDKSLKDIMQNNLPFGGKIMVFGGDFRQILPIVPKGDGKIGQYNDGFSEITIPDEFLIKNYDDPIHAIVEATYPSLIDNYSDTNYLQKRVVLASKKEIVDKITFST

SEQ ID NO: 99198 - protein, 100 aa, Glycine max
  Coding DNA Sequence Number=SeqID_7513
VKKRLSYEVPKVTIKLSSTVGLSVHPPLSVASTCLARRRIWQGISIKAGIMLRAQNSTDTTMPTSGKELWRQQEEQLLQRYLGFLGDFSIGKCTVALELD

SEQ ID NO: 99199 - protein, 389 aa, Glycine max
  Coding DNA Sequence Number=SeqID_7514
  Homolog annotation: Hit_ID=Q5XM22; Match level="QueryCoverage=33%, HitCoverage=89%, E-value=1e-31, Identity=48%"; Hit description =Resistance-like protein HAAS-2
MSDGFCGTHLQIMVRTRGLGRALGQVTCRGVGRRDHDDSDDAPQRRRPTASARRQRVAVTADHVDEPVIPDPDVQDDPMEALATVEDIPADAGAEAAEDQPQGFPGGPSDPSVLTAYADHVACSVWTGDERPELKLSSHGRKVHSLGRPVPAIEGLIAGTGLSPLIACSWVSSPISLDDVSSLLHLTVIGDFHAFEPLHVDDAVQMRVDLLIVSPESARAETVQCRGPYVRLQWVREVYQRRCQACHWTDAARAYLLHLLGCTLFANKSATNVHVVYLEALRDLSMTERYAWGVAALVHMYDHLNDASMSHSQQLGGYITLLQCWIYEHFPSVAESTADQDYDEASPRACRWIATKKTVKSIRTPSYMELLDRLRIPDVCWIPYGEHRE

SEQ ID NO: 99200 - protein, 121 aa, Glycine max
  Coding DNA Sequence Number=SeqID_7515
  Subcellular localization annotation: CTP_CleavageSite=48; ConfidenceScore=5.78e-01
MGVHVLVRTSGTSLPTSITFNMNGLPNITGMSFSSQISITTMSFRKIKCFTLTSTSSITPYGLVMERSSSCKVILVGMIYNSPNLMHMESGIKLILAPRSIRAFPVVTSPIEQGMVTLPGS

SEQ ID NO: 99201 - protein, 301 aa, Glycine max
  Coding DNA Sequence Number=SeqID_7516
  Gene Ontology: Mol. function=excinuclease ABC activity; Cellular component=excinuclease repair complex; Biological process=response to DNA damage stimulus
  Homolog annotation: Hit_ID=Q1H1P9; Match level="QueryCoverage=99%, HitCoverage=44%, E-value=1e-132, Identity=80%"; Hit description =UvrABC system protein B
  Pfam annotation: Domain name=Helicase_C; Domain location=93-174; Score=75.7; E_value=1.5e-19; Accession=PF00271.22; Description =Helicase conserved C-terminal domain
  Pfam annotation: Domain name=UVR; Domain location=256-291; Score =49.8; E_value=9.7e-12; Accession=PF02151.10; Description=UvrBuvrC motif
  Pfam module annotation: Pfam domain module=Helicase_C::UVR; Domain location=93-174::256-291
MDNRPLKFEEFEHIMRQCVFVSATPANYEKEHQQQVVEMIARPTGLVDPEITVKPADTQVDDLLGEIKLRVEVGERVLATTLTKRMAEDLTDYLSEHGVKVRYLHSDIDTVERVEIIRDLRLGEFDVLVGINLLREGLDIPEVSLVAVLDADKEGFLRSERSLIQTAGRAARNLNGRVIFYANTITRSMKLAMDEAERRRKIQMAFNAEHGITPKGVTKRIKDIIESVYDKDEAQRERKAAQEQANYESMSEKTLTKELKRIEKAMHDAAKNLEFEKAAQYRDQLKKLKLQAFGAEVEDLK

SEQ ID NO: 99202 - protein, 198 aa, Glycine max
  Coding DNA Sequence Number=SeqID_7517
  Gene Ontology: Mol. function=nucleotide binding; Cellular component =intrinsic to membrane; Biological process=defense response
  Homolog annotation: Hit_ID=Q2YE88; Match level="QueryCoverage=100%, HitCoverage=21%, E-value=2e-57, Identity=50%"; Hit description=NBS -LRR type disease resistance protein Rps1-k-1
MAEDLLKLPNNGNALEIGYKYFDDLVSRSFFQRSKSNRTWGNCFVMHDLVHDLALYLGGEFYFRSEELGKETKIGMKTRHLSVTKFSDPISDIDVFNKLQSLRTFLAIDFKDSRFNNEKAPGIVMSKLKCLRVLSFCNFKTLDVLPDSIEEMPRGMGMLSHLQHLDFFIVGKHKENGIKELGTLSNLHGSLSIRNLEN

SEQ ID NO: 99203 - protein, 86 aa, Glycine max
  Coding DNA Sequence Number=SeqID_7518
MEDASSETTTPEPLVRRKKANQTQEAATTSEPSEPVADTASLQQAADPYTPEDQTTSVLSPNTSPTATPVLHLTDEEDVQTQDTQD

SEQ ID NO: 99204 - protein, 263 aa, Glycine max
  Coding DNA Sequence Number=SeqID_7519
MTHHNDFQDYFDDAKESRVKQVPKNQASGIKSQIIKIQEQLSFKIQDSRTIKIKIQEQSKSRLKTQDSREIDFKIQERKSRSNNQDFTREISSSEGYIHLVFKENKGGYIPCGSLACKGFYKVERNLKNRWPLDPTSGIRAGFLRKVSQFQDSWPPQILCFLKETPSIGHLSLMVRVTTIGKPECKSLLKSDLNIWEAIEIGPYVPTIVDASTSTTTEKPRDKWSEEDRRRVQYSLKAKNIITSALGIDEYFRVSNCLNAKEM

SEQ ID NO: 99205 - protein, 98 aa, Glycine max
  Coding DNA Sequence Number=SeqID_7520
RKVQHEEAAAHVQKGPVEINLSQPNLSQDSDMEFMVPTPIVDVPPVARYKLNIRRPKQKNISDTSTVDAPVVDGPPTAPLLFMPTPRFTRRKAANKDL

SEQ ID NO: 99206 - protein, 317 aa, Glycine max
  Coding DNA Sequence Number=SeqID_7521
  Gene Ontology: Mol. function=fumarate hydratase activity; Cellular component=membrane; Biological process=generation of precursor metabolites and energy
  Homolog annotation: Hit_ID=A9I5M4; Match level="QueryCoverage=100%, HitCoverage=62%, E-value=1e-160, Identity=89%"; Hit description =Fumarate hydratase class I anaerobic
  Pfam annotation: Domain name=Fumerase; Domain location=10-287; Score =490.4; E_value=2.1e-144; Accession=PF05681.5; Description=Fumarate hydratase (Fumerase)
MSVLIKEEDFIQSIADGIQFISYYHPVDYIRHLARAYEREESPAARDAMAQILTNSRMCAEGKRPLCQDTGIVNVFLKVGMGVRFDTKRTLQELCDEGVRRGYLNPDNPLRASVLDDPLFARKNTRDNTPCILHVELVPGDKVDVQLASKGGGSENKSKFAMLNPSDSLVDWVLKTVPTMGAGWCPPGMLGIGVGGTAEKAMLMAKQSLMEDIDMYELLARGPQNKLEELRIELYEKVNALGIGAQGLGGLTTVLDVKINTFPTHAASKPVAMIPNCAATRHAHFELDGSGPARLDPPSLSNGRKCTGRRTTTKSKQ

SEQ ID NO: 99207 - protein, 109 aa, Glycine max
  Coding DNA Sequence Number=SeqID_7522
IAPARHLVDPEKSNRVLGFPALITGLCQFYGVPVAPQQGHQAPINRAFVEKYCAARRAQGEAPQQLGDGLQRATDALPPPLEPLSSSTKVGALHMTRGQPAGDQVQSQR

SEQ ID NO: 99208 - protein, 25 aa, Glycine max
  Coding DNA Sequence Number=SeqID_7523
AHENPRAFSYISGPIYLESIQCPCG

SEQ ID NO: 99209 - protein, 78 aa, Glycine max
  Coding DNA Sequence Number=SeqID_7524
MRAEPIHVIEVSSSEEDIEEDPEELPPEPAVDALDFPEDNEDPLPDVDSPEDVMSASEADSTEESGPGGTANSDDSSS

SEQ ID NO: 99210 - protein, 114 aa, Glycine max
  Coding DNA Sequence Number=SeqID_7525
MLAIVSKYEEELNLATAHEHKVADEYAQVYAEKEARGRVIDSLHQEATMWMDRFALTLNGSQELPRLIAKAKAMADTYSAPKEIHGLLGYCQHMIDLMAHMKPLGSLYCHSDLD

SEQ ID NO: 99211 - protein, 132 aa, Glycine max
  Coding DNA Sequence Number=SeqID_7526
MLSKRKTLDEGSLLSSKSEIQHDHRFTSTPYVPMDPVPSGVANYHNLPFGGRATRGSRMHLPKEECGRSRHQRLFGENVGKTEKRGLRTLSVKGSGNFYTHGEGISTPRVRHKGRQPLITCGVSLAPAYPQL

SEQ ID NO: 99212 - protein, 134 aa, Glycine max
  Coding DNA Sequence Number=SeqID_7527
MVLSGNRDEHSKRAYALSLFIVAVKIWDFQMNALSGPCHAKRAKCALCAKPECHSDEPELSAPCCTKLQLSSMASKKRKAPSTPTQARYDRSRFTSQEAWERYTDIVVPRKLLPERNVEFYANLYDPEDKSPKQ

SEQ ID NO: 99213 - protein, 109 aa, Glycine max
  Coding DNA Sequence Number=SeqID_7528
  Homolog annotation: Hit_ID=A5B7H8; Match level="QueryCoverage=75%, HitCoverage=30%, E-value=3e-11, Identity=39%"; Hit description =Putative uncharacterized protein
MVAGNTTIEKPREEWSEEEKRLVQYNLKAKNIIASALGMDEYVRVSNCKSAKDMWDTLQVTHEGKIFPNEDLINKVLRCLSREWKPKVTTITESRDLSNMSLATLFGKL

SEQ ID NO: 99214 - protein, 96 aa, Glycine max
  Coding DNA Sequence Number=SeqID_7529
  Subcellular localization annotation: CTP_CleavageSite=38; ConfidenceScore=5.31e-01
MEKPILIFTKKSGPNLGPWAQKSTLRFMRTLGPSLTALAQSSWNLLSNTLKGDKCGIGCSGGSSDGGGNDCGDGGGGSNDNDFDGNGDCNGGGDGS

SEQ ID NO: 99215 - protein, 36 aa, Glycine max
  Coding DNA Sequence Number=SeqID_7530
LSSIVTDAWGANTFPVRKNRCDSSCLNLKIKTFRNT

SEQ ID NO: 99216 - protein, 138 aa, Glycine max
  Coding DNA Sequence Number=SeqID_7531
GPGFSGINHGSLPVVRVPVTPSEVIRPPITRAFIEKYCMPRQAQGGDPQAPDAPPPPHQADPAGSFDIERYLRHLSQGLASFPCPTPDQFRAEVAWPRDWPEAQAGEAPAEAPDNADEARMDEEMTDLLDFLGGSGAT

SEQ ID NO: 99217 - protein, 39 aa, Glycine max
  Coding DNA Sequence Number=SeqID_7532
MKKKHMLFEDSDDASPAWKKALKQGDMLELLKMVLLFLS

SEQ ID NO: 99218 - protein, 75 aa, Glycine max
  Coding DNA Sequence Number=SeqID_7533
MARVLDKIKLIDGSRKTLKLFARITDLWFIGIPEKSEQVEMVIVDYDFLSYLNEVEDERPIVIVLTHARIKEGQG

SEQ ID NO: 99219 - protein, 184 aa, Glycine max
  Coding DNA Sequence Number=SeqID_7534
FLSYLNEVEDERPIVIVLTHARIKEGQGSYLPSVSNSLKASKLMINELVLEIQEFRESYRVEVMVNHKGEQTKLLLWDHECAELIGQSVDEVNKLKIADDNVDLNASPQALDRLLGCFLAFKVKPCCKIESSILDSTDPKELESQSVFVTVDDDRSMLDSTDPIELESCSLPASAPDRTSSIKR

SEQ ID NO: 99220 - protein, 153 aa, Glycine max
  Coding DNA Sequence Number=SeqID_7535
MKSTSSTTSSEMKNPMIGPPLIIQFIAAFNNDKRQTCGRQRHSSRKHIWTVRFTQEMLDALEPLKLPRCTKVPLKACGHHMTVLRRFSPPLQWKVETLNPTIGGKGVVQPWYDFLKEMDFDDGDEISIYYRYYEKNWDIVIRRQDDWDDSDTD

SEQ ID NO: 99221 - protein, 184 aa, Glycine max
  Coding DNA Sequence Number=SeqID_7536
MSEIEEVQEQMKADMEAMKDQMAAMMEAMLSMKKIMESNATTVATTSVAHEVNPTHPSGLNQVNPLVSDMVGQGGEALGSTDGPHVLQGKNSFPPYGLPPNYTPHDVAHTPDKNVDNSALIPIGSQQPRSDHAHVSQPMGETHEVPHHNLADFEPHLGYATEGRAFGGIPLPNTLEGPQFHPQP

SEQ ID NO: 99222 - protein, 330 aa, Glycine max
  Coding DNA Sequence Number=SeqID_7537
MVMPKLGLRDYFSDRGRLFMYKVMVGEKAFKDRFNPKVKNHVPFGMLFTQIMRNAGVNVSYMESFVATSQLKGVTFVKIEIADNFPKYAKKHIKKKVKKEPKEEQQSVVGQMIDPAKKPKKQPPSDPKPSNPKTTQKTKALDSKSEPKSRPTTKRLTIKIKHPQTQPTPPSPPKPQPASPPKNQESDDVILKIPTPQTFPSPSTSNLSTSPKPASPHLSKIEVPAFVKEAFELEEGMLAYVKTLSKEEHKKKLTEDAKLVSLSDEKATMMKIDGALEQAMLRSLIEVFLVEVGDDVIEINPRSAPIRPRTKNTGCNKLGVELELKSQKCH

SEQ ID NO: 99223 - protein, 117 aa, Glycine max
  Coding DNA Sequence Number=SeqID_7538
MSISLQFQAKRSYFKELLKVDVSLSELNALSECHPLSEASAHLTNRRNLEGNLSCRHALNTSLARSASRLSPSRLSASLALNESSLTRAKHENGAKRDIKELPCYGRLNPQLGILAE

SEQ ID NO: 99224 - protein, 1113 aa, Glycine max
  Coding DNA Sequence Number=SeqID_7539
  Homolog annotation: Hit_ID=A4CRR7; Match level="QueryCoverage=10%, HitCoverage=43%, E-value=4e-08, Identity=30%"; Hit description=N -acetylmannosamine-6-phosphate 2-epimerase
MMCALECHVICHVHFVNLGQYISLPSSEPACWRKRLFSVKGSSLDKVVTLTGARVASLSSLSSPPAWTNIVWAAFVKLSRVDTFFFLQAKSSVSGECITRTLLLHMCHIKSGHILEMWCVGAQFKNRWRIERSFQLAVPLLRRHAMELLVASPLCVVLAEVLLTFIGWGYLLLLLWTGNPRSHSVGSPSSPPTIASYEWVWNDVLKYRSSITSATSVATLEHQLRAVSGCPSFFLMYYFLFEVLGLILPLNSFQCALLEHQSVAFSQLHPNIWARKLFKFYLNVFCHFKDHFLKVLETDVVADRLPLMFNRDKEPCFLFYWQLDPTRLKSFDEDLLTLVEKVDKAILEQLLALLDARAILSLPSADDVLASLDGKVKPTGRTMPPSTANSPGPFAAGSLGPPLVVQVTVAASAPPSLPAQEVSISPPTMVTTPVSLVAFIIAAPSTIVTPLLSAGVTTTNALEMPPPSSSASSIPPLAILASASPSSSSHPNVSLDHVYSRDIDSMRSMGYRPEQRTPTSFMSSFDKNLIRSIGVQNETDSMTVFLQRSLVTLEENGQRHQEALSKMASLEAEVAKWRATARIVRRVKCPKVANAIVAFAEVVRSNHQLSSKVCDAFAKMLRIRPDGDKLVGRCWHLLRENNELVGKVESVAAEKDETSKVVADLQARLRENKSKLEEFELKASKERKTNKELEEELLDVKDGELLDEEEIVSTEEDAGEEQDLGGVGCKTDLGGFVGNGGVGDIRSSQCDFHLVEGLADQCAGISLCFVKPLIQGQGSPRENLGFNEFWTRDAFILGFDEAHQGRTLDLSSLWRCETHQGADHGFDDTLEKRDSPRVNLGFDESLEKQDSPRMDLGFNEPLEKRDSLRANLGFNKSLEKPDSPRSNLGFDEPLEMRDSPRIDLGFDEPLGMRDSPRIEIGFNEPLEKSDLGFNEPLEKRDSPRVDLGFGEPLEMRDSPRTDLRFDEPLEMRDSLWANLGFDEPLEIRHSPRVDLRFGMPLEMQPGTKKNTTPGLTVACYDPDQLGPSFPARGSFLTHFGLTTLGRQVEWFEYARKFFFSQTLGLVKPCAQGFKDDSVGCLYLIVGLGMFDKSHEEALSAYEVFPGEFLYLAG

SEQ ID NO: 99225 - protein, 112 aa, Glycine max
  Coding DNA Sequence Number=SeqID_7540
MEFTLIKVNTETTKEKLKSNLNDAHEVSFQKAHEVGFQKTHCQVKFFLKNVDLSLFDVDKDVNCQGDLINEANMLEDEVQLLLPVSWHLAHMRDEKRSHLLLIATSNDEPKR

SEQ ID NO: 99226 - protein, 146 aa, Glycine max
  Coding DNA Sequence Number=SeqID_7541
MVKDKDEDTKFLLWDRECAELIGQSADEINRLKMEGGDVDLDASPQALDRLLGCVLAFKGKVQPKFDNDVVLKYSNELDLINVVLDMLADTKQFVSVTADHDPLLRVPLTPTKCLSADELDDEARSCEISPAQVSSNKLARPSATE

SEQ ID NO: 99227 - protein, 127 aa, Glycine max
  Coding DNA Sequence Number=SeqID_7542
  Gene Ontology: Cellular component=ribosome
  Homolog annotation: Hit_ID=A2Q6B4; Match level="QueryCoverage=99%, HitCoverage=51%, E-value=2e-13, Identity=31%"; Hit description =Ribosomal protein L33; Nucleic acid-binding, OB-fold
MARAPDKIKSIDGSKETLKLAVRITNLWFIGIPSKSEQVEMVIVDSDGDEIHVVCKQDQLKSWKANLKESSTYVMHNFKVLKNDGQFRVCNHPYKLAFTGVTIVRQSDLDSLPFRKFKFDDFSNVIA

SEQ ID NO: 99228 - protein, 231 aa, Glycine max
  Coding DNA Sequence Number=SeqID_7543
  Homolog annotation: Hit_ID=Q2HTA0; Match level="QueryCoverage=96%, HitCoverage=47%, E-value=2e-15, Identity=25%"; Hit description=IMP dehydrogenase/GMP reductase, related
  Pfam annotation: Domain name=DUF1723; Domain location=1-40; Score =24.0; E_value=0.00056; Accession=PF08330.1; Description=Protein of unknown function (DUF1723)
MERWHKETNSFHLPIGELMITLDDVASLLHLPVIGAFHSFKPLLVDEAVLMLVELLEVSGEEARAETAQCHATYIFLSWLRDIYQSRYTFRDLSQSESYAWGAASLVHMYDHLNDACKSGGRHLAGYITLLQWIATKATSKSLPASTYRKRLDALRSATMGPVVVTHQPERVVWQFSWSSFEDIDDRWMHYSDYLAAAGQICLVPGQCASDYMDRFFMISHPFMTPAQAAD

SEQ ID NO: 99229 - protein, 110 aa, Glycine max
  Coding DNA Sequence Number=SeqID_7544
MTYLLHLISNTIFTNKSLAYIHVAYLQYLGNLDACHEYALGVVALCTSRTISPMQASRAIGNVEVFAHFPTIGYSKRQENYVVEDPIATRWKPLRGSGLLLSIRDIWDNL

SEQ ID NO: 99230 - protein, 127 aa, Glycine max
  Coding DNA Sequence Number=SeqID_7545
MLTVWVEIALMVATWIGQIQKIRLMVVEINHRGGGAERLRERGRAKAPEKEWERHIPLAVATTRTMMPNMSMTMVGLLKCIIRSLRSIRLHVDTGSAVMGSATYVESKTMTSWSNVRRLMAGKWIGL

SEQ ID NO: 99231 - protein, 210 aa, Glycine max
  Coding DNA Sequence Number=SeqID_7546
  Gene Ontology: Mol. function=protein tyrosine/serine/threonine phosphatase activity; Biological process=protein amino acid dephosphorylation
  Homolog annotation: Hit_ID=A7PEE7; Match level="QueryCoverage=48%, HitCoverage=35%, E-value=1e-35, Identity=73%"; Hit description =Chromosome chr11 scaffold_13, whole genome shotgun sequence
MKIEELDDGECSRDEEEKCQRQIVSIDAKRALVGAGAWILFYPTLLYNVLRNQIEVEFRWWDHIDEFLLLGTVPFPKDVPHLNKVGVGGVITLNEPYETLVQLYQVEYKFMTPAAALEYKFIICLAFQKDIVATCHQQKLIRWKLHSCLLKRFLTLPLSNYLNYARWHKSRLKLCCMKLLGWHQNCMSRITPLDLSILHSRIMKELWLFT

SEQ ID NO: 99232 - protein, 119 aa, Glycine max
  Coding DNA Sequence Number=SeqID_7547
MDVLDTYMIEGQIQCSDQRRLLYEESGDELDRKKALEQRSISNFTENDALLKQERPTLSMTDIVHELETIVVNEEHTVYHVVPFISLSIPNDSKKNAYGQDPRMITIINIITRIPMGPF

SEQ ID NO: 99233 - protein, 108 aa, Glycine max
  Coding DNA Sequence Number=SeqID_7548
  Gene Ontology: Mol. function=oxidoreductase activity; Cellular component=apical plasma membrane; Biological process=flavonoid biosynthetic process
  Homolog annotation: Hit_ID=Q5Y381; Match level="QueryCoverage=99%, HitCoverage=33%, E-value=3e-32, Identity=66%"; Hit description =Aldo/keto reductase
  Subcellular localization annotation: CTP_CleavageSite=37; ConfidenceScore=5.25e-01
MSSSNIPHVVLQSSSNHHRMPVIGFGTASMSPPSTTRVAVLEAIKLGYRHFDTASIYGSEQPLGEAIAEALQLGLIGSRDELFITSKLWCTDNFPHLVLPALQKTLRF

SEQ ID NO: 99234 - protein, 219 aa, Glycine max
  Coding DNA Sequence Number=SeqID_7549
  Homolog annotation: Hit_ID=Q2HTA0; Match level="QueryCoverage=73%, HitCoverage=31%, E-value=5e-16, Identity=28%"; Hit description=IMP dehydrogenase/GMP reductase, related
  Pfam annotation: Domain name=DUF1723; Domain location=78-127; Score =50.9; E_value=4.5e-12; Accession=PF08330.1; Description=Protein of unknown function (DUF1723)
MVRTRGLSRALGRVIGRALGERIMMIQMMFPSGEGLQDLHVGNVILPWQEGSEIWAPEIEGLVAGTRLSPLIACSVDTGDQGLISAFMERWHKETNSFHLPIGELMITLDDVASLLHLPVIGAFHSFKPLLVDEAVLMLVELLEVSGEEARAETAQCHATYIFLSWLRDIYQSRYTFRDLSQSESYAWGAASLVHMYDHLNDACKSGGRHLAGYITLLQ

SEQ ID NO: 99235 - protein, 76 aa, Glycine max
  Coding DNA Sequence Number=SeqID_7550
MPLQGEDESRTSSPPSEAMDKSLKNNSRVQDIIKKNSRLKKKVKIQESRFKVQDLKNQDQDSRLKIQESREGLIKI

SEQ ID NO: 99236 - protein, 185 aa, Glycine max
  Coding DNA Sequence Number=SeqID_7551
MLYFTLGCQRKEVKVSFHDAVDEGVSTGCSPFKAVYVGQTRIILGVCGLSGVLFPLSALMHFMGRVLIALGASHASLQLVVVSLQLSKLLLVMSLHLRNMGLELLESIGGRGRNVFQDLTHWAESSLRIRRGTCKTKDYDAQFGSRLLRLMRMCSCTKAELTYIMGYDVHFVDLGQYRILKHIFT

SEQ ID NO: 99237 - protein, 92 aa, Glycine max
  Coding DNA Sequence Number=SeqID_7552
VNLVGQTLNTFLAWPTHLVKRLSEQVMWDATVFGVFNQDFPLYIKHEDLSKIAHGGQCLSISVIQLWILHLTETSMRAGNSDVYGFLEPQSI

SEQ ID NO: 99238 - protein, 55 aa, Glycine max
  Coding DNA Sequence Number=SeqID_7553
MASLLAISHVARKTPVVMASRGVATAIGNLRASCNSHQQVREEELASAGGDLRAI

SEQ ID NO: 99239 - protein, 409 aa, Glycine max
  Coding DNA Sequence Number=SeqID_7554
  Subcellular localization annotation: CTP_CleavageSite=58; ConfidenceScore=5.57e-01
MSFISDFAMSMRGSDSGGSIQKLLPPTSSLNRKLVLVTIILPLSVFGGARRSGGEDVKASPLVRRSHSTGSPSSPFIVVGYKWVRDDVLKYRSSITFAASVAALECHVKLAHMEDCCKIAGQTRGSDDFPFLRAASGSPPFLFMYHFLFMVLVLVLPLSSFQCALLEHLNMKLTGKIGWISLNNVSKKLYEFDSNVFRHFKDYFFKVLVTDVVADGLPLVFNRDEEPCFPFYQQSNPTGFKSFDEDLLTLVERFDKAILEQLLALSDARAILSLFSTDDLIAAIYGIMGGQPSARVFPNDEVVKVSPNMSFSVLAKRKRDDSVGATGLMPGLGYLSSLQGLPSALSVDVSGSPVVVVSTLVTSVSPIVAPSFTIAMPLLSVVTRAMSKRLQEDWARAAEEGPRVLMNLM

SEQ ID NO: 99240 - protein, 260 aa, Glycine max
  Coding DNA Sequence Number=SeqID_7555
MLCAKPKIFCSLLIVAPKPAKENVRRRFIKKGHHTNQGQISTHPNPWEGSRGRVSFVICTSLLKPLSVARVVGGGSVVGEVGDELEAMREFDGVGPTEGDEFFDGEAAFGEELGDLGDGHGGGGEVGGYGEGEGGLAVATTEEDEEEGAAEHGQEVAGGVEEDVRARDGVGAGELEGGLGTDDEVKGVAWEGMVDVGVALNLGEGDGGEKDGGIAVIGEKAVVEEEAEGGNDCGGAHDLLAGYYVPNDLAELWTRVIIEE

SEQ ID NO: 99241 - protein, 124 aa, Glycine max
  Coding DNA Sequence Number=SeqID_7556
MARLARPARSAQFPLWLELHLVCPSHLERHKKLCWIYEHFSSIGSTLATKDYDERRSRACRWTSGKALPVSTYCRCLDKLTPDVVCWIPYGDHRSFREFEVITLFFCHLRWGPLTVIHQPERVV

SEQ ID NO: 99242 - protein, 133 aa, Glycine max
  Coding DNA Sequence Number=SeqID_7557
MVGKIDVMVVEVVSKSLLSRGLKSLILEVRVVKVHHYKNGFKDNYWIWIVHHEDMLHRDLNEGNSYMDASTNAEYVAQHKQFMLMQDKCVMLLGNLKHLKLQTQIIRKNLQMKTLKDFTFYWWRRMNHCMKGQ

SEQ ID NO: 99243 - protein, 284 aa, Glycine max
  Coding DNA Sequence Number=SeqID_7558
EAWERYTDIIVPRKLLPERNVVVYPTEFDEFLDELERRHKREELTDFLDGNIDVAIVKEFYANLYDPEDKSPKQVRVKGHLIKFDEDTLNIFLKTPVVVEEGETLCAYSRFALLRPDPQELAAKLCIPGKGFELNVDGYLMKILRKNMTTHAQTWSMDMNVGYLISHQISLIAQHDTSRLGFPALITSLCKARGARGKRSEAPSTSATSEAPTPFSSLVPLSSSTHIPVMPPAPLQMPLPAPLFAGPSDFLFTPQMLYSMIQSIHKGCLNAVLVEFSLTRGICE

SEQ ID NO: 99244 - protein, 449 aa, Glycine max
  Coding DNA Sequence Number=SeqID_7559
  Gene Ontology: Mol. function=protein binding
  Homolog annotation: Hit_ID=A5AGS4; Match level="QueryCoverage=93%, HitCoverage=89%, E-value=2e-59, Identity=36%"; Hit description =Putative uncharacterized protein
  Pfam annotation: Domain name=DUF593; Domain location=1-91; Score =118.7; E_value=1.7e-32; Accession=PF04576.6; Description=Protein of unknown function, DUF593
MKDMLCVQQQLLEKLYAELDEEREASATATSEALDMILRLQGEIALVKMEASHYKRVAEEKIGHAEVSLEAFEEIMYQKEVQIASLEFQVHAYRHKLMSLGCELEEDLLLLNRSDQRNGENGGQSSTVRRLQSMPAIQFLSSLRAAAKRGRSPSPVLDVIPKIMEESTTDKEVAQPGSGTLDSYLNQIKELNEQVRVISDCAEGEKSANLRSRRGRSCSILPHASAKMACDQTHRLISTNLDEVSQGESTPNRGVANDSPRILNVHDVYEVPQTSENHEVSEHGGKRFEKWNSDAENRLTKPDSVSEGMVESPLKHDAEKKKGMFKVHGEIKTPCLRDMMMTIIGQKEGMGVDCNSQAEFQKLNQRIERLERERISARQEITHEGNGEEQLRLLKDIQSQLQMIQSEMRCLETKKTTPKNDVYLAPLQENDHLGRPINSLHYMMYNWTY

SEQ ID NO: 99245 - protein, 164 aa, Glycine max
  Coding DNA Sequence Number=SeqID_7560
MGDSKENNKGKSRDKDNYVWKDYLKSHPSHSKLRGKSMVDYEYLKIVVGGGVSSGNNSISVDPDDTDATTFEPENRTVGIEEFSYDPNSDTFITPNNYEPAYQPPSPNQPSPPSHPPLDSEVPIEKQNCHKRRRSEYGGSQALLGSTIKATFWKIFLLALRLLL

SEQ ID NO: 99246 - protein, 192 aa, Glycine max
  Coding DNA Sequence Number=SeqID_7561
  Subcellular localization annotation: CTP_CleavageSite=4; ConfidenceScore=5.14e-01
MFPVESLKAHQTQGPPLVNLTKASTNVFLVESPKARQTQDLHLVNPSKPKTNMFLVESPKAHQAQGPPLVSLTKPRANMFLVESPKAHQIPSPPLVSLAKPSTNVFLVKSSKAHQTQAHGPEIYPKAQENPRAFSYISGSIFFESSIQCPWGVGLHQSPLPTTSRGKEGLMVVTGKGCSSKGAARASPSHRA

SEQ ID NO: 99247 - protein, 241 aa, Glycine max
  Coding DNA Sequence Number=SeqID_7562
  Homolog annotation: Hit_ID=A5B5G7; Match level="QueryCoverage=63%, HitCoverage=10%, E-value=4e-07, Identity=29%"; Hit description =Putative uncharacterized protein
MRNSHKELINFADRSIDVAVVKEFYANLYDPEVKSPKQVRVRGYLIKFDANALNTFFRTPVVIEEGESLLAYSRFTRLRPDPQELVARLCIPRKGFELNADGLPRKILRKNLTTLAQTWSVLSFSNLAPTSHTSDITLDRARLIYGIIQKMDMNVGYLISSQISLIAQHESSRLGFPALITALCMARGVTSDSLTFESLSPAINLAYVKKKCWNLDDPSVQTRNPRNDNFDCQYFDNISQR

SEQ ID NO: 99248 - protein, 551 aa, Glycine max
  Coding DNA Sequence Number=SeqID_7563
  Gene Ontology: Mol. function=cation:chloride symporter activity; Cellular component=integral to membrane; Biological process=sodium ion transport
  Homolog annotation: Hit_ID=A4VCJ8; Match level="QueryCoverage=74%, HitCoverage=41%, E-value=0.0, Identity=86%"; Hit description=Cation chloride cotransporter
MDEPALCPNSDSQPSSFFFGAIHSRVAVIMFLISWSFTVVSLLLASLIYKYVSIKGKAGDWGDGFKSAYFQLALRSLRSLGASQVHPKNWYPIPLVFCRPWGKLPENVPCHPKLADFANCMKKKGRGMSIFVSILDGDYHECAEDAKTACKQLSTYIDYKNCEGVAEIVVAPNMSEGFRGIIQTMGLGNLKPNIVVMRYPEIWRRENLIEIPATFVGIINDCIVANKAVVIVKGLDEWPNEYQRQYGTIDLYWIVRDGGLMLLLSQLLLTKESFENCKIQVFCIAEEDADAEGLKADVKKFLYDLRMQAEVFVITMKWDAQMDGGGSPAQDESMDAFTSAQQRIDDYLTQMKATAKREGTPLMADGKPVVVNEKQVEKFLYTTLKLNSTILRYSRMAAVVLVSLPPPPVSHPAYFYMEYMDLLLEKIPRILIVRGYPLSLFLQWPPSLAQSSLNFAAGSGLVRRSSNRSLVDITGLELWYVAPTLSHSKCGGCFMDLAPVLYFLDNHDTLFPPKRMTCADAEVLSSRLPPQSASASASLYESKWGGRDCCC

SEQ ID NO: 99249 - protein, 60 aa, Glycine max
  Coding DNA Sequence Number=SeqID_7564
MKDIFEVVLTTMLKDEAKNWWKDTMERMMTLEILVIWENFKITFLDNLMRSGSPSNSSKS

SEQ ID NO: 99250 - protein, 539 aa, Glycine max
  Coding DNA Sequence Number=SeqID_7565
  Gene Ontology: Mol. function=nucleic acid binding
  Homolog annotation: Hit_ID=A2Q361; Match level="QueryCoverage=99%, HitCoverage=89%, E-value=1e-165, Identity=55%"; Hit description=RNA -binding region RNP-1 (RNA recognition motif); Pyridoxal-dependent decarboxylase
MYNGCLWKGGRLRLEKAKEDYLVRLKREWEQGALDDATQKPPAAAIEEEIPSTAHSSESNTKHLNIFFPRLRKVKSIPFSGTGKHKYSFQNIKVPLLPVHFCDCEEHCSPFVPEREKLSIDRAADSGAMNDEEISIMNAVMNKLLGKQKVSNAKKLGEEKGSFESPDALHSDECEDSATDEDDLIINVETKKNKTALTGDEELQRILENQESWLNKTKIAKEEPNKSMPPVQKRSNSNHDKNKKRKSLPKLEVSTTPGSKSNMQMLPDEVGSGAQPTELEDDFGEKVSWSQKSSWRELLGDKGNTSFSASLILPKLDSGESQQRSDDQSTPVSTNKKTENMEWDGHLGSKPTNPHVIEELVEAQPTNKQVIEDVTNNKHNVAVAPNKTGRGSSWLQKQSWTQMVSQNNNSFSISNILPGITFPEPMATEPIVEPAISNDCKHNGVAKDTVNEVVSDGFSSRETIPVKSQHTGADDIASASVVEEKVETSPREKSSENVEIGETCSFMRSAASLKEWAKAKAAMSGSLKRKRGQKEDQKA

SEQ ID NO: 99251 - protein, 28 aa, Glycine max
  Coding DNA Sequence Number=SeqID_7566
MARRLQEDWIRDAGEGPKVLMSLRGSIV

SEQ ID NO: 99252 - protein, 83 aa, Glycine max
  Coding DNA Sequence Number=SeqID_7567
MDNVSLGLLCPLQVACFFYIIAKGFFIFEMNICVATYPSAGGRRVTRGMRVPRKEYARSRHQRLFEENVGKIGKDAIYELLSE

SEQ ID NO: 99253 - protein, 141 aa, Glycine max
  Coding DNA Sequence Number=SeqID_7568
  Homolog annotation: Hit_ID=A5BEV8; Match level="QueryCoverage=85%, HitCoverage=16%, E-value=5e-10, Identity=29%"; Hit description =Putative uncharacterized protein
  Pfam annotation: Domain name=AFT; Domain location=34-130; Score= -47.5; E_value=0.077; Accession=PF08731.2; Description=Transcription factor AFT
MSEQADMDYENKEACSANEPHVDCSDAFNTFQVFECREDVSRWARSVAHENRFVAVILRSTTNTGSRGRTAFVLIGCERSDEYRCRKKEFIRRYTRTRKCGCPFKFRCKPVVGGEDWMVKLICGVHNHELAKSLVGHPYAG

SEQ ID NO: 99254 - protein, 99 aa, Glycine max
  Coding DNA Sequence Number=SeqID_7569
MKPQFYSTSPITCLKCNKREGQAAGVSLSKAYALSELHPLSEALNPINAWGNPRRGSVTDARVQRATSSPSESFVPSRAQRAQFAKQELTNSHLARKWC

SEQ ID NO: 99255 - protein, 253 aa, Glycine max
  Coding DNA Sequence Number=SeqID_7570
  Homolog annotation: Hit_ID=A5BEV8; Match level="QueryCoverage=45%, HitCoverage=15%, E-value=5e-09, Identity=30%"; Hit description =Putative uncharacterized protein
MLPFAHSLLFSLRYAVFPRILFVPLLSVWFAERLGSVKVKVPVFGVAVLVGDIRGTQCWVCSGVWQIARIKLIRKKFTDQLDPHVDFIASDQVDPFIVKMDEDQWMHEGIMPKEVDMDENEEECGVNEPHVDCSDAFNTSQVFDNRDDVLRLARSVTYENGFVTVILRSDTKTGSRGRTSFVLIGCERSGVASIARSKKEFVRRDTETRKCGCLFKLCGKPMVGGQGWMVKLICGIHNHEWPSHYLDIHMSGD

SEQ ID NO: 99256 - protein, 124 aa, Glycine max
  Coding DNA Sequence Number=SeqID_7571
  Gene Ontology: Mol. function=protein binding
  Homolog annotation: Hit_ID=A7Q1D2; Match level="QueryCoverage=84%, HitCoverage=11%, E-value=3e-45, Identity=58%"; Hit description =Chromosome chr10 scaffold_43, whole genome shotgun sequence
MNNFALLFSPGNGIPKVVNLEVYGELVEGSIIRGCAKVAWCGGTPGKGVASWLRRKWNSSPVVIVGAEDEEYQLTIDDVDSSLVFMFTPVTEEGAKGEPQYKYTDFVKAGLFRICLVAFAKILI

SEQ ID NO: 99257 - protein, 254 aa, Glycine max
  Coding DNA Sequence Number=SeqID_7572
  Gene Ontology: Mol. function=protein binding
  Homolog annotation: Hit_ID=A2Q347; Match level="QueryCoverage=66%, HitCoverage=32%, E-value=2e-81, Identity=82%"; Hit description =Leucine-rich repeat
MPHLEAASILLVGPTLKKFNDRDLSREEVALAKRYPAHTALCIRDGWEFNRPEHAAESTFRFLVEKWKDHIPLDFFLKEASIDKPVEEDMCRCHFTIIHDGAASTDPPLVLKYQWFCGDISLSNFIPIPEATDEVYWPKHDDIGKVLKVECSLTLGEMVYPPIFAISSRISRDTLKEGENVPVRNHERKRLIKNTICQAVHRICMKIDPWILILNRDAVDFDALFNDILSERTDPVPYVSSLSEDLHYMRGKQC

SEQ ID NO: 99258 - protein, 617 aa, Glycine max
  Coding DNA Sequence Number=SeqID_7573
  Gene Ontology: Mol. function=protein binding
  Homolog annotation: Hit_ID=A7Q1D2; Match level="QueryCoverage=96%, HitCoverage=59%, E-value=1e-111, Identity=68%"; Hit description =Chromosome chr10 scaffold_43, whole genome shotgun sequence
MASHNSSRFSVFQQFVSADPKGMELVIPDCCEDRELMPSRKYFGGHEGVGEYIWYQTKHKLEGSELLDISNAFDVVICGTEPTYKPLLKDVGAYLALYWVPTRADGKCGEPLISICSTPVSPAPPVVSNVCVKELSSGIYSGEGEYFGGHEGESLFSWYRENNEGTIELINRPNSKIYEVTDSDYNYRLLFGYTPIRSDSVAGELVLSDPTNTVLPELPYVEMLALTGKAVEGDVLTAVEVIPNSETQQHVWSKYKKDIRYQWRMLVINSTVLLINADYMYHINIISGFVHQKWETIFHLIHYLIRVLAPIRRYALRQNLYCQLGLLDLSTATQSQLGRGEYVNSSLNVKPQFPGHCPFGMSTCLVLNIFRMLSIDGMMISDFDSDYARIPRIHKLEIEGRGFHTNLYAVHGIYSGGKEGKSRVQWLRSMVGSPDLISIPGETGRMYEANVDDVGYRLVAIYTPVREDGVEGQSISVSTEPIAVEPDVLKEVKQNLELGSVKFEVLCDKDQTSKKISSVGTYERRILEINRKRVKVVKPATKTSFPATEIRGSYAPPFHVELFRNDQHRLRIVVDSENEADLMVHSRHIRDVIVLVIRGLAQRFNSTSLNSLLKIEA

SEQ ID NO: 99259 - protein, 78 aa, Glycine max
  Coding DNA Sequence Number=SeqID_7574
MEITEVKVEKFGAIVTVALSWRKEGRMGDWRVVSVGLIFAENGGFCLDECQRWVCVSFWVSFSFVCTTVGVETTIALK

SEQ ID NO: 99260 - protein, 130 aa, Glycine max
  Coding DNA Sequence Number=SeqID_7575
MSDGFCGTHLQIMVRTRGLGRALAQVTGRGVGRGDRDDSNDAPQRRRPTASARRQRVAVTVDHVDEPIIPAPDVQDDPMEAPAAVEDIPTDAGAEAAEDQHQGFPGLSSLIACSVDTGDRGLFVLRFVER

SEQ ID NO: 99261 - protein, 50 aa, Glycine max
  Coding DNA Sequence Number=SeqID_7576
  Subcellular localization annotation: CTP_CleavageSite=25; ConfidenceScore=5.47e-01
MGSPPASTPPPPPPSHPSDASASPSAMKRTCKASRLRSLSTIPPGAERPV

SEQ ID NO: 99262 - protein, 462 aa, Glycine max
  Coding DNA Sequence Number=SeqID_7577
  Gene Ontology: Mol. function=protein binding; Biological process =retrograde transport, endosome to Golgi
  Homolog annotation: Hit_ID=A7QC25; Match level="QueryCoverage=94%, HitCoverage=40%, E-value=1e-104, Identity=51%"; Hit description =Chromosome chr10 scaffold_76, whole genome shotgun sequence
MEGSQNARGKGKQRKSIGETINKDLEAKLPSVLRTYRDTLTADMKSAIKTAVAELLPVLASRGSESEFFSGDRAVDADGGGASLASKLRSLSSDCFVHLLSAIFLIVQGGMFLGEVLVCPPTLKQFVLQRFEVFVKMGGNIVWQCSVPAHLVRAAEVKKAIEWILSNRDGHYAADSVVAAIAHGAAAAETSQESESHGTTFLPYSAQRSVAKGSSFQGKAIDSMSSSNMSKNFRADILRENAEAVFAACDAAHGRWAKLLGVRAILHPRLKLLEFLTIYNITQEFITATEKIGGRLGYSIRGTLQSQAKAFVDFQHESRMSKIKAVLDQETWVEIDVPDEFQSIISLLFTSDNLTSENLNETEDDISTSYNCVVTNNDVLPMADSSESTAEQQIMQSNSIESSMNNETPDRSKSPVDSTEPNKAHGRISSAHSNNTEKDHKKSTSQALYYKGVGYHMCSLSL

SEQ ID NO: 99263 - protein, 40 aa, Glycine max
  Coding DNA Sequence Number=SeqID_7578
MATWPQVELATSTGESASGFGNRWFDWRLAGAGEAGLRCR

SEQ ID NO: 99264 - protein, 148 aa, Glycine max
  Coding DNA Sequence Number=SeqID_7579
  Homolog annotation: Hit_ID=A5BEV8; Match level="QueryCoverage=62%, HitCoverage=11%, E-value=7e-12, Identity=38%"; Hit description =Putative uncharacterized protein
MVTDSRKCGCPLKLQAKRVLGGEGWMVMLICETHNHALDKLFIGHPYVGRLTEDENIIICYMIKLMVKPKNILLTLKEYNSKYCTTMKQVFFLRCDAIPQVIDRDSALMNVVKTVFPETTNLFCQFHIDKNVKGFGLGFSVDGSCVRV

SEQ ID NO: 99265 - protein, 89 aa, Glycine max
  Coding DNA Sequence Number=SeqID_7580
  Homolog annotation: Hit_ID=A5AUB4; Match level="QueryCoverage=87%, HitCoverage=8%, E-value=3e-07, Identity=38%"; Hit description =Putative uncharacterized protein
MVIIVNAEACGYVSMNYYQYIDVVYTNEHILKAYSAQWWPLGNEAAIPPSDDAWTLIPDPTTIRAKGRPKSTRIRNEMDWVEPSEHRQK

SEQ ID NO: 99266 - protein, 176 aa, Glycine max
  Coding DNA Sequence Number=SeqID_7581
  Gene Ontology: Cellular component=cytoplasm; Biological process =protein transport
  Homolog annotation: Hit_ID=A7Q1Q7; Match level="QueryCoverage=47%, HitCoverage=39%, E-value=3e-32, Identity=82%"; Hit description =Chromosome chr7 scaffold_44, whole genome shotgun sequence
  Pfam annotation: Domain name=Snf7; Domain location=37-170; Score= -21.8; E_value=0.00045; Accession=PF03357.12; Description=Snf7
MKKEIICSVGGSWTSYHTACGSSSGGEIVGCHPRQEARNFKLRNSSLSSGSAGSYYMYLGILNQLLIQSSYVSTVPLAATRILARQLVRLRQQITNLQGSRAQIRGVATHTQALYASTSISTGMKGATKAMVAMNKQMAPAKQVKVIKEFQKQSAQLDMTTLFEGTTIGVYWLALQ

SEQ ID NO: 99267 - protein, 139 aa, Glycine max
  Coding DNA Sequence Number=SeqID_7582
MKVNIEWLILRLEEILEARKLLNQFAMLKGEKYVSKKIIESVKRELEQCEAEKKALEKKETACKKSLARAQDKSTKIYETITNAKSKVRHFDNFSLADERGVPVSSSMRFFIVIHLFICSPEHKVQGHHRIQTQIANQE

SEQ ID NO: 99268 - protein, 94 aa, Glycine max
  Coding DNA Sequence Number=SeqID_7583
  Gene Ontology: Cellular component=ribosome
  Homolog annotation: Hit_ID=P94077; Match level="QueryCoverage=80%, HitCoverage=38%, E-value=7e-17, Identity=56%"; Hit description=Zinc -finger protein Lsd1
  Pfam annotation: Domain name=zf-LSD1; Domain location=1-17; Score =19.4; E_value=0.0037; Accession=PF06943.3; Description=LSD1 zinc finger
  Subcellular localization annotation: CTP_CleavageSite=59; ConfidenceScore=5.69e-01
MYPYGASSVKCAICRYITNVSMTNGRLPIPVQRPNGTANSGTVSSTSSSMPHSQSQTVVVENPMSVDSSGKLQSKIFSLLLVLKDIVRICDFAA

SEQ ID NO: 99269 - protein, 278 aa, Glycine max
  Coding DNA Sequence Number=SeqID_7584
  Pfam annotation: Domain name=GRP; Domain location=49-140; Score= -14.5; E_value=0.0023; Accession=PF07172.2; Description=Glycine rich protein family
MGVGMSECLLVARRQNRSCGSSGGGQCGTPPAKPLALRRDSLPEGATRMRPSALIRVAATTILLVPRRVVSTEGAPPTTTPAYPAGQVPSCVGDRVGLSGEGNGGWGGGVSGGDVGNGGGGSGGRDRGPGRRGSQRRRASSWASRRRVTTSSLAKATSRRSSVADDEADDELCGWWWSWELRTASRSHGRQPWKLGMVVAEMKEGFSRDRTSSATVGGCGEMGMAAMEGDHGRSMKAPMLGEKEHNADFEGSNLQKEREKGEFLTFEASYYCSYPLKA

SEQ ID NO: 99270 - protein, 20 aa, Glycine max
  Coding DNA Sequence Number=SeqID_7585
MAATRRFVSEGILKSCGAQQ

SEQ ID NO: 99271 - protein, 211 aa, Glycine max
  Coding DNA Sequence Number=SeqID_7586
  Subcellular localization annotation: CTP_CleavageSite=71; ConfidenceScore=5.21e-01
MGPLRFLSHTFFLGDDASWLDLGAPTGGARGPSNVSNGAGAVCFLLFFVFFFDLGAETSVLGATTGVGVVGVSAGGELTGTSAGGELTGVTAGGVAAGGVVAGGVVTGGVVARAGAAALDRGDATMGDETRGFAIAALGDEAGGDEVGEATGAVDFGLEGVVVRNPRLHALIIGIFKITLLNISLSQTSILSTIPTQGDNSLNEIKRNSSQ

SEQ ID NO: 99272 - protein, 151 aa, Glycine max
  Coding DNA Sequence Number=SeqID_7587
MTLSTTQKEYMALTRIKSIMKGLSTLTSDSTSSVLRKGSAKVDVLLSELNALSKCHPLSEASSRLADRRNLEGNLSRRHMLSASSTCSASHLSPSRLSASLALSKNSLTHTKRENGAKRDVEGLFSIERCIVSLELDRVGLGSRMSGHGMR

SEQ ID NO: 99273 - protein, 84 aa, Glycine max
  Coding DNA Sequence Number=SeqID_7588
MYETIPNLFALGNLMIKFNGLHYVEWSEMIQFQLGVTHFDLTLIMDEGPPIIIETNVDADKSLKEAWKRSMLDYWKAYLCCHRL

SEQ ID NO: 99274 - protein, 106 aa, Glycine max
  Coding DNA Sequence Number=SeqID_7589
MAKIMLKVTVPLDTILNTVNVKDQIYGEVSRSFVVRWKDVYPTPHKVTCNSLDVPNTMYYFLKDKGWTHLHLEDVVECRLVFNHLRKIVKIGAGWKYFCESPSKLA

SEQ ID NO: 99275 - protein, 127 aa, Glycine max
  Coding DNA Sequence Number=SeqID_7590
MQSTCITLGTRASALGNECTGEMVQYGTSLVEMHKMSSPLEISELITSTHTNDNEVNVQVPADSTQVEANNQENEHQESVVERKRKKTLVVWNDFDEMEISPRVKKAVCRYCKSKFATGGTGQVLPI
